United States Patent 7,868,149 (PLANT GENOME SEQUENCE AND USES THEREOF) - sequence listing, part 70

SEQ ID NO: 38428 - DNA, 29111 bp, Oryza sativa
ctgcgcccccattacaattaaatctttacaataagatgtcacacgattgtagtatgtagtatgttggtaaaataaatatattttaaatgttgaaatttgatgtttaatgtatgagaagcgaatgcttcaactggaattctactctatcgcacattttaagttttgattaaaaacaaatatatttttgcttgttataattatttgtgctgtttgtgagccaatatccatgcaaaatagaccattttaattcacataataatcttataaaagtctatttcataaaaaaataagttttatattgttatgggcctatttggtttgcattgggtgaccttaacttggctcgtacgggtcatcctatttgggattagcatggccataggacgtagatggctgaatggtgctgtctggttacatgtattagtttaactaagataggttgggataatgtttggttggttatatgagatgcaacacttgggagatttcgcatgagtttcgatacctattctatcctctatgtgaagtgtaaggttacatctttcatctcaaaatttatcaaatctaataaacatatcaattgattttagttacattttaaatgtttttaactataaactatacaattaatatgcgtggaaaagatgctaaatgatttatcacacacatttacaatgatatgttatagtttttatataatggcaattatggcagtaaagaaaaaaaaagtcactccgcctctcgttgttcccttgcccctccgttgccgacctcttccctgctcttctcccactctgccgctcgcctcctgctctcctgctcctttcccactccgcagctcgccgttccctgggttagggtttgcactttcgattttggtcaaactttcggtagcaccaaaatttacgaatttcggtacttctggatcgaaattatttgaaactttaacaaactttaactgagtttaaataaattttgattgaatataaaaaaaagagaattttcaaaaattttggatgagagaatgatttgacggtgggtcctagatttcaaactgaaataatataatcacttccccgggtccctaccagggtgtaccttaccgccggtaaccgcgcggttaccgcgggggtacggtaatataaataccgcggtaacctccttaaattcaaataaattttaaaaataatttgaatttttgataaattttgtacggtttttcacggttaccgcggttacatgtattagtttaactacagtaaccgtgcttaccgttgggacgtgataaacccggccccgacggtttgaaaaacctggtccctatcctcttctccatccgtgcagctccccgacaccttgaccccccagctgctagagctcctctatggatctatccccactgtttgtgactggattcatcatcggttgggccgttcgtttgtcacatgggcttcgtagttgggtaagccccgagcaaacctactcggcccgattcacccccgacggcccaccaaactagccgaaccactcgcctagtctcgtgccccggtgttcctcgcccacactcccaacgcataaccaaccctagctctcgcaaagcaccgccaccctcgccgcccccaaccgcttgccggcggagttcgccgccgcgccgcccctcggcggtgctccctaccccgcccgcctgaccgcccgcctgtccgtcgcccctccccgcctcgccatcgccggcgccccacccaccgctactcgcgcgaacgcaccgtctcgactagccgacgccgccttgggatcgcccccgcccacctccagatacgcggcccggccgcggagccgtgcttacgtccgctaccacccggcgccgatctccacgacgccccgctcacgaggtagggttttggagtgggaacgacgacgatcgcgttccccctcgcacgccgcctgatttgagctgccccacgcgttcgttcggtcctttctcaggtactcagatcaaaccctaacccgatgcttcgcttgtccgagaggatctgtgcaagtgtgtaatcctggattgatgtgatgatagattaatggtttccctctgcatgtgtttgttgtgtgtatgattgtaacagatctgttgtgttgcccatatcattgttgatacatctcgtgccgagtccatttcaagttcacttcttgtatgtgttgggtataatgctttggtttgtcatgtggcagtctatgcagtgttattagtgcatcactccgtatgtatggacttcaatggatatagtcagccatgaaagattcccttaatatgttgtttccgctcatctttgtaatgtttttggctaaccttgcaatttggcggaatatagttagcaaggtcttttcagatttaataatatagtctggtactggttctatttactctgtacgtcgttccagctcatattattaacgtagtcgaatatattctgtctccatttcccgccaaaattctagttggaacggtttaattccagctttgataataatgtctgttactactgctacgtcgattccgtcaacttgtcgtttctaccttgattacgtggcataattttatctgaaatgattggcttggaaacttcgcatctaataacatctcttattgacacgtgtgacatgttggttcccattgtatataccatttctgctcagctcagcaacgatgttggccaattttgttaatatgattacctgccatatttgtttggctgtgtctgattgatgcacatgttgtatatggacctgctttaacgtaatagtgcattatggtttagtattactattaaaagggatgttcattagcagtttttatcctctttggtggacgtaatacctgctgcacttgaccaaaaaatatgttgctgacatgtgaactctacttatcacactttatgtggctgttaatcaggcaatggatagtgcttttgtctcttgtcgggttaagattcctaatatttgcttctgtaacttttctgactgaataaatttgtttgattgttcctgcccatgttatatgatttattgattgattggtacaaattttgtgattattctcaaaaaccaattcttgcattgtcactgcatatttgtttcttttcttcattttatacgctatatcatgcatgttagagtgaatgccatgcatgataatttctggttttattgcaaatactatgaaaattgaaaagctcacacctgcttccttttatcacctattggatttgcaggcatcaaaaccctgatttgataacattaagtggaattttgacgatgggtttcgataatgagtgtgttctgaatattcaaactcttcctggtgaatatttctgtcctgtttgtcggacgctcatatgtcccaacgaagctctgcaaactcagtgcacacatctctactgcaaaccctgcttggcttacatagtggcaacaacacaagcctgcccttatgatggctatttggttacagaagctgattccaaggtactgctatcttcttaagggaatgctttgtgcatattcagttcatcaagtatatttggtggtagtgatccctttatttacaacctgatttgcaatatgcagcctctgatggaatcaaataaaccccttgctgagacaattggtaaagttacagtccactgtcagtatcacaagagtggttgtcaatggcatggtaatctgtctgactgcatcacacatggtactacttgtgcctatgggaactctcctgtagtttgtaaccgttgcagtactcagattgtacaccgtcaagtgcaagaacatgctcaactctgtccagtatgtccatctccatcattccttattactccctcgatatgtattagcatcatttccctattcactaatgttttttccctttgcatgttattgcagggtttgcaacctcaggcgcaagcacaacacactgacagtagtatgatgcagtcatcagcaacaggaacccaggcagccgtgcaaggtccttctgcagtggcctcagcagtccctatgacgcctgttacagcagctcctacaacagtaccatccacaactacagccagagctggaacagattctgctatcgcagttgcttcagctggttcaaccactgtaagcaccgtggctgtggctccttcacttccggtggcacctactgctgctagtcaaggtcaagcacttgctcctcaaactccaacagctgagcaataccagcagcagctccagtaccagcagtactaccagcaacattaccctggatataacccctacatgcagcagtatcaacagtatggtcagtaccaacagtacacacaacctcagacgcaaattgcaccccagaatgtggctcaagctcctgcgcaatctgctccatatgctcagcctcaagttctacagcccaatcagccccaacacatggtgccattccaacctcagaatcagccccaccttacacaactccaagcaccagcagctcagtcacagtctcagcagcatccaccattgcagttgaagctcaaactcaaattgtacaagcacaaccacaaagccaagtatttttccaacagcttcaaccccatgcacaacctacaacccatacaccagtccttacacaacttggtagccaaccatttgcaatgcttcttactcaagccccaccatttgaagttcagccccatgttcaacctcatattccacagcaccatcaggttatggctcagcaacaacagccccaactgcagcatttacctcagcagcaacatccaaatgcacagcagcaatcttatccacaaatgcaggcatatcatcagcctcttccaatgtctcatgcacaacctcagaatccttcagttcatgcagtaacaggtcatcaatcattttcacagcctcagccagcacatcagatgcaacaaggtgctccactgcaacgttccctacatgtatctcagcagcaaatgcctagtgctcagcatcatgcacttgcacatactccacagggccaacaaccaactatgatggctcaagggattcagcagacaccacaacatcagcatgttgggcatcatgccctgcggccagaaatatatgctagcattcctccacaggcagcaccacaaggattccctctaaacgcacctgctccctcacaaacaggtcaatcataccaacaaggaatgccctcatcacaacaactgatgcatgcacctcccaatcccaaggccaacaatttatgcaacagcaccctactcatacttctgctggtcggtctatgaattatgttgcaccacaagagcagttccaaaatcaatctggtggtccagttaaaggtttacaggcaggtgtgatgaatcaacaaccaccaatgcgtatggcctctgataatgtaggagcaacatctgaattgcatggtgctggacaatcttttgggcagggctcttcgtctttaaaaaaacctacttcggaatctgagaaatcagaaaatgcaactaatggtactggtaatacagaagtaagtgggaaaaatggaagtgctgaatcagctcttgtaaatcctatttcattggatgggtcagatggttcagacaaggggaaggggaaaggaaaagttgacttttcagcttgggaaagtaattcacatgatccagatgctcggggaggcaaagggactaggtctggtatatcaaatgatcttgtgaaaggtggatcattacagcaggcaccacaacatccttatggacctgattcaatgcttcctcaacatatgcgtcagcctgggcatatgccgtatatgcaggggctgccaaatcaaatgaggccacctaaacattcctttcctgaaaatagtcggcctccaatgcaacaaccatttgaaatggcacctagggtgcctggtccaaaccaaaatcagatgcaaatttcacagtccatcagacctgatggtgctatagttcggccaccgatgggggcaccaatgcctgggctgcatgattcaacagttcctccttttgctcctgaatatgttggtcagcctcatcctcttggtaattctctgtaacaaatctaatatgtatgtatgtgtttgcaagcatatgaccaaacttccatttattcaggaactaaaaagaacaatagtgttggcaatggaccacatggaggctcaagggctttatttgaaggtggattcaattcttcacagaaacattccaagtcatgtgcagcaaatcctggcagaaacaacgttagccacaaagattttgaagataatatgaagcagtttccagtgcctactcaccttgacggtgaaggtcatcaaaggggtcctagaccttttgaaggaggttaggtagacctgatggttttgctgatatattacctggaaggcctccattgacaaatcatcctggtccatttcctataggcttcggagaagattacccaaggaaacccaattcgactgttagttatcctgactttatttcgcctggtgcagaatttggtcatcgtggtattgatggaatacctactcttagaaatgcaggtaaggatcagaatcaccttcatccttttcatcatatttcataaatggcgaaaagtttagtacaccttgatccttttcatcatatttcagtgactaatggattaaaatgaaatttaggtccatttcttcaagggatgacaggcgggcctggaggtttgcataaagatcagctaggctctagtaactttcctgggagtggacaccatgattttgacaactcagagttccctcgtactcgattccatcctggtgatgcttttgtgccaagaaatctgcacggtggtggttggggtggtggccaattgcatggcattgagccttctgactatggctacagaggtcacatgcatgcagatgatccaaatattccaattgattattctcggcatggttttccaaaagaatctgcccactttggttcggtgggttattggtgtttctttctataatatgctttatctcttcccatatgatattgctgttacctgatgttctgtttacccgctgaactcttgtttggtggtcttctctatagggtggacacttgagagatggagatgtcagttggtgccgtatatgcaatattagctgtggtacagtagagaacctgaatatacatgtagagaccagggaacaccatcaacatgcaatggacattgttctgaaaatgaagcaagatgttgcaaaggggagaaagaagtgagtatactagttttaattctaacatacttggttaagcattgcccatctgtggttttaaactctccacttcagttccttcaggaattctggtggtcccaagtcattcaagaaaaaagtacctgggaagggtagctttcgtggaaataggcgttagaactcctgttatcttgttccttggagacaggtgtcggaaggtatgctttggtgctttattatttaccataagtgcaaccatttcttcctaggcttcagttggttacctaattttcttttgccaggttgctggtaatgcttctggaactatctgagaccattgaaattgggtcttgtccatacattttggttaaggtagtgctgcatgtttggaatagaattaccatgttctcctgtccatacatgtttggaactatctgtacttatgttgccgttttaccatgttgacgttttaccatgttgtcatgtggactttacctgcttttgtggagttcgttgctcctatattggatgctcaactcacaactctgaggatgcttatcttggacctgcaatactttaattttgtacacctggatatctgataatgcacaatgcatgactcccatgtttatccgctaggctcagatggattatgggttctgttatactgtataacggccctacagggtcaaaagagataagtttcaccaaaaggatccatagctatttttctcatgcgaatagaaagaaactatacaactagctatgaaaccctgcaatcacaattttttttctatgcaagagactagtggaagtctctcttgggggccacttgcagtgcctgaaatggttaacattgaatcccaggacatacatttgcttttttactctcacaatgttttctgtgaaagaatatttaattaaaccctatgatcctagcccttcatattttgaatgtgtgatgattggcatttcctgcaatccatagttgtgatcaggtataagaaattggtggcaacataaactgttgttaactaactgcctcttccatacgttcatttggtttcagagattaatttcattctacttcgtgaacatttttgttcccaatttatgaataataatttttagtgccaattgggttaaactgagctcattcaaaatttaagattaaatgaccagtactggagacaacctactattttaattttctcatgacctgtttttcattctggagtttatagatatttaaggttctgctgccttgacagcttgaaaggaattacttgtaggagaatatgcgaacttacatttttttttaaccatagcatgtcacataatgttgagttgtcttgtacttaatggtttgactaaataatactgcaatgattgcctatgagggcatcccaactctaaaatgtccaaagggaggtagaaggcagaaaaacaagctatcatttggtaggaacatggatcctagatattagcatgccaacatgtagtaagagtggcatgttagtgtagtgcaattgaaaggggcaaaatttgccctaggacattcccatgggacactccgaaacatgcctttccgtaggaaacttcggttttgtggcaatttgttaaatcatgctattccttttcttttttttcttgttttttttttatctttgagtgaaaatattaaagttcactaaggacactttgaacccatccccaaattgcacgcttgacccggctaaattttcatcccaaattgtggaaatgaaaacatttcaggggattaggcgccgtttggttcaggtattgtacagattattgtcgtggattgtcgatttgattatagggataaattaaatattttaagaaataaatttaataaatagcttaaacaagtggtctaagcaatgcagtagtaggaatttttttagaaaacgtatttttggaaatgtgggcgaaataatccatttcaataatctggtgaataagctgaaaagaaaagagcctaattgaatgaaaaattttagaagtactaaaaaatttctgacgaaaaaaactgaacaaaatttggccgaatttaaacatgttgtgctgattccaaaacaaattgtgtaaatcaaaaacatttcagaggcctgtataatggatcttcccccgcaaaagttttagcaaaatttggctgaattcatacttatttcgtaattaagaaatgtgtgttttttttaggaagcatatcctacctggtggccaaaagaccaaaaatttcggaaatgtcagtttaaattatagaacccgaacttataacttggcatgggggtagaacgccatttccaaaattttgtcatcagttaagccagaaatcttgaaataatgccatcagtgttttagcaaagacacattttttgagtgccttaaattccaccaaactatgatgtcatatagaaaattttgccgaaagtaattacactaacaaactctgtgcaccgctggaatgaaagcacattctaagaaaaggagcaaataataaggtgtaaattggttctgagatggaccattgtgcatgagctatcgatgccaattaaggacttgtaattttttttcattagttcttgcagacagtggttcttggtttgattatcataggtattgccgtattggtgtggcattcaaacccaatgaagaacatttacattctgttgatataatattttcagttttaattttaaatttaacacagttcgatatgacttaatccgattatgtttgatgtgatgatttgtttccttggcaatagccttctcttgtgtttttccccaaagtgatcattaaatcatttgtttcttttgttgttttatttgctaaagcagaaattgacaagtttaggaaaaatccctgagggggctcaactgtcgttcttgcatgctttcctgaaggcggtaaggatagatgcacacttagctttttctatgttgtgatttaacttagccacagatctttggccaaaatatataagctgattatgctaaccctttgtcagtatgttgaactagacctgtagagactaatttcatatgtcctagactgtttccatattggatcttttatgattgatatgacatttagtttctttgtaaataaaaactggttggactagctgatcacatatagaaattgatttagtacaatgttacaaggcctatagatgtcaaggacattttctgacatttcaactgtatggtaacctggagaatcaccattctcttctaatgcaacatgggatcataattagtatccaccatttagttaggggaaccttgaaaatatcctaatgatgcaaaaggtgtagctaacaataccctcaccatggaatatgtcgtggctttgggctggaaaatggttccacgacaattatgactagcatctaaggaagcatgggaaatatactaactcactgaagtaggagtagttgtgaagttaagtgctaggcacaaaaggccaaatttgaataattaagttgcttggtgttgggattgaacctatgtagaatatcttttgaccttcatgtgaattcaactttatcttatttattgggctcaatgaccacacgtttatctgcattgacatgtttgctagtatttttgggatttaagttccttcctgcctagggattaagatgcagctgagatatatttgctcagtagatacgcacatcatgtgtctccattttttgctgtctctacaatatgccaagattctaggcttcaagccactttagttataagttttctaggcttccctgtccctctccgtgcatgcaacactagctgagaaagtggtgattttgattgatacagtggtggttttcaagcaaaatgaactattattagataagttaactgagctctaatttactgtctcttcataacatgaataataggggttttcactagagaggcccaaaaataaacttggctagaagcttctttactatgtaatctgtatcacctccacatgtaatattatttttgcacgtgatgaagctaaaccgcatattcttttcattctgatgggatatgtggttagttgcagcggcacctaaaacatggtctcgcaaagcccttgtggtttaacagtttcatcagttaaatctgtccttagattcgcatgatataaatgaagagtgaaaccatcactgctcactagtctgtcctatcattttttgctgcttttctactgttaaggctcagtttgaatcaaattattgagcggattgttgctgtagattatctgcttgattaaagagataaattaaatattttgataaataaaattaacaaatagcttaaaacaagtgatttaagcaatactgtagaataatgttttttagaaaatatattttatcaaaacttggagcaaataatcagtattgataatatgtaaataatctaaaaagaactaagttagccatgatgttctcaccgtagcaggcagtcatactagcatttattttgctgtgaaggtggccattattactgtcttcttctggcattaccagctgtaattcatgatttgtctttaattcgcactttatatgtttcctttttttttcctatcccatgttttgtgttactgctttggaaagtcttgtagcagctaatgaggcattcatgatggatatgctggaagctaaacaagtagctcaagctccgaccgcatttcaagagctcgagtggcacaggaatgtagacaaaccgtcatactccagcttgctgaatttaattatttcattgtaaaacagtgtagtttcttgcacagtaatgtatcaagcagttgatgactcgatgtatcaacataaatgtaatcatttgttaattttttcctacttaacaaatatcagttggacctgtacattatgctagtataaagaaaaaaaaagaatattatttgtctggtctggtgttgcatttattgccttgacttgatataaagttgtgaactccagcaggccaagcttgtactcttgtactacgtatttccacgtaagacaaaagttctctgttcagtttgtgatattttttggatgtcaccttatgtatagagcaactttgggggaactttggcatggtgctactactgatcgacctatgcttatatcattgtgttgttagcttggttctcgggtgaagaaatagcccaaactaatgtgtactctctaatcacttttcttatttaatttattctgcctgtctgccaaaagaaaaaggtagtaatttctattttccagctaagttttctagtgtgtgtgattatttattttttgttgttgaaagtttaagttaagttctctttcgttggtgatcctgttttctaggaacagagagaccaaatgtcaagccgtcgaggtgcagatggcggcggtcgcagccgtctgccggtgccggagcgggcctcatgggcgacgacgtggctggctgtggctctgttcttggtaattaactatcctcttctctctctcttttttgttcactttgatgttctattggtatctttgggagttcttttttctctcacattcttgatcttttatgttcttacgtcttttatcgatcgactcacgcgtggatcgctgggagtgaatgcatgcatgtgtccgtgcgcgacggacggagtaatgtccagcgcagcgcagcgtgtgatacgccctccgtgcgttgctactattgtaactatccatcactgagctctcgattcttgtcagaagcgctcgaattccttggtctcacgattatagatggccgtaaggctccggcccacggcatgaccatttggcccggcccaagcacaacatggcacgattggtgttgggcccgtgccgacccgactcgatagttgggctgtgcctaggccgatgtcttgcacggtgagccgactcggcatggcacgatcaaagaaaaatagttgagagatccaaaatagacttaattgagccatataaggcacaacccaatgaggagggacgcaaaatagacttattctagccatatatgacagggcctaaagagacgagagaggcagaatatacttattccatgtaaaatcacaatgggctgtcgtgccttcaaaccagcacggcacaaccgcctgggccgttggtgctgcccgtgggcaggcccaacccgatgtgtaggttaggccgtgttggcccgactaacctcggcacgggcctggttatgcctaggtagggcccgaccgggaggcctatttggccatctatagtcatgataaggaaatataacccatgtattacaactcctacttgaagaatgtgtatgggcacagtactaacaacagtgatattgcatttcatttcaaaaaaaaaacaacgatacatgatagtaacagaagtagaagcactgaacagacttctccacatccatttattcatgaatactatactttggctaaattttgtaggagcaacaacaattgcgtctgcttcatggtaatcgatcagtttgtgttctccttgcccatgtagcgacaaggacatatactttgtcgtacagcttgtctggtagttgaaagaaagcaattctccatcttcgcttgaacaacagaacaccaaatgccatccaggtaccagttatgaagccacacccaagtccaagataaaagaaatctatcccatgaccttcttttgttcctccctggtgacgaccttgctttgatgcattatccctcgagcaattgttttggagaggatgcccacaaagtccaatgttgccaatgtacataaatggatttgctgcatacaagctattaagctgtgttcccgatggaattcctcccgtaagattgttgtacgacaagtccaagtaacttaagaacgttagatttgacagagtggctggtatttcccctgagatcttgtttaaccaagctcgttaactgccctatccattttggtagcgtcccagttaactggtttactccgaggtctagttccttcagttgattgggcgagcaattagacgacagattcttaaacatctcagttatgtctccgtataagagagcccagcgaatcttcaggacattcaaactgcatagattgctaaggtccgtggccatgacgcccatgttcttgtcaccatctccattagacgaaagatcaaggaattgtagggatgtcatcatcagtttgtgcggaatttgcccatacaatctatttgaactgaggtcaaggtattgtaggcttgttatgttccaaaaccagctggccgacattggatggtcgaaggagttactggaggcatccagcacctcaaggtttgtgaggttcactggtagcagcagctggtttgcggtagcaagagagcagccagaaagattaaggaccttcagagaagggatcatgttcgaacatgacacgaggccaatccatcactgtcgtaaggttcatgttgttgagactaagatgttgatcaaggtgttccagatgttgtagagcaagtacagaagggcttatctggccaaccaaagctgtgctgctgctgctgccaagtcgaagctcgtgcacgcgtcctgtctggttgctgcaccggacgccacgagtcgaggaggcctgcaggatcgtgcggcaagcagctcgcactcgcactcgcactgttgccaccagcagcggctcgcaacacggacatggcagctgggtgatgcatgctcgaggatgtgcctagctcagttcttccactgcccgtcgcctgttattattatagcgttactacgtgatgtcccacgattagtgcgggatacatggtagatacgatgaaatgatttagattaaaatattatcaaaatgatgataatttagcatgtgtatgtttagttttagaatgaaataaattgtagatataattactactttcttcgtaaataaaaacctaactagatatgacatattttagtacaacaaatttagactgatatatgaccaggttcgtaggactagaatgtgtcacatcaagtactagattaattttttatgggatggagggagtatatgcttgcatgttgatgagcttcgtgtgtttaatttgttgatgtggcatacttgcatgtaagatttaagagtgctattcaatactatgcttatatgttgagctttagatatttagtgggtaatagttttatagaaagaatggattagacaactagtactcttgacagcagcatcacttaattaggctgagttcgcttgcgctagatgggaaccaatctcctacgcacggaaaatggagtggtctattagcacatgattaattaagtataagatattttttttaaaaaataggtcaatatgattttttaagcaactttcgtatagaaactttttgcaaaaaaatatatcgtttagtgctttgaaaagtgtacgcatggaagacgagggaggagagatgggaatttgctgtgccgaacacagcctagtgtgtctcagcgtcaacgggtcgagtcgtcgctcaagcgttcggcgttgaagccgtcagcgcctcagcagtcagtcgtgagcgcgttcaacgattatttcctgtcacgatgtccatgtactgtactggtgccctgatgcctgggcaacttggagtacgtcctgtgcatggaaccggccggatccactaacgtgaactgctcccttacgtgaaattttttacgcaaaaaacacgcgcttcgcgattgcgggggttggacccgtgacccaggcctcacgcgttcctcccttcaccacactcatataaggccagtcacaatgggggtttcactagtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaagactctcgtatttatttacaatattcgtcctcctcattttatcttcatccggtattcaaatgggtatttgagacccaaaatgaattcaaatgaaaaagttattaaccataaagttttatagctttttgagatctacaacattagttttggtcaaatctccatccgaggtcctttgaagaatttgaatttcaaatgtaagaaatttaagcataatttttggagcctaaataatttgaaatgaaaaattagtcaactacaaatttgtagatctttaaaaagaagatctacaaaagataaaagcagctggtgcacccttgagcagcatgatttttgcattctaatacttactccctccgtcccataatataagggattttgagtttttgcttgtaacatttgaccactcgtcttattcaaaattttttaaaattattatttattttatttgtgacttaatttattatctacagtattttaagcacaactttttatttttaatatttgcaaaaaaaaattgaataagacgagtggttaaacgttgtaagcaaaaacttaaaatctcttatatcgtgggacagatggagtataatatatgaaagtattgaacatcccacgttcaacaattccattgtcgtctagtccggttaggatacctggctttcacccaggcgacccgggttcaaatcccggcaatggaactttttctgatttcgttttcttttttcgttgtttgcagcaagataaacacatgtttgcgtcttggggtgttagtgctatagcattgctgcaattcctcatgatcttttctctaatcctaggctgctgatcacgattggaattgttcagttagcttctcttctctttctgggaagcagcagtgctattcgattcagattattttgtgatccaaatttggtccttcaagatggaacggtgtactgtgatgcaaatgctcgttgctcgaacttcactgctatctaggtgtcctatataaaatctggatgctcctaaaccatttgcatttgaaagaatgaacgtaaaacactgtatcatatcatcactcgtactgttagctcctttctcacttcaaaacaaccaaatcctcgaacttcaaaccaatcggagaattgaaacttccaagcgtctagactatgtcaaaaacaatcggagaacacacggaatgcttactcttttgaggttttaataacaccagatgaggaacgcggcagagttccacattcctggtaacttaggcttagaaacaaagaaataaaccatgcgaggtgcatttggggttgctatttggcgcgcgcgcgcacgcgttttcgttttcttttgccatctttttcgcgttttcttttttttttctgccatcttttttgttttttcctttttttttcacgtcccctcccctagcatgttttacctttttttcgcttttttttttctgatttctttaatagttaacacacatgttttcaaaatatattgagttaaaagttttcaaattttaacttaaaagttttccaatctgaagaaagtttcaaatctagagttgtaaattttcaaattttgagttgaaagttttaaaatctgaattgaaatttttcaaatctgagttgaaaatttcaaatctcgagttgaaagttttcaaattttaaattgaaagttttaaaatttgagttgagagatttcaaagattgagttcaaagttttaaattttgactgttcaaatttcaaattttaaagtttaaatcttgagtcgaaagttttcaaatttaatatgaaagttcaaatttcaagttgagtttagagtttcaaattttgagttgaaagttataaattttatgtattgcttttaatttttcaatagaaagttttaaattttaaactttcacgtatagatttcttttcaatctgttagttaaaaaaacaaccgggaaaaaggaaaatcttatctaattactatcattatctaaaactaatacggttagttatactaacttctcccgaaaaaatgtgcgccgccaatccacgctcgccaactagcttttccataaattcttacatgtatgaaaaaaaccaccacaacattgatgggttcacatcgtctgccgttcaggctgacggcaaacattgccgttgccttcatccctgccacacatccttctatcaacagttgcatgcagtggtcccaccattgtgattaattagggactactaattagcagaatcacttatttctcttcaaaaaaaaaaatcagcaaatagaatctcggcggtaaagcgcgcgagaacaaaagtagagcagagggaagctcctgctttttggcgccaagaatatggatcgacaccaaatgtctattcatccagaaacagaagaaccaaaacaacaaaatcctgtattgatggagcagccaaacgatcctacaggctacaggaagtaggaaaagcatgaacaaggaaatccttcatctatgaagcagccaaatgattctgccgtcgcatcgaacgagtaagcgatacaggcaaatttctctttgtttgatctctcctacagtgtcttctacttttatcttatcaagcctaaaatttcgtttgtttttaatctacacctatacacttctccgtggcgttgttcaaatttgatctattttactaacttcttctataacgtgatttatcaaagttcttgttgatattattcagttaaacgaatacaacaaacatctttttttcagagctgcacctagttgggttcctcagattggcatggcattcagtgatacagaggaggcatggaatttttgggtcacgtatggaggtcggatgggctttgatgttagaaagaagtatcacaataaaaatcaagtaacacagaaaactacatcagctagatttgtttgctccaaacaaggttttcgaggcaaggataaaagagataatttgactaagcatcctcgagctgagacgagaattggatgcaacgtccgcatggggcttacactcaatcgagtaaacgaaaagtatgagatatctgatctggaagtcatgcacaatcacatactgcaaacgccagaaacttctcacttaatgccatctcagcgcaaaataactgaagtgcaagcctttgaaattgaaatggcagatgacactagtattcagcccagaatcgctcatgagttggctgcccgacatgttggtgggtcatctaatcttggctacacttgtcttgatcagcaaaattatttgcgaactaaacgtcaaaaggagttgaaatatggtgaggctgggagcttgttgaattattttaagaataaggccatagataatccttcatttcattatgctgtgaaattggatagtgaggaacaaataacaaatatcttttgggcagagatgattatagattatgctcactttggtgatgttgttaccttcgatacaacctttgggacaaataaagaaagctggccatttggtgtatttgttggatttaaccactttagagaaactgtagtttttggtgctgctctcatgtatgatgagacttgtgactcattctgttggctttttgacgcctttttgtcatgccacaatcacaagcatccacaaactatttataccgatcaggatgttgctatgggaaaggctatcacagaggtatttacagaaactcggcatggcttatgcacttttcacataatgcaaaatgcaaacaaacatataaatcgtcagaagactagtgatggctctaatgtccttgctgattttagtgcttgcatgtgtgaacatgaggatgtggaaaaatttgaggaagtctttgctgatatgaggacaaaagttcgcaaagggacatggttggatagtgtttataagttgaaagagaagtgggctgaatgctttatgaagaatgcatacacattaggaatgcgaagcactcaattgagcgagggactgaacagtgatttgaaggagtatttaaattgtgaattaaacattgtacgctttttccaccactttgacagagttgtacaagggaagcgagataaagagatcaaatcagagtatgaatccaggaaaaaattgccacgcatcttaatgagaattcctatgctattgcaaacaagtaagctctacaccccgcagattttttaggcctttcagaaagaatatgaaagatcgatgacagcttatacaaaagtattggatgagggcagggcatatattgttgggataagatctctagatgatgattgtacaattgaagaagagtatatggttgttggaaatcatcaagagagtatggtgtcatgtgattgtcgacagtttgagagggtaggaatactttgcagccatgcattgaagattcttgatgtgatgaatattaagcaattaccagatcattatgttctcaagagatggacacgagaggcgcgtcatggggttgtccatgatatatctggaagacatgtcctagaaaatcctaaactagacgcttcacgttgatataagtttctttcacacaaatttatcagtttggcgtctcaggctgcagattttgaagagtgctttgcgtttgttgataatgctcttgaaacccttggacagcaagtggaacaaatggtagaagtgaatacaaatattcagtcgaatttagagacagagtttgagatacctgaaaatgtctcccaagctattggcctaaagaaaaaagagacccggtgtagcacatcgaagcgaaagaagaattgggttgacaagctacataaaaaaagaaagaaaagcctaaggtatgtatgtatgctaaaaagaaaaaataaatgaaattaaacgttcattagttattctgttgtaaatcacaatttaggtaaccacggtccactgacaggctaagaatgggaatgaagtagcacatcctgagccattagaagaggacatattggagaatagtacaaaagaatctcaccaggattttgaatttttgggtagctatacccagctactggcggtatgctaaccctgacttttgttttttaagatttgataaattccaattttttaacttatatcagtttataaatttgcagggtgattcagatggatatgagttatattctgaaggatttcatcagtagcttcatttcactgctagtttttgaatgaaaaatactctatatgggacatagtagtagtgcggcaatgctgtttttgtcaaatgaatacttaaatattttataagacatgtactattgttcaagtatttggatagcttcttagtacagaagcttgttttgctgtagtattttgctctgttgtactatgctctgcttctgttctgtcagtcgatccatattcttggcgccaaaaagcaagagcttccctctgctctgcttttgttctcgcgcactttaccgccgagattctatttgctgatttttttttggaagagaaataagtgattcttcttattagtagtccctaattaatcacaatggtgggaccactgcatgcaactgttgatagaaggatgtgtggcatggatgaaggcaacggcaatgtttgccgtcagcctgaacggcagacgatgtgaaccctattctgacctggtgttctgtagggctctaatcgcaataattttttgggctaaatatcttgaaatttatttattttccagctagagccccgagtggattgtttcagtgaggaaacataaatgtttgaaccactttaatttggactataaactataatattcagcaataatttatggtccaaagccatataaaaatagggttaatcacacttaattattttgcccacaaaagcaacacggcaaagttgtttttactcccctgccacaaaatgaatcaacttctggccggctacaaacctggacgacaggagatgatcacgaagggagtataacctacatggcggaattactagtataattgcatagataaactactgcatagctaaaatagctaatttgttaactaatcaaatatgtcaatgggcactgggacgatggcgggtgacaacaccataacaaagcttttggaaatgtgccaagtacttagagcatggtccatggaggttggaggccacatgatcgtagtggtctcatgtgggctatatgggctgaaaccaaatataggccacaccttccacaatggaggtcacactaggggtgaaaatggtaatggtaatttctagccgattgacgttcgtttctgactttctaccggccgagccatatgaaaatagtaatagaccaaaacgaaaatgaaaatggtgaaaaatatggaaacgaaaacggaaatggttttgctgttataccgattgtttatgtatttaccgtattcttgtagaaattacagtttcttataatatggtaattaccgtatttctaaatatgctgatatttttagggcatgtctctacttgacccacaatttagagattgattgactcttccattaaatccctaacttgagtgcatggctaaaatggagttaacttataatttatatagtataattgtataagcttgaatttatttatacatataacatacttatgtaaagttaaatatacgtttttatagtttaatgttttcgtatttgttaccggtttccgatctgtaccgacatgtttccgtccatattgttccatttccggttttccgatatcgttttcgtttccgactttaccgttttcgattttgtttccaagaaaaatatggttatggaaatggttgagattgtttttcgatcgtttccgaccgtttttattgtaagccacccccaactgtttttgtattttgattcctgggtacttgtatgtcaacccttgaaatatttattattatcaaatccgatgaaacttttatgttttgggcccctatggccacccaaaaaaaaatattcatgtactttacctcctaatgacccacttgtcaaccactccactaatatttttccatccaccccatcccccatttctctcacgaattcgcctctctcccacactaaacgcgatgcggcatctcttccccatctgagcaccatctcatttttttcttcccctatccgagagttcccagcctctcccctctccccacctatgcttctcccatcttccttttcccggccatcgcgctcgcaagccttcccaccctatcgaccagattgaggtggcgggcctcctttcctccccttttcgtcgggagaccgtgccaaggcggcaggaggacgagctcccaatgacggcgcgaccaacaagctccttgcagcaggcatagatcaggtggcgagctccgggcggatttgcttacagtggcgccctcactctcctctcctgctctggcgtggtcgtcgaggtcaacatcggttgatggtggtggtagctaacgatgacgaggcacactctctctcccactttctctttggatggctgctaactagaccacaattttcctccttttctcctcaaaccactatggctcctgcaggtaactctgacacaaatgtagcccctcccaaacctccaccatggcattcgagccaagttataggctagaaccacaggcttgagactacgcgttgggcatggccttataacaaggctagtttgtttgagcatttagctcatgaagtcatgataggtgttagtttaacgtactagggtcaacaagttcaggttggtggggtcaccaccaacgatatgctgaggaacacatcggtttagtcggacatcgtaatcttacctggtgtcgttggtgtcattaacttcggtgaaacaatagtagatccaccggtggagtacccatagagatattaatacttttgtatagtactagttgagtctgattaggtctgcatgatcctggtggagttggtgtcatattccttatcaattcaggataatatcctcatttgggtaatcctcttattgcgtttagtcccacatcggtgattaatgatgggggagtacgacttaaaaggtgagggcagtcctcacccatcaaactagtcttttgggttgtgtagacgtaggacctaaagttgtggctccggttgggcttgtggtagagtagggccaatgtgacctgggtagccatgattggtgggccgggctgcgcagtaacaagtggtattagagcctagactagtcttttgggttgtgtagaccaaggatctaaagttgaggctccgattgggcatatggtggagcaggcccaatgagacctctcttaaagattgggcatgtgttggagcaggcccaatgtgagactacaatgtagcgttgacacgcagagagatgatggcggagaagccatggactcgtagcggctagaaaatatattgattgggaaggagcgcccataatcaaagccccggagatgtaggcttcgtttgaacttcgttaacaaatattgtgtgttcatgtgccgtcatctggcatgtcttaggtgatcaatgactgaagtgatcgagagagttagctgtcgtttcgctatatcaactaacttttgtaacaccttctagtagaactatatgtattctatatgagtatttggcattttccaccattgtgtgggtatgccatattttatatactgacagtggcccccgagtgctgatcaaacgaggagcaatcacactatgtgttgggacctctgctgggaatagttccgaccaggtagagattggtagtggttggctggcttgcctatcatgatttggttggttcagggtgagattgatagtggttggccgggttgcctatcagccgggttggcatctaacccatcgtatccttaaaaagttattttcacgcgtgcgttgtttgtagtttgaataggattggaaaatacgaaccgttcactggacaatttcagtggacacatggtggagaaatcaggtatagtggactctggaaaacaatcatatcacttgaaaacaaccaaatccgtacatttctatacaatcaaattaaggaaaccttgaagagtcttagaaacaggggacacaattaaaactagctagctagctaatattgttttaatagcatatgcatgtgtgtataagttcttacatgcgtggaaaaaaccattgtaccattgatgaaaatctgtgttgccctagggtacttaagctaattttgctggtcctgaagtcatacacaccatacatgggaatcccttccttttgctgatacacatagctgttggtaattctggtatggatatcaccccactgcctggtcaaatcacctcccaaaaagaagatgcaatttcctccgaatctcgggtcgccgtgatcaaaagagaggatcgccttggagcaagcttctgaggaagacgacctgaccatccaagcttttcacctctaaccactggccaccctccaaatccgcctcaaacaccttgaacttgatttcataatcgtccacatttgctgaagtgcccaacatgggagaaatagtacacctgaacatcaacagagtgccactgcatgaaataacaaggtacttgcatgaaataacacggtactggtgtactatgtcatcgatgctatattgccattgaagatgcgacaatggaggctctgctgcggcgcccctaatcacaagctcagcacgagacaatgtgttgttatctctgatctcatggacaagaagatccccgttgctagtaagggcgtagagcttgccgcggtacaaggcgatgtcctcgtacattctcttgtgatcaccatcatcatcatcatatggaagaactgaccatgatgtgtcaatgcccggcctgaaagagacgatgttgttatcgataaggcgggaggcggcgacgatgaggtccggcgagcacacgatgatcttgtgcaaggtgaacctctcgggccacgtgctgtaacggttgtcaacgacgaaggcgttgatgggccgatcaaagcggcaggggatgtcgatggtcgcgttggagaaggagttcttgaggaagtgacgattatcgcatgccatgatgcaaggcttgaacacgtccatgtgcatcagccacccgtcgttgtgggaagagatgcaccagagcgcgtcgttagacatggggatccggcacgccacgccgtcgtcggcaaggctatggtgggtgcgcgggtgcgtcagggtgagcagcaatgttttaaatagcgggctaaggcatttagcggttagcttctcaaatagttatagcggcagttatagcgggctaaatagaactatagcggctaaattgtacatgagagcaaatagctagaacccttctcaaacagttatagcgggagatagcggcagtttagcgggagatttaaaaacctggtgagcagacatggcagcgctggcggcagcagctggcgctgctggagcgcgccgaggcgccactggctgcagacggcggcgaagctgaggcggtcgtggtggaacggcagcgaggagacgatctggccggcgaggtccgccgggaggtccgaccagcctggcggtggctccagctgcagcggcggcggcgaactgctgcttccgctgaaacagagccccatggtggcacgagaggaagacgcggctaattaacacaagggaaaggagatgaaaaattgaaacctagctttgggcttaatttatcttgatagctagaaaaggtgatcttaattaaagatgaaagacaaatctgtttcgaactcggttgatgaactcggtcaaaagagaataagaaaaactatggatggacccaacttgtcagccagtataggatggacagtgctgacgcgtcagcgaccgtgtggtgtaccatgtcggattttggaatattaattgtcagtggtgcatttaggagtataaagttgtatctttttaagtttattgacccagatgaaatctatgtactttaaggatggcctatgtaatttactttaaaaaatattattagatgtttgagtctaaaacattttcatttaaaaaaaacaaatgtgcatcaccactacaactagtaagcttagatatatgagattttttactgtccagcaggtttgagcggtaccaaatgctagccgtcagatggaccagatccaacggttgaaattgatcggtaccaccaggtaccgctttagtcacttaggtggtaccgcaccggtggaagggtaaggtggtcttttcgcatagaaaattttgggaagtcgattagagcagcgtctttcctcccccagatggctagatgcgtgctgttgtcgccaccgctgtgtgaccttggtcgccgtcgccgccgtggtgtcatccccatctgcagatgagacagaccaagactagaacacctggggtcgtcgtcaatggagcagcccagcactcactctctgggtgatatgccccaaagcgggaggtggagggccgtgcccatgttggcgatggcgaggtcaagctccgtcgaggtggtttccagcttgcaccgcggaggactcctcggcgacggccgccgtctcgtgccatcttccgaagcacagggattgcgcagagatttgcaaatggcaacataatcttcaggaataccatcttagtactgtacctttgtatatgtatttgtatatctgttaatctactaccattagtaagagactctgaatcaatcctcactgtgcattcatcaaattgtcactgtgtgttctccgtccaggcggggtctggcttgtcccactaccacggccggacgacggagcggaagagcgcccctgcatgtctagaagtagttgttgccatacgcgacacagccggcgtgctgcagcgcgtcgacaccggcgggaagcctgcgttggtacttgtgcaaccacgcaggtggaactgatggctcagcactacgcacgccgtgaacaggccggcgaaacaggtgtgccgcgacagcatcgacgggagggaatgaatcggcggcggccgcccgtggaatattttgcggtgggcaggagaagcgttggggggattgtggcgcctgcgagaggatgggtggcatggagtccaggatgattcccatcgtgcccttggaaattggacggttagattcaatctggtaccaccaggtactagtaccttgaggtacaatttgctggaccagagcaaatctctagatgtatatattggctcctttcacttcaagtcaaccaaatccttacacaatcttgtaaacaatcaaagagcctctcccagcgccagcagagtcttatggaagacaaaccaagccagctaatttttactaatatatagcatgtgagtataaatccttacatgcctggaaaaaaccagcatacctttgaatgcttatattcccttcctaggtaaatcaaactagtcgcgttggtgctcaagtcatacactccatacataggaatgccttcgttttccttatacataccgctagtaatactggcctgttgtatgtgatgtcaccgccaggtgatatcctctcccaaaaagaagatgcaattccctgcgaatctcgggtcgccattacccggcgagcgaggaatggccttggagcaagctttgctgaggaagatgatctggccatccaagctgttcacctccaaccactgaccaccctccaaaaatcagcttcaaacacctg

SEQ ID NO: 38429 - DNA, 12273 bp, Oryza sativa
ggaaggagggcaacgtccgtcggaaggtccgacgagcctggcggtggtggctgcggccgaggatgcggcggcgatggcggcggactgctacgtgtgtcgatgccgaaacagagacccatggctccacgactgtgggcggcaaacacaaactaaactgattgcaaatttgcccctaataataaagtgtaaagatgaaaaacaaatctgtatcgaacaatcgatgaatccagtttcaaaatcggatattgttaggatgggatgcatggattgccaggagagaacactatctgtctgtataacgtgttacgatccaactcgagtcttaatacggttctatctttggaattctgctaaactaaaactattaaccatgattttggaaaaattttaaatcaactcgactcttataatatagtattatctatgggtatcagaattttggaaatttcgaacctaaattgtaaaccatgattctcactcatcaatcaacacatgtacagtaggatcatctgatggaattactgcagcaagtaatactggaagcactgacaaattgcctgcagttcaattattaccttgacattctagctagatgatgatctcctccatgattaattagttgtaattaccttggaaagaaccacgtcgcactggatcggcgactgatgtgcggtccacccggtgaaattgtcttgcttctcagatcataaacgccacaggttgaatctgctggccattcgtgccgacgctctgcaccatagtcggcgaagtatattttacctgcttccacataacctccatagctcgacgcacgaactgccatggagcagcttgtactaacgaagatcgcctcatcacccaagctctcgatatgaacatcagtccatttgattgcttcgacatgacgaggtagtgtaatctcttgcatctcacggcggcgtaggtgccatccaataagaagctctcgaacaagccgacctgaatgatctgtgtcgcgagatcggaaaccatgggttgtttggtctttctgtgggtggtgatttcatgggcgaagaggtcgcctctcccggcgacggtgtagaccttgccgtcgtggaaggccatgtcgtggtagcccttgccttcccacgggccggccgaccacgacggcgaggttcccggccggcagcacgccaccacgtcgtcggcgttgtcgtgactgtagctgatcctcgcgacgacgaggccgccgccgccgcagacgatcaccttgcggatgtagaagtaggcggtgggggatcccggcgggtgttggcggcggaggcgggccgggtcgccgcagtggcagtggcccgggaggcgcacgacctcgccggtgagagggttcttgaggtagtggcggcggcgagggccgtgccccggccgcctgaagaggagccagccggcggcggtggagccggcgcagatcgtgtgccggttgaggcggctgaagcggcgtcgctcgccgccggggaagctctggagggtaccgtcgtggaagttgagccacgggagagccgggggcagcggaggcggcgccgtcgtcgccgcgtggcaccattggcggcagacggagccgaagcggacgcggtcggcgtgggagggcagacggaggaggaccacgccggctaggtccgtcgggaggtcgaaccagagcggctgccggcttgccggcggccgttggcgtggctttgcttagtccaacgcccatgacgcactagctacctgcccgtatgtatgtaggacgtcacgtccgcacatatatttgggagtttgagacagggtgcggtacgtgtgaataacggttcaaaatttcggactgacatttcgaatctatgttaagatttcggctgtttttttaattttttttcaagcttttatgaatttggcaaaaaaaagttcaaatttgatcaatttttgttaaaaaatttaaattatttcagaccgaacttgtcgaaattttgaaagtttggatcatatcggtacccgatagaaatagtgtaaatgattatttcgtacgaaaatttctatatatataagttgctttaaaatattaaataatttattttttaatttaaaataattaaaacttaattaatcatgcattagacataaacggttttttccttaacaaaactcccgtcgattcaggtttgaaatttcgggcactgttcacttgcatgaaactatgtagtccaggcaaactatgtagtccaaaatatatatatttatttattaacttgcgaattcagtaaagtttattctaatacggtgtaaatctgctcaattttaatttttaattacgaattttacgaattaaacactaattaacttaataccgagaattttatactcaagttagaacaacagggaacatggtgttgcacttgcacttacttcctgttctaccccttaagagcaagtttagtatagcccactactagctctaatttatatatagccaatctaatagccaattcatacaatagttgtttactatactattaatatatggtcccacctgtcatacacacattgcgtcttggagtctgcgttgcagctggctacagatctgtagcccgctgctcttctctctcatattttatctcaataaaatatatttacagcgggctaatagcctgctactgtatctgctctaatggcaaccacagtgtttatttagcaacttggtattaagtagtaagatggattccggtgtgaaacaataatagttattagcatgtttcacaatgtttaatacctgaagtgataagtaaagtggggtccacatggaatgcttccctccatcacatataaaactcaaccctacctacgaatctaaacatacacatatccaggtttatagctagtatttctctttttttttacagagtagtatgtgagaagattattatacatacacgagtaaataatatattttaataacttattgttagtagtaagcatactatccggttataactactaccacataccacaattgtatatactctctccgtcccataaaaaacaaatctatgatcggatgtgagtatgtacgtatcatagtatagtactatgatgtgtcacatctgttttttatggaacggagggagtagcttattacccgctttttctttgcattgtggttgctctaacgaatttagcaacaagtgtaagggtttaactgcaaaaatgtaaaaccaaccccctccccttcccttcctataaccaccccaccgcccccgcctcacctcgccggaatcgcggcctcgttcactctcgcctccacccgcgccgccccccaccctccgatgccggagcgccgccacatcgccggagatccgccgtcctggtgatccccggagcacacccgcccacccaccatggaccgcctcctgctctttcgcccccggaaaccggcctcctcctcctccgtcgccgcggtggcggacggcgacctcctcgagcgcgacgtcctctggcccgcctcctctgccccaggcctcctcgccgcgctccccgacgacgaggggagcaagaagaagaagcgcgcgggccccgccgccgtacggtccgcctcccgacctgtcccggagaccgccccgttgaccccgacggcgggcgcggcgaggtcggcgcccgtgaggataccctcggaggccgcggcggcggcggggaggagggggaggtgggcggcggcgcagtcatccgtcggcggcgaggacggggacgccgccatggtcgtcccgccgcacgaggtcgtcgcgcggcgcgccgcggcgcacagctcggtgctggagggcgccgggaggacgctcaagggccgcgacctccgccgcgtccgcaacgccgtcctgcgccgcaccggattcctcgactgagagggcggaggccagtcgtctcgtcgctctcgggataaaaccaaaaaagttttgaccctttcttcctttgattttgttcccctcagttgtgtgtttccggctatctttgatttcttccccttcgttagaatgggatggaaagaattgaggcgagtttgcgaggtgtacaacccggcgcaataacaaagttattccatcagttatagatggaaattttggtccttacatctgttcaattcagtatttgcttgatttctgttcaattcagtatttgcttgatttatgtttgcttacttttgagtaggtgaaaatttagttatcggtagcttggtgccatggatggaaaatttagttgttggtgagttcagctcacatgctcaaatacttatgtttagctactaataatcacccaaaacggaggctcgtaaggcgcaaattgaagttcttagcaccagagatggcaattgtttggaaaactttggaactgctgaatttggggtaattataagtaggatactgagaatttagttgcctccatgtttgttcataggcattgtgttgttaatcagacgtgccatgttaagtgttacttcctccgtttcatattataagactttctagcattgctcacattcatatatatgttaatgaatctagacatatatgtgtgcctagattcattaacatctatatgaatgtgggcaatgctagaaagtcttataacttgaaatggaggtagtatgttctagctaatggtgtggaatttcatccacatactgcaatctactatatagttttggctgcattgcagttcggtgtggtggaaccattcagatttgagtgtttgaagtatctatgtgattatctcatatttcctggttctgtccaagagagtataagaatggtaaaagtttttaagaagagatgccaggcgccagctgccatattgtttctggttttcgttttagctgaaactgaggataagttactaattctgaacattgccaatagagaaacctaacagtggtgtttaagatgaacattgtgtttgcttttgttatttttattggcaaatgattgtatcaatgtatagattgtaggcaagttgctcgtaggtcaaacagatctagttgatgtaggaactaggaagaaatgtttatctaggtagttggtaccaagaaaaacacattcatcttaaaagcatagatgttgattccttggaagtcctttacaccattttttggtggtccttcaaattcactacacatctcaatagttatgctttgctgtagatctggaaccactgcacggcgttctagtattttcatggaatcatctgctcttatgtcttgtccaggaccagatataaaggagctgtttgcctattttgaattgcacccactctcatttctttctgtgcagctgattgccttgtcacccctctgttcaggtataaggaccaccaccattccaccgcggtgtagctaatctgctaatgatacctcaagtacacaagttccttggattatccccatcaagaaacagctaatatgtctttgccatcttaacttgtgggataaagttgtttggttcagtcacttcaaaatatgatgccatacaattcagaaagctaatcaaagaaagagtgaataaatatggtccatatagaaactctgaagttaattgaagaaaacagttgatgaatacggccatccacctagctgagaccaaattatatacaaggacattattaatttcaaatttctgaattaatatgataaaaaaatactaaactaagactcccaagatgaataaaacttatatttatcaattcttaatttcagaattatcaaatcatgaacaaactaaaattgaaagtccaagctgagtaaaaattgtacttactaatttgactttctaaaccattaaatcaagcaaattactcagtaactgtcgatatatatttgtaataaagttttatacaagtatttggtatgcaaatgtaatataaatagcccgtgggaatacacatgttaacgatgacctgccagtctgtcactaatgtggcacattatgcatagttttatgtttatggaggcagtagtacaatcatcaaataattgaatcttgaatgcttgatttgtgttgtttcatcactactaagagattgcaagaacatgactagtcgagtagccatttgaacaagagaacatgactgagagattgtgataattgacaccatgaccatcttttgtgaattggcacattttgtctagtgctctagtgatctgtcagattaagagcaatgaagttctcttgttcaaatggctgttctacatatactgtcgtcatggatgcgccccaatgctgcatttatcttttgtatggtttttcttttgtcttttaatgaagtacaatcaacttcagatttacacatccactctcaagttccgtactacatgaagaattttgttcagaagggcaactgaccattaatatggattttggagctttattttacttcaatgtaggttccatccttaagttgtttatagaattgatactgaccttttttgtgttgtctggatgctaaaagtaacactatctttacattaaatcgtttgatatccctttcaggatcaggtccactttcttgcttttatttgattccttcaaattattgggatgtcaatttatttgtcctgagggctgtacattatgagattcaactgctctgaacatgccatatttctttcattatgtactcctgctgaccataaattatttagtgagcatgtgtgatgtctagctcatacttgattgtacccaactcatgttttcagtataaaataaatagcatatgctgccaaatggtgtattcattgaccatctctagatgaccagctgcttactttatttcattgttttggcttcaacatgtattgatccgattgcaataagtgatatagtctgcaatgggcatgcaatatgttgcttcataaccatactgatgtcctattgtagttctggtgagacaaatatacgacgtgtgtacaaattatactcatggtaacccagtctcagcgaagttttgtttatcatcaatgatgtatgtatgtatatatagccacatgatgttcagaagaactactacttgttaatgtaatcacattgatgatgatcagacaatgataatggtagttatgcagcatggatctaaatatagtctggagtgaaagcatcctgaaagaaaatattctgagcacctatctgagatcactgtgctcttgttggccagataagatatactttctgtggtcatgtgatctatgtgtttgtccatacaactgttctgtttctttgtgacattgctggtgcctggtggcatggctttttgctgtggtccagtctccaggctataatagtatgttctgttatgatccagttcacaactttatgatgatgctgcacccctgcaaggaaaacagttttgttgcagtttgccaatgaatatgctgtggtgattcctcctcaactacttcactgggagatgtaacaataaaccctagtactcctgagatgccaagcatccaatgctcacaaggcaataatgcatgcagtacaagagcaagtgaatttacaccagagctgatgcatttcatgtttgaatgccatccatagatcctataaaattgttgtttgaatggagctgaggtccaaagtatgaggttttcttggcaattgctaggtcttctggaaaccagtcatcttttgctttaatcctgggaatttactgaaatttggcttggctactgttacgagtgccttgaaaaaagaagagagaatcccagatggcttgattagattttcaacgtttgaattcacacttcacaaaccctttcctcctcggaagcctgaaaatatgttgaattctagtacacattccactgctaatagtacttgtatgcacggtgcttatgtgatgcgtggtggctgtatgtgtttactgatctgaaaacgtcctgaattcgctgcgtggactatctcaaactttgaagtcagtccttggttgagcaacccacacgtgtacaacaattggacctgactctgaatttctgaaaactttgaatttcaacagccatttccaaggtactagtagcactaggagtacctttttgtggctgcagcctgcatggatcgtaggtgtagaccagaacagcatcaatcacgtagaaaaagcatcattaactatggttaattcggtagcctaaattgcacaccggttttacatggctacagttggtgccctgcttttcttcctgtctagaaatgagatcagatcagacttgttgttagtcagaaagtgtgatctgtcaaaatggcctaaccatctatcagcatggagtctgctccagctcctttgttgaactatatgtgcattagccatagtggagatggaatcatggaattggagtgaacttgtatggactcatgaatcaaacaaaacttggaccatggttgaatggtcagttagaagctgcttgctagaatacagagccatgccatacaactaaatagaagtttcttgctaggctctcttctgtcagatccccaaattcaacagaatgtagaattccagtctccgaaattcccatccacattccaaaaaccggatgaagaaaaaggtaattaaagaagctggattcattggaccggtatgtttggcatccttcaacaattgtgctgatcaccaaattaactaaccatacgttgaaatggtattcagtcgaaggcgacagagcatagcatcacggcgacgtgtgcttggagcagagacgcgttgcatgaatcatcgcagagcgaagacaatgttacttctgttaaaaaactgtgccacctcgctcgcagctctggactgaaggtgtacgcgttcttgacacagacccagtcgcaagcagtagctacgtagacaggaaagactgttctagatttggactgaattgcttgcacttaattgtagtgatatagggtgtgtttagttcctgaaaaaagttgaaagtttgaaaaagttggaagtttgaaaaaaaagttggaagtttatgtgtgtagaaaagtttttgatgtgatataatgtgatggaaagttgggaatatggggaaactaaacacggccataattgatttaacagatttggacttaattgcttgcacttaattgtagtgataaatgatttaacaaaaagataaatacatcgtcagtccttaaatttggaccgcgacatcacgacaaattggttatctaaattaaatttagtttaatgtatcacccaagatctaaaaacccatttaacaaatctccgacgctggtgtagttatctagagtgacaaatgtttttcatttagccccgttgttttagatttatccttttattttgaacgactcgcactagatagtgcaaagttctattaatagagtaggaaaaagatttgtcctcaacccaacttctctctatactctatcgatcttctcctctttcagaacaaggagagaaagcggcagcaacatgaagtgcggtgagcatagggtggtgcaaaatgcgggaagggagggaggaggcaaagttcggtgagggtagtgtagcgtctttttgtcatcaccaccaaggatattcgctaagcgcctcattaccttcaagtcacatgaggtccatcactcatcctcatagtgaccatagcaactcaccgaacttgcgggatcatcctctccctatcgcatcgtctgtctttgctctgagacctctgcctatcgataattgccccccccccccccccccgtgaccgccatctcttcgcctttggggaatgacggggaataggggtggtagtcggatcgggggtgtactgtagggagagggctaaacgtaaaatgtttgccaccatggatagcctggtcgttgcacaaaactagcccaattatacatgtgaatacattaaatcaagattacatattatagttctagatgagcaatttacaatattatggatctaagtgatacccaatctaaatttaaagaccgaccatgtattttatatatgtttagagagcctgctcaaatgaatataatctgtacatccttttatatctgcaaaccaaggaaaacaatgtcctcaaggacgagaggacgtgttgggttgacttgacctagtcattcagccttccactaaaacgatatatatagtcgatctacgttgggatagtctacttatttatacggaatgggttaaatataaatatcatatattagaaacctaataaatattttctccgattcaaaatataatgcatccttattatcgatatacagtggatccatcctgggatgatctactttttcatatggaatgagttaaatatcatatactataaacctaataaatgttttctctatttcaaaatttaaggcatcctttcaaattatcaaaatcaatatttgaaaattttaaataatgactggactaaaagtatgagtatctaaggccatgcatgtagctagaaatcacgtttctctatttaaaaatattttcatataatattaatttcgtaattgttgataatatattatgaaagacactaaagataaagtaaagataaagtataatgtttgagaatgtgtaaaaggctaatacgtcttttagcatgcaggaagtagtacactgtacactgtacagaaacagctggtctcacgtagaaggtctttagagaaatcatatcgttaaaaacgtgatgcaaacaatccacggcaataatccaaacgatcagctccattgaacaggtcattaaagaatctctcattcaattctcttggcagtactcggtgcttggtgcttactgctaatatatataattagcaattgctctggtgcagtgtatgaattgaaaagagtgaaaacttcatcatcttttccattgcatggtcatggcaactgccgagcaattctttgtgacagcatgtagcttatataggtgatctcagctgaaggactgcaaacttacaataatgctagctgaaaaacactcgcagttaccatcagggaatgccaatcatatgcctttaactccttattaactattctctccgtttcatactacaagatatttgattttttttcaagtttataataaaatttagcaacatttatataatatatcaaattagttttcctaaatctaatattgaatatattttagtagtatatttttgtgtaatgaaaaaatgttactctgtcttagatttgattaagtttaaagaagtttgagtagaagaaaagttaaatagtgaaacgaagcgagtgatattgagcttatttgattaatttagataagtgtacacatacccggtcattacagccctagtgtgtgtgtttgaggagaagggaattgaggagattgggaagatacgcaaaacgagatgagccattagctcataattaattgagtattaactattttaaattttaaaaatggattaatatgattttttaaagcaactttcctatagaaattttttacaaaaaacacatcgtttagtagtttgaaaagcgtgcgcgtggaaaacgagactcaaatctcccctagctccccagaacgaacagagccttaaagcaacacggaagtaattaactcctccgatccataggcttgtcatatactcgtgtcagttcagttcagttcataggagtagaccttgacctggacttcgatcaattccttgactacttcagtcaacgcgagtagtttgttgctttatcaattcatcatcgtctttttgcgatcctttttttcagaacttctttttacgatctagtcagcttattaattgactggttaattactttaagcatcgccatcaacgataccttcatcgatatcattatcttactacattcatgtctacagtcaaaagacgtttacacacgtactatgctttagggggtaaaaatagaatgggtatttcctaaccgcctacttgacccgaggcttgcgggagtaatatatgggaggaaaaaaaaagagatcccaatactatccgaatttattaggaaaaaatgggttaggatatgggaagacatgtattcacccgtatgtcccatgttacaaaatatgtacgaaaacttattataaatccacctaaaaatatgataaaagattggctaatcactattttacgtgctcacatgtactattgtgtatttttttttgatgtatctcttttagtactttaattatcttattatatttaatatctatgaattagagagataaattaatatcggttatcaaatctgatttgaatgaaataatatgggataag

SEQ ID NO: 38430 - DNA, 2009 bp, Oryza sativa
attgttgccgttttaatagtattttggctagttttttatttgtaccaaaacatgctagtaacacatataacactactatagaaatgatcttcacatgtgaccaaaacttgttttcgcagaccaaaacttgttttcgcaggtgaccacccacctggagccaagtgtttgcgaaaattgacatttttctatgcggacgcaacaaccgcatacgaaaatgcatattcacatatggcgtcctaagaaggccgcatgcatgtaaagatccgatttttacatgcgaataagtaaggacgcctcactacaacgattttctaaaaatttaaaaaaaataaatccaaaacccttgatcgggcaccgccttggcagcctgtgagtccatcgccgtcgggtgccgccactaccaaggcccctccgctagctccgtgaaggacagagccatcgtcgtcattgtcgatgcagtccgccgcccaccgtcgtcgagaccctaccgcaaacaaggccgacagcgacagatccatgagggagagggccgccgctgtagaaaccgcatgggggggtaggaagtgagtagtggagagagaaatttgatattttaaggcgtggtgaactggttgcaggtccacttgcgaaaataggtttatttttgcatgtggttatttaagagcccccaacaaaaattgatttttacacatgggcttcttaagtggccttatgcgataatacgcctattattatagatgtgtttcttaaggagccgtatgcgataatgcgttttcacatgcgaccctgaactaccccccccgagcaatttttgcataagcgaccaattacggcctgcaatgcacaagggccctcatctagaaaaatcgttactactaaaattttggtattgcctatatgttagcatggtagcataccaaagtccataactctctagctaattaatctacttcactaactttgactatcaataactttaaaaatatttagtttaaaggaactataacaagatatatatatttgtctttcaaagcactataataaaagtaaacattcatttatttattatatatattataatagaaaaataaggtcaaagatatatttggtaggccatgttattgtctaaaatgtcaattaaaatgaaactggagggagtactagtactgtaaccaccctccctctccctctgtgcgcaagtccacacgtcaaccatggccgtacgtattgtccatgcatatgtaaacttctccgaaaccaattcattcatttcacgcgaactcgagccccacacatatatatacacatcccaagatcacaaatcgagtgtaattaaatttgtgatttgtgaaccttcttcaattctacctagctagcaatctattgagaggtgaattgaagtgcatgcatacaagaatatatagatggtgatgagcggcggcggcggcggcgcgaggattgtcagtgatccggcggcgacgccggggttccgattctacccgacggaggaggagctgatcggcttctacctccgccaccgcctcgccggcacgagggccgacgacgtcgcccgcgtcatccccgtcgtcgacgtctacggctaccatccttcccagctcgccgccatggccggggtggcgaccgcgggggacagggagcagtggttcttcttctgcccgagggcggagcgggagctccacggcggcaggccggcgcggaccacgccgtcgggctactggaaggccacgggctcgccgtccttcgtcttctcctcctccgccgccgccgccgccagggtcatcggcgtcaagcgcaccatggtcttctaccagggccgcgccccctccggcaccaagaccaggtggaagatgaacgagtacaaggccgtcgccgccgccgccgccgacgacgaccacaacgccgctggcgtggccgtgcagctgccaccaatggcgccgccgccgtcgtcctccgcgtgcgtgcggctgatgaacgagctgagcgtgtgc

SEQ ID NO: 38431 - DNA, 5862 bp, Oryza sativa
aagtttgatcagtgcttgctaattgccatagtgttctatgttcaggtcaacttgattgatttattacctcccaaactctcaattcggcttgtctttaatttttcttgaataaattctgaactatggcctgttcttttcttacgaagatttcttacgaagatgaagattctacctcgctttccgttagcacgtttttcaaactgttaaacaatgtatttttgtgtaaaaactttttatatgaaagttatttcaaaatatcaaatatatccattttttaagttcgtaataattaaaactcaattaattatacgctaatagttttcttattttgtgtgcccgtatttaaaccgaatatttatgtgtgttagcaatagcatgatgaatggcaaacagaaggctttattaaaaagtcataaggaaaaaccaggaaagaaaagaaaaatagagtgcaaatataaataataaaagttccaacagaaaaaacacaagcatacaaaaatttaagaaaggttagaaaaaaaatgaaattctaaagtggagaaatataatgcatcggatgagaaaaactcgaaaaggaaaaatcagaaaaactataagagaaggaatctaggatattggtgacaatcgtacgttacaaaagacaggtaataaacaaaaaaaatatggggtaaacatttttatctatattcctagaggtttaattaaaaaaacaaagttatgcaatgagtaaaaggcccagcattaactatgaaattatgcttcaaaatccaaattatttttggttgtaactgatgagctaataagcagtcaacagacgatgaaagacttatggtgaaccacttatttcgtgctgaagtacagtgatagccaccttaaatgtaaactccaaaatagatatcatcacataccacatcataaagaaaggtcatgataactgcttgggatggtagctttgaagttgagccaatttatatgagcatacgtaagtcgccttctattttaatggttacaatctactcaacacttgtattgcgtaactaaaaacatatgtactgcataactaagatgatgcctcttttttctctttatcctcaatttttctctttaggtaaactaggaagaaagcccgcgcagatgcgatgcgtatcttgttaattgttttataaaaaataataaaaaaaattatatatcatcatttctacttaaatgatacttcctctatctacttttgatagtcatatttccaaatctgaaaaaattatttttgataggcatatttcaatccaataacctagtatcatattaatgactttctcggatttaatgcgtgactctccattcttctacacatgattggatacatgggcattgagaaatataaatattaatgagtcgcttgtttacgaggaatgactagtaacatgtttaaatggatgataagtagaatcacttatccttggtctatgtgccaaaatgaaatatgattatcaaaagtagatggagagagtattaaatgataagaatgtttctcatatttaaataaaaacattttgatcgagtgacatataaattattttatcgtcaccatgacttattatgttttaaaagttgagcatctattaataaataaaactgcatatgtaccaattaaataggcctaatacatcattaatacactaaaatatcctctacttaaatttcataactcacttatttctaaatccatatataaatattgtgaaaataccactacttctatctattaatgggatacctaagttaaacatgaatgctactctactgggtagagccgatcatagctgccaagattttctttctccgttgccttcaaatataggtcccacatcgatatagttgtactcctcaagaccagcttggagcacaattttaattcctaattcattaagtattgcatcgataagtacgaagttgagcactattagcgatggtggatcacactggggctagattaacttagccatatgttgcatgctatatatacttaccgcaccgtagcaaactctgttatcgatgcttggtgccctttaggaaaggacaaatggaagatggagttgatcaagatagtttttctattgtttttagtagatttgtggtatagtgtagacacactttttttatgatgttaatcattactacctaaatttttatgatataaatagaatactctgttataaaaatgagcaaagttaatcattcggtgatacttaaagaatgtacatgtttttccaaacatatttacaataactaatccgttggagtacacttatagtcacgtcagtggagtttatgacatatatccatcaattatacctgacatattgaaatttcatacgtataagaaaatataatatgagtagtttattatgcatgttactttattgctcatttgtttaagaaaatatttggcaaagaaaatatatatgaccataaatctcatgatggattatagcaagtccattggctggaaatgttgttgataacttttttttcatatctatataccatgtatactgcccacttctgaaaaactttgagaatgttaatctcaaacaaattacaattaaatctcggatgtacttgaaaaacacaactaaattgtgttgttatgtagatttaaattagtattttatatttgtaaactgatatttcacaccctaaaatatgatgtgatttttttgaaaaattgccgtacaactaactattatatgtcggccccatatgtcgtgatatatttaggacaacaatataacttttatagtttatttaaaaaatacagcggaatcataaattggatatataatttttttaaaaaataatagatggtttaataacattgatcggatattttatatttttattatccattttaatttaactacatatttatatttgtgaataatatttttatttttatactgtaaaaaataaaatagatgaccgtcgattttcttgcagcagaaggtaatctttgttttcaatcgtacgtgcgtactcaacttttgttttcagtcactagaaaaaatgcccgtgcgttgcaacggggtaaaaacgttatctttatcctatacattttactcccttggttttggaccgaatgcttccttggttttggatccaacgctcattccttcctttccagcttcagtcctagccctgtccgctacctccctctactcggcctacctctcttcggctcagcccaccagtgaacctgtaggcctagctcgaacaatcccgtgcctgtaccataacggagccgatcctcccattaaatccggtccaatctttctcgatctccaaaatttaatccggtcgagcttgcatagtccagtgtccgtacgatgatggagccgatcctttccatcaaatccggtcgaatctttcttgatctccaaattgttgagggattttgatctactcgatcccaatcttcctttttaatcaaaatccccaaaattgtcaagggaaaatgacaaatccggtcgaatctttcttgatctccaaaattgttgagggattttgatccactcgatctccctcttcctttttaatcaaaatccccaaaattgttaagggaaaatgatgagagagtagtcgggaatcttcttgatctccaaaatttaatccagtcgagctttcttgatctccaaaattgttgagggatttgatccactcgatctccctcttcctttttaatcaaaatccccaaaattgttaaggaaaaatgatgagagagtagtcgggaatcttcttgatctccaaaatttaatccgttcgagctcgcatagtctcgtgtctgtatgatgatggagccgatcctctccatcaaatctggttgaatcttttttatctccaaaatttagagggattttgatcccctcgatcttctttttctatttttttatcgaaatccctaaaattgtggagagaaaaataataagagagtagtggggaatcagtttttgcaatcaattggagaagaaaatacacatgggaaagcaaatcaacgtgaccgcggtgcagggttcggcacacgagaaaaactaccgcggcgcaaggttcggcacacgagaaaaactgcaaaaaaaaaagcgacaaaagaaagaaaaacggcgaaaagaaaataaaacggaaaaaaacgaaaaagaagggaaacggaaaaaaaaggaggaaacggaaacggaaaaaaaaggaacggacagcgaaaagaaaataaaacggaaaaaataaaaaaaagaagaagaagaaagaaacagacgaaatttaaccggaaaccttatgaattttttaattaggtatatatatagatatagatatgtatgtacatacctacggagaacagcagtcgtgtttacatgagggggaagttattattttttaataataaatctaatctaatggtgtaaaataacgggtccacaaatttaagtgaaaatcaacggtgagattagaatgggtccaccaatttaagtgaaaatcaacggtgagattagatagtcccatgtggtggcttaagagcgtatataggagtgccacatgacgtctttagaatatttgtagaaaggttaatttgtagaaaggttaatggacttttattatataataggtagactgtgccctcgctcggaacgatgccaccaatttccttagcaccgtgagacgttcctaccaaagtccaaaacaacaagctaggtacatcaagcgtgcaagtggcaccatcccctcctatcttctttcatccaatagctactaacatcttaggcaatgtttggctaatgggaaatggaaatgatttcccacccaccaaaaaaaacatctttaaatcctaaccattcattctccctctttcatttaatcctaacccttcattcatttcccaatcccaattccactctctatttcccattatccaaatacactcttagttgaagaccgacaatagcatagttggctcactcctagtaatgagaacaaccaactgcgacagtggcggagtcagggatgtcacgaagcccaaacgagtagtggcgttttctggtaatcgactaatattttcgaatatcataagatatctacagtggagacgtcagcgatggagcccgtgcagccacccgacctgcccggaatctagctcggtctttaatcgcaagtactattgtgtaaagatcagagttgcgaggcaccatcatgtttctacttagtattggatagtaagtagaagctattttcacctttgttgtaggcacggttttcataattaactgtgcgtatcaaatccatatttaacagtttctttggaaaggtactttaaaaggggtacgtgtgccgttaagccttcaaccattagatcaaacatgttttggcgtgagttagggtctgggcggcacccaggcgactgggttgcggcagccttctcctcccatgaaaggaggatctggatggaggttctctccgatctgctcagaaagtctgcggaggtcacgtctgcgatctgtaattgggttggtgatcaggttaatcgtgctggttctggttggatctggccgaatgcttttcgacatcgggcaggatggaggcctatcatgggacaatggaatcctaatccgaggaggagggcggatatgaagtttggtagaattacgcctgttgtcaaattctggtacggcaagttctacaggggtcacaccaaagatatcattgatgtggatctgttttggcgatcaaccgtgaaagaaaaggactcggagctgctggggtataaattcaggtacaaggaagggataaaatcaaaaatatctctcgggtcacagatatctagtg

SEQ ID NO: 38432 - DNA, 2538 bp, Oryza sativa
ggtcatctagccttgtgcttaaggtcatggcggctgccgagggtgggggtgatcaagggactatcaatgcgatagttgcccacccgaagccttccggtgcgtcgtcgttgcccccagggagcaggttggaatctgaactccaagctgtactagttctgaatcaaagcgtggatgggatacatgatcaggcaacaggttcaagagtgctgccatcgtctggaaatcatgatggtgggttggcaagtaataacctgagcagtcaaggccctacagttttcactgaaggagaggttgtcgatgaggaggaggatgcagttgaaattgaaatcgaagagaacgaagttcagaaggccggtcaatggacgatcctagcgaggttctactcgctcaagtttcctaatcagtcggctctgtttgaggatatgagaagagcatggcgtttgcgggcggagatgagttacaagtccctaaaggataacctcttcattgtgtcttttaatgcagaaggggattataatttcgtgctgcaaggagatccatggttgcacagaggagatgctttattggtggcggagtttaatggcttgttaaacccttccatggtgaacttggatacagtccctatttgggtcaggatctatgaccttcccctagttatgatgaacagagcaagaggtgaactctatggcagtaagatgggcaaagttcgcgaagtggatgtccaggaggatggatgcaataagcatgatttcttccgtatacgggtggatctcccagtcaatcgccccctaagaagaatgctagctattaagataaaggtgcaaggcaaagaggagactcgcagatttcaccttcgatatgaaagagtcccacacttttgtttcttctgtgggtttatcggacactcagataaagaatgcgaaaagagactgacaaatgagaatgagcctttagtattttctgctgaactccgttgttcgcccttaaaaccctttgagagaaaagtgggtaaagtaaaagcagttcattctcaaggtgttcagagaaaattgtctttcaggggcccaggaagtgtgagttcttcgtcagcgggtattagacaggatgctaagagatatgaagatcaacccacaagggtggatgcttttgatggttttgatattagagaaggaaaaggtgaagactcaatagatagtcaacttgctgaccagacaaatatgctgcacgtctcggaggtgtcaagccttggacagaagaagggcaaggatttggttagtaaggaaaccagctcaataccttcaatggagatgatcccagcaattagagacctgaatgtacagcaagtttcctttggagatggctctactgaagaatttggaagcccaacaaagaggaaagctttgccgacaacaaagagctcaggcattgtccagcaggctgttttggagtatggccagagaggagcagaggaaacggcaagctcaacacgggcaatgaagaggctcaagaagggagtggaggcaaacactggcgtggaagacatggaagcaaccagcctaggggctgctggtaaactggcgggacctatgagagggtctcgccaggagaaatgagttgcctgcctggaactgccgtgggatggggaaccctgcgtcagttcgagatctgtgtgccttatcaaaggaggcgagttcccgactggtttttctatgtgaaactagacaaagtgtggagaagatgagtcgcttaagagggagactgggtcttaggggttttactggtgttagcagtgaaggtatgagtggtggtcttgccttgtattgggatgagtctgtttcagtcgatgtcaaagatattaataaaagatatattgatgcgtatgtgcaattgtccccagaggaaccacagtggcatgttacttttgtgtatggtgaaccccgtgttgagaatagacatcgaatgtggtcgttgctgagaacaatccaccaatcttcgtccttgccctgggccgtcattggtgattttaatgaaactatgtggcagtttgaacacttctcaagaaccccacggggtgaaccccaaatgcaggatttccgtgatgtcctgcaagattgtgaattacatgatctgggatttaaaggtgtaccacacacttatgataataagagggagggatggaggaatgttaaagttaggcttgatcgagtagtggcagatgataaatggagagatatatactctaccgctcaggttgtgcatcttgtctccccatgttctgatcactgcccaattttgctgaacctggtagtgaaagatccccaccaacttcgtcagaaatgcctccattatgagattgtgtgggagagggaaccggaagctacccaggtaattgaggaagcctgggtagttgcgggagaaaaggctgatctcggagacatcaacaaagccctggcaaaggtcatgacagcgctgcgatcttggagcagagccaaagtgaaaaatgtaggaagagaacggagaaggctccgaaaaaattgg

SEQ ID NO: 38433 - DNA, 4082 bp, Oryza sativa
tgtggctgcagcggtccagagttaattggctaaaggatgaggatcgaaatacgaaattttttcatagccgggcagtatggagagcaaagaagaataaaatctccaaactacgggatgcaaatgaaactgttcacagttcgacaatgaagttggagagcatggcaactgaatattttcaggatgtgtacactgctgatccaaatcttaatcctgaaaccgttactcgtcttatccaggaaaaggttacggatatcatgaatgagaagctttgtgaggattttacggaggatgaaatttctcaggcaattttccaaattgggcccctgaaatcacctggtccagatggctttccagccaggttctatcagcgcaactggggcacaattaaagctgatataatcggtgcagttcgccgtttcttccaaactggactgatgcctgaaggggtcaatgatacggccattgttcttatccctaagaaggaacaaccagtagatttgcgagactttcggccgataagcttatgtaatgttgtctacaaagtggtatccaaatgcctggttaacagattgagaccgatcctagatgatcttgtttctgtggaacaaagtgcctttgtgcagggaagaatgataactgacaacgctctcttagcctttgaatgtttccatgctatgcaaaagaacaagaaggcaaaccacgcagcttgtgcatataaactagatctatcaaaagcctacgacagggtggattggcgtttcttggagatggcaatgaataagttgggttttgctcgccgatgggttaactggattatgaagtgtgttacctcggtgagatacatggtaaaattcaatggaaccctacttcaatcattcgctccaactagaggtttaaggcaaggagatcctctcttgcccttcctatttttgttcgtggcagatggactgtcattgctgctgaaggaaaaggtggcccagaattctttgaccccttttaaagtctgcagagctgcccctggaatttcccacttactctttgctgatgataccctcttattctttaaagcacaccaaagagaggcggaagtggtaaaagaagtgctctcatcctatgccatgggcactggacaattaattaacccagccaaatgttctatcctcatgggaggagcctcgaccccggctgtcagtgaggctatatcagaaattttacaagtggaaagagacaggtttgaagatagatatctgggatttcctaccccggagggacggatgcacaaaggacgttttcagagtctgcaagctaagatttggaaaagagtgatccaatggggtgagaaccatctctccacgggtggaaaagaagtgttgatcaaggctgtgattcaagccatcccagtatatgtgatggggatttttaaattacctgaatctgttattgatgatctaacgaaactaacaaagaacttttggtgggattccatgaacggccagagaaaaacgcattggaaagcctgggattcgttaacgaaaccaaaaagcttgggtggccttggtttcagagactatcggcttttcaaccaggcacttctggcccggcaagcatggaggttgataacatacccagatagcctgtgtgctagagttcttaaagcaaaatatttcccccatggttccctgattgacacttcctttgggagtaactcgtccccagcatggagaagcattgagtatggcctagatttgttaaaaaagggcattatttggagagtgggtaatggaaattcaattcggatctggcgggattcatggctgccaagagatcactcaagaagaccaatcactgggaaagcaaactgcagactaaagtgggtgtctgacctaattacagaagatggatcctgggatgtgccgaaaatccatcagtatttccataatttggatgcagaggttatactgaacatctgcatttcttcaagatcggaggaagacttcattgcctggcaccctgataagaacggtatgttctcagttcgaagcgcttacagattggcagctcagttagtgaatatagaagaaagttctagctctgggacaaataatattaacaaagcatgggagatgatttggaaatgcaaggttcctcaaaaggtcaaaatctttgcttggagggtggcctccaactgcctggcgaccatggtaaataaaaagaagagaaaattggaacaatctgatatgtgccaaatctgcgacagggaaaatgaagatgatgctcatgctctctgcaggtgcattcaagctagccagctttggtcatgtatgcataaatcgggaagtgtttcagtagatataaaggcctctgttttaggaaggttttggctgtttgattgccttgaaaaaattccagaatatgaacaggccatgttcttgatgactctgtggcgcaactggtacgtgaggaatgagctaatacatggcaagtcagccccgccgacggagacgtcacagagatttatacagagctatgtcgatttactgttccagatccgacaagctcctcaggctgacctagtaaaaggaaagcatgtggtgaggactgtacctctgaaaggagggcctaaatatcgagtgcttaacaatcaccaaccatgctgggagagaccaaaagatggctggatgaaattaaatgtggatggatcctttgacgctagctccggtaaggggggtcttggaatgatcctcaggaatagcgctggtgatatcatcttcacttcttgcaaaccccttgaaagatgcaacaacccgctagaatcagagctgcgtgcctgtgttgaagggcttaagctggcgatccattggactttgcttccgattcaggtggaaacagattgtgcctcagtggtccagcttctgcagggtatcggtagagatttttctgttctagccaacatcattcatgaagcgaggcatctgctggtgggtgaaagggtgatttctattaagaaaatatgtcgtagccagaattgcattagccatcatcttgcaaatacggctagagctgattttcttgctggattttggttgggagagagttgtaatcttatctcacatttattaagcgagaactttatgagtgagtaatatatttctttccccccgcaaaaaaaaaaaaggggtacgtgttgatgtgcatgtgtgtgtctggactctctctataacttgtacaaacttgaactatactgtttgcccgttatattattttgtcggccgattgtacaggccggtttttatatggcccaagtccaaagcctgccttttggctgcgtgaccacactcatgtgatgatgtgataagtctgctagcactagcagacgccttcacggaccaacacaaaagttacgacccaaaaacaaactctccgaccgaacgcaacagcgcactgcatgccaaccgaccgaccgaccgagcccgggccgcggggtgggccaggtggccatccttccagacgcttccgccccccatcccacccactgacgcgtgggccccacacccacgtgggggccgccgaggagggccatcggtcgccgctttgaccggggaggacaccgtcacccactgacgccgtggggcccacacgtcagtagccccgtactagtacgttttttgcatgctttgtccgggatgcgcggcgcgaggcgtggctccacgtgtcctcctcctcctcccccacagcctacgtgtgcctgctccggtgatgtcctgtgtcgcgggtacgtggcggccggcgaccgggcgcgccctcgatatatcaggccgcgccccccctcgccgccgcactcgcctgcccccacggcgagcagccagatgccaagatcctccccgcggctactcctcccatgtcggacgaccacagcggcggcggaggcgagcagcggcaatgccggcgagggttcgcggtggacgtggtggagctcggtgcggccctggctctggccgacatggccggcgccgccgtcaaaccggccatgcagctgcagctgcagccgaccgccgctcaggaggaggacgaggagatggcga

SEQ ID NO: 38434 - DNA, 8087 bp, Oryza sativa
  unsure (1)..(8087): unsure at all n locations
accgagcccctccacatgctcaccgaggtaactgaaactgaagccaatgacatcgctcgcctatcaaactgaaactgaaactgaaactgaagctggtgaaatcgcctagctgcaaatctatcctgctttaattaatttctcctacaaatttgcaggaggagaaggaggcgaagcggctgcggcgagtgctcgccaaccgggaatccgcacgccaaaccatactccgccgtcaggtgatccgatctgctcataaatagttggaaattgcacaaactgtactccaaattgctgcgactgttgggtgtcaatataatcagtgtttctcctggactatcaatttcaggctattagagatgaactggcaagaaaggtcgcagatctgtcaacacagaatgagagcatgaagaaggtgagcgaattagacctgacaagatcaacagttgtatcttttatgtagcttaagctggcaattaacagtaatgatgttgtgtttgggggtgcaggagagggagacagtgatgcaggagtacctctcactgaaggagacaaacaagcagctcaaagaacaggcacagcatcatctttcgctttccttgttctaattaatctcttagtagtataatcttcttctttttttgttctcttttactacaaaattattattactcctaccattctgaggccaaagagagcccaagagaatctactctactctactctaccatgttccaaatccaaacctccagttactttaatccctaatcccttttctcttttacttgtactacaaattaagctaagtaccattctgagttaaggccaaattaaagagaatctactagcatgttcctccatttgccacatgactgcactttactgctgctactggtcctagtagtggtcaaatcaatttggccattgctgtacggctgtagctagctgctggcgaattgggaactgaaaatgtttttattggatgctctggcacttgtgtagtgctgtgtatgtgccacactgacatctgtaatggatataaccattttttcttcctgtgttttgtggtacactgctccactatctggcaccttgtgcatgtccagattcttttagttgtcgatgcgatgatgcaaaaagctcgcttgaaattatttgtttaatcattgtcatgtgggatccaatggtccatccttgttccgcatgggtgttctagccagttcagtttcatttatgcgtggggaaaaaaagaaaataaaaaattctatgtgtgctgggtaatgaagcatgtatgtggcaagcagcaatagaatacatacctactctactcttatgtgatgtttgtgttagaataggggttgaatatacgagttgggattgaagttggaataggtataatatccctctaaaatagagacggggcaccacaatcacggcgactacaatgagtgttggaataggtataatatatagttagagagttgaatcctgtgataggcttgctctttcttaaatggagaggaaaatagagacggggcaccacaatcacggtgactacaatgagtgttggaataggtataatatattgttggaataggtataatatatagttagagagttgaatccgcttgctctctcttaaatggagagggggcaccataatcatggggactagtgtagacccctcttcttaaatagagggggcaccataatcatgctaactagtgtagacacgcagaggcgactataatgtagtgtagacataagaaaaatgatggcagtgaagtcatggatcgtagtggttaggacttatcttgattgggaaggagcgttcataatcggagctagaaagattatgtttacttcgctaataaatatcgtgtgattctacgtcgtcatctagtgtgtatgtagtgacactctaatgcttgaagggatcgaggaggttagtcgttgaggaggttagtcgtcgttcttttatatcgacgaacgtttataacattcgtctgtgtaaactattttgaaggtctaagaacgccaattagtcgagatcagccttttgatgataatggttggttaaaacgcaacattcccgagttcttcgcggatttgaattcatccctgcggatgcgttgcaaaatttgggaaattcatgcgttagcagtataaacaaacactgctgtaatgagacaagaaccaaacctgcaaggctgcaacaacgccaacagcaactgtgccttccagctttgtcagccactctccgccggagctgagatcatcgaggtgcagctcaagctgggccaccatgtaggggaaaaagcggtattgaaattttaccgacatagcgatacatgttcacgtaaaattaatataataataataagagaaattttatggggtttgcatttcaaaggtatagattccacggttctcagtcatatgtactatgctaaaggtatttaagtattgatataggtactatgctaaaggagaaccataggtactatgctaaaggtatttaagtattgatataggtacttaaggtatttaagtattgatatagatacttaggtattaagagtaaaacatataattttgctagtagagtgaaaagggtagaatttgtcccccaaattataataggtaccgtgtagataggaccgtacgcattaacataacatggtatcagcgttatgtgtttttatttatgccatttttctcttttgcgtggtttcttgtagatttacgttgtgttcgagttaagtcgtttatcggcactaagatcaatcaaatattgtctcatgttcaaacgctcgaccatgccaaaaccttcttcgaccgtgtctctcgtggctgcacctcttcaaactctagaagaacaatgtaggagatattgtttgtcccttatgaagggaatctgtgaactacataaataactaatcaactgtgtaaataaacaaaggataacttacgaatacgcttgtctagccgtcgatcggccgatcctgtctcctcttcaaccctcaaccatattgacgcttctccctctgtctcccttcggtgaacaggtttaaaccttagaacacgcacgaagcaaaagggaaagaagaaagaagacgcgagtgttacgttctaatcagtcactaaatcaacgaagtaatctaatttacttttttttcctacaatgataccgagatctacgatgatataccgatcaatggtttcgaagtaatctaatttactttttttttctacaatgataccgagatctacgatgatatactgatcaatggttggaggtattcaattcactaaaaaatactcatgttttactagttaattactcaattgtcattagttaattactcaattgtcatcatgttacaataattttattttctaccttatccttctcttgatcaacaatacatattattccacctccaagtacctctaaatacctcacaaacaccgtgaaagatctcaataagaatatatatctttatcgatcgttgctggttgtaaaatttagttttttttctaatttctatcagcgtttttataaaattagtaaaaaggaatttattaaaatttaatttttttaaatttctatgagcgtttttatataaaattaataaaaattgatactgttttcaacttccgaccgtcttcgtctccgtggccagtgagcacggccatggccgccgcggcattggcattagtacgttgctagcacatgaggcaaccgcaagccatcagtattaagttgcatatatcgaccagtttaacttaaaagcaaagcttaaactgatgagaaaaggtggataatccactttatattccaataggtatacactgtccagcgataacgtcgccgtcaattaaattgtgccaccggttacaaacatgaaaagcttctcgtacaccttgttaaatcccaagagaaatattaaaactgtgccaccggttacaaacatgacaaacttctcgtagaccttgttccgtaaatcccaagagagagattaaagggcattgaggaaaataattctacattaccataaaaataaaattaattttctctgtttcattcaatctaagggggagagattaacggactgtcctcagcaagaagttaccgacaacagtaaaggccaagccagagcaggaggaaggagacgatgagaaagctgggccgtgtacttaattgggcctcaaccaggccaggcccattttaaccgcgtctctcgtgggcccacattaactgccctgacaacacagcccacacgtggccgtgggccccgacagcccagtccgacgtgtcaccggatagtttccagaaacgtcttcctcctcctcctctctctctcctccccactccgcgcaggcagctgctttgctctgtgctcccttctcgggcctcggtttgctcagatccaccgcgtcgcgccgtcgatccgacgccgatgcggccgccggcgccggcgacgacggcaggcgcgggggggaaggtgacgccgaacctggcgatggacgcggaggggacgcggctgctcaacctcaccgtgctgcagcgcctcgaccccgccgtcgaggacatcctcatcaccgccgcccacgtcacgctctacgacttcaacatcgagctcaaccagtgggtgggtgaagccatgcgccgatctgctcgcctccctccgctggtgtccccgtccatatgatccgatctgacgccgtgtttttttttctctcttccttgtctcccttttgggtctatgtgtgcagagccggaaggacgtcgagggatcgctgttcgtggtgaagaggtgaggtgggggtgctttgggcttcgggaatggtggtttagggtttggatcggggtttttgcgtgtgtgctgattgagatctaacactttctggaacgcgttggatcgcgtgtaggaacaagcagccgaggttccagttcatcgtcatgaacaggcgtaacaccggtatgtagttgatgagtttttttttcctgttgcccgtatttcgtagcacgcttgttgtttagaactttggatattggactgattgagctgatctgtagtaccactatgacctgtgatctctgatctgtagttctgacacatatccagatattagcaggctagttcttcttaggattttaatttactataggcttttggaaagaataatctgaaattctgcacccaaatggcatatatacgtaaatcagctatgatcaaggtatatctacatctatgagtagcagagcattttatgattttgtagaaggtgtttttttttataaccacagtatttaacacagttacgcagatatcagctcaatacatcatagtctagacaatgaactgcaacattcaatattaattaatttgatttgtatgctttttaatgaatttgatttgtatgctggattcctcatgaaaagatctgtttctgttgttgtagcctgtaacagataatccaagatctgggctgtgtatatccccttgcagatatagaggccggatttctatccattttctaaaaaaacagataatctaagatctgtttttcttgtcgtaactcgtaacagataatctcgtggaggatctattgagtgactttgaatttgaacttcagcctccgtatttgttataccgaaatgctgcacaagaagtaaacggtatttggttttataaccaacaagactgtgatgctgttgcaggtgtttttggaaggtaaggccttttctctaatatctcacctgcgtgacatgtttcaatctgactgggtcatttagattgggcaaacaagaaatggacagggacagatgagaaccatctaagaatcgtgctccttgctatctccatttatgccatgaactaatttcgctagttactcttttgtgtaaaagacatttgtttttttacttttgttgtttagtatattcaccaaatcgtaaattagtagttgcaaatgtgatcctttttctgattctaaattatattatgtctaagtacatacactttgactgaaactgtggttgaattgatctgtttgggttcaggatattgaatgcttacgccaaagtgcctccaaagcccaaagtaccttccacaaaaaggttcccatcttttgagttgaactacacttgcattctaagctttacatttagctatatattggaattatactgatttctgttggtgtactgcagtgagtttgaggaattggaagctgttcctacatccgctgctatagatggcccccttgaaccttcttcgtcgtccactgttctagtttctaatgcccctgatgaatcattgactgattatttcagtgtatgttctctcctttaaactccctgctattgcattctaccttttattttttttcatgttcatcaaataatatacaatagcttgcctcagatcctagtaaatctttatttgcatcttgattgctacatttgtactagtatattgcttcttaccagtcacacatgtatatatgtttgtactgtcagtcttgtcacaatattgagttctgttctgaacaaatctgcagggcgctgttaatgttgggaatgtatcaattacaccaatggttggaagaactcatcagcctatcgagtctgttgcatcctcacacgtaccattgatcatcccatctgctgctcctacacatcaaatgggtgttccttcaggggctgcgtcagctccaccactgcccgtcattgacactaacgttcattctagccactcaacaaatcttgtaactccagccttttttgcacctccctcatcgtcttctgcatcattggtggcaccagcttcatcctttatgcccacagcatcaccttttcatccaacttctgccgatgctcaccgtccagcatatggacatggtacaccccttcttcaaccccttccgccgccaacaccacctgcatcacttacccctgtacacaacgatgagcctgttatttcgagggataaagttaaagatgctctcctgaggcttgttcaggtatgtttcacattgacaaacacatggttgaataacctttttctttatatatttttaactcttttatctcatgcccaacagaacgacgaattcatcaatttgctctatcaggagttacagaatgcacatgcgtagactgcttactcagcctttatggagtgtctggccttgacgagagttcacctgttctttcgtagttttgtgtgctttagttctcaaaactttatgtacagctttggcttctttttatatcggatgtccgcgaagagattgtgcagctttgtcttgatgcattattgatgtagagtttttatagcaatggctggtagtatttcttccaaatggttgtacttgtatagtatttttgtttcctgttggaaactcgaaatcggaagctggactatgtgtggcaacgttaaaatactgtccattttgtgtgatatactgcacagttgccatttagatatttgatatcacacatttttttagatcaaacttatttttacacattgatcagttctaaagatcaaatatatgtggccagagcgagtatgagtagctattgcctattggtggatatacgtaccgtggcaaacccgtggcactttgctccctcgtcgaatcatcgtcatccatcgattgttccagctgttactcttatgccattgctctacttctattctgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 38435 - DNA, 723 bp, Oryza sativa
  unsure (1)..(723): unsure at all n locations
cctgcagccgttacggccggcgaggatatgcaactttgttcaacctcgaacaacaattagatacggagtactacatgggactcccatgcaaactagtcgtgctcctacgacctaaccacaagtaatcaagtcggacacgacaacagctactgcatgcccatgattgagcatgcacatggacaactgggaggaaagaaaaaaaacacacgtattcatacagtacgtgtccatcaagttagtatattaatttttttaataatctactaatttcgtagatatatccggcatatatctacacaggagagagagaggaggaggaggaagacgtttctggaaactatccggtgacacgtcggactgggctgtcggggcccacggccacgtgtgggctgtgttgtcagggcagttaatgtgggcccacggagagacgcggttaaaatgggcctggcctgttgaggcccaattaagtacacggcccagctttctcatcgtctccttcctcctgctctggcttggcctttactgtcgtcgctaacttcttgctgacgacagtccgttaatctctcccccttagattgaatgaaacagagaaaattaattttatttttatggtaatggaaaaatatattcctcaatgccctttaatctctctcttgggatttacngaacaaggtctacgagaagtttgtcatgtttgtaaccggtggcacagttttaatattt

SEQ ID NO: 38436 - DNA, 16138 bp, Oryza sativa
  unsure (1)..(16138): unsure at all n locations
caccttgtcatttacaaggaaatatagtaatatcaggttgagttgggccactcaatgcatatgccctccttacttgatctctaatttcaggtggataagcttcaattggtttgtgaagcctggatcaccaattatatccgaatgactaaactctgccctaggcctctttggctgacttaaattctcgatactagctgaaggatctgtgttgcttgaactagaataatacgtgagtagtgttctttttaacatgttgataatctaaaaagtaaaaaggtatagaaaacaattataagtttaaaattagacaatcactagctcactgaaattgaagtcactgaaaatctgaaattgaagtcttgacacaatttctaagttctaactgtctattcagagaatcagaggttagtagtttacccactgcgctgccgctggccgcctgcggcctgcacgcctcgcgccctcactggctcgcggtcgcggagtcgcgggttgccgcctccccgacagcacggcggcgctttcccgccgcctcgccgcctcctgcgctggtcggctggccgcgcccggcgctcgcctcctgtcccgaccccgccgcggcaccgcgctgccacctgcttgacgggcgctctgcacgccggtatcgccgcgccgtgccggtatcgatgtcgcctccgctcgccggctacctcccgttgtcggtcgcccgtcagccgccgccctccgcgcgccgcccagcgccccagcccagaccagcgccgcgccgccgccaacagctaggtttaggctaggaggattggggattggaatggccggttggagacttggattagtggccgagtaggccaaaatttattccaatgggctgggccaaaatagaaagagtgagctcggggtggtcctgggctgtcttccctccgtatttctggcccaaaatcacgaatttctcttcttcaacctccagccgccccctctccagccgatctaactaacctcaagcccccacatcccataaaaatttttagtgggggcttaggggggtctccactatcccggaagcggtagtagggtctcaagacccccccccccccccgcccgcccccacangaaatccgcccctgattgctcaaatttatacattagtgccatgaacgggtggtgctaggaatggtggagaggggggcacatgttcttcctcctccacccccctcttcttctcccttccctctttttcctctccatggggatgcagcggtgtagggtggcttgaacccctggcacccatgttggatccgctcttgtttccttgcgcaagattaaaatgaattattttttcacacctatttaatggtcaactaacggtcaacagatgcaatgggtatagaagggatgaaaaaccaaaacccctgggtattgaagggaatgagcaaaacttagtgacatatacctaaattgctgaaatctaagaggtacacaaggaatttaacctttgtataatttcccatctaaaataactttcgacggttgcaacaccgtataccattattattaggaaaaagtcccaattaccttgtgaactcgaatacctgattattcatactgaacgaataacccacttgagcactgttttgggcgcttttgacttcagcctacatatgtggccgccaatgtggcatccagtcagcaaagaaaataaaaaaaatatctcctaggcccacctgtaatctctttcctcaagcctatccctccccattccccactcccctcgctttcctactctctctctacatctatggctggagaaggaggatggagagggcctcgttcaaggagacggtagtcggcggtggaggcggatcggcgcaagcctaaccaggcacgcggagttcctccttgtagtcctcctcatcctcgtagtcgtactcgtagctcccaacatctgagctcccataattgttgccttcgctgacctggagcacgcgggcaagggtgatcgctggcgtcaacctgctgagtgctgtgaatggctgccgtgtctctgttgccgctgctgccacggccacgtcggcgtcccctccagcgtcagcggccagcgccatggtggtagccgggcgggtccagattcgtgacggggttcgcgttggcaccaggcttgtcactggcggcgctactgctcccctttgaatccaccatcaccactcgcgttcatgaggacggagaatggtgcactggtgcaggtgtgtgggttggagaatagtgagcatgcgtgcctagctaagctcacgtcgatccgcctctgccgccagccgtcgtctccccgagagaggtccctatccgtcatcctccagctatagatgcatagagagagagagggggggaagaatgggggaatgggtagtggggagattggcttgaggaaagagatgacaggtgggcgtaggtttttttttttattttcttcgctaactggatgtcatgttggcagccatatatgcagaactcaagttaaatccacctaaaatagtgctcaggtgattatttgttcggtataaatagttgatggtctaaaatatttggtattcgattgcaggggtaatttagacttttccttattattataatatattttatataattcttacttataacttttgcatttaaatacgtcagttatatgcatgctatatataaaatttttacaaataaatgtaggaacttgtagaatttttagaacagatggctaatacagtttttcaaacttggcaatcccggtaatatatatacacacgtatatattttttacacgagggagcgtaaattatgggctttgcattggctaaagttcattggctgaaaatgattttttaaacgaggacttaattttactaatttcactaatactttgcaacgtatggacatttggctagtcggtctataaccaaactccgccattgatatgacgcgggccaaaaggagaaagttttactactacggaaaactccgccattgatatgatgcgggccaaaatgcgaaagttttactagtacggaaaacggaacaaagagcaaggggacggggagagaggttgccttgatcgcctttgagtcagttcataaaatcctctgtccttgaaagttaatatacttggttgaacatatatagtttttttttatttttttctagagcagtggcaagcaaatctttttagataaaaattggttagcccagttgatacttcattcagacccattttttaccaaaggatgacgtagtcaagattacaacatgaatggcattcttagttacaaagtatgtgaagatttgggaaatagaaagtgttgcatcattcatgatctcttgattagttttactgggctaatataatgcgacacccggcatgtcctaatctagctggagcatttcacatttattatggcctgtagatatagaactagactatcaattaattgttctggcaaatggacgtaacagtactcagtcataggaagcttttgtaacatggcatttcttgcaaagtcatcaattggaatcttgatcctcgcgaaagaaaattttaattggatttatggatggaccctaaacccttgactcctgatctaggcacagttgtgaagaaaactaaccctaaatccctaaaccgtgtagccacaattagcatatatatagtataaagccctcattttcttctgcattataggatatccttttgaatcaaagctagctacaggctacttacctggaaagaaggaatatccactgtaccaagataaggtaaagaaccacaatcctatgttttatctcctaattaatcaaatgaaatagagcccggggccgctacacaacacccgaggtgaatcctaagctatttcgcacgttgctgtgggagagttatgtgataaaatagtacacatgagttgtaaaattttctttgttacttattatacaattttcttccacatgcttattatatattttgtacctttatcaattatccaaaggttataaatgattgggttgtatggtgtggctattggggaggagggatgcattttgtaccttatgaatgatctaaaggttaaaaacaattgaagtgatgtggtttcataagagatgagagaattagtattaactatacttagtgaggataaactttattgatatataggatccaaacaatactttttttactgtatttgacaagtactccctccgtcccaaaaaaagacaaaccgtgggttcctgtgtcaacgtttgactgtccgtcttatatgaaatttttttataattagtattttcattgttgttagatgataaaacatgattaatactttatgcgtgacttgtctttttatttttttcataattttttcaaataagacgaacggtcaaacattggacacgaaaaccagggtttgtcttttttttgggattggagggagtagaatatttttttagtgtctatcaaagtatggagaggtaccaaaagtagcattcgaaaaaggtgaactgagagtaaaaaaaagcataaaaatgtgaaacctcgaggtacattcttaaacaaaggattgtgaaaaacctctaatttcaaattcatccctaatatcaacatctcaaagacacgaggatacacttctagaataggatggatgttgtcagattgacaacttgtgtttgtttcatatcttaggataaatttggtactctatttttctaagtttgtaacgaattttctggtactacacaaatatttttcaagcattctggaaccattttaatataatatggtggatttgctagaagaccctgtgttccaaaccactgatagtaaacacaacgtttattgagggtgctcaccttatttaattcctacaaaatttccacattcaaaataagcccttaactgcgcctaagaaacaatataatgccctatagtccctttaattaatttgttttctatgtccgatgagttgtagcttcccacctgttgagattagagagcattgttaccttaaaaaaaagttccagctagaagtggcccttatagagtagtgtaccctacttatagatttagcaacctagtattttgatttttggtaatccttttctaggttaggccaataacatctacatacagtacagaacacacaggaccagtcatctcattagagtgccctatgcccaattaatccttggcgatctctatttgcttttactaatgcagcatgcatgacacatattggactccttagtcctatcaaaagtgaaagatctctatgtccggatataaatctaactacagaaagaaatttcagtcatatgaatagtttcccaaaagaggtgatatgagccaaatcaccaaaaactaaaaattcaaacaaattaaatctgaacatgacaatttatttattttgggtatgaattccaaacacatcttaagattaaaaaaacacattttaagatcattctgaaactaaattttggtttagaaattcagggtgactatactgaaaaaatttgctcattagaaaatttcaccgtcgttcctctgacatttatataactttactggtttaggcaattcatccacttgattttctcattgttgaagaaattaagggttttaatttttgagaagagccttatcatctatggttaggagcagtgggaatttggtcattttggaaaaaagttaatggtcaacactggcgtcaactattataatggacatgtagggggttgaaaaataaactaaaacttaaggacacataggagataaagcataacttagtgacatgaatattagtgagatgaaaggaaatgagtaaaagctcgagggtgtaaaaggattttctctaaaatttaccaacttttttcctctatatagtactgatagcagagcaatttaactaagcttagacatatatatatatatatatatatatatatatatatatatatatatatatatatatatatatatatatatatatatggcaatcaactatatcagggacagttcaagctccaaaccattcatgatggatattatgataggcagttcaaaaatttaaagtaagacagttcaaagaaccacccacgatgatccatcacttttgtagtgtggaggtttgtacaccgacatcttgtacaaaatgtcatgttgaattcaactggaaaaaaaaagaggggaagagtgctttttttgaaaattggttatcggttagaaagaatattgagtccataaaattggttactggtgcataaaatgtttgtccataaggcgcgccgtttacatggccgttcacttaagacagccatcggaataaattgaaataattttcacgggcgacgggtgtcatggtattttgtttacatgggtggctgttgacccatctccgctaataatgaacttcaagtaagtgttttttatctgcctataatataaaattaaggttgagtgacttacggaaatcgtttttctactagtgaggattattttgttgatacggtccaatagcattgttagccgcacggatgatgattgcgtgcatctggtcgatcatgcattcacaaaagcacatggctcttgcaagtacgatagcgagagaaattaacattggtcatattcgagcatcaagtactactccataggggttagctagctgtcctaacactttcttcttttgacactagcgaagtgataaagaggctatatatccttgtactaattaatttatcgcattgagctcatcactatcatcaaaacagtaggggatactttttgttgaaacctacctagctatccacccggactgacccttcttctatgtgccagcattttgtacagcttggaaattgctctagcttgtagcattttgggtttgatacccataataatcagctttccttaatttataatgtcaaagagaaatatatataaatttgggagcaacactcacttgtactatatatacaatattaattcgatccgatattttattctgctgtggcttgtaagctagctgtgacacgtgaccaaagtaacggaaaaataaattagggtagcaattttatacttctattttagcggtttaaaagccaagaacaaaaatataaaatgatgaaaaaacacgtagactattttgaaataaagttttaaaattcaaatttaattgcggcttataggctgatgagctaccaatttctaaatagatatctccttaacaagttcatcctcttagagtgtctgactggtaatctaagtaaaattttaacagcactacatactagaaaagccttcttaaccaatgaataagtcagatttatttccttaactaaaaacccatgtaactatgataccaattttttatatataccatgcggattaactccctaagttcaaacacaggatggctttattcatacgtggtgcatacgtggtggtggccccacatttcagtcccctcctttggtctttcctccctgtttctctttcccgggtgtagcctacaggcacaaagaggttgccgaccggtgcgttagttaggccaatcacaatggtagtgcagtgcaaagttcacgatgaaccttgtgctcccgtctccacatgtacagggtcggctttggcaacaacagaattccacaacatgatgtggtaaggatgaagatcatcaagatggaatgcggattagtccgattttacattcctaaagtattgcgccagttcaatttacactcttaaactatgatacctaaacattcaacaccctaaaacttcggaacagacaaaattctccgcaaatcacaaggtggcaggatggcgttaattctacatggcacatacgtggcatcatctaaaccactttaaatccataccaaagtatatggttcagttcatatacttttaattgaatagtgtgtgattttaaagatcagatctatttatttattttgattcaggattgtgaaaataaaatgttcctctaactacataatcagctaaatttggaagtaaaagtagagtgaaaaaaaaccccgcatcttttctacgtctttgtgaaacagaagcccacaaaaagtaatgggctttttaatgccatttccgaattgcaaattccatagcctaaattaaattaaattccatagctataaaattcttgagaggcctgctattgtttttgggaagaaaagtctgaaaacattgacaccataatgagtcattgggatggtcacatggggatattaattgctatactgaccggcgtggtcaccacaaaagagtgtcacggtttatactctataaatagccgccttgtgaacttaacacttgaacttgaccttgaaaggcttgttgtctgcattgattttgcacaatctatgacttgatgctttcatgattgctgtcacgaagcattgagatcagactttcaattaatagtggaaaattacagatacaatcataaaccatcgatctactaggccatacaaaaatacacacacacacacaatattatgtttcaatttatatctttatctctcagaggttgttgtttccagcaatctgtcagctgaatctgccttcttccacacaaatcaatcaaatttaagtaactattgttccaaggaagttagttatgttgtactaaaactaaaattaaatcaaactcattactcatgcatatatacataaatggaaagaataacattgtacaactatgccctgcctgtgttaggggcatactcgtgggtgtgcgtgcatggtggtgtgggcgtgtgtgtgatttccgtgtaatgaaaaaaaaaaacattgacacaacacatattattttattttctgataagcttgaaataatattatcatcggtgttttaaacttcaattgattgggcaatcactgccttttttgtgttttaggtgaaccaaattatatatcatcacaaaatcacaaatgaataatacatgcaaattaaactacatacaattttgtgcatgcaaagcaacaatgaagaacaacagcgacaacagccgcgccactagaagtacccagaggaattgagccccatctctggtcaacatcccgagagcgataactctaccaattaacctgtattagacgatcactgcagagctgaaactctttcaattttgtgccactgtcacgagtcacaatattgagaggcatatcttagcggctcctatatttacgcccccgtttaattaccaatgcatgtcactcttgaacatttatgatctgcaagctttattttcaccggccactatatatgtttaaatcgatggtttacctaattaacatactattgctaaattttgatagtatcctaaatactttttcacaaagattaatttatatatcattttcgggtggccaacctttgagagctcctttaaatcgtttaattgaaaaaaaatggaagaatagaaaaaacatatgatttaaataggaatgtaaatgcaaaatagagaattagaatatacatgaaaaaaatataggaatgatcatttgaatagaccatatgaaaaacacagtaattagatatgtgagatagacttaaaaaaattcaagaggtatgttgaagctttttatttttttcaaaaatctctataggattgttcttacatagaaatttcaaaggaaattataggattcaatccattcttttagaagaactccataggattattttctataggacacaaataatttataacttctatgtttttcgtttgtttcaaaaagagcctgaaattattattgcatacatgcatgcaagttaggcagaagattgtgttgctgaaagaatgaccaaatgatctaaaaaactatcacattaaaattccaaaatgtagcttttaagcaaaacttgatgcccatgactttctctattttaatcatgttgaacggtcaggatttttcttatatatgaagtgccttagcgaggccatagactttagatcaactttacaagtatatatgattagtggtcaaagctgcatatgcttgattaagcatgccattatgccacacacatgcagatacatatatatatttaaaagaggaagtgcgcgtgtgtccacactatgctttggtaggtgcttcttagcattttcttataagtatctccataagtccatatctacaaagcttcatgcatatgggtcctaaatcatgtgtatgctatctctgataaatcactattgcagatcgaccagctcccaattctgactgtattataaatttgtttttttttcaaaacacaatacagacgcacacgcttgtataaacatctcactgcagacgcaactcgcgatcaacgggtacatctttttttttaatttcaatacaagcgcacacactcatataaacatctcacatcagactactcgtgatcaacgggtatgtcgtctaccactaaaagaataattagccataaatacgagcatatatatgtgtcaaatatatgaattaaatccaggttgataggttttaacaaaaaaaaaccctaacgaattgagctcacctctacatttattttcaacacttctttctaaacctatctttgttagaagagctagtccgtttcaccctaaactattgtgacacgactaaaaacaactacttagctccctttttctttcactgttttttcttaccactaataataaacgaaagtttcatgattatatttattaggatctaaagtacttaaagtttacattagaatagtgcctagtgtcaagaatgtgtaaacagatcagggagtattatcaggcaatttaatttagactggcaaattctagaaaaaaaatacacaaaaaatatcttagaattagtcacatcaatgcataatcaggcatcgctgtccaagtaacaggatgcaacataacttccccccttaaccaccgtccaccggcttggcttgctgctgtgggctttgacatggacgaaaccgatcgatcgatcgatggatccatcgatcagtactggcctgcagtccaggacagcagagaaacgacgccaaattgtagctaaagcgctatatctacttgttgcgacgcatgattcttcctgcgactctcgggatgatagcactgttgatgagaggggaatatatgtcccttgcttgtgatcatccctgtaacttcggatctcgacgttgccttaacggaaaatcatgtgcgtcccagatctatatatattgtcggcagtgctccgatcgataatgagtcgaatcatcggagcactgtagctttagtacataaaattatccatgctcaattgaggatcattttttttttggatttacgtcgagaaatgaacccatagcaattgagaaaaagatacaaccatagattcgttatcatgtctcgtactacagaggatccatgtccttctattggatgattgtatgtacatcatattgagaggtgtacagtggcatgctctctcttattgagcagaattccaattgccccccaacgatctgaaaacgactggtcaagccaatccatctgcagtccatccctgaccctcgtggctgagagaagattgaaatattgaatgcacttcgctgttgataacctcccagtatacaacaatatatactttttctctggtcgataatatttgacacgccgtgcaacgaccgagtaattaccattttacttaattataagacgagctgaaatataccatatgttagattaaccaaattaaaattgaaattaaaatatccagtggctactagccagcgtcagggtccatgcgtcgtccatgctggcgatgaggcaatttggccactgtttgtgtggatgattatttcttggatgcaatgattctctctctttctctctctgtgatgcaatgcatgcatatgtggtggtgtagctagatcaagaagctctctgctgccttaatggtgtttgtccaccggtttgcttccaaggggctaactgttcgttggtgtcaattcattcatgttaccaaacatatgcatatgagggagattgctacctcttcctagagagcatcatttgatggttgctgcaccggcacgatcgacaaacagtcctagcttctcactcatcaaagcctcgtgcatgcaaatattggcattggttgtattacattgaagctagcttctcatgttactattacacataggggcagagctagaacaaaatgaaggggttcaactcgcttactttactctggtttgaatcaaatttaacttaatacgggtgcctaagttatatatatggtgaaaatagataaatatattgtagctaaaaattttttaaaccgggttcctgggcaccccctagctatacatagctccgcccctgattacacatactctcttccttttttttttcttacttgtcatttaggaattcgacatcgatacaatcatatatgttttacagttaatcatgcactcaaaacataacaacatcaaagtaccttaatttcacggtgaatcgatagtatcatcgctctatgcaagatcagatcgagaaagtattcaagttattcttagttaggactaggattgagaacacacaaaaggtaaaaaaaaaatggttgttgatatggtatgagattgtgttgtggataggattcatattgtcagtgtcatgggaaagggatatactagttgtcatagagtctgagtaggacatgactactcaatgtatacggctctaagacatcaaggacatggtcagccatgagtatggtaccatgaattcaagagggatttagtagagtcatgggtatacaagaaggatccctgatcccaagattgccaagagattctgatcaaacttttataaatcaatcaagcttacatacatacataggagccatgccctcgttattagaggagtctccatgattaaccttaccgctagctagggcttaataatgtttatacaatatatcttttgtcctaaaatataacaatttcaaaccagattaaagatatgatcaagaggtttaggttaagaaataggttttgggatagtctacttttaaaataaaaaatatgaaaatctcaaaatagtaaagatatgaaaatctcaaaatagtaaaaatccacgatcatatccttcaaagaacataaaggcaccatgtataaacataacacatgttgggacattaacccgcgatatatacatccatcaccaatatggaaacttaacagccttatttttatgaatcaaccaattaactcggataaaaaaaaaccctccaatatctaatagagaatgacaaacgggcagggttcaccaaactattttgggtggggttactgctaccccgcaataaggtggttatcgcagtattaagtggttaccataaaaactgtatggttaccacgagtattaccataggttcaaaaactgaaaaggttaccgcacgtgataaccgaatagttttgcaaaccttgcaaaagggatcaagatgcatgtgtagggtattggtggactcgtctcatgtggtgacgtttaagtggtaatggtcagtactactggagaaatgatctttactgggtcgacccaaaaccacaatagtcccggttccaaaaagaacctagactaaaaatgatctttagtcccggttgaaaaccccacagccattctatgatctttagtcccagttggtaccaccgacagggactaaagattagtcatctttagttccggttcatcccctgtcagtggcctatcagggggccaaggatcattaggacaccaaccgggactaaagatcaccactcttagtcccagttggtaatactaaccgggactaaagatcaagtcctggttagtattaccaaccgggactaaaattcaatacgtagtatataatccctcgcacttatcctctccaccacaatcgcaaccacatcctcacaaatcccttcctcctccccttcctcacacttatcctcctcacagatccctctcctactccccctcctccccttcttcctcccctcccctctccttcctctcctcccttcccatccggcggcgggcaggcgggcggcggccgtagcaggcggcggcgggcaggcggggcggcggcgggcacggggcgagtggctagcagcggcagccgggcaccctctcctttgccggccggcgtcctttctcctttttttttggataattagtgattcactgagatgtataattttgtgattcattgcatggatctgagatgtatttgatttgtgtgtatttttttaggatttgtgatatatttgatttgtgtgtataagtaacttaagatttgtgatgtgaatgatttgggatgttacattgaatcggggatttggggatttggggtttgatttggggataagcatggcactcgattcgggagaaaatacaaagattaactctggccaaagaaacaaaagaaaagggaccaactgggaccgctaccctatctttaatcccggttagtaataccaaccgggactaaagatacctctctttagtcccggttggtaacactaaccgaaactaaagatgggcatctttagtcctggatttctagtcccggttggaaacccggaactaaagagggttgccaactgggagtaaaaacggtttctccaccggtgggtgccaagaactataaattttattcgctaagatgatctaacaaatgcaaattttgtttaaaactcactagggcattgtaaatcttaaattagagtaaattgcatgcacggtgcaacaagttgataggtgggagcgatttagtgcaagaacttaagaatgtgacttctaagtgcaataacttggcatgtgggtgcgctttaatacaagaatttgataatttagtattttggtgcaataacttggctagatatgtgctattttggttaatgagagctatgcaagttcatgatgttaatatccacatagcaatcccgtagatataatcaatgtttgatgtaatctgtaagaatatattgctcacctaatttacaccatcgatttagatatttttcaccatactcaaataccaactagaaaatttctacacagtaaaatttatttgacttttaattactagagtgacaaaaaagaatattcttgtgcaaatctacataagtatattaataactgagcacatatagccaaaaaatactcaaaataattaagtttttacaccacttctcaagttattgtatcaaaatcacacccacctttcaagtagttgtacccataagcttatttattaagttttgtttattaggttgcacccacttggcaagttgttgtcctagcatgctcatttctcaagttcctacactaaattgcactggatttttcacaattcggtccttttgaaaaatttatttcgcaaatagaccgctgaaaatcttatcacgaaaatggtcttttttagggcgccagagtcgctgcctctctggcgccgtcctccagcaaccgtggcaggtcggcgctgaggtggcaggggagcgcgtcgtcccgttgaacgacggcgccagcgactctgtggcgccgtcccgttggacgacgcctaaaatggactattttcgggataagttttttttagtctatttgcgaaataagtttttttcaaaaatagcaaattgtaaaaaaaatccagctatatcgcatcaacttgctaagttgatgtaccgtaaatgcacattaaattattatggaggccaagcccctgctcgtctcctgttgtctatgccactcgatttcaggagcaataattgaataaattcgaataatacaagtacatttatatacatacatgtttttttttgcttctatttaaaatagtgcagactttgtttcggtagtactgccagattctatatctttttcatgacgtcaaaaacatattttgtacaggaaactttagttttttctgtactgtatatgagtatatccccacattttcctgacattggcacacactgctacgtacgaccactcatggttttgacgtgtgtacttgaatatgtctaagatgcagcaagtgggaacagtttatactcaactattttttggatttgaatgatcgggaaaccaaaattaa

SEQ ID NO: 38437 - DNA, 6341 bp, Oryza sativa
agccaacaaaactgactgaaacgaggagacatagtatgaaaattcaagagttaagccgaaaccctaccaaccggcaagcatcccatgacttgagaagatcctcaacattccgtatgatgtcctgttaccctttattccaaggctaattacatttgacactaactacttaaggccactacctaattaaacctgaaagtgtgtggagtgcgttttggtcctctgttcattttttcgagtgacccacagcgtatttttctgaaagaattggcattcagacaacgcggagtttcattaaataaaacacaaaagaggtgaggggggcgatggcgattaggtggctggtggccggtggaggtgatgggggccggcggaggtgaggggggcgacgtcggcgagtaggtggccggcggaggtgttgaggacgacgtcggcaagtcgtaggtggccggcggatgtggtgggggcaagttggagtaggcggctgtggagcagaaaatggttgttttggccagcgaggagctggggaaggtggccggcatagtggcttggcgaggtggttggagtgctggaaggtggtcggtggtgttgccgcttggagaggccgtcggtgatgcagtttgcttgttggaaagccgcaggacacggggaacaacagtgtgtatgtcggcctggtcgacggcaagtgatcctccacgatcggctggggcttctcccgttccctggagctcctccccttctgttgaccggtctctcaaacaccagacgtggggagtttcatggcaagggagagagccagtttggttggaagagtttttgattggtggagttcgggagccttcatctctgctggtgctttgattgttcttgcgatagcgagatgcttggtatggtagagaggtgctgcacgagaccccgcgacataaccttttgttggtgtttagggtggagtcggagctgcttgcctaggggtggcaagcttggcaacgtaaccccctttgccttcttggtagtttcgttggggttgttgtgcaagtggcttcccagcggggctttgcattagtgtgttggggggagtcgtgttggggggagtcggagctgcttgtcagaggtggcaagctcggcaatgataaccctcttccgctttcgtcatgtcagtgctatggcagcttgggttgttgtagttggcagggagagagagctagggcgaaagccctgctcgatcttgggtgagagcccgcgatgtcggcgtctgtgggctccgttttccttcttgaaaacatcgtacctagcttgctttcccatttcttcgggtgaaaccttgttccggtgttcggacggatgttgtttggcattgcgacgctaccttgctcgttggaggcttcgtcttaaggaccctacgctactttgtctgtggtgtgttgttaggaagtcggagctgctcttatgagctcggcaacgatgacctatgtccttcagttgtgctgtcgcaagtttttggtttgttcttcgtgtgggttttgctcggtttgcccttttaaactgtgcttatgtgaggtttttgggcccggtttttcctgaaaaactggaccaagtctctccttcttaaatgaaaacaggcactccctgtcctctctgaggttttagttaattaaaaaaaaggctattagactataactttgaaagataaaaaaaacaaacgtaccaccacatgcacctatgtcgcccacatacaccaacaccactgaggaagggatagcagaaaccagccattgctagatcctataaagagctacaaaacaattgagcaacgccgactccaagcaactgaacattagcctcatagatgttgccgaggcaaaaggatgcaaatagagagagagcagaaagatccctctctcttgcacaagcccaccgacttgccatcatcgaagagcttcccacatattgtttgagagtggatttggtgataatgtgcaccccccccccccaagatgacgtttgcaggaagaaacacgactaagggtgacaccgtccgccatccatctaggtccaaaggaaaccaagacaatgttttgatctggtgggtccaccagggaggaagatagacgtcttgaccacgtatccaagagtgaaaacgacgctcaaatatgccgtttgtcggaataaggagactggtttatacttttttgagataaattaagacaccttattttaagataaaattaagtcacggctttttagtttccattagatcaaggtccagtagggatcaccacacaatccccaatatggatgaaaaattcaggatttaattatgtttcacggtgataatataatgtgatatgccgcctaaacaatatatatgctgccgaagctgctaacgaggcatttgccactgcaattcctttaattggcagacatcccacaattttgggtatagcttgatgcttctagatcctctttaagcccgcatatacatggaaccataaatttaacagaatccaataaaaccatgtatagtttagttagtgggatgagaaaggactgcatggttgttctcttggataagggacgagatggttaattatttgtttgcggtacagggaatggatatggttttgggatggagtgggacgaaccgtacgtacgatggtgcgtaatttattgagatatgactgataatccataaacaaagcaaataaatatgttttacgggtagaactattacatctgtattattaggtgtataaaagtcattgttacaaaaattaacaccaaaaatttaaattttagctacaaataagatagctaggccaacaaacaaataatgagcaaacaaagcaaactctctccaagagcgaaagacccaacaataatgaaaaaaaaaacgtgcagcctatatattgtgagtactagaaattaaactcatataaaagcacatatatttgtcatgtataaatggcattaagagtctctatatgtacactttctatttcatgataccctaggcacatattatatatattttacaacatataaatagaaaaattggacagttaaaccatgtcgatattttaaatatatatgcacagttaaaatatgttatgattctgatatttaatcaaattgttccaagatgaactatctccctctaggattctagctgtctctgaaaaaaatactatagcttccataattttttgactttttattgagatcaaacaattaaaactttgcctatcaataattttctcaatatttattttagagacacttttttattgagatcaaacaattaaaactttgcctatcaataattttctcaatatttattttagagacactataacatgatatttagattaatcttaaaaagcactccttccgttttgtattgtaagctgctttaattttttttgtcaaacatttttagtttggtcaagtttataaaaaaatttggtaacatctacaacaccaaatttattttattataatattgaatatattttaataatatgtttgtttataattacttaaaaatatttgaatagaaaaaagtcgaaacaatttataatactccctccatcttttttttatagtcatattttatcttggcacacagaccaaggataagtaattctacttatcatctatttaaacatactactagccattcctcataaacaagcggttcattaatatttacatttctcgatgcccatgtagccaattttgtgtggaagaatggagagtcacatattaaatccgagaaagtcattaagatgataggttgttggattgaaatatgcctatcaaaaataattttttcagatttgaaaatataactatcaaaaatagatatagggagtataaaacagagcgagtaatttaataaaattaattatacctaaagatatatcttaaagatcatgctgttataagtatgttgagaattattgaatatatttataaaccgagatagctctatagctagaaaacgcaaacacagggtagggccccagttaattaatcaccgacgcggacacacaagtaaccggccggccgttgatcggcatgccagtagtacactaaaattgtaaagtacgagaaggcatgcagtgctccactccactgatgtatgtaaacaaatttaactcttgcagctgatgggccatcatgctagctatgtatgtgcataatactatgcatttatattgtttttttgctgcaagcaccggcaccgcgtgccctccgaaaggtgaggaatatgagttaacaaattgggagctgggactatactgactttcctcccaatttcgccttagccatagcttagcttagccggccgaaagtcagagaactctatctctcacaggtagcagtagagtatactactgtactgtacactgcccatgcatgcaaccatgccgttgtagtagtagtagtctacatgtacactccattcatgccacatacatacatatacatgtagatcgagctacagcacttggttttggtttgagaggttttggatgcagatcaggtattaattataattaattggtcgtgtggtctaacagacacaccatgcatggaccttgatgtgttgtcaacttgtcaagtgtgaaaccttaagattgttgtgattgttgtgctaggcctgccggtttgtgtgatgacccttagaaagatttgcaaactgtgacaactttgcttcaaactatattataaagaagacatgtacaatcatgctgccatgtacacatatgctaaggtagtgtgcctccataaaaccaagaatggacgatatgtggtaaatctgttaaattgaaagaaatctctattaacgcaaacacaagtctggataaatggaaggactagggtttaaactcagctggttgatgaagtatagtgtagaagtcaagctaggtatggtcctatatagatagagatctttgcgagattcaatttatcagatgatcgatctcaccgagagtttttttttccaaaagtatttttactgaatgaacttcaataaaatttgaaaaatcaaatggatctgaaatttcctgcaaataatctaaataatggtcaatgcaatgaccttgagaaacaactcatcacctctgactttaccaccgaccaagagctggctccttcctacaaaaaggaataagttttaaacataacactaattttatttggctacaatattttatatagtatgtgaaaaaacataccaacaatctgacttgtaatttctcaaaaaatgaagtcaagatccattcaacaccaaaacatcaaaaatatttttttatcccaaattggcgcccacaattccacttctattaacttaagaaaaagacactccattatccatccaaaaaaaatcatttctaacaattctcaaataaatcagtagtgagacaatggtgccaatcattaatactctttgttgtatttcctaggctccaaattaatgcctatgttttagcattattggctgtaaaatgtgtaaatgaagtttttgtgagaaaatttgaatgctagaaatgaaatctttataggacaaaagaagtagtacggtagagccaatgccagaactgaaattagtactctcaaactatattcagatgcgtgtgttggtttattttaggattcgtgcataaaagttggtttattttgaaatgtaggaagcacttatacctctaaaatccatacaatctcttctgttccaaaataagcgcgccatatagttcaaattatccaaaataagcacaaccgtgtagttcaaactttggactatatgtggctgcgtatattttgggacagagggagtagaaaatatcaagacactaatacatttgtcaaaaaataattttatatttttaatactatttctacgactatttaattagttcttttttataaaaaaaaaggtagggtcgaaagacggtgccgatgtccaacggtccaagacatagagtgaaaaagaaagtatacctccacacacctaaacaaacgatgtatcgatcgagtgcacaggcacagctacacacgcgctgagagagtgctcatttccaagttttcaaccaccctctccctcccctatttatacccccctcccgcccttcactcccttcaccaccttccccctcctcctcatccttgccttgcctagctactctcatatctcaccctacttacttacttcctcgctctcgctgtccctcgctcactctcacagtctcactccggccggtcaggcgcgggcggctatggcggcgagggtggtgtgggtgaacgggccgatcgtggtcggggcggggccggcggggctg

SEQ ID NO: 38438 - DNA, 77375 bp, Oryza sativa
  unsure (1)..(77375): unsure at all n locations
tacacacacacacacacacacacacacacacaatatatatatatatatatatatatatatttgatatgatcgaattgagcgccatgtctgacctgttgctatgtgatggcaagaaggtgcacgtcctgccgcgggagatgctgggcgtggcgacgttctcggtggccgtcttcctcctccggttcctgccgctgtgggtggtggacaggatcctggtcgtcctggcatggctcttcctcggcgacctcgccaagatcggcatcaccaggccatccagggggcccctcgagctcaagaacaccagggggaggacgcccgtgctcgacatcggcgcgctcgccaggatccgctccggcgacatcgaggtcgtgcccgggatcaggaggctcctccgcggcggcgccgagctcgtcgacggccgccgcgtcccggccgacgccgtcatactggccaccggataccaaagcaacgtcccccagtggctcaaggtaaattcgttaattaattattacttaaacttactacttactagtattattaattgcagttacgatagtgggcagcttttgaaactttaacgtaacaatatttaatcggaactgagttttaaaagtgaaaacaattacggaaagaacaccacctaagttccaactcaaagcttaatttattctccaaggacttaatttatgagaggacaaagcaaggtgtattctgccggaaaaggcttctaaaaaaagatggataatgatgcctaacaaagttagggctttctaatgttaatttggcagttagaaagatgttaggtactaaaaagtgtgctccatgttgttgtactttattttaatcacgaaaatcatttcactgattaatttcttaattgcttgtcatgattagggaagtgacttcttcacacaagaggggtacccaagggtgccattcccagatggttggaagggggagtcagggctctactctgttggcttcacaaggagaggcctctctggtgtctcctcagatgctgttaaggttgcacaggacattgccatggcatggaaccaccaaaccgccaccacaagatgattgatttaacttgctaaggaattaaccatgatcagcttgctaactgcaaacaaattgcaattaatcaaatatcttgaggcgcaacatggcactcaactggctaagaactgcatgctacaaactctgttcagagacagacaccaaaatattcagaaaccaagtcagggtccaaaaaaaaactataaaacaggggggagatgaagcttcagagtagatgaagcttcagagttcaggagatggatgccacaacaaaggggaaaaaaaggggtgctatggatgctaggtttaacattgatgaggaggccagattaagatgcatcaagtagagcccaaattttgttgtacccatgggcctttatgtacagaatgttatgtagtggagcttgtgtacatctaatggttggtagggaatctagagttgacattcatatgtacttggttaatgtttacgtaatatggaggtgatgatgatgagacgcaatttcgatttataatatttcttaagtttttttaaaaaaattaataaatagcctttagtaaagttgtctgtctatgctacttggaagatgcttccttactctgccaaaaggagaactacactatgcttcacttatttataattgacaacttgatatcccgtaataatagctgtaccgaataatgaagatttctggttagtcatgtcagcagtctcatttggttatgtctcaagtcttgtcacgaaaaacattccccaatcgatacaacattccaccgagaacgcccccccccccccctctcgcagcagcagctttcatgatctcattgctttcgtgaaccacttgattaagagaagtattaaactgttggtatttaatatgaatacagctcttacagagcatctgtaggatgatccaatggactgattatccagtagacaattctatctttatcctattgcataactccagaactttttgcataactccaaatgttaatcaattaccatcattatctgcgtcctcaataaatgcaagacatacaaagttgattgctgaaagaaatataaacattttttttttacttttggcattatataacattttgatcacaataccagacatatactctacctagtgggatgcaactttaaaggaaaaaaaatcaatcaagttatatacaaatatcagataaagctattcattaaaactttgaaaccttccctgtgtttaaagagataataccttacatccgagttttcactcattccttccatgctcctatgatatgtttgatcccctgcagaccattaagtttcattttttatcttgtatgtgtccagagcttcatcttcttatcccctgcagacagttgagttttcactagcagctggtcgttgtggccagcacaaaagaacaattgccctccaatatttcttcttcctcgccggcttcttaaacttgtcctgtttagagttttgacatattgttaataaagaattaatcttcagttcatatatgtgattgggtatttcctctaaggtcattgccagcttgagttgggaactcttcaaccatggcacacaaaacgaaacgatggtttagtgcatgattaattaagtaatccctccgtcccatacgaaatcaacctagtactggatgtgacacatcctagtactacaaatttagacataactctgtccatattcgttataatagaatgcgtcacattcagtcctaaattagttttttttgagacggagggagtattagctaaaaaatagaaaaatggattaatatgattattaaagtaacttttctatagaaattttttgtaaaaattgtaccgtttagcagtttagcagtttggaaagcgcgtgctagaaaaacaagagaggtgaagttggaaaagtaaactaaagaacacagccttagaatataatcgaatggaaagttatgtacatgtgaggaattttgtcatacatacaagtgactaaagagctatttgtagaagcctataatgttaatttgttgcacatgaattgaaatttacctcgtaattccaaaggtgttgctaaaaaaacatactccctccatcccaaaatatataagaagttttagttggatgtgacacattctagtactacgaatctagataggcagcatgtcccatccaaccaaaactccttatattttgggacagggggagtagatgaaaccttaacataaatctgaagaaaaaaaaaacagtgacaataacattggtgcaaatccttcattatgtgctgtttagattgtacaagtagtccttacacctgcctttatttctgcacaaggcacatcttaatcattatggaggattcctggattgcagttttgactacttcatgccagcagcccattgactcgaaattatagtttcttccttctcataaaggaataaactataccaaaaaaaaaataggtgcagggcctaccagtctgccttcctaagatcagatggtgaagtgcataccaatctagtcaccatttaaggtgttaaaaactttggaggatggaaaagacactatggcatagcgcgtgaatatagtattttaaaattttgttcatagtatggaccccaactactccaccccatgaagattttaattttcctttttcatttgcctcacaaaaactccatctttaatgcaatcaacgtaatgtagtttaagaagtgaggataaatatattggagtttaagaaaataggagacaaacacgttggagtgtgagaaagtaagggctgtttagaaaatagggacttgcccaagcgcctacccaagatcagattcgagggtagataagaacggagcgaggttatccccaaagagagacccttgtagcctttttgggtttatattggtatatgtaagataggtaaaaataaactcttttgagacggaggcataaaacattgtatgcactatataactataagtaactgctgctaaaagaattcagatcacctgccattgatagtgctcatagggaagttcacaagagatttctgggtagcaagcgtaccagaggtgtagaagagcgtggccactggaaggggaatgaatatatttgattttgcagagcatcgataatgccttagctgtatctgtatcgatgtacgtggccttttcaattcggcaactggatacgtcagaagcctctgtcgacttgcacactgcagcacacgattatcatcagccagcccccgtccgctgtcagcaactgcacaaggttcccccatcgactgttaggacaagctatagtatgcccattgtatcgtactttgaaccccaaaaatcaacgtgccacgtgcacgtgtccgtacacgtgacagggacgacgggtgccctccaatatcagccttatagtgcccagcttcattagatgatgaatgatcagcagcattctaattgcctgcttatacttatacacgacaggtgcccacgtagtatgaatgtatgcagccaaagtgggacgtacgtatgtatgtgagtatgtcttgacattatggtgtaggagggggatcagcaggtctggtctgagctgtatcggagaatttcacggtgtaagcttcgggagacacgctcgctcgctctcccatgtggtccaaatcggtgaaagcatcaacctcattcagcagggccgtaactgtcaaatgatgatgcaacatgccaggtgctccaacaggattagtccccaacttcagctttcaaacattccttctcactgatcatcccaaagctggtgcatgcacacacgcacgcggcatgctgtgtcatcttaactgtcatccacacgacgacgaacagcccactcggttaaggtccagcgatggtatagcttactctagtgagattttcgtgttttgggttgaacttgagagtcttgatatacatagccaccatcgcaacattagcttcctgagcaatatgagacctgagttactgccaccatccatggctgataaaggacaggggaatataccaatgacaaacaggattgtaacagatggattgaagagggtgagggaggggggatcacctagatggaggcgcagtagggtggtgccaatcacgtacggacaggcagccaatccgagtatccaacaacgcgcaatcatggcgggggtgctacgggcaccagaacaggatgacagaaaatgaaatgatccttccatcattccctccatcctgttttttccagcctctgtgtcccattccagcgatctcactggccgcgagagcgacgtcccaagagggcgacgcgcccgccccgcccagcccgcggggccacgccagaaggaataaatggggatcccggccccagcagctaccgtcgctgtcccgaaggagagcccaaaggtgccgacgggggcctcgccgtttgccagctctgctagccttgcccatgtgacagccacatgatcccaccctccgacatggcgcccgaggcgcggcgctgcccggccttggccgtgcagtggaatcgcgccgcgcccggagcaactgtgccgccggctggctggcctcggtgctgtggtgccgccggcggtcctccagctggcccggccgccaggatacttacttcttgctcaagtgcgtacttttggatccaacagtggcgcggtggatcccatccacgtgagttcttcatgggcagacggggctcaatagcacaaggtacaacttcatgattggctggttatcagtgctctgtcaggtccacatcacaattacttcgtgagggcaacccacaagacgatcgagaataaaaatgaggttacaatatgggtaatgagcaatgcctgtaagaattgccgtttgatagacggaatgatagatgccaggaactggtggtaaaaggcaagcatgtacctgatgtgaaccatctctgctgttgccttttgtgcgaaattacctcctttgagtagagcaagccagtccaaagaaagggcactgtgtatatgtatccagctttcctgaagcagaaatcaactcagaagtggacaagcctctcaaaacaataatatttggtgtaggtgagctttataatcatattaaatgactcaacaagctataagtatgccgctatctacaagacaagcacgagcagcctacacaaagcatgtttaaaccagaataattaagacatggtaccaaaaaattcagatgaaaggctacagttcctcaagctgttccagtcaatagcatgcttaaattgagattgtgctcttctttgtgcatgtgtgatggcgaggacctaaccaacatggaactgtacggccctaactttgcaaaatcctgactcacaagtcaagatattctgaaaagggccacaagaccaaactttctgtcacctcagaaagtgaattcagtgacggcccaatcagggaaggactgattgatctagatggcaccttgctcatggcattaaccaaagcaaagaatcacttttgacatcagttccaagcaatgcgggagaggcagatgaaatatgacaattatcatgacgcaggtctgacagtttacctcttgatatcacatggccatctgacttcctgtttccactctcacatctgtctgggcatcaaagattactgaaaagttagccaaacaagctggtaagaacaaatattttaatcagaaagaactaaaacatgaaacaatggaacaaatgattaaaaattgaagtagcaaaaacaaggggaaatataaattgtcactccatgatgtcatggaaatatgctacatacattgtttgctctcatcatcaggaacacattaacatagcacaacacttggttcaagccacaagtagaacacagcaacatacacaaatgcagatttcataacaccatcatttatgctttcctcttaccatagcaacaaaagcatgcaaaattaccacaacacctactgcaagttcatgccaataaaatggtggccatcttatctcgtttggatgctaaaataaagctttctactcaagggttataatgccaagaaaagccccgtctaccattctaaatacctttcataacacccatcatagaggttagcatgacaaaacatacgaataaataatgggtcaaattcaatacatgtattacagtattgttcagagcaagtgttagtctagtaccgacctccatctggatacagtatggggaatgattacgtaatgttatgatactgaatggctggttataatttgcccatcatatcttgtataatgatagatgggtgatggcaactgaacagaaaataatgaaattgacatatcaagaaaccggatatgaacaaagtcttgaacaaatgcattactatacaaatatatccagcaatctttacagaaacaacagagatttactgtcaattcatgtcccagcattatcaaccaacattgatcactacaaatgctcctccaatggtaactatttctataagcatcactcaactgcaagaaccatatgaaaatggatcgcaagtaaataccaagcacattcacaaacagtgaaaagataagatgaaaaggctgttattgttcaccaactactgatagcaacctaacaagccaaaacaagaaaacgtattttgaccatgttctaaatataactaagaaagcataattgtgaacaatttcttgagagatacagattatagcgcataacatagaccagaacaataatcacagattaataacagatacaaattaaccagcactgatgaacaagccaaatggcattccatagaccagaataataatcacagaattatgacaacaaagatctgtacatctcagcaaaatgttacaacaatagaccacaagttttaaatgcaagaatcaggacaagttttgcagtagaaatagagaaagcctctggatgtcatacctgctgttgcatcacctatgcaatcaagcttaatgtgtacacagggatttatctgttttgtaccactcaattctgtcacaatttgaaagccacgatcactgtacactgatcatgtaagcgtcgaagcaacttcctcatatgacagagcagggtttctctattcaatgaaccccgattggttttcaatcatggaccgctatgcattatcatttcatcacttcaacacgcggtttgtaggtgtctacaagataagattgccagattgatggagatttcgcggttgataatgacaaggaagttacagaagttgcaagcataaatcaatatgagggtagctagtgaccactcagtaattgaacagatactaccatgaaccagatctcccaatgaggtcagagagctaaagtgctccccattagaatatgttttattatctggtgctagtgttcatttgagtcatacatgcttcatatgttgtttgaagttgaaaaccctacaaacactcaaagaaaattgagaaaaaaaatgaacttgccccagaaatggactgatactcataaactgatcttggtcttggaaaacatcccctaagatataatcaaccctgattattatcattcaaacaaaatgcattaaaatgcatattcattaactgagtgaatagaaaccaaagcacagaatatgatatttccaacaacatctgcataccacaaacccacagcactgcattgtatgtacgatctggacatctcgtgtagcaaaccccatatcaactaagcatggcggtgttatctaattcagtaccaactaattatgtctatagtcccataagcactccaagcatattggattaattcaaatattttataacatgtggaagacaatctagtggccaatggttgttggcattgcccacagtctaaggtctaatggtattgcatctattttgtagtgccaagtatcttatcctcagaatccaacatttaaacttgatcagaatgtcttcatcaataaggcatacttgatatgcaccaaaataaatttcaacaaccagcttggcagtctactggcctggtaggtgaaatgtcatttttccttgtatgttgcataatgccctttacttatatggttgacataaattcctaccatgcatgcattgcaaggagtactagtattctagtctaaaacaagtacccgctccccctccaacatattctcaagtagatattattttaaaatgggtggagttaaactccaaaagaattgctactaacaatacccaataatatatgtaaaaagtattagtgtgaattgcagtctgcacctcctttaaccaatcttttcactttcaaccctgtcttcgatcttttccttcaccttgaagcccatgtgctggttccccaccacagccattgtggaagctaactcgctggcaggtctaccacaagccaccgatgtgctagctggcctcccatggttgggccacctgatctggagccacaatcgatcatcctgtgcctcactgtgcgccagtccagatctagagcagcctggagaaagaccagtcgggcagtgcagccaggggagcctcgcacaatgaggaactgggctgaggctgttgctgccattcattggtgagagaggttagagttagactactatagagccgcttgtccgaagttctctgtttgggtgaatttttagacagctttcaaattacttcaacccttctcagacaaccagacagaaggcccaactcgctgtatttattcttattgtgtgatgaacatttgtcaagtattagtccaaaatactcaagaccacagttcctttaccgagttgttcttgttggtattaatgctcactaggtgtcccttttgctgttggaacacattccttcatgagttcagaaacttgtgagcggctggactgaagagaaaatgagtatgcgggtcaggaggtgctcattaaatcaatggtgcaagcaataccaatatattctatgagttgtttcatgttgtcagtttgtacatgcaagaaaatcatgatcagtaacacactggtggaccagcaatgctgagaagtgaaggatgtgacggcaaaagtggaaaaccattcaaaaccaaagtcaagtgcttgaaatgcaggggtgaagattgcgaacaaatgcacaatccttatgggccagggtacgaggagagctattatgagtgtagagaagcataagatcagaggcttaatcaaaatggtggaggagatcaagtggtaacaaccctttgtcagaatgtggtctatcttgatttcttgagtagatgtaactaagaattcttgaattctaagtttctgtggggaggcccaaagaatacattgcaaccggtgtgggcaaggatgtaggttttgatctagaagaagcaaaagaaactaaggaatctggtaagttatgttgctgaaccaataatggacacctttagacgtcacctatgtcaagatcaatatgcatatgggagttacaatgaagtggaaaagattggcacttcaaatgatcattagagtagatcttgaaaagttttaaagtgagacacaggctcgctagtactctcacttggccaacgctcttgtttctgaagtttggtgctccgtgatgttctctgcatgacatcagagctatgagaagtacacgtgctaagctagtacctggatgtaggcaggcctgcctgtgggagctggtgcttggtttcctctgtaactgcgttgctaaggattatgctccttcatatgatgaatgaaaatgaagcccctgattcacgaaaaaaaagggggtgaaacttcagtcataaaatgtgacattagcagatttgtggccagttttatggagatctaacagtcattatacttctaacagttttatggacatccaaatacaaatagtaatggtcaaggatttgtattggagactgtgtcatcacgtcataaatgacaagtaaaatgaaacagatggattacttttgtatgatgacactatttacacagcatgcagttatgcactgttatatataaaaataacaataaaagatattgtcaaacatatttggttaacaatttaacatgttaccaataagcccaaagcagggctcaaatctcaacaggaacagccaaagaagactgtacttccaatgttgtgttttccacaaccccgtttctaggtttccctgcaattaccttttatataaataggtctacaactgcttctaatatacaaacaaaactccaaatacataaataacagaaagtaattagtctaaccccttccacctaccctctgaagtacgaaacccagtgttgttcctctaagtgatgaaaaaatgattcaaataatccccagcagcgggtttggaggcggcaactaacgtggctatgacatggcgatgattagttcccatgtttcagtgttcactcccatcttcttcctcagttaataccttttcccggtggccagagtgcagctgcactcagtaaccgaattgaagcagcccagtggcaatgagcaaccatgtcagcgccatttgctcgagtcattgcacatcaactaccatactgggaaaaccaccccaggattatttgaatcagttcccatacattagggtgttaaagacccaattttgtagttcaagggatttagtagacagaccatactacgttagttgtatagtagactttttcctaacaaaaagatggaattatgggttacttgtgcatgaggacatcagaagaatggaaattttggacaatttcatcattaaggaacgcaatttgtcgctttagaaagcagactccaatactagagggtataagacaatgagtatacaaaactaaagaagcactgtagctgtatttatatatcaaagcagcctattccaataactgtagtgtctgttcatgtccaatataacaggttccatagcacaaccagctaaacaatgctgctagggttcagggatatgctgagaggaccattaataattcattgcaatcattattacctcattatgttggatttatccaactaaaaccagggatcttcttcaatgccccttgtttaatcttagccctcacatgttcgacaatattccagcttccatcaaaggcatgcagattagatactgagacaagattagatgggttcccttcttccagtctaagaaggtatctgcaggacaaatcttgaatttctttgttattgtgaacaatggaggcatccagaagtgctccccagacactagggcctggctctatactcattgactttataaagtccaaggcctgattaatcatccccgatcgaccaagtaaatcaactatgcaagcagacatctcctcagttggatgaactccataatccttcaccagagagttgtatatctcaaggcccttaaaaaccaaccctgccctagaacaagctgaaagcacacccaagccagttatgctgtctggcttaaccccagaaatatgcatctgatcaaacagggcaactgcttctgcacccttcccatgaaggccatacccctgaatcatcgaacaccacgagatcacatctttgcaccatctaccatcatcaaagatctgccgtgcataccacaagaccccgcatttgacgtacataacaatcaaagcattgttcagggatacttccccagacaatcccatcctgaccgcaaagccatgcacctgtttcccagcagccaaatctgtgagggcctccacagctgagagcacactaatcagcgcaatcctgtttggcagaacagcaccgatcacccacattgcccggaaagcatccacggcatcctcaaacatcccgctctctgtgaaccctccaaccattgcagtccaagaaaccacattcctctgctccatcccatcgaaaacccggcgtgcatgtcctggttggccaaccctgaagtacattgacacgaggctgctcccaacatggaaatcgcctgccccgcacatcccactcttcagagcgaagcaatgaagctccctgccccggagttcggactcgcacgctggcaggatcgacgagaccgtgaaccggtccggcacgcacccgtcctcgaccatgtgccgcacgacgggccagacgtcgacacccgggggcgagtgcgagatgagggtgttgtaggtggaggcggtgcgcgcgggcatttcgtcgaacagcctgcgcgcgaggcctggcgacgcggcgcggaggtagaggaggaggaaggagttggcgaggacggggtcggcgcggaggaggccgaggcggagggagaaggcgtggaggcacccggcggcggcggcggcggcggtgacggaggcggagggagagtgggccggcgggaggagagaggcggcgagggaggagagcgtgaaggcgtcggggcggcggcgcgggaggaggaggcggcggaagaggtggagcgggaggtgggcgtgggaggaggcgagcgcggagaggagggagttgaagaacgggagcgggacggcggctgggtcggcgcggacggcggcgaggcgcgccgccacggccggcgggagaggccgcatgcttcggtttcgggatccaggcggcgccccgccggtgcccggctggacttcccacaaggcaaattagaaaaaggaataagttcaccggaggtccctcaacttaacagcgagattaacatcctttaaccacaaacccaaaatgtgtacctctaaactcaactaaactgtttaaaggaggtcccatggcagtatttttgtccggttttactcacatggtatcctaatcagcaaaagaaattaaaaaaattacgtgacatcctagtcagcaaaaaatacttccatgggaccttctttgaacagtttgactgagtttaggagtacacatttctgatgttgtggttaagttgagggacctccagtgaacttattccttagaaaaatgataacagttgggccggtgggccggtgagggagaaaaaggatgttttaatgcaattttcgcgtagttttacgtgggccggagacacgcaacgcacacggagcgggccatgggcttctatggttgtgatttttttgggaaaagtccattttacacccttgaacttttatgctggttcaaaatatacccccaaactacaaaaccggtataatacaccctcgaactttcaatacggacacttaaccgggagctgctagctggcgcgtgtgcacaagcagcgagcactcctccccgctttagtcttaagtaactatattagttattaacatacttaacactaatgatatcaattaggaaatattctgaagatttttttggagatttttttactaacagattgacaattttttaagttagatttgaaaactttcgatttaagttttaaattttaaagtcaaattttaaaaactttcaacttgagatttgaaaactttcaactcagattcgaaaactttcaactcaagaatcgagattcgaaaactttcaagtcgagattcgaaaaatttcaaatcaagatttgaaaactttcaacttaagatttcaaaactttcaagtcgagatttaaaaactttcaagttcagatttgaaaattttcaactcaaaaattaaaaactttcaaactcaaaacatgctagagataaaaaaaatcagaaaaaagtgaaaagaaaaggaaaaaaggtttaaaaagggttaaaaaaaaggaaaaaaagtggaggagacgcgcgcgccggcgcagcggcactgggccttctgggcccgaaacgcatgccgccggtgcgagcgcgtgtattagcttttccgcacttaacccccctccccccccccccggctgtttttagcgtggtttttgacatgtcggatccaagtcagcccacaaaataatataggccaagtccatattgtctctctctctctctctctttctcctcgccctgttgtgtttctctccctcgtgaccattgacggcggcatggagctgctgcgagggtggcagctacggcagcggtggctatgtggagcggctgcgagggctgcggcgctgctagggttgcggaggcagtcatcggtggaagcctttccacgcagtcgccggcaaggagagcagcgatggcggtggagcttgctgccccgcgcaaaagaggcggatctcgccggagccacacgcgtccccaagccccgtcacctccgccaaactctacatccccaagcagctctagctcactggcaagctcgatttcgtggagaagatagagctcctgaaggcggcaggagaggcggaccttgagcttgggctcgccggcggttcgcacagaagggaaggctagggatgtgcttgagctttgtcgccgcaacaagtcccctgctccaccgccaccgatctcctgctccatgagctcaagaatgccaccgccgcttctctcctgctctgggacgaagaaggatagagagagaaagtgaagaggagatgagggaagaagaagaggtggctccaccgtggttatggactgacataaggtcctaatttttatttttatttgctgactggacttccacattaatgccacgtaggcgaaaaccagctgaaaaaccactcgagggtgtaaagtgaacggtattggaagttggagggtgtgaaatattcggttttagagttttgggtgtattttagacaaaacgaagagttggagggtgtaaaatggacttaccctttttttaattggatccattccattacaacttcggcaaattaaaaaaataccgctactatttatgatatcggttatatgccattggtattttataaaatttgaatcatgccactatatcggacacagttagaccggatttttttcataccatattttttacgtaaaatctaattcgagatccctctcgttttagcgctatcgcgcgacgttggcaaagccgtccgatctccaaccacacgcacacgcgggtcctgcttcagagagagtcacagagaagaaggctacagtttctcccccatgtcatttttttcttcaaacaaagttttatctcaaagtacttatccgatctacaatccgattacaccattgtgttcgttacaattaaatcttcacaacaagatcttacatgattatattacgataaaaaatatttatgtttgtaaattacttttattatatacataagttacttttatcatatatataagttacttttagatttcactaaattacttcttagacatataaaagtaaattcaataaagtctgaaagtaatttacatatattataaaagtaatttaaaacaaaatgtaagtaactttgtcacgacattagaagtaaattcgttgtagggataaaaatatgactagaaattaaatttaatcagcatagatcaacacacataagtttaacaatttttaaaagtaacttgaatgttaattgaaagtaacttttgcatggttcaagttaaaaggagatattagatggagtacaaactagctaccactagctgtgtagtcacgtccaatgagaaaaatatattaattaaagttactttctttttgttataagttacttctataatatatgtaaattacttttaggttttattgaattacttttatatgtctaagaagtaatttagatatattataaaagtaatttattattttttataaaaatataatcatgtgagatcttgttataaagatttaattgctacgaacacaacggtgtaatcggatcgtaagtcggataagtaatttaagagaaaattgtatttaaagtatagatggatagtgtcttttataaatgaaggagtagctgtttaaccagctaccactatcgatcgatatagtcacgaccaaaatacctataacatttagaggctgagaagtggaatccacgtactcaatccttctctagctcgacgaagctgatggcttgttgagagctcgaccaggcccacgtcgggttaggaagggcggaagcttaattaacgagaccgggccgtgcacggcagctcgaggaggacggcggcaggtctccaagtcttgttcgcgccgccgtcaccatcgtcttcgagaaggatggggatggagctcatcgccatctttcgagtcttcgcaggcgccgggcctcctcatgccgctccacgtacgccaagccgcaaccagactcgcctccgctaatggacctgttggcgctgctgctagacccaccaccgccgcgacgaacttgtcacagcctctcccccgcctgatttgcttaagcccaccacgtactggatccgtcgccttcccgctgaccaccaccaccgctgctgcttgcttctccattgatgcaactgctgctactcgattcgcggctgatgttcccgcttgctctaccgccgtctcgctccacccggtcgtcgctgattgcttgtcacttgcttgccgcaaccaccaagataatgagtggatagaagcgaaaaaagtctttacttgaattaaagctagatggcgcccgcgtgccaccagagcgcattttttccgggagtaacaagcataactagttttagacttttagataatgacaataattatccgattacttttttctttttaaggtagtaatacttttctttcttcggtttttttaactaatagagtgaaaagaaatctataaactttcacgtgaaatttaaagctttctaactttcaactcaaaatttgaaactatttttaaaattttcgacttgatatttgaactttcaagttaaatttgaaaactttcaactcgaactttaaaaactttcaactcagatctgagagatttaaaaactttcaaattcatatttgaaaatttttaagtcaagatttaaaaactttcaacataaactatttaaaaacacgtgtgctaaagattaaaaaaataatccaaaaagcgaaaaaagaaaataaagcgaaaagcaaaaaagaaagaaaaaaatgcgaaaaaaagaaagcgaaaaaaacgccgcggggggggaggggctgcaaactggcgcgcgcgcgaattagccgcccccgatagaagtattggggaagaaaagaaatatgacaaggtggatctctcttgtcagtctctaatactaggagcattttggtccgcatgaaatacaggatgtaaaaacccggtctaattgtttccgtgatgtatataatggcatggtttattttttacaaaatactgatagcatctagctggtatcgaaaatattagtgttattttgtcaaaaaaattaaagagaaaaggtagagagtctctacctatattcattgatgtgaaatagttacatatatgtaattggcagaggagagggatgataaattaggaggaggcgaggggaagaagagaacgagaagagaagaaagatatattttgtcaattaggcatagttgtgattgcagggatccaattaaactttttttttcattttagagatcttttctattacctcagtttcacgttataagacgcttcaatctctccatttatcatattcactagtatccatatgaatttaaaggtatatacaaagcacatatattgatcaatgcttgaatagattgaaaacctaaaacatgttatttgaaacagacgaaataattcattgggacctacttgctccgtcccacgaaaaacaaatctagaattggatgtgacattatatccagattcatagtattaggatgtgtcatattcagcctattggttttttatggatggagagagtactccatgtccttataaaaacaaacctacgataggatggatgtgacagtcatatcttgtcgtaggtttatctttttggcaaattttgctacaggacatcacgacttccgggttttagttatagggcaccgtgcgaagtgacttttaggggaaggcattatcaaaagttggatatttgctggtagacatcccgctcattaaaataataatttccggttgaagagaagagagaatcgcgtgaaatgtcaaaaatgcccatgggccacatgttagctctcctatctctcttctctctctatccggtttgggatgatgcaggtttcgatgttgcaggcggtgcgcgacggcgtggtgctcggctcggcattcgtcggagctcatcaaggagcttgcagcggtagcagtgattccaggcggaggaatcggcgccggactttggcagcggcggctcctggcggaggaggaggcattgagggctccggaggaggaaacgttcccaggcggtttcctgaggtcggtggcggttcccgatgaaggaattggcgtcgaacttcggcggcggcggttcccggcggaggagtcggcactaagggctccaaaggcggcaacgttcccaggcggtttccagaggccagcggcacggtggcatcttcatggcgaggaccttgtcctcacactgcgccacccctgtcttcgccgcgcgcgctccgcccgctggtcacgccgccgctcgcggatcgtttggcttgccggagaagagagaaaggagagggagtggaagagaggtaaggaagaagagaagataggaagaggaagaggggcaatttggtcacgctgtgtaaaaatgtgggtcccctctcacctggtcagcacaaaaatactaaattagtggatgcagtgtcccgtggcaaataaccacatttacataggccctgtttagttcgcgaaaagaaaatttttgggtgccacatcggatgttaaccagatgttggatgggattttcggacacaaatgaaaaaactaatttcataactcgcctggaaaccgcaagacgaatcttttaagcttaattaagctgtcattagcatatatgggttactgtagcacttataactaatcatagactaattaggctcaaaagattcgtctcacgatttccatactaattatgcattagtttttgtttttatctatatttaatgtttcatgtatgtgtccaaagattcgatgggttgttttcggggaaaaaaaattagaaactaaaccaggccacattgtcttcctcaaaagtcacttcgtgcggtgtcctacagatataaccacgatgtcgtgatgtcttatagcaaaatttgccattttttcgtggaagggagggaggatatatatggaatttatgttgcttatatggtcgtacttgtactaacatgggatgatgcgttgtactcgacgtgccttgcaatgtggagttaatcatgcatgtcatcaaaagaattcacagtactactctctccgtttatacatttcacgttaactttttcagtgtcaaattcttttaaccaagtttataaaaaagtatacaagtttataaaaagtatagtaacaatttttaacacaaaataaatatattatcattatatttaatgaaactaatttgttgtcgtagatgttgttatttttttaaatttagttaaacctaaaaaattgaatagaaaaaataaaaactacttataatataaaacgaagaaagtagttattattaatcacagttctacatttttattgtaaagttaaaggcaccgtacaaaaatatcatgctaactagcccatcatcctcgtgtacaaccattttgcacacttatcttgctaatctgcaaattaaccaagtcccaagatgcagtttgactggcatgtttgtccaagtacgtacgtcagtccgctaattaatcctggacagcaacctgcggacttggagataagaggaggctgcggcggaaggcactgtactgcggggagccggggcagtagtacaagctgtactcttggcttcgggcaaagccagtgtagtacgtacttcacgtactccgagtcttttcccagcgatggagcagcaaaaagtacgacgccaatcgatgccatcctcctcccgaccccgtggaaaagagtctataatacgtgagcgctttgcctgcgttttggccaggcaaacgcagcctccatcattaatccggtcatcagcaaaggttaattaggcccggagatttttgcagctgagagcggggagggaacgaatcggaatcggcatcgttatcggcatcggcagcggcgatggagacagagagatggaacgcgagggagttcctacaggggcgagctgggaacacacggtgatgaggcggtctggtctttcgtgtgttctcaggtcgcccctgccgggactctctggttgattatgtatatgttgattattttctcttgccaaaaggtctcctaaatggcgcggtgtaggtatgttctcttcctcgattacacaattcggttgattccagttttgctttaaaatgtcattgtcttatcttgtggccactttaacacttgctatatcaagtttaccttttcttttatactgggattaattctttgggaaaatatctactgttttattaatttctttcggaaccaatagtaatgcatgttctcataacgcgcttatgtaaacgcacatatgcacacctctacctatgagtatttacataagattaagtcggtatatatatatattgagattgataaagtcatcatgaacatatcactgttaacgggtacatcgtctaccattaaaacaataattaactacaatacaatcatcagtatcaggtgtagattgaatccagatgaggtagttccaccacaagatacaacctcacttcgtagctattttattaatttcaggtgaaactttgcatatgattttttaaaaagaacggtatgctgagaagagatagacattttactccgttaaatgctttcgtgtaaaagaattgttgtgttctgatgacatttgagacacggcgcttaactggcctactttccactctttgtttcacaatgcgatccctcctgttcgttaactagatttcctttctcgcacttctgttctactactctttcgataccaaaatataatattttttcactttcagtatttatctcaaaatataataatttcttcaccaatattttttcctaaccaatcacaaccactactacaatacctattctcccgtgtgggctaaacgatttttgcgtgcgggtgggcggcccgcacgcacccagtcatctgggaaaatcgcgatcgcccacacggaaaaacaaaaaatcgaaaaaaaaaaagaaaaaaaacctaaccctaatccgctgccgtcgcccccgcggtcgccggtgccggatccgtagtcgcacatcgacacaacagatctcacatcaattccaagagcacatctcacatgttcaacaaatgaactccaagaacgcatcgcacaaatcacaaagagtcacaaataacaaagagagaaggagggggagagatggatccaccggtcgcctacgccatcgcacctcttgccggcggccccacctccacgccggccgttgacgctgctgcacctccaaccggcgccgcacctctagatccggcgcgagccgcctccgtcccaccgcctcccgccaccgaggggcacgggctgcctccctcgtgccgccgctcagccggatccgctgggcccccatgcctcccctccgccggatctgcaaggaaagggaggggaggggccgcgtgccgccagatcggccggccccatgcctcccctccgccggatctgcaaggggagggaggggaggggccaccggggtcgcccgccgccgcctgctgtcaccgcccatcttcccgcccgcagtcaagggagagggagggaggggccgcgcgctgcttgctgtcgccgtcggtcggccgggagaggggaaaagaggagaggagaggagaggatgagtggagtaggagagagggagagagggaggtgggaggagaggagcaggcggagggggagatgagcgaagtgtgcgggcacgtgacggattaaaaggggtgggctattttcgcgtgcgggtgaaaatatgcttattttcgtatgcggttggcttaagccgcccgcacgggataatgcgttttcccgtgggagagacagctcggcaccggtccccctattttcccttgcggttccacttacggaccgcatggcaacataagggggcggcatccaggaaaatctatcatgttgtagtgaaccctccaccattcaatttttccacttacctttatttcttgtccaatcacaatctcatttaattctacatattttcttaataactatattaaccctaaaaattcttatactctccaccaacattctctttttaaccaatcataatcctctaccattcaattttttcacctatctccactgctcattcaatcataatctttctctatttaattctacctactttctaccataaaaaattctacacactttcttaataatcgtgtacacccctaaatatccttatattttaggacagatgtggtaataatttttacttgcatgtcatatccaacacatgtgtgaaaatggactgggaaaaaataaaatagtttggactgtttggtagggcttcagcacctaaatttagagcctgtttgatacggctccatctccagctccacttctcctagagctaaagctcaaaatagttttagctccacctaaaataagagtggagctaggtagagcattctcacaaaatgaaaaagagaggtggacctgggtttaggtggctccacaactctactccagacccaactcctgtagttaaatttaaaaattggagctctaccaaacaagcacttaactctaggaactgggtttaaagtggagttatggagctgcctaaacccaggcccacctttctagtttattttgtaagagaactccagtcggctccactccctttttgggtggagctgaaatcgtttggttggcctccagctccagaaaaggtagagctagagttagagctgtgccaaacaaaccctttatgtaccacatttcattcataatttggttacttcattttagaaggagacaatatgacttattcttgtttatttagagagaagacacactaaatttgaagatactttctgagaaaatttcctatgtacccctaaaagttcacctaacctcttttatactcctgagatttgctcattcccttccatacccctaaatttaagtttggatcccttctataccccttacattagttgaccgttaaattcctatcataaagtctattttgccctttggtatcaagaaaaaataaatttatgaagtatattgatggagtgtataaatttattgtatgctactattatatttatgagtttattttgtgagatattatttaacaaaaataatattttagtttcacctccgcgaaggcaaaacaaaaatattttttatctatgacaacatttatttttagatataataaaaaataatattttttaccattaaaaactgtatatataacatattttgttataatagtacgacatttttgtaagataaatatatttacatgctaaataaataatttttaataactaataaataaattttatttttatgtcatacctaaaaataaattatcataaatattatttatgactttgttacgcaagatattatttatgataatttatttttattgtgcgataaaaaatatttttgctaaataatatctcatagaataaactcataaatataatagtcacatataataaatttatacactccatcaatatactttatgaatttatattttcttgataccaaagggcacttacatagcatataaaaatctaacctatatttttgttcttcttatattttgcaaatttttgttttgttttcaagtttataaatgcaacatgaaggggaaaatgcaatatggaagggtaataatacaagtcacctcagtgggggaaaggcatctccccccaagcttgtttcttgctcatggtccaaggtaggggctgaacccctggtggcgaaagtgggcctgccagtcggcctattgttgctgcatcgtgttgttgaagttggagagctgtgcatcaacattttgttgccactcatgtgtctgcatgacatgttccttgagcgtgtgctggatatctctggcctgcagctcaagattgcatatcctccaagtgagttcacataaataccctcgagaggagacagagcaacgcaatcgggtggagggaggtaggccacttgaactggagaagcgctttgccaagacgaacctccggcctcatgttgaggaccttgtgtccaaccgggggcatccttagttggggctcaatcggcctcatacatctgcactgccggtgaagaggatgacacctcttaaggtgtcactcttgccatgcttcacgtcaccttgcgtggaaatcatttgtacaagattcctctatcaattggagaggaatagtagcactcgacaattatacaaatagaaccccagttaggtaacgtgatttcattcgtatagccgaggaagaaaaatacaagcaaatcatccgggccatgtttgagtgtatggccttgcaccaaatatgcctcattaacatatgaacggggtgtggaaatgtaagaaatttgagcatccgacactaacccaacttcataagctatacgagaaactagagaagtgcactcaattggaccggtagccctcaacctcgcgaaaccaacggtggcgacggcacgactcgatggctagctgcggccgaaggcggtggcggtgggtgtgatagcgcgggcgcaatagaaggcacgggaggaggtggcgagtgaggaaaaggagggggcgcgggagagaatcttataggtccgaggagaggagtttgtggccaggaggtgcccctattttgccgacgacgtgggagaggtggccctatggccgcgcgcacgtgccgccatctcgcaggcacgacacgtatgggaaaggcgagggagtgggcaggcaacgtgggcatggcgcgtgcgtgcggagtgggggcgtggggtggagaggaggaagcggcggcagcagttagagctggggctccactggctggagattgaggaaggggccgacaagtgggccccacctgtcggtgaccatgagcggcaaggaggcgggcgccgactgggccacggcctcggcctgggccagctaggtgggagggcgcttgtgggcgaggcggactaggctgatggcctaagaaaaggaaaaaggagaagggatttgctgggatttaattattaccgagaattgattttaattggttaaaattatttccaagcctctaaaaattccactaaaaatcatgttaatatatttaaacatggggaactcaataaaaatcccaccatgtcattttcgattattaattgcatttattaattagggtttagctctaggttaaattaaattatttcttgaggcaatttattaactgaattaaggctagagaaaggggaaacttcagggtgtgacatgtgtactcatgttttacttagaaatgattgagaggaccaaaaagggagaggatttgcgcgggctggatttggactgaaggacatcacaacttgtgacaactgccacgacttcatacaaactccattttgggcatgtaagtacaaatggatccatcctcatgtccatatctattctggagagtctgcaatcatcattttactacaaagacttttttatgtccacggtgctacgtcaccttatttgggtcgaatatgatgcgtaccaagttgagtccgttagagacacgccttatagttagaggacaaccccaactcattctccacctatatatttcccttagccgccatagatcaactcgggttttgtttagatcaaagtttagtgtcgctattttgccgtgtaatcttgtgatcaattagattgccgttttgctcgttacggaaccccacctttgacactcttgttgatttaatcctacatctttattccgtaaattgagttgcttgtttatcttattgtttctagttctcgattgcttacagaaacaatcactcttgtggttaggctgattatgcatccgctcagattcaagactgtctctagagttagtgtaatgattgctaacgcgcaacgtctctagtcggatcaccaacgtcgttccattcaatcggattatcttctcttcggaaaatctgcacaccctcgcatcatcaacgctgaacttttctgcaagtctaaaaatcaatggtatacggctaaaccggatccctcccaactttgaactatcaatctgaactttccccaagaaaaatatataaatttggtcgctgtgaaataaatttgtaaaaatgattttgtctaattttatacattattttttggtgaaaaattatacagtatatcatttcatccatgcatcatgaatgtacaggtaatcaaaattttatcatgtaggccctgcttgggaacaccgaaaaattttgcacctgtaatggtgccccaactttaccagtgaaataaaaaacaatgcaggacaatctgttttttttttttggggggggggataagctaaaataggaaaaatgaaaagaaaattcaggttcatcccaattagcaacaaagatgttctcggttcgtatgatatcccaggcatcgaaggttttagatcaaaacaacatcaaattagagaaataggaggaatgaaaagaaatttatggtttagccgtgcaaatcatcaaggccagctcttatgaagaccgcaaatcaacaagcccaaactcccttatcttttatgcgttgatcaacatggagagtcgagcctagtgagccgagcccgatgttcacgaaaataagtgtgacctccttagcccacacttatttttcgctggatcgggctgaaaacgggtggaaatttgttgtgttacggcccatcaaggatttaactttactagagaaacatggccatgatttacacccgttttggaccgaatacatgtcttccgagcaggccaatggttatattattaatactcttttacaaatatatagtctgataaaataatgatcatcctttcgagaacggaggcggtagtagttaaaaattgatttgtctctataataacaatacaaacaccaacatagacactaatactcacgcatggacattataaacgcatatacatacatcatattcttatgagcacctttaaacatattttttttcatataaatatggatagttctttttttttcttttccctggtttcaaccccagatagagtttctctgatccttcattttatcttacatctttgctctaccactcatggtagaatacatattggttttgcttccaagaaaaaatggcactgaatctctagcaccggcaacataataaacaaaatacaaaagcaaatctgcactgactggattttatttcatgatccttattacgtcgtcgaaggccccggcatccacaactgttcacagttgttttacacacagcttgactgaaaccagaatattatccactggactgaagtgcactggaatctcaggaatcatttccaggatcccaggcaagcaggcagcgtgcgactgaaactctgaacatgcactccacagtccgctaccaacaaacacaagaaagaagacgcatctgtttcttgctagtgcaaagcttgccatttatacttaattattaataactaaagcagcattattgccagtgcttaaacttggctagctagctatagctctcattgggttcaagttgaccttaatggaagatttaggatagtattaattaatttctccacagtgatccatatgcatgtgtgtttgtttggtgagctaaacaaagtttggtgatggtgatgcacaagaccaaacaaccagctcccctcaattccagcatcgtgctctcatcaaatctttgaacaattaactgaaaaagatctgtagctagcaacatgtccggtctggtcccatcagattcagatcaaccatcacacaacacaacaagatcaggaccctcctaggctcctagctagctagctactacctccctccgagaatataacaacttttggctataaatttgaaaacacagttatccagattcatagttaaaaatgcttatattttgggatggagggagtagctacatgaggtctcttaacttcgggggtgtttagatccaggggtgtaaagtttaatttggcgtgtcacataggatattatatagggtatcacatggggtgttcggtactaataaaaaaactaattacataatatgtcagtaaaccacgagacgaatttattaagcctaattaatccaccattagcaaatgtttactgtagcaccacattatcaaatcgtggagcaattaggcttaaaagattcgtctcgcaaattagtcgcaatctgtgcaattagttatttttttagcctatatttaatacttcatataagtgttcaaacattcgatgtgtcagggtgaaaatttttgggtgggatctaaacagggccttccatataacttactccatttgttccaaattacttattattcaagctttgttttaaatcaaatatttatattctactattagtttttagaaatttgtatagttaagcaacatgtgaactatatatatacatatatacatatatatatacatatatacatatatatatacatatatatatatatatattatgaaagcacttctcacgataaatccataaatgtaaatctaatagaattaatccatataattttttagaaagcgattatcaaatatataaatatttaatttagaataaaaccggaacgacaaataatttgaaatgaagagtggagattgattgtggtatagcaaatagtagcaaccactattcttccagtttggggtagcctgcacatcacatgcactgtagtactatacagtacacagccccacaaaggtagctgcaggatccatgaaaagtaattgtgtttctgaacttgtgataagcattgagtaaactatgattgggcacatgattcatgaatttatacctttgccagcctacaatcaagccctttgccctaggaattatagatagctgcactcaactgaataaagattgttagagcaagtttaatagtatggcccactacttactccaatttatctatagccaatctaatagccaattcatacaatagttgcttgctatactattaatatatggtctcatctgtcatacacacattgcgtcttggagtccgcgctacagctggctacagatttgtagcccgctacttttctctctcatcttttatctcattaaaatatgtttacagttggctaatagtctactattgtacctgctcttaggagtactactactatactatgctgatgtatgtatgtacaaacgagaaagtagctgatgtaactgcagtaccgaattctaatgagtaatgactattgcaggatgaagacaagcagaaacgtccacagtgaaactgtaaagaagtagtagtagatttttaaaaaatgacattttatcaatttttaaaataactgagagtatgttaattatcactgtccctgagtcaaatttctagagtaaagaacacaagcttgtggttatggttaagttaactacgcactaattctatcaccggtaaagacaaacgagggttcaaacccttgaagaaagtgatgcaaaacaaaaacaatggtgctagctagcttcctggtatctttgacttaactgaaatagaatcagagagagagagaggaaagcatgcacctggaatccagtgcaaacatcttaggcaatgaatttaattatgtccaattttgtactaatatatggccttaattatctgatggattaattagacctatgtacctgtcctgtcttgtgtcggcttaatcggctatagcaatgccgtaatcgaaatgttaggctatagcaatgtggcactgtgcattacagtagcaatgttgtaatcacattgccacattactgtgcattactgtgttaatcgaaattgattaacatttcgatgccgtaataaggcaacatttatagcaacaatgtggcactgtgctagaaataccgtaatcgaaatgttaggctcgatcgagctcgacaattaagtcaattgatcagacactgtccagagaccaaaggacatgtctaactgttaacttttttttataattagctatagcatatgataaatacttaggttttgacttgtgaggcctaatccaaatactaatcgatcctaacgttgtgagacaatgttttcaaagatcaaggcagtgagtgtaacatgagacaacccaaatgtgggatgctcgtcaacaatgttataatgaaattgtgagctcattacactagaaatagttggtgtacataggttaattatttactgcttttgcaatgagcagtaaccatctatagtactttgaaattactgctttgccatctttactactttgaaattactgctttatcattggaaaagtagtatagaaaatcattatgttgctactttaaaagaatatagtgacgatgacgacagggtatctgtcaccttaacctacttttattgtaattttgtggattgccccttcaatttttttatattataaattaaccaaatctaaatggatagttaaattaaggtgaatatatattccgtttagcataaagatgcgtaatacatttcattttaaaaagtatcataacatatttttaatccgtagttatgctacggagattccgctagtagtttaaaattgaatatcatgcataaacatggatcattcgaggctggaggtagtagcaaataattcaaaatactatacccacaacctttgctttactagatcattttagaaaattcaatggctttattattgaaatcaaccgatcgaagcagccaagccaagcaggaaagatgaggcaagatagacccaaagtacaatccaatccgggagtttgcttcccaaatggattaggtccaaattaaaagacaaacaacaacgcgggcggcgcgtcgtgatacgcgctgcatcctccctcctaatccggattatcggggtggggtggatatttgattaagggatgtgggccccacaccaccgtgccaccggaggggtggggccctgcagaattccacggtggtcgtcggccgtcgctgtcgcgctcgatcagcctcagcgctgaaccccagacgccgaccacggacacggccggagggggagggagagggagaggcgccgcgtgccgtgtgtgcgccgcaacgccagttttgtgcccagtagttgttgtgttttggtacgtagacgccgcgtcaaaccgcgtctcaactactccagtagtactccacgggggaggtggtgtgttttgcccagtgggttgtggtgttttggcagcaggcaacgcgccccaaaatcatagaaccaaacaaaaactcaaatattagggaaggacctattatcaaataattagaaggggtgaggctttgaacccaggccgtctagtccaccaccttatggagctagccagaaaacccctgagcatttctcccaaaatcatagaaccaacaactaatatatcgctgctaataagtttgtttggtttggacaaacaacatatgtagggggagattaattaatactgtatatcaaacccgccgctaattaggataaagacaaacacacttatgcactttttgttaacacagggatttctccccctcgtgatgggcttccccgaagggccgaaggaagccttagtaattcccctcgttttaatcgtggaggaggtaaattggactgaagcaagagttcgtgcaacatttagacttttttccatacaagtatattattgtccaaagaaatacaactcgaatacacataattctaatcaatttccaaacatttcaggctagggttgaaatcggatcgggtctgataggatcatggtatttccacatcctattctatattttcctttgaattcaaaactaggaacggcggataacatatcattcatttcatatcatatccaatacttttccccataattgaatttggaaacagatatctattaatttctctaatttatagatactaaatccgggaaatcagttaaagtgttaaaaagatgggagtagctatacttatttttcaaaaaaaaagtaaaatattttttacgatgtaaattacctacacttacattgtaagaatgttgtaaacttcaaaacttacaatgtaattgtctatggactatgcccgactacgctatttttagagtatggagatcttgaatatcaaaatatacgtgagattgtatcaagaagacaagggacaaggttttatactggttcgagttcttaagatgagtaacaaccttactttagtttatatgtattgctggggagatgtgccacatggattacaaggaaggggaaagagatgactaatctaatccgctgactagaacccgccaagaacggtccagctagatctaatcgacgactagggtttcaacttcatccggattgtatcttgatgtggcttaggctatggctgtaattcgatgcaccccccctccatggaggaccatgtattaataacaatgagtaccttcttctccaagtaaaaccctgagactttgggctaacacgagccgaagaaaccttgtctttccttagtaggactctgacaccttctatctcagatagacaatttcctttcagactcgtataaactccgcatctaaggatatcttcccgtatactattaggtacgtgatatttttgtatatcacaaatccgtatatatgatgtatgtatataggaggtatgtcttatctataaccctgacagtaattacattgtaagttttgatatttacattatatttcttctaatccacatatataaagagaattaggattaaaagaaatttatcatctacttaaaagaggagatagaagatacatacgagagatggagtgatcacatatggaaaaaagttattcaaataaagtgaaaaaaatatgacggcataaaattagcaatcctgtaaaaaaatacatcaataaaagaaataagcaatattacttattagcacataagttggacagaggcaacgatttgtagagcagctagacatttttctgcaggagtataatgacatctacaatgtaggagtaaataactactaccaagtcatagatttactaacaggctgtaagcactttatagtaggttctatctatttttaaacatgtttggagattcttttaggtgagttctaccttattacccactatagacatgtgtacatttttttctatctagttttgcaacaagtattaagctaagttttaccatcgaaagatacacaactgaaatatacatgacaataaaaacataaacataacgtaaggatataggaaaatgtgggacaaagtaacgcatggccttctttaaatctgaaaaatggtcggtttaataattaaataaatacatttggaccatacagacacgatctgatagatgaggtacaactacaacatctagctttgcctacagggctactacaacaatcacattgtgacataatgaaataaagtactttccatgaacagttgctgataacagtcacgtgacaaaaaaaaatgctactctattaccaatgatctcagtagcagtactttgtgtgcaaggtgacaaaatgatgatatgggggatggcacaaggaaaaagggaattagatcctagttcatactacccatgtcctcttaaaattatgtaattgcagaagtagccctgctaaaaatacaacttcaaatttgtgctggttagaccaaatctaaaatctttgacacctcttaaatctacactctgagcatgaactaataggaaagcaatgcgctaatatgaggacgaaggcacaaatttggtgaaaattttagtaacccctactcaaatgaccgtaaaattttaaagtctagatcgtttttgtttggaaggaaaatcgataaacaaggaacagttgaagtcatcttctttagccttagtcactttattatcttcccaataagattgagtttaatctcaatttttttatacgtctgtaaaatagcacctcccatatttaccatatttttagtaaatttttataacttctactttgggaaaggctttccacaacttcagtaatttgatggtttcacttgatacttccccttatttgaggttagcatgattagttttttttcttttacactcgataatttggtggttttttaaagttatatgccagatttaattcatgtttgacattgctaaccgcattttcccagttctgcttatataggtcataattcactatgttagccatgtcaaccccattacacatgcacttctcatcccaaaccaaaagcaatctatgataggttgaaaaaaatactttcaagctactgatatagagtgttaactaggataatcctataatcaccacttaaaaccctaatctacttggtgtttctctctctctctctctttttggttttttttagtttttatttgaattgtatataaccatacttgttgggattgatctacttaccctgaagtacaaaaactagtaaacccaaaagaatgaaaacatgttcaaataagccctaaagactagagcagttataagtagttttggccatgtgaactatgacaaggacattaacatatgggaatggattcagataaatatcttttacataagttatatggatttttaaaagcacataaatgttagtaacatgtaattcatgggctcactaggtagagaaggatgaaagttggtttgagtaaaatatcctaatgtgtcggccacttaagaaacaccacacgacacgtcattgtcgatgtggacaaaaatacctgcaaaaccactccatgagactatttggaccggttttcatactttatggtagaatactcaatttttatatgggttaagtagattaaccacttcggagggttatatagaccttttcgtttatatttattgttagaggttcgaagagtaaaagggagtaaaaggaggaaagatcttttccattgtttattggcagaggatccataggtaaaaaggaggataccatgactaataagtcaataactgaatatatactgtctgccacttgtttcaacctggacatccttgcattccctaagctttttcaagggcatggctgcatttgcaccgtagagttaggtggtgtttggttggagggactaaactgggctaaactttagtccttctcacaaaaacataagtccctatgctcacaaaagcataagtccctatgggagaagagacttatgcaatagggacttatgcttttgtgagaaggactaaagtttagtctctagttcccaaacacccccttaatattctttgggcaacaaaacaacagaatatatcaaactcatgatatcatgttactgcatcatcatttgactttaactaaccaaaattgagaagaagaaaaaaataatgaggggctgacttatggggaccacactctgaatcaaggccatgtgactatgacattgagatccctctcaatggattgatccctcaaacatacatgcatggtgcccagcccagatctaaagcattaatcatccatccatttcctcttgttcctttacccctagaaaaaaaataacttgaataaaaagaaaatattattatttctatttatattaagaaacaagtagtattatatctctcttcaaaaaagaattttatttctttaatgaattgagcagttgggaaactgcaggagggctagctagctgagatgaaaaaaaaaaaaaactctggccaccggtccagtgtcccctatcagggagttcatgaaatttttgaatgttgcataatttgtggtccaaaaggctttatagccttttttgtggggtcttagaattatgccggtatgatccataccataatattcactttctgtttctgcctttttctctcccttcttttttaacttcaaggtagtaggagtagcctgttgtctttggtatgtgatagcataatgttcttttttttttaaaaaaaagaaaagttcagaaactgtaacaaaaatagaaaccatgcatttcaaactggtcacagagttctaaaaaaattggcaatagagcataactttgtcattatcggcggtttgtttgactagtagtcgtttattttgcggtataagtttactgtttcatcagaagaactacaggctatatgagttcggcagggcaagtttctaacttctactatatcacgcgcacacttcctaaactatcaaacaatacgtttttttatataaaaattataaaaaatacttttaaaaaaaatcatattaattcattttcatggttttagctaatacaatacttaattgatcatgtactaataagtcgttccgctttacatgcgcacgagagaatttccaacccttaccagtaaacacaggctaagtgtgcattcggcagtgaattccaagcttatactccctattttccatgcgcatattttgcaaagaaaaaagtccaaatacctcccaagttcatctagcaccttaaactttagaatcagacatccaatcccctaaactttgaaatactatccatattatattacctcataatatagttttggatgatggttttgcaacaactttgaataattaatataacatatttggatatcatcggttgtaagtcatcaatttatacttttacagtgatacctagttcgtatttgtttgcaagtgagagctaacaaggggtaaaaaattaagtgaagattttaaatatttatgtcaaatttgtatgtcacgtgatcatattcatccaagttatatataaattagataaaaaccattgtgtaaaaaccattttagagggttttataaatgatattataagtttagggggttgaatgtcatgttttgaaatttataaagggtgccagacatatttacattcaaagttaagagggagtttggacttttttctttcccgaattactaaacaatatgtttttttaattttttttatagaaaagatactttaaaaaactatattaattcatttttaagggtttttaagcttcatatttattaatcatgcactgattcgttgctttttttttcttgggaaaggttcccaacttgcatattagattgaagcctaaggcctagtttagatctaaagtttttctttgaacttccaacttttctatcacatcaaaacttttctacacacataaacttcaaacttttccatcacatcgttataatttcaatcaaatttctaattttagcgtgaactaaacacacccaaagctagttctccattgcatctcaatccatgcattcaatctcatgcatatcagcaacaattattatgctatactcccttcgtccctaaataaaagagattttagttgaatgtgatgtattctatatccagatttattttactatgatgtgtcacgtctagctaaaatcacatatatttaaggatggatggagtagtatactaggaaggtgcactaaaaaaatattattaaaggagacatttacgtctcttttttccagcttctagtgtgctgaattggcgttttgggctacgcagttggtgaaccgtttgtcttttaagccacaagtttacaatgacagtcaaggctccaatagtaaaatcagacaaaaaaaacttgtagctgtagaatagctgtagaatgacagatggttttgaacaaaaattttcctcatgcatttcgttttggacgtgacaaactgaagtcgatttttggtaaagtcacgggagtggaaattcgcgtgacaccttttatagtagttgatcaattatttttgaaaaaaaaaaactaaacgcacgcactcgtataaacatgtgcatatatattctaattagcgcacatgcacacacaccttatatgattatctttgaaaactgaattaacgaaatcaccataaatgtctcgttgtcaaagctacatcttatctggaaagagtttcttgcactttcacttgactcccacgcttgagaaattgcgaatgaaacaatccaaaggtaattaatgaatccaaattaatcgctctgaccagttgcaaatacagtcataaaatagaatagaggcagcaaatgcgaacgaatcctttccattcgaaactcaaaaaactgttcaaatccagccccaaaattgattgaagtttgcgaacggtggaagaagagagcaaaaacaacggaggggggaatcaagacggagtggagccaaaaaaaaaaaagttcttcccctttgctttgctcgtgctctgctcacatttgtttctctctcctcctcggttgcaagctgcttctgccttctgctgggctgctgctgctgtcccaatctcttttctctctctagattccaaatactttccccctattcctgggcaaccccatcatgagatgagagaggaggaggaggagggtggtctactctagcctggctctagagagagaagaggtccatcctagttgttgtactagtagcaatagcacaactctagagagagaggcaacaaggggagaagaagaagaagaagccaagaagaggcaaggaggaggaggaagcaaggagcaagaaaggtaggaaggattggggaggcatttcttggattcttggcttgcggggggtagcattgcgcctcaattctttgcttgcgctgctgttgcagatcagcggggaggtggggggaggaggaggaggcgtttcttggattgattcgccggaggaggagggatggccggtgtggacgcggcgaggtacgcgcacagcgaggcgcaccacgcggtggcgacgagggaccacgcggcgctgcggcgggtgctggacgcgctgccgagggcgcggaggccggaggagatccggacggaggccgactccgtggcggaggaggcgcgcgcggaggcggcgtcggcggtcatcgaccggcgcgacgtccccgggcgggagacgccgctccacctcgccgtccgcctgggcgacgcggcggcggcggagatgctgatggcggcgggcgcggactggagcctgcaaaacgagcaagggtggagcgcgctccaggaggccatctgcgcccgcgaggaggcgctcgcccgcgtcatcgtccgccactaccagccgctcgcctgggccaagtggtgccgccgcctcccccgcgtcgtcgccgccatgcgccgcatgcgcgacttctacatggagatcaccttccacttcgagagctccgtcatccccttcatctcccgcatcgccccctccgacacctaccgggtctggaagcgcggcgccaacctccgcgccgacatgaccctcgccggcttcgacggcttcaagatccagcgctccgaccagaccatactcttcctcggcgagggctccgacgacggcaaggtgcccccgggctccctctgcatgatcaaccacaaggacaaggaggtgatgaacgccctggaaggctctggcgcgcccgcctccgaggccgaggtgcagcaggaggtcaccgccatgtcgcagaccaacatcttccgccccggaatagacgtcacgcaggccgtgctgctcccgcagctcacatggcggcgccaggagaggaccgagtcggttgggccatggaaggccaaggtgtatgacatgcaccatgtgatggtcagtgtcaaatcaaggagggtccccggcgcgatgacggacgaggaattcttctcggcttgcaacgagaacgataccgagagcgagggcttcgacgatgttttgactgaagaggagaagaagcagttggaagccgcgcttaagatggactctcctgatggtgctggtggtgaaggccagtccgacacgtttgttggtcctcgacatagctgtgttgagccgagggagagagagataccaattgaggatttgagcatctccggaaatggggatagtaaacatgataagaaaggttggtttggtcattggggaaagagggttcagagtagcaagctagaggggacgaagaagatggcacctccaaggagttcgctctgtgtagatgagaaggtgagcgatatccttattgaatctccatcgaatgtacaaactaggccaggaaggcattcggtagatgtagtaagaggggatgagagcagaaggggcaaggaaagggattatcggagacctgctgcttcgtcggagtgtggacataggcgcaaagaaggtagcaaagaaagcgagtacaagaaaggtctaaggcctgttctctggctttctcctaacttccctcttcggactgaggagctcttgccactgcttgatattcttgcgaacaaggtgaaggcgatccgtcgcttgagagatctccttacaacaaaactgccaccaggaacttttccagtcaaggtattagcttaacttataattgcacgtatatgtttgttatgcatttactgtgccgcaattctttctgccccaactagtgtcaagtttattcttgcttgtcagagctacagtattttgttagtgttcggctacaacgtgcaagttttactatgttcatttctggttatttgtacaattttgaactccttgcgctgttgagcgtgcatgttactgaactattagagcaccatctactagtaatcaatgagtccatataaatgtgtacttgtgtgcctttatcattgttagttatagagcttttttagattctcgttctttttaataatgtataatttgaggtccttgtttgcactttgcacttggtggtacgtcaagacatggataataagttgataaacaaataataattatttggtattgaatagatgctatttctacatcatatatgacatatagctactcaactagtaaataaatgaactccaagaaaaggcgctatgtatttattacaagaggagccttatgcttgaatatcttgagtggccctgtaatattaaatcctcgagagttcttattccttttccacttgtctcctgtttcattcattataaaaggacgatatagaccttatgcattttggattagcatgagcctgataaccatctaaaaataacttttatagtagatttgtaatagagtttctccctctggtcataaatattcgtgttggacatacctttggtaaagctttttaaacattgtatcaatgtcttttaaaatgtttacattggatgcaagaaaatcatatatgtgtagattcatcttagagtacttacataatatctaaaatgttttgtttcatgagtacataacataacaatagaaaataatggtccaattgtattttaaagaccatgtaattgtccaaaattatatgtatttctgaacaaagggattatttgttaggtagcaactagcaaggtagatttgcccccgatatcagaatttatatggtatatatgttgtatctttgatatactttcatttacagtattaactatgatgcgccatttctccttttcctctgggagatctagtccttgttctgcacttataagactggaagttgtctcaaactctgattgcctcttgaatttaatggacagatgcaaaatcttataaaaccaaacatgtcatattgaatgtacatatgaatacctgaaacaaaattcaataatattggttatcctgtatttttcttggattggcactttaagtctggtagctgtaactattctcagttgagttgctatggtgacatccgatacattacaaaatcaagatatttctcccttttgatcccatttccatactgttttaaaagtagttgtgggtgatggtgtagtctacacccattccccactcataaagatattttgtaattagttacacctagacatgtttgtggtttcgtatcatgtttgtaattagctgcattctttgcacatgtgtgtatcagtgtaggtactaaggtaggttgctgattgtatacatttttaggtttgaggataattatatttagcattttgaactgtcatatttggtgtctattgactattgcaatgcctggcaacatgtgagttcgtttgtaaggttgatgtgctaactagtaagtattatatattttgctcagaatttgtatctgcattgcttatttgaccaatgttgcagtgcctggcatgatgctagttactactagtttgtaaggttgacatgctaacttgtaactattatatattttgatctgaatttgtatctacattgcttatttgatcaaatgtcttctccaagataaattgagattaacaccatatttgcatgctgtagattcatagctcatacgatatattgtagcttcatttcctagcaaaagagtgctagatatcaacttcatcgatgcattgtattgaaagcagcacatccatcaaagaatataatagactttccgatatgccgccccgcaagcaaggagtgccgcgcacgagcggagcgaaaactaagcaaggggaattccgtcattccatggaaagcatgcgaaatcctttgattgtttatagagctcagttattttagacgtgatactctatttaatgaagaggtctagagtatatggagctaattattcaaatttagttactgagatatacttttgtgatgtctataattcaagtggtttgtttatgggatttggcttagatatttttatgcactagctttgacctgtaatggcgtctgtttctctggattcagatagcaaatgtatgacatagctgtgcgcttataaatgacatatgatacttttgcatttgctctgtcaatagtggtgtgtttccatgtcattgctatcttggtatcttcaaaatggcatatccggcagagggcattaacagaattatggcaatccgtccatttgattttgttggaagtccatttgattttgttggaaggaaccagggcgtcaattatgtagggaggtcaataggtgttgtgggaatgggctgaggtgtaagaaacggataactggaactggagagaatatattcaaaacttactattaaaagaaagataccagtgctatctatgttctatttacagaatacaatacggtatattatctgatattgttgctaccgacacttatacagtgatactttcagctcagatgataacagtcagtaggtaaacagttttgaaaagagcagtgtgtgtgcagagttgttaaagcattgataatactatcctatttgccatatatgccttctggtattgcttgaacagaaatttttacattatagctgttagtctgttgaaataattttgctggattctgtaacatgatgaattggtgatgtattaacactttattactctcaggttgccatcccagttgtacccacaatcagggtacttgtgacattcacaaagtttgaagagctacagccattagaggagttcaccacaccgccatccagccctgacaatagcaagagcccagtggcgcagtcttcctcaagttcttggattcaatggatcaaggctccttaccatcagaacttctcaacagctccaggccccagcagccgtgtagaggacatccaggacccatttgtcatccctgctgattatgtgtggacgacaccagaagagaagaaaaagaagacacaagaaaacaagagtaagtcgaagaaaggccgaaatgcggcggcatagatagatagcgctggtggtggtttgagacaatgtcgtggatgacactgaaatcattgaaagggcaatacttggtgtgatgataccttctgatctaacaggaaggatgagtgggagatttgaagatttcgacgagctgcaggtgactgatgtcgaatgtcaagaaacaaccgcttgtctagtttcgatgtgatgaaaagatttgttcgcaacattctttcgtttaacccaaatcatttcaatcccatttattattgcatcgacctgcaggtagttttttttgaccgaggtgtctgttgataatgctggtgtcgcggtgttctaaagttattgcctgtttttttgcatcttcaccgtgccaacatccaaatgcatagtactatatttctgtatgttggggtggcacaaattttgtgacatgaaggtgcacacttaacttaagtagatcattgtatggtagattaattttctgtctttgctgggtgcagggatcaatattcatggttgaatttgtctttagtgtcttatctggtctgctattctgaacttcgtattggttaagcttgggcatatcaggcaaattttaaaatttatatttctgatgattgcttattactacggtttaattgttcgtctcagtttcaattatttgtataatcaatccttaagcagtcaagaacatgtactacataacattgctgcacaaatttgtgtggtttggtcctggtgctaggcaggttcaccaaactgtttcggatcaggttatcgcaaccccacggtaaggtggttatcatagtaaccatgtgattaccgtgaaaaccgtatggttaccgtgaagtttactatggtttccgtgaagtttagggcccctttgatttgtaggaaaaatgtaggaattttggaggatttcaatcctacgaaaaaaaaatcctatgaaggcctttgaaagaaatgattgaatcctattaaatcctttaaaattcctatggaatggtaatcctatgcatattttggaggaaagttagcaagaggtctaacctcttggaacatttcttccgagtctatctctctcatctgatttctgtatttttcctgtggtctaatcaaatggtcattcctgtattttcctgtgttttgcaatcctctgttttactgttttttcattcctacgattcaaaggggcctttattgtggctttaaaaaccgagaatttcaaaccttggtgctaggtggggtgcctaccacatttgcaacaaaaaaaaaagatgctggatattattttgttcctcatggatattcttttgctcgtcaggagaacactgatgtacttgcccacgttcttatcaatgtacagtactaggtttcgtttcctcctaataattgcatcattagtactatattttgcaatgtactagtacgttacagtagttgagttttcttttgttgcagccgccagagagatgtgtcatgtatgatggagttgtgcgacctctacaggtaacgaacgaaatgaaatgataatgggaacagtgcgggtgtttcagctcatttcagttatggtaggttggtagctcagctaatccataatcaagaagtgtattggttataaacacggaataattaactatttgcttaaaattggtgctaaattatttgtcactaaacccatatgtcatatacacatgagggcccacatgtcagacatatgagggcccatatgtcatagataagcacatcttaaaagtgacatggagttaaatgtccctttaaacactccacaaaacacatatgtagaccgagcagagtactgcaaaagcgtctgtaaagcgagtcgtcgtcatcctctctcctaacgcacagcacactttttgcaaggaaaaaaaagtactgaagaaaaacaaaaagaaaatattctttttgaaaactgaaaacgtttagttcaagaaaaagaatttctctactacttagaagcaagtcgtcatcgagcaagaaaaaatattactgtaggaaaaaataaaaatggttagttcaagaaaaggatttgttggagaaaaacagaaaaaagaggatagttaaaaaagaatcatctgcttttaggataatcataaatgaaattgctatatatcattcgaatgaaatttggggatgaaaccttacagattttggaccattggatctatactaagattcgtgcatcggcttcttctcctccaactccggcgggctccccatcttctctggcgccggcgacacccaaactccgacagggaccatacaggttagggtttggttggggggagggggggtgtcagggtagaagggggttggggagggggaagagagaggtttactcgagacttagagagatggccgtgagcggcggaggaccagcggtgggcggtggacttgggcaggtgatgcgcatttgatgattaaaattcatttttttgtgtgatatgagcttttaaagagaacctattaatgtaggtcgctcaaatagtctaaacatttcaaaagtttgataaaatattatcctaacataaaacatttgattggaggaaaaaaatcaaatagcacgtcaattgcttgctaggtaaaagaagaatcataaattttcgagcacaagggaattaagcagcattagattttaagagcgcaattgtcggtaatagagatagagaagagaagtagagaaaagttttttgaggttttttttataaaagtttcttggaaactagaaaaaacatgttaaatataatggataaagtttccatataatttgactagttcacatggattcactcagagcaaaccaacaaagttaacatgtgggtcacatactcacatatgggccttgttgtggctgtaactttcgcatgcaagtaacggattacaaccctcttaccaggaagagagagctaaggaataattttttttacgggaaagaaaccaatgttctttttttcaactctggcagtttttttttttttttttacccatgggcctgcagggcttgaaggtttggtagccgaaaccatctgagagctaattaaattccaaaaattcaaagcaaaccaattttagtaccgttgtgccttctatataaagctgcttggcaaaaaataaaaaatcataggccggctacatatacagacacacgcgaagccgagtcgcagatggacttggcaatgtcccaaattgaataagcggaagtcttgcgtatattttaactagatatagactatagatatagatatctattcgtagtttgtactactagttttgtttttgttatattttggaatggagggagcagttcgcaagaaaaggctaaagtttcttgctggcctttgtatttattttgctgggaacaatgtgaacactttgaagtgatagactgcttgcaggagttatctgtaaaaggccagaaataaataaatctataggaggtaaatatatttgataataagcatatttgaattttggggattctttgtaaattcagaaaatacaaatgtgtttttattatttcaagcaatcaaaagaaactgtataaattaaatagaaactgttaactttacaattatttggatccagaaactactacataacatcctatcctatcttagtgtaagttataactcactagatcctaaagcttaacatacaacgatgctatattatcatccactaacaattattacatcttaagcatcacataagtatgttatattatctattattctattctataattattaatttttattttagtgctttaaaatgcaagcatgttaaatcatcatcccacataattcacatgtttcaacatatctctcaatcattttttattatcctaggtatatagttcatcctcacttacttaatgttatttcactcttctctcattaagccatatcacatcaattggttttagttattagatgattaacccattaatctatggttcaaattatctccctcctttctctcattaagccatatcatctcaattatttttagctcttaaataattaatcaatgattcaaattatctcttcttttcttctctcataaaaccacgtcacctttacttttacatttgaatatcattccatatactctctaaattatcataaatcatatcaacttatgtaaatttatgttgtctaactattttactaaaatccctcgataacgcgcaaggtttcacctagttatatcaaagccaaacctagttatatccgaggctgttagctgatatgttcatggctgcttactatacttctagcaaagctaaatattgtattaatgaatttttctaactagtgattggcattcacagagcttaccatgtttcagtgtcgttaaactctgcccaagaccttacgaaaacagtctttccgacggcatagaacagatttacccatgtaaatatgtaatttgccactcaacgaaatgctcgaaatttcacaacctaccttttcttttaaactaaaaggaagaacaatcgggaaagaaggccaaaaacatcggtctcagagcaatcaactggaaatatgaagggcacacctggagaagaaaaaaaaacaagctattgatggtttgcctacgaggcaaacatcttaggatttttagaccaggatacctgggttcatgcagcaacagaatcttaaaagcacaggtaattagtaactgcttcctctgtttcacaatgtaagactttctagcattacccacattcatatagatgctaatgaatctagacattattatatacatagattcattagcatctatatgaatgttagcaatgctagaaagtcttatattataaaacagagggagtagcattgctgatgaaatctctacaatgaccacctcaacaggttgcacttgtagataccagggtgacattgacaccagtagcccgacagttgaatatatgaatagctagcaaaaccatcagtacggcatatatatgtcctggacagaatgcctctccaggactagcctctgtaagagctccaaatctatgagctaccctaccattcaagacatggccaaccagcatttacagacagaagtgggacacattttgaagtcatgtaatgtacagatatatgtacatatggagttctcgtagcaattgaagggaaaaaaaaagaaaaacagaggtcaagtatgaaactcggtgcttgctgcgcaaaacaagcttcctacaaaagcaagcatcaagcttcaagggtgagagggaatcagccacggggcactgcagctaccatgcaaaaatatacaacggacggttgatgcctagtggatgacaatgagctgtgactttgccttcctcatgggaaggcttgaaacatcatcccatatgcaagcttctgttattcgcctgaaataagaaataacaggttcattcatatttgaaaaaggaaaggaattattacgggcaatgatgagttaaaaaaaaggagtgtaactattatttacaggaaatgaaagcaatgcactagtttgacaaaaatgcataatgatgttgttggaaaaatgtaaagctaacataaaaaaaaatactagcaaagtagaaacagctgattgaatttgaacatgtaaaatacaataaccacctcagatatgctgtagaccaaaatgctttggtaaaaacaaataggatgctgatctgcaaaacaatatggtacagcatggcagtaatttaaaacgcacgcagaaaaagtcatgtcataacaaatcactactatttagacaaagagagagtgtcgtctaccgtcccaacagcaaatccaaaccactattacacagtaggtgactagttgacaagtcgaccatagagcacaactagagggacacgactcaacttgggactgcttgagagcaaactgggtcttgtttgggaggccaagttcataggaaaggggaaaaagaggagagttattttcctcttccatatatagccagccaccagagctagagccagattagaggaagcagcaagaatttcacacctcctttgctcatgtgttccctcttttccctgatctcctttataaaacactaatcaactcatcgactagtaatgactggtccacaggttggtagaaggatgcatcaacttgactttagtagtttacaacttaacaacaatgatcaacacgcagaattgtttttatttcttaaaccttttacatataataatttaatattagaccctattaaaattttatttccaaatctgaatcttttggccatgccaagaatactggcgttgccaaataaccctggcatgatggaacgtgacacactgaaagactgtgctacgtcatagccttgccatgccaacatccttggcgtgacaaccttgctctgaattgccgtgccctgcggcatgacggagatttgcatgcatgctgatcatgccctggtttggatgcgagcaggctttgcatgcctattggaggtaatggccccctagcgtgccatacatgtatgacactttaattaattagcttgagttgccagctagctaacaaataatgttgattgatcgtttaaaagtatttttgaagtgatgtcattatattacaggagggggtcacaacatattgcactctgaattatttcaaagtcgcaagccactcagtgaagggccctttgatttgtaggataggaaaaatacatgaatagaaaaaacacaaaaattaaaatagtatgtttcttaaatcctacatcaataaaaaaacacaggaaaaaataataagagtcctttgaaagtgccataggaaaaacaaagcatgcagtatgagtccggtccctacatgctctgctatatcagtggttactcataactatttgtttattttgtttgaaattatagatgtaatttagccatacatgcatttgtgtaaaagtgatatatatgatgtactctctccgtcccataaaaaacatcccgtactagatttaatttttatgggatggagtaacttttatgacaattatcttcatatattactgtacatgaatatctagaaaatatgcaaagagtggtgatcaatggtatgcacctactagctaacacaggcaaagcatgcagctacctacgacatggtctgacacgcatgcaagcactagcagccatttatgccacaccaaggagcacggcattgcagcgcttccttgccgcgccagggacgttggcatggcaaggctatgacatggcatggtctgacacgcatgcatgaggggatgagagtggatggtttgatcttcaacttcaaggttgatcatgctgtttgatttcacagatgggatannnnnnnnnnnnnnnntgggatacatattccaggaatattctatattgattctgtacaattccatgtgagaaaaaaaatgttgaaccatgctgtgggtcatgcgtgtcaaacagtatcctacttgtcatcttacaaaccaaacatcgtatggtaccatcctgaaccatccgacacaaccaagcaaagaaaatttgtaccatactgtgtaaccaaccaaacatctactccctccgtcccaaaatagctagctaccttggttaaggaagtaggtggaattaaatggggatggttgtgattggttgggatgagtaagtaggtggagaaattaaatgagatggttgtgattggttgagatgactggtaggtgtaagtagctacattttgggcgcgacttcagttgacaaaagtgaacaagatagcgctaacacctgatgagaacttttgttttaacagaacttgaatgctaaaggtagctatattttgagatggagggacaacttgtatcacagtccattctagaccatttcatccatcatgcattttcctatcccatccaccctcctccctcaaccaaacacaccatcaaaatacatgagagtattttcaataaactccatccaagtgatgccaagataggcttctataggcatgctaagtacaatcacatatgaagataatggtggaccagacattcacatttacaatcagtgccatgagcccataaaacataggacaagcagatacatgtgtgcatccttctcatggtgtgccatgaaacaagcttccaaatagttatggccgcaaaactatggttttactgcctatacatggagatcaaacacattttgttctatttttaggtagttttgggagatggcacaaggccatgtttatttctaaatcatggcattgcctaatcttaataatatttgtttcttttattaggtcactgaacccaatttactgtgaacatatgtgtcccatagtagcatcatggataacattaccatcaaacccacaaaacaaatccacatattggccagagaggatgacttgagggcacaagaagttgttggcagtagaagacacaatgaagcaaggcagcaacgatgagttgcttaggaggcttggtctgtcaggcccattattactgaatgaagggagataagaaaagagttccattaggtccatcagcacagcatgtagtgcaagacgagtggtagaagcaaccagtaaatgtagtaaaagtcagatatactaccaaagactagtgtcaactctcaagtcggtagaggggcaacttgactcaactttactacttaacaaccataaagctcgttggggaattatatgggcacgtattaccatatatgggctagattgacctccagattccagaaacgatgcaaaaaaatgtaacaatatataattgatattctaacataagccaggctgaagaacaatatccccagaaatcatcatgataattggtataagatatttaatttcaaactaaattttgaaaccactagttttttttttttgaacagcacatatcagcagctgaccaccaatagtacgataaaatccaaatatttctgactgaaagaaatgaagactagtaaatcaaagataacatttatggtacatatgtatggagattgttgcctatttatagagggcaaggaacgcatgcacccaggagcactacttcacaaggctgcactttaaccaattcattacttcattcaatcttttcaagtaccacaaccaatttatgaatcatgatcccagcattgaaaaatgcaatgaagttgaataagcaagagataaacaaaatactaattaagtaggaagtaatacaggtcaatcaaaaggaggtacagaaaatgcaaattgaagcaattcacacacaagtaatgtagacttgttataaaggcatattataagtactgagttcgaaacataatcctagaaatctcaaaataaaaagatcatggaaggactgggagagttaccatcagagaaacttgttgtcagcaatcacctcaaaaatctccatgagaaggattatgaaagcatcaaaacaaaggaagataaactgagtattgccttctagtagacagcctgactacatggttaactttcccacccattcatcaatcattccatagtcaatgcttagctccctcaatggtggaatgttctccatggcaaagatcatgaggtgaggataagctgcgttgtaatggtcaaacagcacaaactggacaaacacatttggactgcaactatggctgaaataacaagccacattccttgcccttgacacatcaattgaaaatttcaagtcaggaacagctggattgtttggtgccacatactctggatagacatcagagacatcaccccaatctaaccaccttggagggaacctgcttggccgcaccaagcaatcaccattcgcagccataatctctgactgttgatgagtgagcactatcccactaaactcacagatgaaggttccagccttaatgagatccaaagaccgaacaccccacccagtctcccttgaccggaatacctcaagccgattcctaagccccttctgactaaccctgttggggcaactaggtgggcaccggcaatatggcccacactcatataccagtggtttgccccgtaaaagagcaccgagcttgtcatatgcaaactcaccgccattcctctgtgcacagtaacatccaattgagcaattctcagtgcactcacacccgccaccaccctcagcaaacttcccttggactgcagaggacggaaatattggccgcgccagatactcaaataaaagtgggtcacgatcatcatcaacatcattgtacagtgcaaccggcatgatctctcgacccatggaaatatcaaagcccaaataccctgttggccggaaagtcagggcattgaccttaagctgttcggctagtcgaaaatttacagagcccatcgactcctgcccctcgatgcgcagcattttgtacttgtaaacaccgaagccagacttcccacggtcaagccagtagtcaacaaccttatagaggccatcatagaagtataccttgccgacggggctgcgcttggacttgacagcacggatcacgcggatctcaataccataggccatgctacgctcgagggcaaggttgccaccctcaagcttctgatcaacacaatgcttgtggaggttggggtcacgaccaccatgtcctgtgtacacaagtacatcgccgcgatcgtcatcgtcttcatacccaccggacacgatgatagatgtggctatgggctcccctgaggaagactgcccagccgtgacaaagtcgatcccagcctgcacctggccgtgtagccctagcacgcaaagctccatgcggaagaagaaggcgtccccaaccgagatccccgggatcggccccacgattcggcggtcgcggttgagccacaggtctcggtcccccatcagcgccgcggcacgcaggtcggcgcggacgcggcggcggtcgacggcgccgaacccggggacgcccgtgaggccgagcacctccgcgcgctcgtcgtccgcagcaggatcccgcggagagactcgaacgtgatgcgcgcccggcgcaccaggtcccggaagtagatctggtcctgcacgctcagcgaggacacccgcaccagctccgacgaccgcggccgccgcttcttcgcgccggaccccgacccgggctgcgccaccgcccccgcggaggcctccggcgccgccgccggcacgattacgccggccgcccccgccgacgacaggtatagcgtcgcgagccggtagtactccgccaggagcgtctcctcctcggggttcggcggcagcgactgcagcggcgtcatcaccgccgccgccgagaggtcgggcgtcgccggcaccggagttgccaccgtcgccccttgcacctcgagtgncggtggtgggggcgccggcggaggtgaagacgccggtnccgctgccgccagcggcagaggccctcgctccggtgaagccggctccgacttgggctccctcttgaggaacggcaggaagttgaggtcgatggagtccgacgacgccgccggcgacgacggcgccgaagacgatggcgatgtgtccatctccattgcccccttcccccctctctcacacacaaaaacaaaatacaaaaaaaaaaaaaacaaaaccacccactcctccgcccccttctcccgcaccaaactccctcctccccgcaaaatcccaccggtttacgaggcggcggcggcgacggcggcgaggtggggggcgatggcgaatcggttgaatcggcgatgaggcggaggcgagggagggaggaagcgaagggaaggggtgggaagtgcgaaatctccgaaatggagcgccctttttcccgggcttcaccgaaaagtaaaaaaataagtgaaaaaatcgaatccatagaggattaaactttaaggcccgtgcacccatcacctcgtgctctcgacagtcactgacaaacaggtccagacgacaacccggtgggtttctcgagaaaaagagtgaagtaaatgctcaactgcacctccctgagaggtgcagggttaattatggaatatcgcttcgattagacggcgatatatctttataatatttatttatatgttattattttgagacagggacgtgtggattttaaacgattaatttatttgaattgacgtgacattgatttttattagttaaatatagagttattacaaaatcaacttattaataaatatttgtagactatgaaaaaacggagaatgacggtcatattatttttcttataattcgtttccctaacttttgtgaaatattcttaatgcaaatggtccatatgcatgtagaaaaaaataaacggttaatctactttttttcatgtagcgtggtatcgtcgattacatctaatgctttattccataggattatttggtttatcttattttagtagcacacgaatcgccactgacacatgattaattaagttttacgaagtagcttttataaaatattagaaaatagatttattttatttttaaagaaacttatatataacttttttaaaatactgtttagtaatttaaaatgcatgttcacgataaatgataaaatagccgagcaaataatctgtgtagaacttagccagaaccgtaaatataccatttcgttgatagaattagctgagatctgctactcaacacgacatggtgattcttagggggaaaatttggccttagaaagtttcaaagcaacaagagaacaaacaaaacgcatttagggggggtgtttagatggggctaaaaatttttaaatccatgtcacatcgaatgtttggacgctaatttggagtattaaatatagactaataaaaaaactaatttcataaataagagctaatatgcagacgaattttttaagcctaattaatccataattataaaaagtttactgtaacatcacattgtcgaatcatggcgtaattagactcaaaagattcgtctcgcgaattagtcaaggatatggaatgggttttgtaattagtgtatgtttaatacttcaaattagtgtccgaacatccgatgtgacaggtacttggaataagtccctgtttcccaaaaggtcttttgctaggtgtgcacatcctcctgtttgttggctattagagcaacccgagtctttgtgtccttctgaggctgtgtccgttggtggggttgggatccatctgctatgcacggaaaaccaagcggtctattagcacgtgattaattaagtattaattttttttcaaaaagggtcaatatgatttttttaagcaactttcgtatagaaattttttgcaaaaaacgcacaatttagcagtttgaaaaacgtacgcatggaaaacgagagtagggagttgggaactgctgcaaacgaacacaaccttaaattgtttgtcacataagggatgaaaactttcggtcccatcgtttggcttattcgtggaataagcctaacaacatatttataaacaaaaagtaatttgtgaataaaacttttatacacgtgtttttagcgatctaaaatcaaaggctaaaaaataaacttcgataaaaaaaaacctcaaaatcagcttcaaatttattcgttgaaaatttaaattttggctgataagcataagcataattgaaaagatgaggccctttgaggcatcaaattacaagttgtggccacacaagggatgtacttcctattgagctgttttttagctataacatggcaacaagctctaatggtttggtcatttgttactttccattctaaaatataatgatttttagatgcatatcttgttttaaaatataaggattttcatcacttcacactactacttatcacatcaatcactttccattcaaacttctttccataccaccctcccaccctaactctttcttgtttttttaagggacaccaaagtctttttccctcttccttaatccctatttaaaaaagctagaaacataatattttataacagagggtgtggttgtaaccaggatgtaggtattgtaacctaagggcatcctctatgtgtatatatcgataagcaataatgatgaggtcctgtgcaggaagcactaattatgacaaacttcacaatggttaggaattaaggaaatattgcttcatttgaaatctttcaccccaagaatgaactacctccctctcctttgtgtaatagttttattcttcttttgtcttaatgtccaagccataagcttatggtgaactttagcatcaaatggcttattgccaactttcacaatatataaggctattagctacctttatgtctcttactatgttcacattgtgaatgtcctaagtcgttagatccacattattacataggctctatattgacttttcctggttaaaattgctctattatctctgtttaccttaattgtcttccttattgctagtcatccccttggcggccccatcgccctaccaccattaccactcctcttctgtattagcttgtaaagaacgccactaaaagctcaatgttgagacttaggggaaataggagctccagttcatcaaatcgacttaggctgagtttaaaagagaagttagccattagtatataattaattgaaacaataattatagttattattaaaaacttgagtttattttttaaaaaagaaacttatatattttacttgcaaaaacacgtcgtttgggaagcatgctcacagtaaatgatagagtagcaatatccaatctcatttcaaaattagccttattaggggaggggtgattatcagatctgcctcatagtaggttgttagcagccctagaagaaaagggagagaatagttaattgtcacctatatgtcaatgacataaggaccctcatgtgcctatgacacgtgggtccaatgataaatagttaatcgtcacatccaaaagtggtaaatagttaaatatcttgagagaattgggcaatcttcaatatatcatatattctttttactagagggagtacctatgtgagctagagaaaaagtggttagaagtaggtggcttattaaatgacactgatgataagagaaagttttatataagggttagttgtggcatctaattttgtctatgtaaaataagagatgatatgtacaatacatcacatttacactatctctagcatactaatcccaatgattttattttatttgtttgtctaatccactcttcttttatctatttttttcttgtagtttgtgtggtggttgcccttgcatgaggagtgttgctcatcttctcttttcttacttctgtcatccaccttatcatttaattctgtatggttacatggccatgagatgttgagattgttgagatgcacttagtggtacagtgacaaggggtgtggtttcaaccttgaggtcttgtgttaaatcctcaacttcttaaaatggagggacgtatttccgtccaaatttctcttttttttaaccattagatctagattgccgattaatgcctagcagcagaaccaaacaaagcaacatgtatcccaataaaagtgaccttgacatccaaatgactgttcgtggcaaactggtgagctacatgagtgttgatcccgatggtacaaccaagcaacgtaattcacgagagtagttgttctaggtttattcacatagtttccaacattatattttgaccattatttttataatatattcaacaactatagaactgaatgttctatttggttcatgaatatattataagaaataatggtaaaaaaattcaagggtaaggatggataggaaatggaaattcatatttgctagatgggggcaatccaacctttttctatggatgtagtgattagatttcttgtttggttggagggatacaatttgaatgtgataaaccaaaatttagtggaatccgcttgccatatattttttccatcaaaatataatcataggagatcttgttttaaacatttcattgcaataaatacaacattataattagataacaaattggataaatggtttaggagaaaaaatcatttaaaccttactaaccaaaattgaacacatcacaaccaatcagaatatgacacgtcgctaggaacaaaatatggatggctccatttggctagatccaccatccattaatatccttagtggtcccattcttgtgtgcccatcaaccaaacacataaaaaaaaatatagcagacatcttccatacaagctaagcatccagatacattttaaaaacacacaaaaatgcttatattttggaaaggaggaatagaaagaaagggtttataaaaataattaatgtggacactgcaattgggaggaaagataattaatgtaaaaaagaagtatggctctcttgggacaaagaatttatggaggaattttgtaggattgaagtctaataaaaatgtccttatttgatcttttgtaatgaaggattaaagtttttataatcctatcacattccgttggtatggtttaatgatggagatttaagagggaagttaatatgagatccaacctcatagaaactttcctttgactttttccttttatccatttgccctacagcttatccaaacggttatttcaatagctctttttgtgtttcataatcctttgtttgctttatatttgtatgcacaccaaatcacacatttttcctattcactagtcatgtgtttcttgataaaaataaatataatttctagacctgttattatttttctagttcatgaaaagttcgacaaaatatgaagatatcaaaaataaaaaaaagaatagcctaagcatataaaattgaagtaaaaagaacttgaattccacaaatcatatatgtgaaaaaagacaaatttgtaatgccattcctatctatccccttcatgatctcgttgtgaacttcaacaatttggttctacagatttaggacatgtttggggagcgtttggccctatattttccaaaatttaaagctctctagatagtccataatttcactcaaattctaaaaagatgtagttatagaatccagaaaatgaataagaatccagaagctgattttcccagcttctccatgttttcgcaagctagattcccactaactccttagaacgtaaagctccccaaacatattcttacttcgcatgcctatgaccatccattgtgccactgtactgatgttgcgaagagaacatcaacattaattgatgagcattgctcttagaatggtgggatgacggccatatggagttttttgtgaagctgcaagaaatgcagtagcagcgactgcattgaggttgagggtatttttagagataatactgttttgttggaaaattacaaatgcttggatttaattgtgaaaatagatgcttgtcaaactgacaaactttgatatggggtctatcgatttgttgctgtttttttaacaagaccaaagcatgggaaaccccttcagttagaaattttatttaaaatcgaaaaaaactacatagcttaaagcaacaaagttacaatatatctctttacaagattaagtctaaaagcaaataggtggtggatgtcctttttgaaaaaaaaaaggctccaagaatgaattgaaggcactatttgctgaaagattaactcaattctctgtttccaaatgttccaagctacataaaggactttttcaacaaatggcaactttggtaaacatttgcaacctgatgaagcattgtcctaaaccagaagtcagaagatgtgttccaattaatccgaagcctctctcaacattctatgctaaaaggacgttcaaagaacagatgcatacaggtctttcaggtgcacacttctttctatctagcatgtctatggtgtttaggcggtcaataagcaataagcaataaccaataaaaaaattaattttcatagtacatttactcttccaaatccatttcaaatattttggcggttttcttcccgtaaatttgttgttgttcgatagcaccctatcaaacagtgtacgcgcaactggtagagccaatcgaacggtggaggttcaattgggcccacacctagcagccgcaagccctatcgaactggctgttcaataggcccccgaacaatgggcattcgactggttgctttaaaaccctccccaccacttcaattggagtcattttttagagggatggagaaccaccgagcggcaccggaggggggggggtgttctaccaccatgatagagagagccgccgtcacggtcgcctggagaggaggtcggcgtggtcgggaggaggcgacgtctacgactgtgcaggcgagagcaatgacggtaagcgtgcaatacacataataaataagtgtgtactctatttgtaccacaagatagggcctgcgaatttgccaagtgcttcaacctattgaagctcacaccatcagttcactaacattgaactccacagagtgataactcaagtgaagtttgccctctttccctccgcaaggtcccttttatagtcagttggtgggtaggttgtacaatagcgcacctcgccatgcatacctttgcaagcgggagatgacaacaaactttcgacacatcaccactaagagcaagttttatagaagaggtaattgtcacccctaattttatctatgtaagttaagaggtaatatgtacaatatatcacctctacactagctctagcacaatactcttaatatttttattttatttatttatccaatccattatttcttttccctattttttcttagagtttgtgtggaggttaccacttcatgagggatggcttctactatctctctctcctttcttctcttctccacctcaccatatgtccatattagctaagtgatatcttggggttagtgcttagggacttacagtacttgctctaacacaacacgtgaataaagctgagatgagatgcaacaatacgtttatttcaccttttcacgtgtgaatacaaattcacttacataggaaagccaattttggccgtgtgcattcaccttagaatgcataggccgttgcccattatctaaaataaaaggtaagctaattttcagcacactaataacaaggtataccaggaaaactgtgcaccacacccatctccttcacggtgtgaacctagtccatgcatcagtgcgctgtattgttcaccgaatccaattaatcgagtacaaatggattaatataaaattttaaatttgctaaccgaacaaaacatttttgagtttaaatctattttaaacaatattccaaaagctagtcaaatggtggcagtttgattggcttgggcattaggcttatcgaacattggtcgttcgactgtttgactgggctcgttgaacaatcaaagttcgatattgtcgtggctccccgcagatctatcgttcgtccttcatacgacatgccccgtgtcgaactttctcagttcaacggacatttattttcataattaaatccaactactttgcaattttccaataaaataacattatttttaaaaatattcttgacgatatgcggcagttccgtacgatcgggattaggatacttttctagggaacttttgtttgcatactgtgctggatgcctagaaattagtaagaaattaagagacgagacaaataggagtaaggaaggctcagtccctacacgaatggtctatacgatggggcaatccaactctttgccagtatattttttcattaaaatatgattatatgatatcttattttaaacattaattacaaaaggcaacattataatcggatcacaaattaaatgaatgatttagaaggaaaaaaaatcattccaagctcattaacaaaaattgaatccatcgtaaccaatcaagatataacatgttgtcataagaaaaatatagatggtttcattcaactgattggctcaggaccaccatccagcatattaggggaatattccctggtggtcccattcttattttttcgtcaaccaaacataaattatataattatatagtggtcatcttccaagcagacttgtgtagtaaaccaaacacacttaaaaattaattgtttcaatgaaaattagatgagaaccatgatggaaatgattgtgttgtatgtacaaacggaaatgattatgttgtatcacaattcatataatagaaactttacattctcacaatattaaattgaagcagtgctttacattgctgccgaaaataaagattaaatggaaactaattggttagaaggaatctacgggtaaaagatccaattcttaatcagagccatatactaaacaatggtaaggattaggtgtttagttcgttgcaccaattcaatattcgtgtaagtaggacgatccaccatcaaatttcaaacatattattgtatcactgcaacaattatgattatatagaccaatcctataatgagttttactcccatccggcagcctgtaccgaccggtaatctggccgtccaccttgaaaggatacaattgggaaacagaaaagaggcggaacgattccggagtcacgccgccgctttcctccctcactacgctctttctttcctctctccccgcatcggttctttctcatctattcctccatccgagcgcagcaacggagtagttgcgccgcatccacgcctccgccggtgccgattttttccccatccatctgctgtccgcggcagcaaagccaccggcgcgctccgtcaccaacaacgccgccgcattcacgagcgaagatgtcgtggtattctgtgtcccctatcccccccccctcgacggctcaagcaagtacctaatctcccccgctgccattggcacagcctaagcccccattacggctcaaaaactactccactatatggtctagttattttgtaatgaacaattcaatctgccatgtttcttgtaatgaatttataagaaaagcacaagcttttgctggagactttaatctttgaatggaaaattttaagctcatctgtcgtctgtttttttatgctgtttacagggcatgatctatcgttgaatggagcttttgacttaatttttgtctgctatgaacagagcatggtatatatgtcgtattgagagccattaatattttgtctgctgtttttgctcgatctcctgtaaaatacatgtcattatgtggagtgattagcagcacaacaatggttacaaacaagtgttttcaatgaacagcaatccagctagagatgtaaaagttgaggaatcactggagtagagtgctagacacaggggcaataattactgaaaaaaagtataatttacatgattctgaaagactaaaacaaatatagagtaattcagagtttcagacagtgggagaggttaggtgctctcccaaacagaatagacagttaaaacaaacatagagtaattcagagtttcagatagtgggagagactaaaataaacagaattctgcaaattttcagccaaacagaacgaactagaacttagcaagaatctaaaactgaaggataagttagacaacccatctgaagaagctgtaatttagagtttcagatagtgggagatagataaacaggagaaatgcccaggggtcttccggctagctccacaaggtggtgggctagacgacctgggttcaaagcctcacccctcctaattatttgatattaggtccttccctaatattctagtttttgggagatagataaacagaattcacatggattggttgctaagacatcaacatgctgagtgatccccatccattaattctggtaattgacatgtacaaaaatcaacaatggcaagcatagtacatattatcaaatagcttcatgagaaggaacacagctacaactactgttcctatgaactactttctaatgggaaaattagaaccatgccattataattttgcaaaatttgagatatgccatcctgacccacatgtcattgactcatgtgggtcctacatgtctttgagataccgatggcatgtctcaaactttggaaaattataatggcatggttccaatttacccatttctaatgtcatcagtctcttttttctgcttggacaacttcttcattttctctcttctgccttcgttttctcaacataatagttgagtgcttgagctgtgggcagtgctacagaataaccagaggttgaagaaggatgcccaccacgaaccacccgctgccgaaccaccacgcacgccacgaaccacccgttgtcgacgccatcgccgccgccacctcatggacacgggcccaagcaccagacactgccgccaacaccacctcaccaccgcagcccacggaccagccaccacctcctcgtcgcctcccatggaccacctactcgccacctcccacgctgctgccgccgccgccgcctcccacgaatcagctgtcgccaccgccgcctacggatcagccgccgccaccacctcccaaggaccacctcgccgccgcctctgagcgttgctcccgtccagcaccaccgccacctctcacggatcagagctgaatcgagatggatccctacgcgaaaagacaacattaccattccacccctctaactattccggtaccacctcatgggcaaatatgtacctggaggtaccgcataatttccaccattcgatcgagctaaataaatagctgagatttggtaccgggctggtaccgtggtacctgcaggatgggagcaagctggtgcgggctgcggctgggaacggcaccggcaccgctcggcaagcaaccaagcagggagagagcagcgtttagcacttgctgcacttcagcgtttacttgtattcccaaaataaaaaatactttattactttaagtattcttcaatgcatactcttttatttatacttatttgcaaatggacaatagattacgatcaatggttgctgccatgcttaacataggcttattgacgtaatattttgccgtacgataccgtgcaattgagattgtttatttccttattcttgttgggttttcactctcgcgctagtccatatgagccacaccttgtttttttccgtcctccgccactggccttaattatcatgtatttcaattaatgtgaatatgtggtgggatatattttttacactagctagtacggtagcacccctcaatttaaattctgaattcgccactgtgtacactgtagttgcaatgcatatacacaagtacgcaagtgaatccttagaaatctgagccaaaccaaagcggtagttatcctcaccacccaaacttaatctaatcatgtttgttttttcattttaaatggaaggagggcgccaacatatacattagttagatgtatatatgtgctagcgcgtatacacacgctagagaagcagtgatacagtgaacaaaaaattaaacttttttgagtgatacagtgggtcaaaaccacacttgcatggccaaattaaacttttgagttttgtggttagtagtagtaactaatgaataaaaaaatgtacttgtacacaaacaatggtcttttctttcgtacgatgtgtgaacaaatcacgcacagccagagaagatcatggagttctaggtgatgtgtctttttacataggttggatcttctgcagtactgttggtgtcctactactactcgtgtagtaatgttgtacataacacatgtagtaatgtcgtagagaatcccaattgcttttacacatttttcctataaacatttttaagagaaataaatattccctccgtttcaggttataagatgttttgactttgatcaaagacgaactgcttcaaatttgaccaagtttatagaaaaaaatagtaatattttcaaccaaagataaatttattataaaaaattatataattattaatttaataaatctaatttggtaatgtaaatattaatatatttgcctataaacttagtcaaacttaaaacagtttgactttaaccaaagtcaaaacatcttataacttaaaacggagatagtaacaacttcatctgcacaattctgaaggaatggaaaagaaattgtgtacctagaatggtagcttctctcatcatccaaacatgaacttttggtcacgatattttttaatataaaaatataaaaatatgtaatcattgtacgcataaattatacatatattatacggagtgtgtgtctataaacccttgggatctagctatgataaagactcatcatgtgagcatttacaacgctctagtgtggaccactaatccacaacgccacgtaagagtacattgtgtgcgaaggagatgtgtctcttctaacacagaaagaaatcctccatcaatttaaaatataagaatttctatgatttaaaatttatacacaatataaccatttctataacattaattccaacacacaaaaatctatacattttcagccgatgagatgcatgggaagagaatctaaccaatttaaaattcaaaatttgaccacttaaatgactaaagagggaatctatactttgcttatagactagtggttcaaacttcaaagtttcaaacccagccagagttaaaaaaaaaagaagaagaatggaactagatcaattctgaaattaggcctgctcttctcaattcgtatcaaagtttttttataactaagagagcaacgctctcctatttctattagtagaaatgaaaacattcttaaaagagaacttttacggtacattctactgcaagtatatactattagtatataatagggtagatttgatatttgttaaaaatctgaaaagggttgtttagtcatttaaaatagagattgttttggtttttttaatcacgaatagtgataaactttcccgtggtttttttctgttgtggatatcgtcatccgcgtgtagcgcttcttttcgtttcatctggcgtccccgacgacggaagctcctggcgcacctcgctcccgccccggctcagcgcctccatcccgataattccttcggcgccgagagaagccgatcttccacgcgcccggcgtcttccgcgtccccggcaccttgtctccagccctagcctgttctcccccttatccgacctcccacagcttctgccctccccaaaccacggcggcgagggttaatggttttggagtctaaacatggtttatatcatctaaagttcgaaatgatgctaatggttttggagtctgaacattcttctttcacggccttctctggaagactggaacatgagagttgaatggatagtagtcacataaactgttcatacattagttatattggcatataaccatgctaactacacattagttatgctaattatgccgccctgccgctgccacctgctgccgccgggctgcctttgccgctgcgagctgccgcagctgcacgccttcttcccggcgcccttctgcagctccacctgcccgccgcctcccgcagaccgggcgccgcttatgtcgttgaactccgagttgaggatggtgtcgaactcaacggcgaagaggtggttggtcacgttaacattgccatgccatcaaagctgagattcgcgctggtgaaccccttgaagacgaactgctcgtggccgccgccttcagcagcccgccggcgccgcctcccgcagacccgacgatttggggattttcggaagaactaggttttgggtgaggaaagggggagggaaatcgaatcgattcccgatggcagcgacgccgattctggttgtcgacggcagcgcggcgcagcatactcgcaaaggcagtcagcgaagacggcagtcgcccacgcgtggcttcgagaaaaattcgcggccagatctgactaagtgagaaacacgaatttacaaaattaccccacacaaatagataaaaaagacaaatatacccccattcaatttatactgcagaataattgggaaaaagatcagatgaatttacaccgttagatcaaatatattggtagtatatacttcaagtagaatgtatcctaaaagtcctctcttacaaagtgattcatcataaactaaaagtatagatagctacttcctcccccctcaccaggtaccatcgcaccatggttgggggtgagaagccaagcaagttcagtgtcctcccctaaaagacatatcaccgctacctctcccgatttcatcacagcttacaagagcagaaggagctaacagaagcccatcgaaacaaagcgttcacatatggcgctcattactccaaactaaatattcagacaactgcacgatcacgattcctccagtttttagatccccaaccagacatttgtcttccatgacccttgtaatcttgctgtcctgaggctccatccatgataggcgccatagacctcaacggctaacccgctttaacagtctgatccctttctgtagacttcttgcctcgccctccttatctgtaaaatatcctcgatgttctattattgtactccctctgtctcaaaaaaactcaattttaggtttccgtgtccaacaattgaccgttcgtcttatgtgaaatttttttatgattagtatttttattattgttagatgataaaacatgaacaatactttatgcatgagttatctttttaatttttttcatatttttttcaaataagacggacggtagacacggaaacccaggaattgagtttttttggacggagtgagtacatgccaatgccttatattatttttgtgctcgacttgagtgtcagaaatattaaaaaccattgacaaatcaaacatcaaccacgatccaaaatattaaaacccgttgacgaagcaaacatcaaccgcgacccaagccattatctcacctaacaatttgcatttcttttagataatacctaacaatttgcatacgttggcacttacgacaaccaacaaaacacaccttattaattgaagaaaccaaacacaacattatttatatcaattgaggggtacacccggttggcagctcaagagtacagctaaacattatgcaggaatgtgcagagacagaaggtatacagttgtaccttatcaaaaatcatcaggtgttctcgtggatctccttctccatctgctggttgtttgttgtctcacaacattaaaaagcatcatcattcctcggtggtgatctatcaagattcccagaagcagggcataaaccgtccgttaaaaaaaacaacttaagaatatgtttagattcataatcagaaattctttctttttttttaaggagggaatatatccgtattctgtcagatatcattaggtgttcttgtcatctcttggatcttttccatttgctggtgtttgttgtctcacataaggtttttcgaatgtccatttgtcaagattactggagcagtctacactgaagaagcctcattacttcatgatcattctccagcatctatcttagagggagaaattcgtccagcatgcaaggagaggatgctggcagaactcttaaatttggcacagctctagctcccaactccaacttacctagagctggaactgtgccaaatggtatagattctctattttttggagcggagttggcagagctattccacaaatttgtactacggaggtggagctgggtttttgctgctccacagctccaaaccaccctaaaagatccactaccctttaattttttaacgtatttacacaaaaataccactgaagtaccccttcacaccttctctcctcctgttctctctcctcccatcctcctatcaccaccagtgagatttggtacgattcagcgacgaacgacggcaggctggctggcggcggtgacgcgagagctgttggcggcgcgtgggctagctgacggcgtgccggctgggcagcggcgcgcgtactggtggcggtggcccggtggctggcaccggcgcgcggcttgggtgatgggtggcgggcggcagtggcgcagactgggtggtgacggcgccggcaggcagcagcggcggcgcgcgagctggccggtggaggtgccggcagcgaacgtcggcggtggcggcgtgcgggctggaggcgccgacggcggtggacacgggcggtgggcggcagcggcgcgggctgggtggtggcctgggcgacgcccaccaactgtttgacaaaatgactataagggacgtggtggtgtggagctaacaagtctagccaaacattcacacacacctcagctcctataggagctactccttctactccctccgtttcagaatataagaagttttcgaattggacatggttattaagaaagtaggtagaagtgagtggtggaggattgtgattggatgagtagtggaggtaggtggaaaaagtgaatggtggagggttgtgattggttgagaagagaacgttggtggaaaagttgttatattttgggacaaatcctaagggctaaaagttgttatattttgggacggagggagtagctcccattggagttggagtttggagttgtgccaaacggggcctacatgtaaaaccttatattcaaattcattatattttaaccgtaaaaaaacaaaattctgacaaatttaatttgtcagatttttcacttttttgctacggctaaaatataatgaatttgaatatgagactttttagatatgtgcaatactattaggagtaaatatccaatttttttgtagatttgtttgtgatatttgctagttagcgtgcacgagaagctttatgtatataggatatatcttcttacttaaatatggattactgacacgctaataagtttttgtgagtttttttttttgttgaattgagataaagcatcgcaatagaaatctgcaaactacataggactagtatactacaagcgggacatttaactatttaccacttttaagatgtgtaaattaaagatttaccactcgttgtctataacatgtgggtcctcatgtgtctataacacgtggatcctttgacaaatcctttatcaccattcgtaaaagtggcaagtagttaattattccacaagcatcatgggccacatggccggtgttggtggtggtggcagacactactgccttaagaatgtgttcggcagtacgtgttcccaactcctctccttcgtgtttcgcgcgtacattttttaaactactaaattgtacgttttttaaaaaaaattatatacaaaagttgcttaaaaattatattggtctacttttaaaaaaactaatactttattaatcacgcgctaatgtatcacttcgtttccgtgcgcaggagaagtagtatagatagtgaatggaacggcaaaaaaaaaacttctagaaagatctttcgatgatataaatctgaagtctaaacccttcaacttacactggtcaaaccatttttcttgaaaacctgctgccaaaccattttttttcccaaaaagagaggccaacaaaaggttagtgcgaaaatgtttatcatgattacttggccaacttcgtaaaaccaatcatttggcaccacacctcaagtaaaaatgaatattagcacatgttttaaacatgagttattaacatgcggatctagatttaaggtcccgttcgtttctccaacaatatttggatgaagatgaagattttcatggcacgtttttcaaactgctaaacggtgtgtttcgtacgaaaactttctatatgaaagttgtactaaaatatcagattaatccattttttaagtttataataattaaaactcaattaatcacacgttattaccaccccattttacgtgaaacacttaatttttatatttatctttatcttcaagagattcaaacaccaccttataacttccatacaattaatgtggttgctaagttggaatcatattccttgaattctttgtggttgcatgaaatccaattacagctctcccaccttttttttcgacttttaagaatgattgactgcgcgctccttgaattattatactaactaggaaggtagcccgcgcattcgggcatgcgttttatacattatgtttgagatagttataagagcgaaatatcaaccgtaaaacatctaccatgatttcttcgtaaattgttttcatcgacattaattgcttttttaattttctaacctattagctttatattataggagtataatatttacctgatatttataagcaattatttataatcttcttcatcatttgaaatcatttgaaaagaaggtagacttattttctttagaaaacatgtcaacgaaaagtaagtgtaaggtaaaactaaggtatttttcttttttgttcaattgcatatgtattatcatggtttattcgatgatgaattgggagagacatgaagctccactaaatatatgggtttatatagcctaatatgattgatgtagtttgagagttagtcaatctatgaacatttcatgtagagtgggtaaaaggttccacgcaagctaacttgcatacgataacgataaaatataattgtacaataatatttttgaaatatgacataccatgaatacacacttgtatttccttttataagatagttctaaaggttagaaataatggttctaccggtttaaaagatataggagtactccaagaatgtagcttaaaaattatggttgttttaatatctaatattattgcgaagtgaacgtagctcaaccggttaggttccttgtgatggaacttgcccgagttcagacttcacaaattcttttagtggtagacaacgtacccgtcgatagcgagacgtacgtggtgacttcgtcaatctcaaaatatatcaggctagtctcttgaaagtactcaaaggggtatttgcatgtgtgcgttcacagaagtgattgtgcgcgttgtgagcgccagcgtttgtattttgtttaaaaaaaatatcaaacattatttattgtttctcttttatttaatagataacacaatagggaggggacgacattgttgtgtacatgtgagggtgatgcggtggagattatatttttctaactttttaaataatttaagtgagagccaatgacgaggtgtttcatttttttctaagaatttctaaggtttttcctttttataggacgtgacacacggtgacttaagattttttctaaaaaaaatagatttaatagttaaaaataatggatacatcaaattaaattgatttttctgataatttaattacaagatctaatctattggtttattatagatctagattacatgaatatatatacttccgtatattatgtagtattatattttatcttttttatattatacaaaatcctattgttagaccgtagttttttccacggatactaagtacactttttttttgctttattttatcgtagatagatgtctattttttttcttccagctaacagtaggtagctttatatgttttttttaaaatggagtagctatatttatagcgccatatttttcaccaaaaaatagtcaaaaaaaaagtcggtatgtatttacattgtaattccctaaattacatatgtaattttagtgtatttataatataagtctcaaaattacatatgtaaatcttaaatttatatactaattatatatataagtggggtgtaactacggtgtaaattcgtataaatatataaataattattaattttacgacggaggtgaagtgctaatgagtctagagcttaattaggtgcatttggttctttcgcataagctgtaagatggggtgcagcctgcaaatgcttgaaacgaatcttaccggacgatctcacggttaaaacatccgactgtacacaaatttagcaataccgttttttaattgtaccaacgtagggacatttatttttctttccttttcccagccaccggttgcatatgtttttttaaggaaaaactatcacattttttaataatagatctaatctaatggtctaaataaacgggtccaccaatttaagtacatccgactgtacacaaatttagcaataccgttttttaattgtaccaacgtagggacatttatttttctttccttttcccagccaccggttgcatatgtttttttaaggaaaaactatcacattttttaataatagatctaatctaatggtctaaataaacgggtccaccaatttaagtgaaaatcgacgatgagattagatagtgccacgtggcggcctaggagcgtttgtaggagtcccacgtggtggcttgagagcgtttgtaggaagttttatagacttttagtataataatagatagatagatagatagatagatagatagataatagaagatagatagataatagatagatagatagatagatagaaatagataatagatagatagatagatagatatttggttcggctctaactccacccgataataaggatataggagctaaagtcttaataaacatgcccttatttgcccaatcactaagcggatgatgactaacgtgttccacttgttgaacatgatcccgcatgatcccatcctttaacaagtatgaagggaatattgtcgtagatttgcgagatgtgaatatttcctcggcgtgggaacacaagagatttgataatttaacactcctta

SEQ ID NO: 38439 - DNA, 4555 bp, Oryza sativa
tgtttgaatggagagtgaggctgacatgtgggctcgggtggcatttgggaataaaaatttgggagagtggcatttgagcactggcattttgagagagtggcaaatagtaaattctcccttaaaaataggtttcaattatttgacatccaaccccacttttattcacttagatggtcccatatgtcatcctgtcaattaaagcaattggacaataaaaaaaatgtcgaattatcaaatttctcccacacggttagtttcggcccatctattcgctggacctatccacaaatctaccttaatgggcctctagaatagacccaaatctaaatgggccaaacaggcccgaaccattaaaacctaggtttttagagggttccgacccaactcgaccgcactcccagccggcggcgcgcactctctctctcccccctactccgccgcgctggtggcgccgcctcgaccccaactgcggcggctgtctccaccccctccggttggcagcgcccgcggccaccgccactaactacgcgcctgccgccgccgccgccaaggcctttgacagaatatggggcacagcgacggcgaccacggtagcgacctctccgccgacgattccccgtggagcgaggggagctggtccgacgacgatgacgaggtgcggctctcctcttcgaaggatttcgacctttttcacccaattgtttgtggcgtgcttttttttttgtttgtttgtttggtttgtgagtaagcgttgatggttcatctccggttgttcgagctgcagggatcgctatccttcgaggacagcggcgaaggctccgacgccgagtccgacgaaccggatgccccggcggtggaggagagcgactcttctgaggacgaggtgagacccatctgctgtttgatgtaaaacatcgcccgtttaattatttcaggttttaattcattaacgattccgcaatttcgtgttctcttgttgcaggtggcgccacggaatacgataggagatgtgccgttggaatggtacaagaacgaggagcacatcggctatgacatcactggtagtaagatcaagaagcgggatagggagggccgaattgaggcctacctcaggaatgctgatgatgctaagaattggtgagttgctgctagaactttggttggtgtagtttcagtagctgatgcagccaaaaaaactttggtccgatgaacataggattggattagtcatccataacactacaatttctattttgctacataagcatcacaacaaaaaggatgaatgagtaaatgatgaggctggtaggatgcttcattgcttccctatttactgctttttcatttccagtaggatgccctcattaagtcttttgattgtccgagtcttgtcatactcaaaacatgctagcttaagctcaatcatgatttcaggtaagaaggtgcagccacatgcgtattaacattcattttgaatatttcgttgcataacattttgtaaagatgtcgtcgggtccagatggtaatcttgttttggccaataaagtgaaaggttcttgataaccattacaattaaaatgtccatattttccttgtcgctccattgattggaaaatgcattttgcatgcactattgctttgcacatcatctaatgctagcttaattggctattaatctacttatgaatttaatttatcctcattgcttttttccgatttgtaggagaaagatctatgacgagtataatgatgaagaggtgcagattaccaaggaagaggctaagataattagtagattgctgaagggaaagactccacacacaaatgtggatccatatccagtacgtgcaataacacatatattatgcatttgtatttaatgctaaagttcatagctatagtaaatgcttatcggtagggggcaatgttgtcttaatgggtatgcaattatgcatgctgctatgcttatgtattttatgataaacattactaaaaaagaattcccaacatgtggcatacatatctgtaccaatttaaactgatatttttgccattacaaaaatattaatctacatttactatgcaaaattcaatgggggttacctgcatacatctagatagatagtgtttcctcaaggtttttatggttctagtgatgtattgagaggtagaggtatctcctagtgtctacaagtctcagtagagctatactttatgattaacactacgagatacatgtaccttccaatacctcttaaggaatgtaaaaaagtcctccaactatttatgattataatgtgtgttgctcgaaaatgggctgactaatgccttattttaggattatgttgattggtttgaatatgatggtaaaggccatccactttctagtgctccggagccaaagaggcgatttgtaccctcgaggtgggaacagaagaaggtatgttccttgtaatgcccctatttgtttagttatgtttttcaagatataaacaactgtgtagatgtttattaccgagttcaacttgattaaaagacaagatagatgaatgcatattctatatggaataatttattttctttttgctagagtgaaatgaatgctggcaggttacaaatatcttttttagtgaatcaaattcatgaatacaggacaatgaggtgtttcttgttttcttttattatgtttgctctattgcactatcttctgtttcagcatttggtattctaaatgagtgcacattgcagttagtctttaatgatgctacatgcactcttattccattgtgaagatattgttttcggttaaaattgaataagccataccaaatgcctcaattgtccataagaattttttgttaacttccgtctgaaatacattcgaatttttagtgcatgctgtcatgtttctggcacgctattgaactattaaacagttggcattgccattgagatagccttgtagctcatgtggtcttttgtgcaggttgttaaacttgttagagccattcgtaaaggatggataaagtttgataagccaaaggaggaacctaacttttatctcttgtggggagatgaaactgatacagcagacaataagcggcaaggcctgagctacattcctgcacccaaaccaaatttgccaggtaccatgctacaattgcgtaatcagccacaaaatgtttggacatgaacatttccgtgccagcaaagttatttagtgcagttgtgctgagcactcattatatttcaacttatatccattcttataatggcgttaatttgcatattcaggtcatgaagagtcatataatccttctgttgaatacattccaacacaagaggagatagattcatatcagcttatgtatgaggaggacaggccaaagtttattccacgaaagtatgatatctacattgttattttagttctcttatgtatgtcttaaatatatttaatattttatctgttggttttgtcagatttgattgtcttagaagtgtacctgcatatgagaaggcacttagggaaggctttgatcggtgtctagatctttatctctgccctagaacacgcaagaagcgtgtaagtagaaacctcttttcatgaggacatgtggttcattttttacttttcctccatttatcaatttggaccattcttttttttttgtcattttctagtacgtgttgattaatttataatctgcagataaacattgatcctgagtcactcaagccaaagttacccagtaaaaaggatttgaggccatacccaagaacatgttaccttgagttcaaggggcataatggtccagtgaagtctctttcagttgaagcaactgggcaatggatagcatctggtactatattcattttctatgagccacatgcatatatacgtgcagaatattctaatgattcaggtgttaaaagatctggcattaaccaatgcacaagatttgaaggattaggtcctttgacatccatgattgcacgagtttattgtaacagttacttctaatgtaggttcatctgatggaacaattcgtgtttgggaggttgaaactggtcgctgcattaaggtttggaatgttggtggtgttgttcaccgtattgcctggaatccttcacctgatagacacattcttgctgctgttgtgtaagctcatgctgtcccctttgatgcttttcctttctttgacctttatgtattctaaattccaatcttccatctttgaaacagagaccatgatctgctgcttcttaatgctgaggttggggatgaagacgctcaaatgaagacaaaagggctcctccaaatcgaggaactggctcaggaagaggataatggtaagataaactcaaccaagcaattctgctaatgtttacagactcattcactgtttctgaattcttcatactatttctatattgtaggtgataagaaaccagctgtcaagtgggtcaagcatgaaaaatttgatggaatcatgttgattcatcataaggtaaccgggtagtattacttaaaatatgacttccttttaagtta

SEQ ID NO: 38440 - DNA, 3992 bp, Oryza sativa
taattcagtcttcccactaccaatcagagaactgatgacactagttatggaagtacctttttgtgaccttttaaagtcaacaagaagaacctttaaccactaatttaattgctatataccggaaagttacgaagtgtaatatactaatatgattttttgtcttatcaagaacttactctttacatttttgtataaccatgctagacattcaaaacaataacttcggtgaaaacaaatatggtttgattgcatgcattcttgatagtgattatttgctggctggatggagtactatcagttacagtctacagcaaaggtcccatgtaaattagctatgttctttgttcaggtaggggcatgtgctttctattcttttgcatgtccccatataatgcataattatagacatgcatcttcattatgattttattcaagtgtattccttaattcctgcttacgtgattcaagagctgtactgttgcatcagctctctaagaagcattcgcatcatcctttccgtaaattgccaggccttcctattgcagcagtgtttcatccaagtcaaaagatgttctttgtggccactaagaaatttgttcaggtttatgatctccagaaggcacagttagtcaagaagttggagtcaggtgttcgtgagatttcctccatctcgatacatcctggtggtaagttatatgttagctgtatgttaattaactaactgctagatatttggggcaagagttgcttcacattgcattgtcctaagcaataaatcacttgtttatatcagtattattgcattactattgagttgattggtgcagtgatgatcttttataattctttcatttaggtgataatgttatcgtgggcagcaaagatggtaaattgtgttggttcgatactgatctatccacgcgaccatacaagacattaaagtatgattcttatcttatctttaaacatcttttcttttaggaaatctatagattttttttaaaaaaatgttttctgtgatgtcttacaaaggtaagcatcatgccaagcgaatttgctctttgctcagaaggaatgctgtcaattctgtttgaggttcatgcaaaagctgatttatttcctactaaaaagaagctgaaattcaatgttgtttccattacttttatcattacttattgtcctatcattgtttgctgagtttttttttctgctaacttaacattgatgttgtgtatttcaaagtgttgttatgtatcaaatacttgaatatggacagcatgggtcacatgtttttgctgtgtggtgccattctttccaggaaaatattccgggatgaaaacaagttctctgcagtcttaaaaaatttcacactaattataaatttatcataattttgagtatttattaaatttgaaatgtaaaaggttaaaagcaatgaaacattgatgccttctcttaattctaaacctagcgtaaataagcatagcctatgccctatgcatttccaaacatggtgcataaggttctgctccaatgaattatgctttgatttggattaaaagggatagctctgactagattttaataattctaaggattctctgagaggagagctactagttagtgctcaggaatgtcttcccttgttccatcttactcatttacaccttacataatccatattttttcagaaagattttccagttagtcaaaggattggctattattgtttgtcatccaactatgactcttctctttttcatggttcagatcacctttttttttttactgggagatcgcattattatgccctatgatcttttgaactccgatatttctattttgtgctgttgtaactcgtttgcttaatttcaggaaccactcgaaggatatcactaatgttacttttcaccggaaatatcctctttttgcctcatcctcagaggattgtacggcctatgtattccatggaatggtctattcagatcttaaccaaaacccacttattgtaccattggaaattcttcgtggtcattcaagttcagatggaagaggtacatatatatctagtgtcttttttaatttgcatcctctaacatgtcctttttcctgtacacatttctttacatacatgtattattagctttttgttgataaaatgtactaaccacatatattcctaaataattaagtcaatactgagttgagttgatcgagtaatcttagaactgtgtggatgcattgctgcaaattgaagataaatattttatttgttctctcctttttgccttttgggaagaagtttcttcttgttgtttcttctaattattagtgatatctttactgcattagtttaaaattctttgaaggatgccaataatgtttaactcatttgcttgctttattgttgcacttcaaaattcttcaagtaattttgggcacaatatctaatcatcagttgtgcctttgttggtgtgcaggagttctggattgcaaattccacccaagacagccttggttgttcactgctggtgctgactctgtcgttaggctttattgcgactaaaggtgctttcgaaaaaaaaaacaatagatggttttacaaggcaatgcaatatgtctggtctttctacgggctcgtatacgatgatggatggtgtatcatgccaaacacttaactggagccagggcacgtgttgagccatctgtgctgcctaaattttggttcaaattatttgtaccctattgttattttagttctgtagtaacagtgagacatgcagagtgttccagaatcgtggcaaaggtaggtgtgtactaggataaacagataaggaacaccgagctaatctatgctattccaaaagaggttttgtgctgtcacaagcttttgtggtctctgaagctgaactgaactaaaaaagtagtgatattggaagcttgagttcgacccaacttaggtgagttatagtgttcttcagtttgctaatggttttttatgtgttctacatgctctgtaaccgagcctgcagagagccttgtggaatgctcattgtctcattgtaacaatatgatgatctcaggattagtgtctgcgtacgcttctagctcggccatttacttcttctagaaccttctacattcttctcttcgcactgcaaattctaagcgagtgaaatggtcggtcagcacataagtagggttcgtagaatgatggaaatttatgtgcatgtacaatttggccgtagaagaaagaatacaacggttataagcaagggattatcaagtccacgaggaagaagcagaggcaggcaaattacatagtattatacggattataaagaagaaaccaccaccattacactaatacacacaaagctcgatcaagcagcttaattaatttcttccacatgtacgacatgcatcctctcctcactccgtgatcaatttaagatgattctttgcagctccagctcgacgacgatccatccgaattaaaatcatttgacctcctggatctcgtccagggcgtagttgttggtcgacacgccggcgtagttcaccttggcgaaccgaaccaccaccgggtagcgagtgttgggatcctgcatccagtcaattcaattcaaccattaattgattattattcattgcttaaaagtatttcttccttttgattatcgattggagtactaggagaattgaactgattcatgtgaaggctatgagatttgtacgtacctgatcaacggtgacgacggagccagtgccgttgtaccagtaggactccctcctcaggatcttcacctgcatccatccatgaacacattgcgtgattagttaaacgttaatacaatctaaacaacgcaattaaggaagctaatatcattagctaagcaaccaacgctcaccttggtgcctctcttggggccaatgggaggcggcttggcggcggcggctccttggtcgccacggccgcctcggcctccgcc

SEQ ID NO: 38441 - DNA, 25745 bp, Oryza sativa
  unsure (1)..(25745): unsure at all n locations
cggaccaccaccatcctcctcccgaccctgttcgccgcgaagctcacgcggctggccccgccgccgccgctgccgccgttcccgccggccagcaggaacctcgaggtggccgacgccacgttaatggtgctcgccatcgccgccgccgccgccgccgcgctcgtgtggatttcgaattccaagtgaagtgggagcaggtggtggaggtggaggaggagagtgaggcgtaaaatggcgcggggagattatctgcagcggaggctggcgcgggttggatttcggccagtggggaggcgccgcgtggcgcaccttatccgccggtgcggatgatgtggataacctggcggccatgggatggattcgctgccataagtggagatcgcgagtactagcattttcttttgatttgcgatataatttgacttggcgcagatcaagtgagtcgcgtgcttgcgtgacatgtgtacttttggcaactcatccgaacatgggagatattttccggcctgtctagggagcgtaaaattctgaaaagcaatttgttagtagccggtctatgagaatcttgaaaagttgggtttttcggtttctgaattctaatttattttctggattttacaactacagcttcttagaatttggaccaaaagctagactatttgggggagcttctgattctgggagaagttacagtagctagaagctcctccaataggccctaagattataagaagcagtcgattgatagttagcttcttcgttctagaaaagctaggtttttcggcttttggcttctacttcgttttctggattgtacatctactatttctcataatctaaaccaaaagctaaactgattggggaccttttgattctgggagaagctgcagaagttagaagctccccaaacatacccatttgtttggtggaaggtgagggtcattgacaaagttcatattacgcagtacacatatggttgttacaggtatggagaaaaacaaagtgtatatggacagataacaatgtttgtatcatattcgtcttttagtttattttatgaaagtaaatatgaatagctcgtttaaaagtaaatacgaattatcttgtatttttgaaaatgatccgacacgaatatagaaacgaaaataggcttctaaactcacgagagtatcgttaatttgtaaaatagaatggatgaggcatttgccatcaactaaaatccacaaatagccccaatagtgtatacaaacctgccatatgcatataaacctcaattaaagaaatgttagtatatgctagctttaagcaattttatttcacaattgcacaagctggaataacttacaaccgtgtatttaaattttaagttattatgatgtgtgtcacataaccacagatttacaagtgataatacttatgatttttttgataatagaatatggggttttttgaaatttactcttaaaatcaagaacatcatgcttccttctttccacgacgataaaccaacaattttatttcagcaaacaatgtagagcaaaaccaatattttctctgaatacttcgtaatttataggactatacttatggaaactcttttttcttcaaaggagatcgctaccggaaacttgattagatcccattggcgaaaagtttctgaacatttactcccatttattacgtatcatttaaatagttataaaaaacttttagaagacttacatggtagatcaatttgttatatatcatttcaaaaacatgcaagttcaaatttaacatacatttattaaaaactaataaatatgaatgtgaataatacaagtactagttactccctccgcccccaaaatataagaacctaggatcggatgggacatttcctagcactacgaatctggacaagctgcatgctgcctgtagcggtggtgacttgatcttcattccaagtgacattgacgtggcgtttatatggtattagaattaaaaaatattgtgacccatttgtagttcacacaatttttgtgagcccacatgtgaccctctttcttctccttcttcctcatccctccctctctcttatctcttgctttctctccccctttgtaaggatgtcgccatgtgtaaggacgtcgccttttcaagcagtcggatgtatcggcggtgtccacgctctaggtgaagatagcgcgccctcgactcgcgtggggtggaagcggggtgggttggcaccgacgatggcactggaggccacagagggaggtgggccattgagctggggtggatcgattgccgccgccggccacaggaaggaaaggaaagtagagctacaacatcaggggagagtggcgccgacttctgcctcacggctgcctccgacgacgccattgccccgtgccgcaggagctccatcccggacgatgacgacattgagctcatcggcgctcctcctcacatcctcctcggtgcagctgcggagctcaccagtgctcctcctccagccaccgtccatgggtccgctcatcctccggcctcgtcggtgccgacgatgacaatggaggaggcgcaagctcgaaggggagagaaagagagagatatgggagagggaaggaggaaggaaaggaaagacgatgacatatgggcctcacatttttttgtatgaactacaaatgggttccacatatttttttaattataataccacataaactaacaagatcaggtcaacaccgccacgtagatgccacgtcagcgaaaccgccctccaaaactaacaaggaagtgaaattgcaccggctttagtagtcagggggtcgagacatcaggtattatggtttagtgatacgaatcagattcagttactagtcgagggagtcaaagtgaacttattccaccttagtatccctctagaaagcggatacgtgggcctcttagcttatgggcccacatgtaaggctgtaaatagcccgatcaatcggccacgtccgcttcttctctctccctagcacgcaaccgagtcgagactagacaaggggagcagccgccgcgatccaagtcctcctccgccgccgccgacgccgccatggatccgaagctggtggaggtgacgcagctcttctcccgcttcaaggcagccttcgccaggaacgacttcgacacctgcgtagacctgctgtcgcagctcaaggtcgatcccccgtggatctcgtccgctcctgctgcgttgaaatattcgattctttttatcgctatttcgtccaagtttgttcttgtttcgtcggtgtagggattgatctgctgtcacgatgggatgtgtgtgtgtgtgtgtttttttttttgcataggttcgattgcttctggattcgattctagctagggtttcttgcccgggaaggcggatctattcctagtttacaaacgaattcgacggatttctttagatccgagtttgtagtaaacacatgacctcctcgtctggcctcagttagggtttttaatttttaatttttatttttatttactgtggagaataaagaaatactgggattttactaggttttagattattatcgaagtccaattctgatttggcactacagggaggtgtaaattttgtgaatttcatgtgttgacatgtggtacccctccttgtgcaggtccgcctcaccaagttccccagccttcctccatcatttcagcagacaccgaatgcagtggaagagctgaaaattgcgagtaagattaattggatgtttgcttttatattaatttctgcctaaaatgtgctacacttgttacatttgattgattctgtacatggttagttactcttgaacttctcatttgcacacaattatagatcagtgtatttcattgttaaacttacatctgaatatctgatgctgaaatttggtggctgtatttcattagcatgttttccacatgctttttgtggtcaatatctttcctatcttgattcctcttaggaaattgtgtatgcttatgttttatcgactcatgattatgatctagctattcagcaatagacatttgaggaagtattttagccagttaatttttatgtaacattgcagttatccatgacagaacacatctctatctctatctcttatcttctctactatattataaaaattgaagatgtttttgccagtactttggtatgccatttgtgtatgagtcggttttcaagttcgttcacttttggaaatacatatcagtatttgagtcgtttattaagttcgtttgcttttggaaatacagaggagtcgtataagatatctctttaaaagaactcgcatgctaacttgaggtgatcggactctaattgcaactcatgattttaagcgaattcccacagtgaatttcactttaattaaactgtataacaataataagattaaaatagccttcacctgtctagtactaagataaatgtgtaatctttcaggggacatctatgagcatgcagttgttctgagtgtgaaaattgaagaccaagatgcatttgaaagggacttttgtcaactcaaaccttattacatggatacatggttagttcctgtctacacttcacatcagttctgttaccgtatattcaattgtaggctgtcattttgatgcacgtaattttcttttatctaccattagtttttagaaactaaaaataagaagtaatcaaggataatttgttttcctttggcacgagttgcgactgatttgagcctgtactggtcaagtttaggctaccgtgggttatattaccgctaaagtgtagtatgttggtttttttatgaaatatcttttgattgagcaagtattaatctatattatgtaccagcatggtgaacattttgtatgcctctaaaacgtggtcatatctaactttggatgtaaaatttgatgaacacttgcatgataaataattcaagggcttgttgtaatggttgttttatgtttttttttctgtcatgtgattctaaatcattctgttttatgaagcggcataattccaccatcaccacaggagtatccaatcttgggtcttaatcttctaaggctgttagttcagaacagaattgcagagttccacactgagctggaacttctgccggtcacagcacttgaaaatccttgcatcaagcatgcggtggagcttgagcagtcatttatggagggtgcttacaaccgagtgttgagcgctcgccaggctgtgccccacgaaacatatgtgtacttcatggatcttcttgccaaaacagtcaggtcagtataattatattactgtattactggtgcttctcatttgatgtattgatttaaaatttgtgcagcccataatcccttatttgaatgcttgttctgcacatgcagagatgaactggctggttgcagtgagaagggttatgattatatgtcaatagctgaagcaagacaagtgctgatgttcagctctgacaaagaattgcaccagtacatcgcagaggtaattgctcttcctcccctctatttatgtgcctctcgtcaatttacatgatataaaccctgtatttaatgtggtgttacaggagcaccctgaatgggaggtaaaggatggttccgtcttcttccagaaggcgaaggagacccagccctgcaaggagataccatctttgcaggttatcaaccaaacgctcagctatgctagagagctggagcggattgtatgatttgttaatgaatatcatttgagatcatttgggacggcatgttcatgctatgtacacatcaggtgtcacggttgagatgcgcatgttgcagctttgaacgtttgagatgcccatgttaccttatgatactttttttaaaaatttcatttaatgggctggatctgtgtctgatgtttggctgcccagtaactctgatcgtgttttgatatgtcagttcgtgatcaatttactttgctgaatagctgtcctgaaaatgttcagtattagtcgtgaattgcaactgcaaactgttgggcttatgatgatgaaatgagatcgtacttattttgatgatcattgtcagtgtactctgatggaggctcatagtgacacctcggaacaatgttgggacagaaaatgtggtgagcgtttaatttgttgaaattccaaaaattacttttgatcatatgatagccgaagtgctccattgcatgatcaaaagtccaaattgaaccccaattattatggtattgattgacggtgttttttctttgtcacgtaaccaacccggaaaaaattttctccggggtgcctcctcaaacccctatatgtgatgtccctcttcagatttgatgccgcagcccgtcgttctgctgccggcgcaaccaacgcccatcgacctgcaaacaccacttacgatggcgaatttgggtggctgggacgaccacacatgcaacaatcaaatggattagaaatgccatccaagtttcagatttcttcaccggtcctagtcatgccatcgtcaacgaagtcatcttaggtcactcaccggagttattattgcaccctgacaatctcgatcttggttggataatcctttacagagaggctttacagagaggctaaaagggtcaagttcaatcgaacaccaattatcacgagcaaatcagcgagtggaaataagactcttaattgtgttaatagaaagtagagagtatcttttgccgtggactagatttactccctttatattcggttgtggtaggaggacgctaatgaaactgggagatcgctagttagcgcgcgctccggcggcgcacattttgtcccagaaggccaagtgccgctgcaccggcgcgcgcacgcctcctccaccttttttttttcgtttttttgccttttttttccttttctttcctactttctttctggttttttttaatctttagcatgttttgagtttgaaagtttataatttttgagttgaaaattttcaaatctgaacctgaaagttttcaaatctcgagttgaaagtttttaaatcttgatttgaaagtttttgaatctggagttgaaagttttcaaatctcgatttgaaaaatttcaaaattttcaaatcttgatttgaaagttttctaatctcgagttgaaagttttcaaatcttaaattgaaagttttcattttttttaaatctggacttgaaagttttcgaatctcgattctcgagttgaaagtttttgaatctgagttgaaagttttcaaatctcaagttgaaagtttttaaaatttaactttaaaatttaaaacttaaatcgaaagttttcaaatctaacctaaaaaaatttcaatctgttagtaaaaaaaatctcttaaaaaatctccagaatcttttccctagttactatcattagtgttaagtatattaactaatatagtagttaagactaaagggggagggggggggagtgctagcagtcccatgaaactgagggtctgtttggtacagctccaactcctaaaatttagctctagtagttagttctggagtggagtcgtggagctgcctaaacacagctccacaactctagttcattttgtgagagagctccacccagctccacttccagttttggtggagctgaaactgtttggctgagctccagctccaggaggggtggagctggagctggagctgtgccaaataggccctcctacattttgaggaaccaaaactccaaaagtggactgctaccttttttccttcggaataagtccatcttacctccctcatctcttgcacttggatgaataacatccctcaaccggaaaaccgggtataatacctccttcttctctaaaaaccagagcaaatcacctccctcggcggtttcggaggcggttttgtcctacgtggcacttacgtggcgatggcccctccattgactagctgagtcagcttatagaccccacctgtcagcaaccccctatcccatcttcttcctcacgcggacgacactagcggcacgccggcacgaggctgcttcatcccgaaacagagagagaggagctggacctcagcacgtcgcgcttcgtcgtctgccgcaccggcaccgtcccctccgggcacgactcgtcgtcgttcgtccacgccatcgggaacacgacctcctcctccgccgcctccccatgcgccgccgccgcaccaccaaccttgggcctctcctctggctccggctcaacttgcacgcgcacacagctgtcacaaacacgatcaataaacgtcgccggagatagaaatgatcactgcaaattgaaacaaaaatgaatgagcttcgggtggtcgaacgccggttgcaggtgcagcggcacgcagtcgatgacatcaccgtcggggctctgaatgcaaccatgcacaacacgacatccaaccacctcgagtctttggtacgatggcgaccggtgctccgacgtcgtctgccaccgccgccgctccctaccgccgccgccactgctccggccaaggtggagagagaggccgtgggagagagagaagggagagagagagggaggaggaagaaggaaaggagagtttgcactgacatgtgggtcccaccacgctgagtcagctcgtcaacgggtcaacgacgccatgtcggacgaaaccgccagccaaaccactaagggaggtgatttgctctggttttcagagaagaaggaggcgttatacccggttttccagttgagggatgttattcacgcaaacgcaagagatgagggaggtaaaatggacttattccttttcctccccttcccttctctggcccaagtcaagctggcctaggtcagcccaagccaacccagggcagcccggcccacttgtgccccaactctatccattccactcgagcttctcctctcaaggtcgccccgccaccgcactacacttctctcctgctcttccaccgcctctccccggccggagctgggaaggggaggcggaaccctagctccgccgcccacgaaccaactccgaaattcgccgcgtccgatcctcctcctccgaaattgaaggtaggaatggattccccattcccgcgcccccctttcccctctcctccccaacctcacggcccgccggaattcgccggccgccgttctcggccgccccagctcaagccgccactacctacctctactcagtgctcgatcttcctcgctggaacccgccggagcgccgccgcctctcacgccaccgccggaatcggcgtcccctcgccggtcctgctcccccttcgctgctggccaccggcggccttgaaccgctgacgacccctgtaaaccgaagaaaaacgaagcagtctcttccttttgaaataaaaatacaatttctctggttcctctggttcagtgaccaactgaccattcgaaaatctgccacctgttcccaactcattgaattattatcccgagtccatccgcacaagtttcgtctcaatccgagcatccattaacacaacccccaaattttgattcttagggttcgctgaccgttaaagctacagaaattttcaaatttcaccatctaacctcttttgatcctaaacggcaccttccgaggttttagtgtttatttggattttatttgcttagctctttaattgtgtatcgatagattacgccatcggttcaggagaagggtcagagtttgctgttgatgcatacgccatcgctgctgcaggaggagacgtttggtacgactacgctgagcccaaaggcaagtcatctccctttatcataatttgaagccaattgtgcttgccttgaagtacgttttagggtgccttgaagcatacttaaaacctttcaaaatggcaatgaccagttatctcatattgctatatacagccatgccttgttgttgaacctggtatatccttggtaacccttgtacaacataacatgtgatgtttacagtttagttatatcacttcatgtgttcagatggaaatgttatggttcttttaaagtttataaggataaacccacttatactaatattaagtggcatagtttacgcccatacgtttgaccgagtaattagacttgaatgaacacatttccagtggattgaaatcctatactagaatttcttctctaaaaatgtttggagtggcgtctctccctccaaatctcgttttttgaaatcctgcactaggaccccacaacccgctcgctcttgaagtgaaccatatatcggcttgagattgtgctgaggctcttttgtgtatgccttatggtccttacagtgtattggacctattgcatcttttagctcgtcaaggtggtacattaacttcaactgagagtatcggagtaggtcccctacccatggcattgggtctcccgcacggtacgcgttgggggcgtgaccccgtacacgacggagatgttcacggtggccttcttgaacacgacccacccttcagcacgtggctgatgcccttgccgctgcccagccgtgtctaggcgtcctcctggaattgcaccctgctccacatgcctaccgctgctggcctccttgaccacctccagcgccgtgcacacctccacctgcgcgtgccggatcgtgcgctcgaatcgcgcctgcaccaacgcggccttctcctctcccagcaggaatgtcagcggtaccctacggcctgcgtgatgcaagagagaaagagagacagatttaaaccagctcagccaatcccctcccgccacatgctccatgacttattctcttctatctacagctcgctgtgaccgggagctccgagttggccactagcaatggcattgtcggtgagtttggagctctcgcactcgcctccgctgtggcaccttccctccctctgccatcaccgcccaggtataccggatccaagaaaatcgtggacagtaaagcaacccaagaggatctgcagccgcaggtatcagccacaatccaaccccaaagtttcttccttccatttcttcagatgcaaacaattttctcgtcaactggcgaacattcagtgtcaaaactgaagagctgcagagattcagtggccggaacaaccacggaggaggacgagggagcccttgaggcgcggcacggtgagtccgcgcctccctgtgcccgaccacatccctctccctccttacgccggcacgaatcgcctccctgatgttgaccccaatcgacagctgcatgactgcgagagcattgctcgtatgagagccgcctgcgagctcaccgctcgagttcttgagtacgcagggacactagtcaaggtaacccttaaacatatatgatccatatatatgtacagttcttcatcttctgcccaattttcatttgaaaaattgctttgaaaaatatgcaacaatcgaacatgcgtgtaatcatatatcttattaatgtgtcagccattggcgacgactgatgagattgacagagcagttcatcagatgatcatcgacgctggcgcctacccttctcccctaggctacggtggttttccgaagagcgtctgcacgtcggtgaacgagtgcatctgccatggaatccctgactcacgggtgctacaggtcgagagggattcatgagcccttctgcttcttacattcatatatattttagttctgtttggtactgatgcttggtttcaattactgatcattcttcttgcagaatggagacatcattaatatcgatgttactgtctacttgaatgtatgtgattcctttttcattcttctgtcctcttttccttgtcagtcatcaccattcaattcgattgaaatcatctgcattatctaaaaaaaaaattcaacattcaatttgttactcatggtgtgctgctcttgtgccattaattgacctggttattgacacatttgcagtgtaaaattaagtgacatgtagtgtgtttacctagggataccacggtgacacctcaaggacatacctatgtggagaagttgatgaatctactatgcaacttgtaaaggtgtaaatgaccttgctgatctctgctgattgtttcatgatacgataatgtttcatcctgtatctgaagaaacttatatattgttctgtaactaacatgctgaggggaatatcagcctgcaaacacggtgctagttttaagacaattggtcagagaataaggtgttaatctctcttacccataaatttcatgatgtctttcagatgaatcaagtactaatcagcatcgatctgaaagcactgaaaaaaggaacacaaaaattgatcaggatgctgtttttcccagtaataagcaaacattttcctctaaaatttactgagaaattttgtttcatgtacttatatatgtagtatattatctatcatacattttttctggtgcactgaaactcaaataagctgaacagtaagtggaaaaacatataatgctgaatttcaaatgccatgaatcataaatgcacttatcctgtcagtgatagtccagcttctacaaataatttcatgatttctgatttcagtgagtacgtggacgagtacgggtacagcatcgatccctttgtcggacatggaattgggaaaatattccactcggaaccgatcatttggcatacctgtaagtagccaataaccatatatatgtcatgtagtctaatttcagtatggttaatttcttacagacgacaacacactccctaactaattgatttaacatagatgattatgagccaggctacatggttgcaggccagacattcacaattggtaggtaggtacatacatacatacatgatcttgtgttttggttaatggctgggctgcatgcaatgcagagcctactctgtccatgggaggcacccagtgcacactgtgggacgacgggtggacggctgtcacggtggacagcagcctcaccgcgcagttcgagcacaccatcttggtcaccggcgacggcgcggagatcctcaccatgcacccgcggtgagatgacgagaaattctacgcaactagcaccacttgcatatcgtgctggtctaaaagcatccttttctcagttttcatctttcacaaaacaaaggcaactcatgatctgtacagcattttcaaatagtagcaaaatgcccatactttgttacgggattaaaaacaaaatcttactgtatgctctagaatagtacttcccgttcaataattatgggattattaatgtgactgactggggattagtagaatcttttcagaatcatttagagactatactgctacaataattgagacaacaagaactcttaatcatcaatgcaccaaaatatttttttatacccttctttccttttctccatcctcatacaacaaaatttcctttaacaaatgttaagagtcgactctgagctgttgtcatgtatagcaaccatgtttttctttcctcttctctctctcttccaaattagcaaatttacttgcatggcaataaagagagagatattacacacggttgtacatgcactcataggcccaactgcccttttaaagaaacgaaaaacccatattctcacacgcagaaggcggaagccccaaatggccggacgggagcacttataactgacatgtggcactcacttaccagcgccaccggtttgttttaagattggtatagatcctaatttcaaagagtgattaatcatatcataaccggagggatcgagtactgacctttgaagacattagagccgaaaagaggggtcaatttacaaaaaaaaaaagaaaagaaaatattaaaatctccccctttgacgagctagatgagcaagaactaggcccaaactctcgacattccaaaagttaacctttgagcccttacctaaacctcgggaaacggaggaagaaaaaaaaattaatcttcggaaatccctttccaagaaaaaaaaatcagtcttcggaaatccctttccagttcgagaatgatcttttttaagattatggaagcacctcaagcttttcctatcgaaagagaccacttgccccgtgtagttcccatgaggcgatcgaggaaaattttctcaaagacatggtgaggggatcaactaccatcgtgagcatgagcggttaagagatatggagctttcttccaaagcaattcgaattaactccccatccttaactattcaatgtctcatgaaagaggccatggtgaatgttcactataatcccattgttggtgctaacatcatatccacagcctttgcattaactagcttaggggacagactgttagcacccatagacaaaaccttccgaagttcctcaggtcttatgatagaaggttatgggattctatgtggagggccattaaggcacaagaatgtcaaagccctcctagacttccacgtgttcaaaatccctgactttgatcttttaatcgtccattccacataaaagcttcttctagatgtgcccagaagggaggactggcggtctttgaaaactccaaaaatgagttgatcccacaacgagccgtcacgggatggaggatgtgcattgacgttggtatttcttaacgacattactagaaatataattcccagcaatggcgttgaaatattcatgatatattttacggttacaaatataatccgcaagtgcacggatataatgttgtagtattttacccggaagtattccaaggtatcgtatttatttaattccaatgagagatatgataagagaatactatgctaataatttatatcacttgtataaatcagagtctatacaggagttaggcaatatttatgggtagatcagaaaaatgttgacacaaaagaagtaaccatattattctcattaaaataaagtctaagctaaatggagaaagaataatagaagaatcattcatgtacttctagtatatagtcattttaatatacacttgctaatatacaacaatgcagccaataccccctaactatgccctcctactgtttcgagaaaccacccctgattgtcagtttcttacccgtcatggccatccaaccgataatgaatatgggggagtacccacaccaggaaattgtcttagtactatatacccacgtagaggaatacccgtactgagctatcaccatcagcggcccaccactactgttatgtggcatataataccaattaatgatatataataaactaagcactatgcttacattactaaatactacactatatcgttgcagcagacatagagcaatcatcaaaataaacattaaatccacaccattgcatatctctggtaggttagctacattattatattgcgacaagtctaacataaagtcggtacttagataatataaatgaagtaaagaactaaagctatataaagaagaatatttcattgataatataagtcttacaaaagaaagaagagctactagaaccatacccgaaatctcctgaagacttgaggaactagaaaactattttgtttatactccagtagtactagaacaaagtaaataaactagagagagagagagctcttgattcttcttcttcttcggtgtgtgatggagtggagtgaactgacctccataaatagactgccaatgacggttgtggcagttggaattgtcggaaaaaaacccacaaccgtcattggggagcaatcatggacgttcacatggaaggccgggatgagatgccgcagctagggttcggtcgaacccctggtccagccgaacttgggccggcccctctagcctccaattttggccgaggactttcttgttgggccttgttcttcatggtatggtagtgagcttatttgcatgtgttaaattggatttgtaagatcatccatccataagtctgccactcggcggtcatcgattgatcgttcagttattttccgctgattctcctccgtttatgtagagatctttgtattcaaataaaattccaagtacaaatggaaatagattatttctaataaaatacgcattgcaagcataactagttctcttttattccggttatattgacggtcgaaattggtctataacgactgccaacaaactccccaaacttgaacctttgctcgtcccaagtaaaagatttacaaaaacaaacttagttgttaattaggagttgctaccatgctgtatatctcaaaggtattggtacaaagtatgagtactctctctctcgttaagcgagttagcacggtggcttacccatgcgcctaatacccgtgggacacatgcttctccttgtctttagtggttgagagatagaatagttagtagagcactaatcaaaagttttcaagtagagcactaatcaaaagttttcaaagttgcaaataaaagccaagttcctcaaatgattctctcgattactcaaaagtgtataacttgccattgatgtgcattcggatttcttcggctcccacattgatgcatgcgtctgtcatgctcaggaacgaccgcccaaggataagtgtggtgtccttgtcggtgtccatatccagcaccacaaaatccataggaatgaagcaaccccggattctcaccggaatgtcttcagcaatccccgtcagatagcggaccatagaatcggtcaattgcagcatcataggggtaggcaagagcgttgtatagttcagctagtcaaaaactactttgggcatgacactgacgcttgctccaaggtcgcatagggcatggtcgaagtgttgtgtcccaattgtatagttgatggtgggacaccccggatctttcttctttttaggaagtcggttgagtatagccgcgctacactcttctgttagtttgacgatctccgtggtgggctgcggccttttgttgctaatgttatcacggaggtagagagcataggttggaacctgcatcgcatccagtaataggatattgatgtacattttctggattacctcgatgaaacggagattctcccgagaagggcactggtcttacttatcacggaggaatgcatttgagcacctctcccaagtgtctatggcacccctcttggagtagaaccactgttttcccctcccaagtagggagaacagaaacaggcggagcctgatggcgtcctgggtcacacctgcatccaacggtattcagctagcctaaacaccatgtttatgctagtaaataatatcactaactctcccgggactctcaccctttcggatgaacaagttggagctagagcaacttataaaggtcattggaccgttaccgtagcatggatcgactagcctaggatgaagcagatatacaaagtatatactactcatagaacatatactaaacaaaggaatacatatgctatgagcataaataaataaagaagatagttccattaatataactatagtcttacaagaagagtaaagtactaaagacatactggaaactccgagaaggctgtaagaccaaaactcctctagactttattcctactaaactatggacaacacaatagggaagagggaattgctccttgaggtgtgtgttacaagtgagggactgagctccttttataggtggcttatgacagttgtatgtcggataaacacccacaatcgccattgggacttgggagccaaccaggaagctacacgtggagggctaggatgaggggtggcagaggcggttcggccgaacccttgggtggcagaggcggttcggccaaaccaagggttcagccgaacccttggcaccgcctttctccactgcctttcaccagcagatgacaggtggggcccctatgacagttcctggtgttttggccccattttaggtcggtttggctcgacttgtgggcccctcaatccgtgtgcttgcacgtgattcaccagaagtgtgtttccttgtatgttggtcccatttctccttcacttggatgtataattcctgcatccatgttatttctccaatcctaatgcaactacattatttattattggtatatttgtacaaaatgctaattttctctttattagttgtgctagttggcggtcgaaatcgatactgaacgttgcgcaattctattatcaactaattaggcatacttcttgtatgtgcactagtgatgcttacgtgcgactttcatcgtgttcgggtagaatcattgagagtttccatagtatttggtgtaaattcggtgcaccgaatagcctccgagtcatattctcaatgaatcatagtaaaaaaaaaacccattcttgctctatgagaggtgggtgtgcatcataatctttcaaaccacttctttcgtgtagtcaacagagtgtcaacgcactcgttcatctagtgtactcattcatgaaagtaacatagagacaccaatgagagactgaagatgcttgatcaatctcatcaagctaataaatagagtgtacttgagttgatggtgctcaaagcttcttgcaccgtcgacttcggttgcatatgtcagggatattctagattcgatgaacttcttgttcgtgatgccagtcatctttcgttattaaaaaatacacgcaaattacatttaggtaaaatgcacaaatgttgcaatataatggtacacaaaatttccgcaaataattccaatatattctatgcaattctatacattttacagcaaagatatcaattaagggtaataaaagcattacaaataaccactaatcataaatgcaataaataaaattcataattataaatatcaacaacaaaagttcctgaaatgcaaaatcgggatcaaaattcaaaaatccaggggctcttttatgcgagaatatgattttttagtggttttgcaaattccgaataccgttcaaacaaatatcccaatgcaaagggttatttgtgtatttttaaaaaatttcagggtttaaaacatgaaatttccaattcagacaaacatgcgatttcccaaaagatgagggtttatttgcaaaatcacaagattcaatcattttctttttcttttttccctttgttttctttccttttttcttttctcctcccccctcccccgatggtgctcctgagtcctgacaaatgtggcgggcggggaggctggcgcgactcgcacgatgggtgttgcatggcggcgtggaggccgagacacgggacgggcgactgggcgacggcgacacgcatcacggcgcgcgtgctgccgctggcgcggtggcctcggcgggcgcagtggctccggctccagctcagccagcggcactcggccgggcggcggctcggcgcgagcatggccggcggtgaccatatttccgtgcggcggcagcgcgggtcacagcggccccatcacggcctcgatggcgcggccggtgtcgccttctcctttttttattttttttctttttcttcgatttcttctttctaatggcgcatgtgatgtcaggcggtgtggccgccggcgcccggctctatgggcaagacgcggcgtggccgaccggcggtgtaagcagcaacggcagtggccgacatcgcctccccggtctccgcttccttttttttcgttggttcctcctctttcctttcctcttcttctttccttctaccttcccgataatggagtggaggcggcgtagccgtgcaacgacgctgtctagcggaggaggacggagacagtgcaactgtgcaaggttgacgcggccaaggtagcatgctagtgtgggcaattgcattcaatttcttagcatggagtgatgcagtaataactatttttattgacattaaggccaaatcactttgctatatcttaaactacatacatacggaatatgtccattaatataattcatatggataaaaactaaccatcaacacccatgacagtgtccttgtcatatctggagtttccgcaagcacatgtagatatttggagttttagctacgctttaggtcccctttgaaacatgggataaaaaacgcatgaatggaagtaacatgttttttcaatcctatagaatataaaaacacataaaacataaggagaagtttgtttgatgcagcacagtaaagattgaaccaaaggaatgtttccaataggctttatctcttacttatttttttatgaaattgacgataggatacaatcttaaagaaaacttcctatcttctttccataaataagagaaatcctttgccaatcctcataattattaagcttgcctaactgtcgaaattaattactcatcttcattccaacttttttttccagtgaggaagaacctaaatctttacattgcgcatatttcaggactatcatgttaagctcacatcgctggaaaatattttacaaggagtcatctatccaatagtgcctggatcaaccaggagttaccaggagtgatgtcgtacgcctggccatcatcggcccacctatcagtccccgccacgtggctccaccccccctcgaatggctctaggcaaatcacccagctggtatgcacgttgtgacagcatattctagtctggtttcccaaaccgccgaggctggggttaccgcgccccggcggtatgcatggttactgcggtaaccgtgaaaaactgtatgaaatcgtgcaaaattcatcaaaaatttaaattatttttaaatttatttgaatttaaggaggttaccgtggtatttacattaccgtaccccgtagtaagctcgataaccacggtaaccgcgcggctaccggccatacggtgatccctggtctctctcctttttttactcacccccgaaaattcacacccacccccaccaatcctagagcagtagggccccttccaggtgggaccgacgcgcgccacgtcagcgtagcgggtggcaattggcaaagcctccgaaacagagattcccctactaccagaatcaccacggtttccactccaccagcgacacttgacacgcacgcgccacacgccgccgctctctgtctctgtctcggtctcggtctccgcctcccgcgccgcggccacgccatggccgctgccggcagggacccgccggcgacgccatcctccagtgagtgaactccggttccccccttcgccctctccctctcccttcctcctcgctctcgtctggtggcaaagtccccggaaggggcgggttcgttttttttctttcttcgtattatgtgtttgattgagaggatatcctgagatggattgggatcatcccatcttttacatgtgtttggtttaaagactagcaagattccaacagagaatattcgggacaacctcatccagaaatctggcggacggcgccatcccacctccgcacgcgcggtgactagggttagcgcgagcaggggcgagttggcggcgggagtgcgctagccggcggcggccgcgtcgtcgcccatcctcccgcgaacccagccggcggcaaccctcggcggtcgctgctcaccctcggcttttgtctggttgggcctttcctcggtgataatgttggctcgcctccgttggtcgaaatctccggtgattttattttatttttggatcgtgatattatgcattaagcacctgtacatgtacacctcgatttgagtagaacaaaggtttgtagtattgtgcttggaaatgctcctcggaaacaaaccattcatgacatttgaggggagaagtgcttgttctactcctacctcatttgtttgtatgtttgagtgaactaggttctggattggagcttctttgctttgttttggagtaatacctgcataatgtttctagaacgctggtagcggtggggggcacattcgtcatgtcgtgatttgagattctcatggcgtacaagggaggtgtttgttgatggcactttgggaagtgggcgtttgtcgatggtacatataaagaagagtagatttcacaaaactcttttagtttattatgccaaaccatggtgatgtatgattaatgacatctatatactctaaactattcttccctgctaatttcaattaatactaattttcttgtcgtgttgagccacatcatcctgaatcattatggttattggatagttgttctgtgtctgagatttgcaaccagatcagaccagccgctccattcacatatcgagctcttatgtgttacttgccttatgtgcttgttgatgttgtttcagtattgctcactattatattatagaacatcctaaataacattcttaaattaagagttgtgcattaagctcaccattctacttggcatttgcacagtttcattgttttgcagacttaggggctattcaagcatcatttggtttccttcccaaccaaaacctgttctttcatggacctaatctgttgttttgtcttattctaacttgataccccaaaccacaaccaacatctcctctgatttaatcaatctgctgtctttgtaggaatgtattactgcaggcaaaggaaggcttcttctgaggtcaatgccaatgtgtttgtgcctgggggtcagaatggtatttcatttcctgcatcaaatagggctcatgattggggatatggcggtgttcgcgaagaatgggaagctagttatgctcgcaaactccagttgatcaattttctttcttcactgcatcaacgcactgcaaattctttgataaccactagaatggatgctaacatggacactcctttggagcaaaaacaaaaggacagctcagcaataatagttcttgattccgatgatgaggacgaagcagaaagatgtgaacagctcgcatctgagaacaataaacaacaggcaccatctggacccactagtccttgcacaacatggattgtatccagtgcgaaagaccaagtaaatggaaccttgcatgttgatggagtccaaagcactcaaattgttccatatggtcaaaatgcacctttaataaatcagtcccctttgcaaaccagctggcaaccatctatccaatatgaaagggttatattgcagagaagacctgaggagcaacgcgttcaagatcttgtggtatgtatctttcacttgaaatttttcaatggactatccacttctacatattggtacttttactccttccacatacctgcactgataaaccaatttattgcatcatgtcttgtgattgtactttgataaatctgaagagcgttatgatatttcttgtctggaatgtgagaatagaaatgtttggtgtttgttgaatctatactcttttgaagcttaaatatctcatatttgaactttaactcttgttgctcactgtaggcagcaagccatgcagagaagatagcagaaacacaagttttccttactctgcctactcttcctaatgagagaaaacgaaggaaatcagaaccgaccaccctggtagatggagatggtggaactaacctagggaaaggaaaaaggaaaaatcatcaaaatcaagcagcagttgattcaatcttggatttgcaacaaactgttgttcctttgcaacaaaatgatgttccttcacaaagctacaggactatgatagaagaggagaaacctgtaaaagaaagtgatggtctcgaggatctttggaaagatttttcattggctgctgaatgtacaaaggtacaagatgtaatcacagatgttcttttttacttttattctgcagccttataatactgttggttctttttccagctgacctctaattgtactcggaaatacatgctgtaatctttattttttgtttcaagattgaataccactgtccacaaagtaagtttcatggcaaagtgtattttataagataagctagagtttgaaaaggcgttcatttgtcatttaaatcagttaaatgcgtattttgacaaagttttgaagcatttcagttgattatttctatctgatttgtgtctttttccaataatgatcaaagtaatattctttgtccagcttgatacaaatgaagacatgtccaatgaaaaagatgtggatgatgaaaacgagatggatgacgattgcaatcatgacattcggattcatgaagatctaggccatgtatgccgtatttgtggcatgattgttagaaaggctgaaacaataattgattatcagtggaaaaaggtacataccatgttttggacatatgatacttcaaagttctcaaacctgtgatgtctatgattctgttatgggaatgggccaggcccatgcaacagtttaggcatgataaattaggaataagtcatatgaatataggagattatctagttaggaaagatatgaggtttattagaaagttagagatagagattggattggtttatataatactagagactagttccttatgtgtctagtatgtcctccctatatgtaaagggaccccatgtactctagtatcaatcaatcaatgaatctaaagttagccctaagcctcagagcctcttttagctcagcagggagaagccctgcctctgctattatagggcgagtgccctatcccccggtcctgggacccttacctaaccaatccataacagactctagttttactttgaggaaattaatataagcagacaatcaactttgggaattgttttcttcataaagaaactgcaagttgattatttacatgaaacccctcatgtcccatacagtgtccacttttaaagccccaagagttagatctggttatacttgaccctacacaccagccgtatccacttgccgtgttcatgtcaaaaaccattttcctcacctcctatgcaaatgctattaatattaaggcacagtaccttgaaggactttaggcagtggaagggcatcacgatcaagagaaatttgtggagtcatgctgaatgaaaattactgatatatggtttttgtaatgcttgttagattcactatgaatatctagggattctggtttcttttgtagaaaaacctgctatgggggatcttctctttactgaaatacttcctaaaatgggagagtgttttcattaccaactatattgatattgataccgctttggagtatatagtaatagtcgttttgcaaatcatatggatttctttagtggcttgtacctgagctaagctgggagcctgggcagtatccagagcatgggtcctgtagcaaagatggaatgcttgcatcagttttctaacgtttgttggattttcctacgtggataagaaagttaacttcatgcttacattatatcaggcttcaaggacaagaacaaattactatgaatcacgttcaaaggatgctgatgatattgatactggtgctgttaaagtttctgaagatttcattgtctctgatattgccattcatccaagacatgcgaagcaaatgagaccacatcagttggaaggattcagcttcctggtcaagaatctagttggagacaaacctggaggttgtattctagctcatgctcctggttcagggaagacatttatgctcataagtttcattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 38442 - DNA, 3503 bp, Oryza sativa
gctttgaaggaacctttatgtggtatgctctctagtcataagttaaccatctctaagattcgggtccaaggttatgacggagcttctaatatgagaggggaatttaatggtgtgcaaaaattgattcgggatgaaaatccttatgctttttatgtccattgttttgcccatcaattacaactagtagttgttgctgtttcaacttctattccagccattgcagatttattttaactatatgcctttaatagtcaacactgtgggtgcatcttgtatgcgaaaggatgccttgcttgcaaagcatcacgatgtattgttagaaaaggtggagaatggtgagattaccactgggaggggcctgaaccaagaaagtagcctagctaggcctagaatactagatggggttcacatcttaaaactttgcttcatattctggtaatgtgggaggctatcatagatgtgcttgagattgttaagaaagattcaaccaaaccaacatttaatggtggagcatttggtttgatgggtaaaatgcaaagctttgattttgtattcatcatgcatttgatgataggcatgttgagcattacagatgacttgtcacgtgctttgcaaagaaaggaccaagatattgttgaggcaatgagtttgctcatagatgtgaaagagctcttgcaggacatgagggagaatggatggaagccactattgaatagggtgatttcattctgtaataaacatgagattaaagtgccaaaaatggacaaggaagttaatgaaagagggacatctacacgtcgaaggcacaatgtaacaaataagcattactatcatgttgagatctatcttgcagccatcgatgccattttggttgaaatgaaccatcactttagtgaagttagttcagagttattagtatgcatgtcatctcttaatccacggaattccttctccaactttgatgtggataagcttgtgaggcttgctgaaatttatgctgaagattttttggtttgtgatcttatgctactacggactcaacttggaaattttattagcaaggttaggagaaataaagaatttcttggatgtaaagatcttgcaaaggttgttgaattaatggttcagactggaaagaataaaacttatcacttggtgtatagactcattgagttatcattgatacttccggtggcaatggcttcagttgagatggtcttttcagctatgtctcttataaagatagatttgcgaaacaaaatgggggatgaatggctcaatgactcgatgatttgctacactgaggagcagatttttataaatattagtgatgaaaaaaaatcatccaacactttgaagagatgaaaaagcgccgtatgctagtgcctcaacagaaattagtggaatgctccatgcctccattctctccccaagtctctaaattatttgaattcgaaataagtccttttcgattaatcgttaatttgcctttttttattagtctagatagctactcatgaagaataataagtggttggcatagatacatcatctattggacattggtttggtatggacaaaattccctcctaatcattaatttggatgtatgtctactttgaactatacatgtagccgatttatatgtgagatgtttcaatttatgctggcttagtttgttcagcccccactacttttttttcctggatccgcccctgtgagcaatctactataaaatatggtagtttgaaaaataatatatatttttagaaagtatatatagaacttttttttaatacaatatatacaattggtcacaaatatcgtgtttatagcatcgcaaaaacatgctaaatataatttaattttaataataaatgattaaccttttgttatctttacctaaaagataaactttgttgtgaataaaactgtacacaatgaactcacatagtctcatatatcaaaatctacacttccaacggtatacttgagaaatttctatgttcctttgattcctaagggcaaaatggacctttcacgtatcaattaaacagtcaactgatgaaaaagacatacaagcgatcaaatcaaaactcataggtatagaagaaagtgagaaaaatcaaagacattggctaaaattttatgagcgtacaatgaattttctccaaaacaagaggctaaaactatacaatacatatttatgactaaattgcatagggctactacaacttgtacaccatgaaagctgcatttccttaaatcccaataaaaacacgaaagtttacagggaaactcgtaacaatccacattggcatgcaactcatctcagagaaaaaaaaagaaaaaataacagcatatttcagaacatgagctagctaataaagttggaggtaggacgcaagtaccatgactgaatttttctaatccatgttaaatctatactttctacaaagttataaagttataaagttatagttcactaagtctaatgctcaatatgcaaccgtgtcttatcatcacccaatagcaaccattatatatttaacctcatacaagcatacaacatcatctacaattagtttatttaattctataaatcaacatgcaagcatatccttttttgtttgtttcatgttaactactggtaaaccttaatgttttattatttgttcccttaatgttttattattttttcctttttactcttagcttgattatcgaaaaaaatatattaagaattgcttattaatttccacagcaaaaagcggagaatcacctaattaagggttaataataaggggtcaagctttgtgggccatggctgtcaggaagccatagctgtataggccgcatgatattcctaatgggctggctgactggctcccatactggacttcaactgaggtccacctaccaacctgctcgtcaacagatcgatgaccctgctaaccttgcgacgcccgttgctggggcgagcagtttcaaccggtcagtctttttatatatatcttataaattgaaatcctaacgaactttcaaaggtactttaaaacacaggattgaaaaaaaaaacagagcaataaaaagaaaaccacaagatttttgtttgtgacataatttggctagcgactagttctatttggtcaggccaaattatttggatcatctattatattcaagctaataaatagcgttcgtatagcctgcaatagcggctgctataaggggtggcaattccacccacggggccgggtaccctgcaggacccgcccctacgggggcagggacgggtgacatttctaccccacgggtctgttggggccagggccccgcattttgcgggtgaggggatggggcacaagttccacccgcgggtaacccgtggggccccgagggtaatataatatacttgatatgtagcccattacaagaatgcagacccaaaaagcccatgggaatcagcatatataagaaggaaaaaaccaaaccctacccca

SEQ ID NO: 38443 - DNA, 3140 bp, Oryza sativa
acgccatcgccgtgcctctacgtcgtctgtggctatgtgtctagtggtgggtttatcaatgcagggcccctccgggaacgggggctgattttgccccgcatgtatactcggggcctggggcggaagaatagttcccgggtcgggggcggggccgttccagcccaacccgcacccgacccgccccgttgccatccgtagctgctatagcggtagtggaccaagtagcggactgaagatagtatgttgtaacttagcgcccgctatagcagcctgttatagtccttcgcgatcgctataacagcccactattgactttgttggactgttataatgcttgaatgttgttcttcatatatggattgtagaactttacattgtgtatcttatatttatcttatacatctatatgttatttcatattttttatgttatgaaatataggagtagttaacaatgtcttataaattgtaatttttacataaaacttgatgttaatattgatatataatctaaatttatggttatttttctatatttgctattggaacttagcgcccacaatagcggccgctatccgtaatccgctacacaagtactaatctactaacaacccgctgctaacaacctgctatacactatttattaccttgattatattcggtaagttgttttcttaaaagctgggtaaacacatacgtgcagcgatttgtgattgtatgtaggaaccgtgtgagtaacctgctggactgctggaggataatctgttagactgctagagcgtggtgaaatgtgatgatagaatgcagaggaggcagattaaatggagccatcagccattgagagatttgatttagtggagatgacggacgcgtagccaagatggatgctttgtagatgcatatattgatagttgcatgaagattttgagatcaattttatttcctttaatttcggttaaatttggctatcatttttgtgggaccgacttgatttcctaaagactaaggcaaccggtatatatactggtgatggccgattggaaaagaactcctgaacaacttatcaattactatttcttattcttttctttctagttattctctatttttttttatagctgagttctactaaccttataatttggttaatttttgccattttacgttgaaaaacagtcgtacttctcaacaaaacaaaagcgaggaggttatcctttgcaagtttgcatggaaactggacgttcgtcgtcacataaatacgatatttatcttcttcgctagtagtttgtttgtaaattagtcatgtgattctatgaaattgaattaattttgaaatcggctctgatctatcgattttgatgactccattgattataccgtaaatcgttaagtgatcatgtgttggtcatgaaaaagcgtcaataattttaatagaaatgtaagtataaaataaaggattaagaaaagaagaatagtcatttaaatagacaaaaaaacacacatatagattggataagaaagatggactcaaagggagatttctaagaggatgaagatcttactaagttttctcctaacttctattggatcgtccatttcatatgaatttgctttgtatgattcaattatttgcttcaaaggcttttctatgaatttttcttaaaatattggaatgcttgaagtttcttatatttttcaatgaatcaaagtgggcctatgaaaaaactggatattttggtggtagggtttgggggtgaggggaatccgatgacattgatatcaaacatatatatcatttaattgcgtcataggatttgaagctgagaagtctatgtctacttaaaagagagttgttctccacccatctcttccccacttcctcctaaaaatgcttctcccatacaaaccgatttgtcaaaaaaaaacacgatcatggaataaaaaaccaatcaacccacactgtccaaatcattccactaaattgaataaagaaatcgtggcaatatacgggcctataactagtcttaggaaaaaaacatggtttgttcgtttggtacactgactagttaacataattaacacagtccattattaaaagaaaaatgagtaaattttacaaaacttcaaatacattaacaaaactatcgcaaaactgcatatttaaatgatgcatcaatttaaccctaaatttatcatagaactacatagttaaggtgggttatcgcaaaactgaaggtttagttacaaagttatcacaaaagtacagttttagtgtcaatttaatcataaaacttggatgtttataactcaaccataacattagtactaaggatttaaacccaaagtccaaagtctatagttttgtgataattatattactgtattaaggaaaaagtacgaattaccccactgaactatggtggtcgaccgaattactctctaaacttgaaaaccagacattcctcactctgaactgtcaataccggactaattacccctctcgactgaatctagagtggttttatcttacgtggtgtacatgtggcaatccagtcagcattttatttttttaaaaatagtgggacccacttgtcataccttatcttcccctctccctcttccttttcatctctctcgggctcagagtgtgcacggcgagcagcggcgcgctggggctgggcggtcgacgctctggggctagcgatgggcggcgctctctatctctctctctcggctcaggcaggcggccagcgatgagtcctcctcgggagggcgcggcgagcggcgcgcgtggcgcggagggcatggtgggcagtgccgaggagggcatgggaggtggtgcgctacggcgacgaggtcgccgcccatccacgtcggcccatcgaccgtcgtcgccgtcaatcggagccacacagccgcgccaacgatttcccttccccggccgtcgcgcccgccgctcaagacgccacctgattcttctggctttgctgctgctcctgtaaaactaccccgtcacaccggtagcaagcagcacacatctgtacaacttgtacatgcatgtacaccgttcgtcgattcaatttctctcagaattcttccgtgacattgccacgtgagattgcgtcatggccgcgagtagtg

SEQ ID NO: 38444 - DNA, 2279 bp, Oryza sativa
tcatgttagatggatctccctccgcttgagcccaacggctcaagggggccttgacccgcgccctgatcgggggtgcccaacccaatagctggtgggcccccgtcacactgtgccatataaaaggggtggaggccgaggcggcacatggtacgaggtttgtcaccaccgccactctaccgcacaaaccctaaccgatcgagagggggcgtagccagtgacgagaaacgtcgccgccgtccacgtcaagcccgcgaccgacaacgacgatggccggcgcttcttcatcctccgacacctcaacttgtcgattcctctaaacccttctcccttatgttctattgttcaaacacccaaatagagccaacccgactagatctaacctaggttatcctagagcaaagtctaacaatggtattagagcaacctagccaattagatcggttcggggaaagaaatccaaagaaagaaaagcacaagatccgcacggatcaaaagaaccgaaaaccctaaccctaattcttacctcatcgtcgttcgtcgtcgacgccagcaacggaggggggaggggcacagggcaccgtcgaggagcccctccacggtcgtgcacgcgcgtgccggcgagggggcccgcggcggcgccgccatctccgttgtcgccgttctctctctcacttcacgcgggtggagggcgagagacggtggggggagaagagaagagaagagaaaagcacgccggccatggcgcggcggcgcgaaggttgccggcgacgacgacgccgctctgtgtggtcgtgcgagagagaagagaagagaggctagctagggttcggccggccggcggctggggtcgaagttttgtccctccgatctcggcgcccggccgtccgacctaaaccctagccgatcggacggccggcggcggccgggccgaatatggcccaagagggcgcgcgcgggaggcggctttccaggtccaagcccaggttgcggccttggggaaggggaggggggcgcgccggcaaaagttcaaattaggtccctcgggggccgaaaatgatgaaaagaggacaatagcaattttttttattttgtcaatttttcatgcaaatttcaatagaattttgaatagatttttgcatgttttacctctgtttaaatttgaaccaacgggagaacttttacagagaataaataacatacttttgctactgttcatatgaattttatatagtttttccactgcaaatagatgaaattgatgaaaattagtgtttctaaaattaaatttcgaaccaacgggagaatttaattttaggaacattaattatgtgctatgatgttgtaattttctgaccaacgttgataattgcaatgttatagttatggctatgtgtgatgtctaattctgcccaacggtgatgtaggcttaatgcatactactttaatgttaattttgttctcatagtacatgattatttcaggtggctactccttgatgggttgcattaaagatattccgaccctgaaaggagataactacgcagaatagaaaagaaaaactcgaccttgcttttatcttgggagaggtggactgggtgttgactatcccatgtcctatagaacctgctgcacttgtcagaggtgaaaatgagtcagatgctgactgggaaaagagacagagggacaatgctcttctcatcatgtcgtatgacattgaacataagaaatggttcttagccaacaagaaatgtttggctgtggtaaagaacacgattgagccaaccatattgggctcaatcccagagtgtgacgctgtctcagagtacctcaaaagaataaagagtcagtttactggctcttcaaagacttatgctacatagctgataaagcagcttgtgacagagaggtaccatggaggtggtgttagagaccacattcttaggatgagcaatatggcttccaagttgaagccaatggatttgggcttaacagatgacttcttggtccatttggttatggcctcattgccaaagcagtttgacaattttattgtcaactacaacataagtccagagaaatggaactttgaaaagctcatcgctaattgtgtgcaagaggaggagagaatcaaagagtcaaatggtggttcaattaactatgttaaagataacaagaaaaagaaccacaagtctcccacctcaaaagctaaatagtctcagcatctgcctcagcaacaacagttcactgttgagaaagatcagtgtctcccctgcaagaag

SEQ ID NO: 38445 - DNA, 1579 bp, Oryza sativa
  unsure (1)..(1579): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagagagaggaatgtgaaaagcctgttctaaactctcgagctctaaaaagctttgacaggagatgtccttattcttagcaaaagagaatagggagttcatttcatcttgtaaaaacttgccagaccagttatctttccagaaaagggccgtgtccccattgccaatagtgatctttgagactgctctgaagatgggaatcaatctaaaaatgtccttacaccaaaaggatcctttttatgtgtgagcatgaggagagtcagacaaagagtattacttgttccatattagttttacctagggcaggtcttttttgttgaagaacttgtccagatgtttggtcagaagggcaatgttttacagttccaggtttataatgcccaaaccacctttcttctttggctggcatactaggtcccatgtagccaaggagtggatcttagtgtttggatcatttgacttcctccaaagacagtgtcttcttgctctgtctatgtgttgaatcactttttttgaagcttaagagtgcacatgtagaaattagggggagcatatagaacaaaatttaccattgttagtctctgaccatgattgagaaaagcagctatagatgggagccatctctccactctgtcaaccagaggggcaaagtcaataatctttggttttgtggtccccattagtaaacctagataagtgaagggcatctccccacttgtgcagccaaaggttctagcaagaacttccattttttgactgtcaacatttatcattcccatttcggaggctattctgatttatttctagggatggaactttctgagacaaaccgatatcgatgtgccatttcagagtttaataaaataacagacatttatcattattacattcaattgtgtgcatataatattccaatgactaaatcccttctttataaagttatgacacactaaatgcaattaagaccctaaatctcaaacctcaatgttccacgtcatcatcaattctcagccgttggatcactagattagattacattttaggcgttggatgaacaaaacgcaatagccaccacatgaggcccatgtaccacgtgaagtacttagggtttcttctttgattagtagggtctccttgtggagttgtggtgctagaggcagctggttttctccattgatggcaagtggtgccctggcgtgcctcgcacgtggtgtggcactggcctgatgaaaaaacaacatgcattannnnnnnnnnnnnnnnnnnnnnnnnnnnnnnnnnnnnnnnnnnnnnnnnnnnnnnnnnnnnnnnnactgnctgtctacttcccca

SEQ ID NO: 38446 - DNA, 2671 bp, Oryza sativa
  unsure (1)..(2671): unsure at all n locations
acgaatagtgtgatcattcatttcgctatatntggctaacgtcctcatcgtgtattcttttaatctcataactatttaattttaagttgtacacttatatncnnnnccnnncnnnnnnnncaggtggcctttggattgctgtaacgtcaattanncannnnnnnnnnnnnnnnnnnnnnnnnnnnnnnnnnnnnnnnnnnnnnnnnnnnnnnnnatattgccaaaattttgacaatgctaaatttggtaaggtttatttgactataatctgaacagaccctttattttctgaatttaaggttaaattcggccacatctttgatccacgtcttagagcatatatcgttattccccccctgacctacccttttctttgtacgcgttaagcccaatgtgttgggctggtccaaagttattgtaaatactccctccattttaaaatgtttgacaccgttcactctttagtacatgtttgaccgctcatcttattaaaaaaaatttgtgaaatatgtaaaactatatgtgtacatgaaagtatatttaacaatgaatcaaatgatatgaaaagaattaataattacttaaattttttgaataagacgaatagtcaaacacgtgctaaaaagtcaacagtgtcaaacattttgaaacggagggagtatattttatacacagaaattttatatgtatgacaactttatgcatacaatgtatgtataaactttgtacatatatggaaaattcatacatgagtagtatacgcatatatacgtacatttttttacgtacaaatttaaaacataaaggcacttagaaaaaaaaattaattactgtaacattatatccgaactttgcacgtataaataaactttatacttatggatcttaaaaaattcaaaatttattttgaaaaaaaaaacgcgcaggtgggctaacctcccttgaattcggtatgatctgtaaacactaaaaactgccaaaatccatatagaaaataaaaaaaaaagcttgatcgttaaacacgcaaaaactaaatgtggcccaaatagcgcgggcgaaaaaaaaagaataagttcatctgaggtcccttaacttgtcaacgaatccgattttcatccttcaactgaaaaaccagtgcagatgaggtccctcggcggtttggatggtggttttagctgacgtggcgcttacgtagctaatttgactcggtcttcatctgacgtagggttgacgtggcgcttacgtggcaattcgatctgaaaaataataaatctcatgggacccacatgtcagtttcacccaaaaaaataaattaaaaaatggtggggcccacgtggccccacatatcattctcacccctcctcttcttcctcctctctcaccatctctcccctctcctccctccaggcgccacggggccacgggaaggtccggcggcggcggccggcgacgcgggagaagggcagtgggcagggcgtcggcggcgggagcgctgggtcttcgctcacggcgtcggcgcggactccgcgcgggggctcgtggaggagatcggggccgcggcgccgcccgtctccgatgaactgagctcgtgcgagcgcggtgccgggagctgcacgaccgccgacgagaagcagaggaggttcgaggtgtacaggagcaacgttgagcttgttgagaagttcaactccatgggcaatggctacaagctggctgataacaagtacgttcgccgacctgacgaacgaggagttcagagccaagatgttggggttcagacctcatgtcgcaattcctcagagcaatgcctggagagagcagtgatgatattctgccgaagagcgtagattggaggaagaaaggagcagtggtggaagtgaagtaccatgaagattgtggtgtgtgagaaatagcatggtaaagaaagattcaaacctgtaaaaatgttggagattaatcgatggaaatctgggtgttgtgtggatgcaggttcttgctgggcattctccgccgtggcggcgatagaggggatcaacaagaacggcgagctggtgtcgctgttggagcaggagctcgtggactgcgacgacgaggccatggggtgcggcggcaggtacatgagctgttagagttcatcgtcggcaaccacggcctcaccagtcaccacggaggcgagctagccataccacgccacgatcggtgcgtgccaggcggcgaagctgaaccagagcgcggtcagcatcgtgggctaccggaacgtgacacccagcagcgagcccgacctggcgagggccgtggcggcgcagccggtgtccgtcaccgtcgacgccggcaacttcatattccagctctacggcagcggtgtctatatagggccgtgcaccgccgtccgccgacgtcaaccacggcgtcaccgtggtgggctacggcgagtcccccaacactcctgccactgacgccccgcccttccccgcgtcgtcggccgccgccgccggacctcccccgtgaccccgtggcgctggagagaggagaggggagagatggggagagaggaggggtgagaatgcaacccaccattttttaattcatttnnnnnnnnnnnnnnnnnnnnnnnnnnnnnnnnnnnnnnnnnnnnnnnnnnnnnnnnnnnncggactggcaatcaatngccccg

SEQ ID NO: 38447 - DNA, 1646 bp, Oryza sativa
  unsure (1)..(1646): unsure at all n locations
nggggaatganatgcatnnnnnnnnnnnnnnnnnnnnnnnnnnnnnnnnnnnnnnnnnnnnnnnnnnnnnnnnnnnnnnnnnntagttggctgctgctgtagttgacttatggaatattaaaatgctgttaatttacttatcccaagctgtacatgatgctgttacatgatgctgttacatgtagcttcatgggttgcatgtagacagccatttcggttccccatgtctgacctttagttagttgtgtacaccgaatggcagtagagatagatgcgtaagatggtggcaaatctgatcacatgctgttcaattataccataatgacaaagcaaccattttttaattagctgttcttttttcttaattggttagcttaaagaggtttggtggtgtgtcatggactcatgggaaccttttttgattagtggaggtttggtggcctcttggcaaagcataagaccaactcacacctgctcatttattccagatttctgaccagccttgacacggtaaatttttcggagggggggtagatctgatctgctgggtttgtgggaaggggcatataaggagctgaggcctccctctgagtgcatatcgtaggcagcttccctctgcatacaagaggctgcctcccatttctcttctctgtcggtgttctcctcaagatctgtcttaagttcttgagatctggtaagattcttcatgatctcgtgcatacttctgcggttgatctgtagttcgagtatggaccatgcaagctgtgtggtttcctgttttagttgttcatctcaagatacttaatgctgtgaatctctgaatttgcttgagattcatgccttgcacatatatgatcccttgctagattcagtaacttgatttactctgtgtttgtgccattaaatttgtttcctttcacccctgtttggaactatttccttttattttactgcttgctacagtgctgtcgtcgttgatgaattagaggcattattattctgctcgtaacttgaattcgttagctaaactttttgttagtgttgttgtggtgacggatctccatctgtcattctcctgatgcagtttgacaccaataggcacatattattatcatgaactgctcattggtttatcagtttaattgtgttcctcagaacctgactaaatgtatttcacagcctagcagtctttgcatgtttcttttgacatattggtcattgtgcttgtaaactgtgtatctagatagcttctattaactcaaaaatgctgcttacaagttctgatctatataattacttttagtgcttattcttcaatctcctgaaaatcagttttcattatcacagtttcagaactaagctgagaagatggtgaagatctgctgcattggagctggctatgtcggcggcccaaccatggccgtcattgccctcaaatgcccagcaatcgaggtggtggttgttgacatttccaagcctcgcattgatgcctggaacagcgaacagctcccgatctacgagcctggcctcgatgaggtcgtgaaggagtgcagaggcagnnnnnnnnnnnnnnnnnnnnnnnnnnnnnnnnnnnnnnnnnnnnnnnnnnnnnnnnnnnnnnnnnnnggagtntcattttnccgcgt

SEQ ID NO: 38448 - DNA, 22304 bp, Oryza sativa
  unsure (1)..(22304): unsure at all n locations
cgtggcattggaactccnnnnnnnnnnnnnnnnnnnnnnnnnnnnnnnnnnnnnnnnnnnnnnnnnnnnnnnnnnnnnnnnnnnntccactgtccctgtcaagactgcagaggccattgagaagatcttgacccacaacagcaagggcatcaactaccagatcctctcaaacccggagttcctcgcggagggcactgcgatcgaagatctgttcaagcctgacagagtgctcattggtggccgggagacccctgagggcaagaaggctgttcaggctctcaaggaggtgtacgcccactgggttcctgaggacaggattatcaccaccaacctgtggtccgctgagctctccaagctcgcagccaacgcgttcttggcacagaggatctcctctgtgaatgccatctccgccctatgcgaggcgactggtgccaatgtggccgaggttgcttactctgtgggaaaggactccaggattggccccaagttcctgaacgccagtgttggctttggtggatcctgtttccagaaggacatcctgaaccttgtgtacatctgcgagtgcaatggccttcccgaggtggccaactactggaagcaggtcatcaagatcaacgactaccagaagagccggtttgtcaaccgcgttgtgtcctccatgttcaacacagtctccggcaagaagatcgccgtccttggctttgcgttcaagaaggacaccggtgacaccagggagacaccagccattgatgtgtgccacggtctgtgggtgacaaggcacagatcagcatctacgatccacaggtcaccgaggaccagatccagcgggacctcgccatgagcaagttcgactgggaccacccgatgcacttgcagccgaccagccccactgcattcaagcaggtgagcgtggtgtgggatgcatatgaggccaccaagggggcccatggtgtctgcatcctcaccgagtgggacgagttcaagaccttggactaccagaagatctttgacaacatgcagaagcctgcattcgtctttgatgggcgcaatgtggtcgatgccgagaagctcagggagattgggttcatcgtctactccatcggcaagccgcttgatgcctggctcaaggacatgcccgcggttgcataataattttccatattccacacctgaacctcatagctctctacactctgctggtgctgaagagagtctgcgtcgaagaggaatttggttgaccatcattttttatagctcgttgttcgtctttacatacaggagaggctaccattttgtcaaacagaaagttgatttctgttagtatctttgttcaagtttttcttgtgttgcaccattgtagatctgaaatcttcaggcctctaccgtttgagtgccaccctcaatcttgtatgatgacatgaattcttatagccgatttattcttcaaatgtattcttgtgtcgctaaagattaatgatgcaattttttcttggccaaactgcagcagtcttgtttgctctggtttcattgtttttggctcggcaataaatgtgtaatatgctgtaactgaatgaaaagattggtccaatttttttggtgctgcctctcctctgaccaaccactggagaagagagccggagatgatccggtgaccggagctagacagcgacaagggtcacaacttgcctcccaattcttgaccaggaggggcagctctggtacttaacacaaatgttttcacaaataagaaaagaaaacccggaacaaataacggagttggacggtagtgatagaaaagggaacacggcaaattcgagtggtatttaagtgtaccatggaatttcatgaaattttagttccaggtatataaggacctataaatatagaaatatgttaggagaaaaaaaacattaacggcaattagacgtgagcaggggcagtaggctaacatataaccacttgtttttttaactgaactaactgttagaataaatgggctaggcccgatttttctattaaaatctcaagggcccataataaatgttaaagaaaataatatcgccctgagaattaaaagtggagtatctcaacttaaatagagagttattggaggctacctgttaaccggttgaggtggggatcggaaagccacacgcgcgcgcgccgagccgagccgaggccgtgggcgaggcgaggcgtgcgtgcgtccgcaacgggtgcggattcctctccgacgctattaggaaatagagacccccggtcagatctctacgctttctcccatcactggttcttcctccgatcagatctctacgctttctcccatcgctggttcttcctccacgcttgcgcctgtgctgcttctgcttccccggttctgattgcttgcgcgcacgaatgatcggaacgagcagggcctccgaaaccacaccttcgcctgagatctgcaccgggtaggcgggtgatcaggtttttaaggagtgcttccgtacaactgctctctcttcatcatcgtcggtggttctgttcggtatgcgtcgcggcaatgtctactggtggcggcgtcaacggaggtgcgccaggaactggagtcgcaccgatcgacaacaccaacggaggcagttctgtctcacaatccagcggagggacctttacagggtataccatcctactgctatctctgtttttgttacatctgttagtcgcaatgttattgcgttctctaaatgatgttgatgcttattttatcttaagcatgctcctggttatgtttaattttatcactagatcacctcacattgttcatgtcatgtttattgtcttaatattttggattaaaatataccgatatatgaccatatttccaacactaacacacaaccatccgaaaattttcaatccaaattgtctcagttaggtcagaaatgtgctcacaaattacttctatagtatcctacaatcccttgaaaataatccttatcataggtcataacatgtgactttatgtgtataacacatttaaatatatataaatatttggttaccagtttgacgtgtagtttcatattaaattcctttattttaaatatgctattttctaaaacaaatcctcataagggatgtatgtaggctacgcatatagatattctttaaataattattaaatggtggctcttcactcaatatttttactttggactaaaaatttttatatgtgttttactttcgaccacctcaactttcttcgttagtgacatccactctctcctctatcaaagaattgatgtggtttgcacgtaagtgaaagacaataatgtgcaagtgttattgtactttagactgttgatgtatttgagatgagagttggggtgatccaaatttctaaaaagacaaggtactcaaggtgaaaagtaaaaggattgattaagttatgatccagagtgaaattttagctataacagttagcccaaactgcatttcgattagagtattcacacttttcatgactctggttgatcacaaagtcctagcatgtctaatagtcaataaattgtagtagtatttcatctctggaattccaaattgtagtttagatcaagttttatcaccaaaatttatccattgtctaatccttttatttcagactaggtacttttgttattttaatttactttggatcaccctgattatcgtttctaagccatatttagcaaactatatagcttgggcacataggtgaggggagctcgcaagcatgttgaagctgatcgtcagaccagtcattgatgtgttcaagaagtggtttaggtgatcagaactactaccatacatctgtcttataataattgtatttctaccatttaaattttatataaaaaaagcatttgtaataagatgaaacccatccaattagtcagatagagatatcctgccttctgtcctaccatctttccatccccattggcgccaacctttcttttattcagtatgttattatagttatccgtgtttactaaattttataatgcaaatattttagaaaaaaggtagtagaaaaacagcaaaattatctagtttaaaagtgaaaagcttggataaatagtaaaattttggtaacgaaaaattgataacaaaaatgacctaaactaattgttgttttttttaataataattaaaaaagtgctgagttgccgagcagtagtaagctcccagtccaaacatttctcctcctcggtctggagccgctcccccctccccgccgccgctgctctcgacgccgacgccgacgaggcagctaggccggcgacgaacctcgatctcgatccgctcgccgccgtccgtcgccgatccgcgcgccgacaccgacaccgaccttgatcctgatccgcgctccccgcgacgtacgccacggtgggctcccgatctgaccccatcctccatccaccctcctcactctccgccgtcgtagtatatctcaggagggctaccagctgagccgagggaggagaactggatgcctcgtgcgcactcaaaggccgcagctttagcctttaagcttcttttttttttctcttactatggggggctagttgtttatagttagttagttagctcgaagcctctcctgcgtctgcggttgcaaccgattcgatttccaggttggttggttggttggttgtttgcactgatgggaataaacctttatgcataaatagctttgcgtgacttgcactttgtgcagctaaatgtgacaacctgctgttgctgttgctgttgatgttgatgttgctgttgctgttgatgtgcgttgtgatctctgaccaacctgaaattaccgggaggccagggtagatccagttgttttgtggtgagttgtgtggttgtggagaggagggcgcatgatataaagagcttggggtttgctcccctctgaatacaaaagtgacaacttggggaactaggcagtgcctctgcatagcatagatcttcctgtcctttctttcttgtctagtggtgagatctggtgaggattttctcctcaagatatcccttttttcggtttgtagtttgttctgaacatctgtagtttggcatgtccttccatgatctagctgttcgttctgaagatccataaagatattgatacttactgtcttgggaactgggggatatcatttccctttcacccatatgtgaatcaaagtttattttatttagtttacctcttagattcgtcatttcgcttgctgtcgattttgccttctttagctgtgtagtcatgatagaatcgttgcagcaatggatttggtattgtgtccttaggacttaggagtagtttgaccgtcttcccagaactactgctgtttctttctccattcagttgggtggtagctttctcagaaccagagttcacagtcctgcactcttcacatgtttatttcgggatcctggctggtgtgcttgtgatctgcgaaacacggctgcttatgttcactcagaaatgcgcacattcctttcagtttactactctgcaatctccctcaaaatctaatttatatggcaggtttgcagtaagcaggaaagatggtgaagatctgctgcatcggagctggatatgtcggcggcccaaccatggctgtcattgccctcaaatgcccagcaattgaggtggtggttgttgacatctccaagcctcgcgttgatgcctggaacagcgaccagctcccaatctacgagcccggtcttgatgaggttgtgaaggaatgcaggggcaggaacctcttcttcagtacggacgtggagaagcatgtcgctgaggcagacatcatttttgtgtctgtcaacacccctaccaagacccgtggacttggagcaggcaaggctgctgacctcacctactgggaaagtgctgctcggatgattgctgatgtctccaagtctgacaagatcgttgttgagaagtccactgtccctgtcaagactgcagaggccattgagaagatcttgacccacaacagcaagggcatcaactaccagatcctctcaaacccagagttcctcgcagagggcactgcgatcgaagatctgttcaagcctgacagagtgctcattggtggccgggagacccctgagggcaagaaggctgttcaggctctcaaggaggtgtacgcccactgggttcctgaggacaggattatcaccaccaacctgtggtccgctgagctctccaagctcgcagccaacgcgttcttggcacagaggatctcctctgtgaatgccatctccgccctatgcgaggcgactggtgccaatgtggccgaggttgcttactctgtgggaaaggactccaggattggccccaagttcttgaatgccagtgttggctttggtggatcctgtttccagaaggacatcctgaacctcgtgtacatctgcgagtgcaatggccttcctgaggttgccaactactggaagcaggtcatcaagattaatgactaccagaagagccggtttgtcaaccgtgttgtggcctccatgttcaacactgtctctggcaagaagattgccgtccttggctttgcgttcaagaaggacaccggtgacaccagggagacacctgccattgatgtgtgccatggcctgttgggtgacaaggctcaaatcagcatctacgacccacaggtaactgaagatcagatccagcgggacctttccatggccaagtttgattgggaccacccaaggcacctgcagccaactagccccacggcttttaagcaggtgagtgtggtctgggatgcgtatgaggccaccaagggagcccatggactgtgcatcctcactgagtgggacgagttcaagaccttggactaccagaggatctttgacaacatgcagaaacctgcatttgtcttcgatgggcgcaatgtggtcgatcctgagaagctcagggagattggcttcattgtctactctatcggcaagccgcttgatgcatggctcaaagacatgcccgcggttgcataattctgaatccccacctggagcgctctgctggagctgaagaaattcgataaggaaacagaaccggtcgaccactattttctgtagtctgtttttgcaggagacagctaccattttctcagtcgtaagttgaatatctgttagtatctttgtcgaagttttcatgtttgcagctttgcgcctttgtagatctgaaatcctcaagcctctgatctaagagtgccacccaaaatacctcttgtatcacatgaacttcttatagccgatttattctcgtatttcaaagacgctacagattaataatgcattttttttgccaaataaaggctgtgtttagatccaaagtttggatccaaacttcagttcttttccatcacatcaacctgtcatacacacacaacttttcagtcacatcatcttcaatttcaaccaaaatccaaactttgcgctgaactaaacacagccaaagcagccgtgtttgctctcatttcatggtttctttgctgtcatttcgtagttttatgcctgagcaacgaatggcagcagatataaactggctgtgcacagtatgctgtaactaaatggaaagagattccttttaagttttgatgctgctaattgctgtgtccagccagttttgtgctgctgtgatcttgccgaccagctttttgtaaaaatttgtgcaagaggaatggatggtatggtaaaaatttggttacagtggtctgctgaatcggttaaggttttgcatttgtgagcataaggtgctggaacttttatcctctcaagaattcagtgccaaaagctattgcaaccttcagcggggccttcacacttctacaggatttattttcaggttgatccaaatatgggaatatattagatcacacatgtttcaactgcataacatgtctgttcgatatgtaaagaaagagcatgctatgcgggtgttttctgttgtgggactggcatagttctgcagcttactgaaaaaaaggggataagcagttttcctttgcgtgtaaatgaattatgcgcattttgtttttgtttgattttcttcaatgttgtcatgctgccctatatgagagcaccacattcacgtgtatcagattttgaaggactggtcgatcaagatgaccacacgtaacggaaaacacaatgtcaacgattagttcaattaagttgctgggtaaacaagattctgaaccaaacaagatgttacttaaacattccaatgtcaagatttctgacaagcagcaaaactgcacggtaaatagatgtatgtgtatcatgctttgctagtatgaaaactgcaatacatgtctatggtgaatcaacggcttcgccagcaggaatgaatgatcacaaccgagatccgttacagatcaatagctgcggccccagaatgaccatttcttcgcaggctttccagaagcaaagcatgtggttcctgaattttggtgcaccgcatcagaaaaggttagttacaagtgcatggaagaatacgttgcaagaaatgcagtaaaagaccgagcaaaagagattgtgaacccaggctatttgtggcattttagctattgcctgcaaagcataccttctgggagatctggctgttcaaatggtgtacacaatgtcttggcagctcccaggtcaccttttgtccgagccttcacatccttctcaacttcctgaaccagcacgaaaatggaagatgcccatgttgagtagaaaatgttagtaatccagtgtaaatagttcataatgttatgttaataactagtgcaacacaggagtatatttggtagtaactaacagaactccagatatcacagtgcaataaattattttgcaggtactattgaatgtgaccctcgaccaagacattgcaaacctcattgagtctccttgctatcccatttcgttctccattctacttaactcccatctttgaactaagctcgacggtgctttaaacttctattggtcactggtgttacccctaccttcccattctccctccacaatcaacagatataataaagatatacaaatacgccttgccccagcaatcaaaagaaaactttgtagaagagaacatgaacacactggatattccaaatagttaactagtgctaaaaaaataacatggtgagagggagatctcataaaaaggtctcacgtacctcttcatcacaccatggagccaggatcaattttttgtcattcagagccactatgaattcatcccaggtgttaacaaccttaaggcaggcatctctcttttgtttcgccgtctcaaacaagtttttctgaacctcatcaagtaacccattaactttctcaaccaagtcagccgtaggaatatcagcttttgcaccattgtctcgcctaacaacacgggcctgaaaagcagatgatgttttcattaactccctccatttcataatataaggcacaactactttttaaagttgttccataatataaggcatgcatgcatgcatgccattaactaacccatcttctctactaaaatattattatttaaattctccaccatcaagatctctaattttattgggtgcatgaattacatttattagattaatccaaactataaggtgataataattatttcttggtctttgggctaagggtagctgtgctttatattttggaatggagggagtattagttggaataaaggttcagggaatagtagcaaattaaacagcacaacaaaatgaaagttactccatccatgccaaacctatatgagaaatggttgagggcaccattcagtcactggaaaagatgtgaaagttgcttaattgaatcaaattaacatattttaagtagaaagaggagaaataggttattaaatgaactagccaactcatgcattgcaacgatctaggataaatataaaatctgaactcaagaacaatatatagacttcggattgatcatcagttcacaaatgatcctattattacgaaccacatgtgcaaatgatataattattcagataaaagaaacacacgtgcatgtatgcacagaacccatggtgatggtggtggtatggcagacttaccatcaccaccaccaccactagctctttttctctaacagtaaagatatagcagttttcaggaaaatgcatgataacaaaggtgcccttagtttatatattcattagctacttactgttttgatgccattaattaatcatattttccatagggaatagagaacaaagaagccatttacacttcatcttatgctaacaagaaagggaccaatttatacaagtacactgatctactaataaacttgtggattctatcatggatatggaaggcattattaatttatcattaactactttatgaagagtcctagaagcattatagtaattaatgtgccactgatcaatgaagttaataaattaaatggtgtgacctctgtacctgattgtttgccatatcttttggacctatctcaattcttagaggaacgcctttcatctcccagtgggaatacttccatcctggagaatagttttcgcgggtatccaagtctgctcgaataccagctttctccagtgtctcaacagtctttttgcattcgtttacaatagctgttgtgtcaacatctttgtatggaacaggaataacaatgacctgcagaggtgccacccttggtggaagcactaaacctttgtcatctccgtgtgtcatcaccatcaccccaatctgcaaaacaagcatagggtcaatactacaaatgtgaacataatttgggtagagaactcagcaactggaaataacagatacatagaattaaagtaaaaataataatttaaaaaactagcgcattctgtattttaaaattaccagagagcttagcactcaaagctagctcctcattcacaataaaagcctcatttcttttgtaaaacattaccacttcaaaagggcaaaacaagaagaaaattccaggtacattccaaaatttaacaatatatgagaattaccgagcgggtggtgtatgcccaagagttctgccacaccatggatcttgagcccttatcattctcaaaagtgatatcaaacatctttgcaaagttttgaccaagacaatgtgatgttgccccttgtacaccacgtcctgtgtttggaatgaaggcctgcaaatatgataaaattttattattactaaatataaagataagtactcttcttcatcagggtaactacagaaaaactaatcgggtggaatgaagcaaacatttcatattaatacctcaacacttgttgtatacagtccaccagcaaatttttccatctcacttttcctccctttagaaactggaactgctaaaaattcttcataaatccttcggtagagttccaaaatttggagaacctgaacattgtcatggattaaaataactcagcatccttttaaattaacaacacgttactcattatttctgttcgctccatcagatattctacaaaatagttttttgtgccaagcaaccactggagataaatacaaccttttcacattcgaaaatgtaaaacaaggttcaggaagtgtaatgaaattgaaatattactgatgtcaaaacgactatttacactagcagtataatatcttcttcctagaatactatgcattgatattgggccagctgttgcttcacactagccaaaagcaggacaatagtacttaaagatagtttacaacagaaacaccaatatttgttaaacaaaagatgctgcttatttagaaccaaaaattccctgagcaagttatggccagctgcaaatggcagcagattgcccattagggaggcccatggattatggagattgctcatatggcaaggcagcagcaaaaatgctagtgctggaaaagtagcttaaggttaatttagcacatcttgattggagagctaatttcttagtgatcatttagttctgacagggagaataatggaacagtattctcattttcctaagaatccccccttcatccatgcattcgagcccacttcaatatggcagttaaccctgatgaactgcggttgcaaaaacaagtacagtacctcttcgtcagcctcctctttagttgcaaaagctgtatgcccttcttgccaaaggaactcacggctcctgcggagaatagttacagaatgtgtcagccagagatgatgaatatatccctattccctagtgcataggtcaaccacctattcgccatcatggaaacaggtggtgtatgataatgctcgtatttacattcactaagaaaattgagatcatcctgactcattgttatgaaactgatgaatgacataacatgcaggtgacaacacatgagcagtataggaatatatacaatattggatatcatggatatcatgcagaaccatgttggagagtgggacatgtaagaaaaacctaacctaaaaattcatatgaacaccaaagttgcaaaaacaagattcccttatcttcctttgtcccttttgtttcaagtaatgtcgagcacaattagaaaagagctatttcatgattttcttgggaaaagagaaaatgataacccttgacccaggattacagaatatttgaaagcatatcatgccactcatttcacataaaagaatccatattcttcctttgcaaaaagtttttcggatttgttaggatgcaggcaatcaggcactattgaggacaaagcttgcaagccaggcactagaggaaatagggcagggaggggtttataaacaattgactaccttatgaatggagttggattgctaaactcccatcgcacgacgttacaccactggttacacctcaaaggtaagtcccgatgacttcttatccatttggagaagtatggatacatgacagtctcacttgtaggacggattgcgataggagcttccagatcagattttcctgatttagtgacccatgctacctgcaagatgaattacaaaagactatgttactgtatcaagttccaacaaatagcctaaaagtaaaatgtgtatgcaacagtttataacaaacaaaacagatgctattgaacaaataatagttgtcatcagcactaccacgtggcatgtccaatagatagtacctctttttacttgacattttagacatcggcacagttctaacaactatgtcaactcaattattcagtctcagtgattatgatcatactccaggaaaaagtgttgcatgaaaggcagtggcctgtgccaacaaattgcatgactagcacaaaaatagttaggtggtcatacaacaggtttacaggccatgtggttcatgtgattaagagcatcatttcatatggcttgggtgcttgaatttgaaatctatccagaactaacctttaggaactttataagagaaacagggagtttcttcaggagaaattatgggtcaaacattcaaagccctgaggtctagtttgcctcaataatcaaataagagaatgaatagtgtcatagcttcataggtcagatagttcgcatgcctatgaatttatgtgctatctcacaaattaattgagaaatattgtgggttatctcacaaacgagttgagaaatattgctcaggtcaagcaagaaaaatcttttgagtgttcagacttcgggctgaaaagggaatcgttacaaatagtttttgctagcttcatttcatgaaggtttgtcaacatgctcaaatgacagacgtacatcctaatgggtaaaatactgaatgatggagtaaatagcatgggaaaatacacacctctggtgcaaagccctcaatgtggtctttctccttctgtaggacattctcagtgacaaacaatgggaaataataaggtttcagcttcagcttttttatttctgcatcaaagaattcctgcaccaaaccgcataggacttagggaaaaagaacatgattatagtaatgccattttacttaataaactgcaaacaaagaaacaaaggcaagatccttgatgctaagaacgacacttttacacaactcaatcagaagttactgatgatataaaatagacatgttgagataaacttattagtccaaaagggcatcagaattagcatttgaaaagctgatttgttaatgtgatgtttgcagtaactgtcaatcagggaaaaggagtgcataaggttgacaagataaatacttcaggcaacactctagaccaacttgtggacagagattactttttgttatcatcactgatgcttaggttacaagagtacaacaggcaacaatgactacttacatttcattgcaaagggaaataaataaaaattagcatcttgattaattgaatttaagcaggcattgagaaaaaacttactttaagcaattcccagatctccatcgcccatggcctcaagatataacaaccggatatgtcatagtactcgatcatttcactgttaacgacaacctgaaggaacaaaaagtaaaaaaaaaaaaaaacttctataagccccctagcaagaatgagatatattttgaatttgaaaaaaaaatgtttgagcttgttgttttgttttggatggcgattaataaatggataaatcaaccaataacagtttagaaacagaatctgtgtgttccattctccagtaacagctacgaaataacttatatagttaacataacagtatcatatccttggagattactaattctctcttcagcaacagcatttgaatagagtaaattgacccagaacagtttcagaaaaccagcaatagcaatagcaactaacagaaccaccaacatttgcactgatgcagaagtaaatctctgttaataaaagttcaaacgattagctaccaacactccctgccagaacttgtcacacgcatctcgaatacatcaccacctttaaattcaattccacacatgaacacctcatcgcacccacattacattaaaattcacccaaatctaccaacaaaacctcgccaaaaactcatgaaaggaaaaggcgagaaaaaccaacctcggagtaccactccccgaagttgtcatccttcttgtacgccatcccgagcttcgtctccttcttcacctccttcttcttccctgcaactcaaccgccaccaaaccccccatcatcagttgaagaacaaaacgcaaaaacccacccaaatcttcaacccaacccaacccaacccaaccacgccgaaccttcgccttccttgccggcggctncaccttccttcccggacgacatggctccgccctgcacggacgaagagacagacaacacggaagtcaaatctcaaaccccggaaacgcacggagaaatggagaaacagcttcggtttcgtggatccgggcgctagctaagcttgcctgctgctacgacgcggcgggatcaggcaaggcgagcgagggcgtgggcgaggcgagcagctagggttttagtagtggtggcggcggcggcggaggaggaggaaggagatgaggggagtaggcggagtagggcgcaagtagccaatggggacagcgtggcgggcgcgccacgtgacgttgctgacgtggacggaggaggtcggggatgggcccggcgtgtcagtgagtctatacacggggttaacgggagtagacgtgggtgtactgctcgtacaattgtggaaaattggtggcctaacacaaaaggtgctttttttttcaaagaggtgatttaattttattaattttaaaatgggcaaaggcacctcaagttcggccgaaattttatattcgaatcctttagcaatacttaattcataaatatacccctacaaaaattaatttatgagggaatggatcacacgtttagctgctactgtgtatagtgctaatggtaaacatcacagcaacaatggtcttatttacccctgatcccgatgcctagagccgaagcagctagcaaactgatgtggttgtgtcaaggttacggatcagacatacatcctatcctatggcttatggaatatacgagtattgtataccttcacgtacacgggttgttttcgtatgcgttgtaggaatccatcatgaattatggaaaatatctctacgggtcgagtgattaatttacaaagtcatactctgtagggatagagtttctattataacatatgggatccgatgtctccaagtcttacttggagatcaagatgatccacgatataaaaaggacccctgggagggatgcaaggcattgaatctcatgccaacacacccaccatagtctacgaagccaaagcccacagagccaaatcgtcgggagatttcatcgagtctatcgactatgatctcgtcggtatcgtcggatccatctactcccattgtattctgtggcttttccatattaatcccatataaactggattatggctattacctgataaggggcctgaaccagtataattcttgtcttatgtttgcttgatgtcgtaatatgtagatcctcgttccaacgtaccccaataccctaatcatctgttctacaagtatcactcgtcgaaggttgacaataacatcaacgaacctattattgaaccattgattccaaaccctaaatcctgaagttagatatatcccagatcttcaatttggtctcaacatgtgttgtacaggggtatgagcaaaaatggagaagctaggtagctactcttctgatgagaaataagacaagggtggcaatcgatgatgttaataacgacatttttaagcctaggaggggattgaggcacaaggccattattgtaggactaattgataaggtgaatatgagaagtcgagcacctaatatctcgatgtacgccgatgacgcggtcatcttcctcaagtcgatacaaggcgaaaactgtgctgatcaaagcagcacttgacctatttaggattgctactaggctacacgccaacttgtcgagaagcgccatcacacatatccaattctcggaagaacagagaaacttgttcagaatgtgctaattacatatctgggcttgccattatgtgtacgtgaaccaacaaaacttgaattacaacccatcctagaccggttggcaaagaaagtggctgttgggaagttgaagttactcttgccagatggtggcatgtgcctgatcaagtaggtactgatggcaatccctatgcatgtattgtcaatcatgcaactaccaaagtgggctattaaggatgttgagggaatatgtagggtttttctgtgcaaggggcaagaggaagtcaatggtgggtactatctcattgcttaaagagcaatctgtatgtaaattgagaagatgtctatatataaagcatctagctctttttggaaaagctcttagcttaaagttggaagtcaaacgaactgagcagaaggggaggccgtggaggatggtaggatggaaacgaaataaggatctccaagacatatttaactcaacagtgatacatgtggtgggcaacggccaagatacaaacttctgaagagggaattggttaccaaacaggggcagcatcactggtaacatgtcgagaactggctaccgagaggtaacatcgttggtaacatgcctacgctcttcagctttgtcagtaggtcaagactgatagtgggacaaggaatagttggctacagatgggggagagatctccaaggatcgctctctaacagagccttggcagagtatttattcctttgggatgaactctagaatgttcacatccaataggggatggaggattcaataatttggaagctgacaagtaatggctagttcattgtctacgctgcttacaacctattctttatggcgacgatgaaatgtccttatggtgaactattttggaagattagagtgctagcgagggtcagattctttatgtggttggctgtaaaaggatgatgcttgatggctaacaatcttctcaagagaggatggctgttcgttgtgccaatctgagatggaagattgtgaccatatgttcatcaagtgtcgtacaccaacagagtatggacaatgctacgagattggatcaatgtggcctttgacccacctagtcagcaaggtcttctatgtggcataatggtgacagcaaacgcaatcttgttttcgagcgagctacatgaacatgctcgatatgcttttcatgatggtgtgctggctcatttggaaggaacgcaacgggatagttttcgagcagaggttaaaacaattgcagagaagctctggagatattaaagaggaaatagccatttggagaactgctggcatatttcaatattgttatgaatagtccgttttagctaatgtcatgatcaatcgctataacatataacacccccttacaatctcaatgaaatttgattggccaatctttcagccgacccgcgaaaaaaaactccaaatacagctacatcaacagtatcatgtatggtgaataagatccatatcagggagtaccctggatacaatatcgaggcataccacaccgtgaccaaatggtacctacaaatttatctgagttaacctaagtactggtgaatgtgatacgcaactggtaaaagaaacgttgtgtgaaggtgatgcggcaagagatgaaatgtaggatataatagcctcgcactttgacccaaccccaagggcattatttcagttaaatctgagtatggaaactgtgaattctaatggccaaagttcaatactaaagaccatgtcaaaaactaatcacttggtattttccaacggagggagtaaccgctttgactttggcaaaattagcatagggcagtttcatcgaatctgtgacagaattaaacaaaccacaagaaagcaaaaaaaaaaaacataacatcataattaggaatttaggatatgcattatgcattcagcaccatagtaacaaaatagctgaatgcatacagataaacaccgctttactgaacattggtagcttgctttgcaaagaatgaaaattcctgcgactcctcgaagtagcttcttttgaagcaccacaagaccaactcatacagcatcaccaactgccagcatacttgacattgagcaaaaataacacgcatccaaaccatcagatttgcagcgcctttggaagtctttcagctgagagacaaggaacacctgcatcagtgatcacaagtagtctgaaggtatatggctgcacaaggtatgcttcattgtcctctgtcgactctcgcaagcatatgtttcgcatgctttgcatgggaaagcatactagcgccttcaaggctgcaagtagagcatcatgaatttaagaggcttgacttgcacaatcccaattcatgtgttaaatccacccaaaagtttacatgaaaccaaatatacagaagaaacattttgcatttcgattggtgatggtaggatgcaacatactactacattaaaagaaaattccaagatatttactcaatgaaacgaaaagacagaacaaaatgttctacggtgcatcaaggttgccagctaagaatcagaagtgggaaaaacaaaaggagtgattgatacttagacagtccactgcaatgagtaattgatctaacgaagcagcaacccattagtaaagcagaaacagactaatgattaagaatgtgtagttttgctttggagtacagaagctccccaacttatctttattggaatattaaatattactaccagcaacaaatcgccaatcactattaaggacctatgttttctcacatttttcttggttctcatacacaatatgataacaagggcacgtgcaagtattagtgaaggtccaatatactgagtaaaagcatcaaactacttatcttttggcatgactattcaggttttacttactttcaacatctccctgcaaattaatttgctaagctcccaaattgcctgttccattcttcataagttcccagttcacttgaggaaacagaaggtctaacctcctgcaaagcagtctcaaaatcctacagatccaaaattcaaaataagcttttaaaatcggaatgctacattttgggaatgattcatcgcaacaaaggacacacttatttgacaatgcaatagacaatgcaatcattgtttatccttttagtgatcataagtgcctagctatctagattccagcacttatttgactagaatagtagtaccttgagcatcaccggccgcatgtcctccttgtttagctttgttatgccaacaccctgttgaagagcttcccttagtggtcccattgaggcatctttcacaagatttttcatgtcagatcctgagtaacctgcagataaccaatgatgcagaaatatccagaaagatggcatgatacctcagaattagcagcaacaagaagaaacctggatgattatgagtaccttctgttaacttgcaaacaatatttgtttcttcctctgtgagcttgaaaaggccatccttctccaatagattgcgaattatccaggcccgtgcctctttaaaataaaccatggaacaatgagattcctgaagttatccccataagaacagaaatagaacattacctgatgaaggaaggggaatatatagacgttttgtaagtcgcctccgtgctgcttcatccagttcttgaggtctgtttgttgctcctgccatcattttttctccatgacatcagcccaatctaagttccaccattggttatgaccccacatttaacatccacctcatagactatgcaacacaacttcaaagcataggcctttaggcaaagatggatatgcaataatgcatttcacaaggacaatagaaaagcacatactatgttgatgctcaaacctcatacatataaatatcctgtaattcctaccatgacatacattaatgcatatcacacttgatattttcatctttttaacgcatgaggtacctataagtaaaatttgatcatttccactgtcaaaaccttccatctcgattagaaactgtgttttcaacctcctacttgactcatgttcaccatctgatttgcgctgaaatcatgtgtaagggtgttaggtgtcaactgatgcaacatgtatgtgcataacaaaaacaattcactaagaaaaacctgtgatagtagtgaatcaatctcatccacaaatatgacagctggctgacgacaacaggccaccccaaatagtgctcgaactagcttttcaccctcgccaatctgcacagcaggagaattaacaatcattatcaatctaaaggtatgccttcacattctatgtcataatgtatttttttttgaaaaaaaaagattgcataattactgtgcacaaaatgggcaaacatagtttgacagagattaggatttctactttctgaggagagggcatataaaggctgggatgagagaattagcaagtgagagagatcacaaacaattgtagggagtacaagcatgttccacgcttgtactaaatcttggttctaatccatatagactataattctttgaaaacattaataagatggatttattagcatataaacaaatgaatttgttttccgtagcacctttatgattgattaaagatatgcagaccagaaagatgtaactagccttgactttataggatacaaatggaactatgttgaaaattaaaacaagcagcagacagacccatttgcttgtcagtgaacttgcagaaatgtagaaaaatgttgccttggcttcaccagctattgcttttccaatcatggttttgcctgttccctgtggaaattaatgcacttatctttaaattgaataaaatgggggaagagcaacataaccagatgagataaatacccacaggaggtccaaacaatagaagacctcttccaggagaccgacaaccgtgaaagatgtctggacgtagcagtggccatatcaccatttccgtcacgcacttctttgcatgttccaaaccagctattgcaggttggcatgaattagctacaagacacaagttctgaaagtactagaatgcaattatgtacctatgtcatcccagcggacattaggatctttatccattatttcattactgacatgctcaattaggcgaggttccagatttctcagcttatcaggaagctcaccatcaggtccacannnnnnnnnnnnnnnnnnnnnnnnnnnnnnnnnnnnnnnnnnnnnnnnnnnnnnnnnnagcagactgtcgaatttgcgcgc

SEQ ID NO: 38449 - DNA, 4781 bp, Oryza sativa
  unsure (1)..(4781): unsure at all n locations
cgcgcacattgtgatganacttcagctcggnacccagatgagtaattacagtggctgagagcattcactctgattcttaagacaattaaactcattcacacattcaacatccaacaattacttggtgatcagtgtgttttgagagtgtaacaaagtgttttttgtacagtagatagataatagaaaatggaacattctcagctagctgtaaataatgttagagttgtcacttgtgatatcaaatgacttaagttgtatgaagatctcacttttgccacttattgtgctagccccagtggcaaaaacaaaatgcacagggcaaaagtgagatacgatctttccttagtggcaaaaaaacaaccctggtttccatgcagatcttaagcttacgattactgatttaaaatgcaaattgaaatcaatgcaacaaatcaatcatatgaaaaccaaaaatatgtttaaagcgctacacatcatactatacagtggctgcagcagattgtagcaagaaatagaaggcctcagtggacccggaactgtacatagagccacagacaactgttgtgcagacacaactacccccggatcatgaccgttatatcagggctacacagagttatttaaaataatggcctaatgggtactccatatgcttgtctcacattgggagttcaagattagcttgcactagtggtcaaggaatttcaaacacactgtattaatagaaactagtagtagtttttaattttttttttcacatttagcaaatatctattatcatactaatgctgctatatccacttgatcaattcatactcttgttctgaaattgttaagtgacaggtaatattgccatccagaaatttacctagttctttaacacactacattgactttaaagcaacgtctacaacaaggatacccagcaaaaaatgcaaaccagtgtccaaatcaccaaacagatgtaagaaaggcaatcatactgaatatgatagtgataatcttagtcatctcaattgcaaaacaaaaaacacattatggcaatgaagtcaaagaaatgtatctcatgtactttgcttctagtaccaataaatctgagtcttagaaaaaaaaggaaaagatgtagtcatgctaaacataagaaaagcaacgagataaatagctatgtaaatgtcatgtaaattgttacaataacatgaagataaaagtaaattcaaatggtatcatatgatcaagatggaaatacagaccattttcttgttgaatctcccattgaatcatcattttttccaatgacccgtgaggtcatattggaagtggatcctccattatttctgataggaggaacaaaattaccacgtaatccacgacgagaattccaggttggccttacaccataattccggttatttgggttgttatcacattgtggggatacagaagcaccttgagtaccattatgcccatacttttgcacagaatccatctcctagaaaacagaagcatcagctagtgaaggttacattgacaaaatattcaacataaaccagaatggccatactaagctctcctaataacgataccacagcaaggcagatgccacatagtgcacaaaaatggtttcacccaaatgcaaactttgtgtgtttagcaccaaaaaataaattataattctcttgctaaaagagttttcttgaaaattttatgatttcagaagaaacaccataaggatctggaaaattgtcttttttacaaataaaatattcgcacagaatatgctgcaatacatatcatggtttcaagctatgccataagtagaactttatttctaactttagctaactgttacctaatgatgctttcttaggtaacgtgtagaatgctcaggactgcagtgcatgcagcagacagagaaaagtaaaaaaaaaaaaagaacagttaaatgatatggatttgccatcaaccaatggtcattaagaaatgcacaggatttggcacagtggcaaaccagcaagcataaacgagcataacaaagaagctacccattttcaaaactatgcgatgctaaaataatagaaagagtcttggcacgaatagtaaatgcagaagttaaatacacctactatcatatgccactagtgcttacgatgtctttttgttggaggatcatagaataatagaggcactctaaatatttaccaaaattgtacaatatagaataaaagcactgagcgtaccaactttgtcctggcagtcacaaactcattggcaggggcatcggcttcatcattacttaatggagaatttgcatgttcgcagattgggcttctgaatcctgcatgctttcgctttgcattctgcaacagtccacggggtctgtcatcatcttcaagatccatataagcagtatacttgttatcagtatgatttgttctgactccattttcgacagcaacactctcattagatatgttactcactgatttgaacatattcccatcttgtacaacatttgccttcaggggcttatggctacgcagtgatgttagttttctttgcattactaattttgaagccctgatgctaagcttctcattttccatatcagttgagttttcctctacatgcggaccttcttcaatggtggactcttggcaatcagtggtcttctgtatttcagttcatgtcacaaaaagagaaaatgatgataaaatcagccagcaaacaatgacaatttgcaaacaattaacattggaagttgaaagctatgtgtttcttcatatggtgcttcaacaaaaaaaacattaaaaagagttaaatcacctttcagaaatgatgttgtaaataaagaattaagaaaaatggggcaatggttagatgtccctcaagaaggaagaaaattaagaatgagaagtacgaacaataaggtcttttgagcacgtaaagcctacaacataaattgaattgtaccatttgttcagcagcatgtcctttggatttctgaaaaagtgcttgaaaatactttgaacacttgatctttttaatattaacttctcctgtctttgcaaaaacacaaccaacatccttttctgcaagcttaaacacagcactgaaatcgaaaacatctaaagtgaggactgacaccaagtatcacgatagtatgcatcagagcatcacaaataaacttgaacagtgcagaacaaagctaaagtaatttggtttaacagacaattatttgttctagcggttacattgctcaagtagcacctctacgtcctgggttcaactccccaagggagcgaatttcagacttaaataaagaaaaatataccgtgggggcctccctcactgtttccggtcaaaaatgaaatagacaactatttgttcaagattaaacccaagaagccactcagtttccatcagtgatggcaacttaatgctccaatgcatatggtatccgtaccaccaccaaaaagaaatcacatttccaaaaatttactagtccagtagtcctgaccctgataatatctgctactgctaccatctctactataaaattattttgactacaaatatcagaagttggattcatccttgcagaacttggttcgatgttgcggaattttcacaaatgacactccttaactttcatgcttacttgcttagccctgacagtgatttctgcaacgccacaatcgttatttaccagatcgcagcacattaataatgaagacatgtgtatgtcctgcaacacttatatctgaatctaacttgtagtggtatatgaatatgttagtcaattcaaacatgcttagcacatacatggaatgatctgaggaccttaaaattgaaccaaaacacaggctgatgtcaaccattgccgcagtggtaacctggtgatttcttcctcacttaaacaatgagcacaaacaaaaaggcaaaaatatttcagtacgcaatgtgcaacataagaagaaaaaatgttcttggccctatttatttagacaacaatttctaaacttgagtcaaggtctagtgggttgaatcctactatagggagcaacgaatcctaaacaggatatgcaatttgaattatgtgatccacatgtattcaacatatacataccactaatcatggtggaagatagaccatcacctttgagtaccctttgctttgaaaaattactttcccacaattacacatgactttcggcaccattatgcctgctctggtcaatattgttttgcttcatagagcatgcataaaaaagacactatatgctaagaggaagagcagcgtgtattattttatttccattccagcaaaatataatgtatatagcatactaatattacattagatggcttaatgtatttggaaacaaataaaagcaagctcccgagaaccacccaacacaaacagtggaggcactagtacttagcttgcttgtttgtgcacacggtaccagttcatcttagtcacggcaattctccaaaatccacagatttctagagctatataaataccacattaagtgaatactacagtatcagctaatggctctatatatttgcacaatctgaataatagcgaaagcaaatccatccaaatcgctcccactcttcgcccgaatcgaatcgaggagaccctcgtaaacacggcgagccgtctcaacgcatgatttgggcgaaaatgcgggagagcgcgcggggtggcgtggctgtgtttggggggggggggggggggnntnnntttntccnnttnttcncctcttcccttc

SEQ ID NO: 38450 - DNA, 1825 bp, Oryza sativa
  unsure (1)..(1825): unsure at all n locations
tgtttaagtacgacagtctgctnnnnnnnnnnnnnnnnnnnnnnnnnnnnnnnnnnnnnnnnnnnnnnnnnnnnnnnnnntaatgcaatgttgtatgcagtggtttttaatattccactccaagattcacatgacttttttttatcaataaaagaaggcagataacagtaataaggtaatactgggaagggcatggcatcttactttacatttcatagaacggactcagagagtttttaatggcccatctgttacatctcattatctatgaacttccaaattagttgcagttgaacaataaagggacatatcttaaaataaataatctccttttttgtgggttaaaataaataaatctcaaaaggagtctacatgcaactaaagatcaagcaaatagatatactgtagccaagtccacatgtcccttgaaacaatgtccaggtttgctgattgattatgaaatatgaattgatctgcaaacttttgaatgcagtagaaacatgagacaaataaatctcagtcaagaaacaaagctattgtgttgggaatataaggtaaaattggacaggttaacatatctatatcactattaacatactgacatgactccaatagtcattaaaaagtcaaggatctcatagtaaaatctatacactaaaataatatggtgttctaccctgcagaaatgaaatatttgcctgcaacatatgaagtattggagaccaaggaacaattcagttttagtttacataggcagagctttcaatcacaacatacagtgcaaaatagagtaaatatgagataataataaggattcaaacagtaacaggagtgcacctcgaccatgcatttcatcaaacagttggtgagatgcccatgggcacaccaaggaaccaccgtgatagctaatctggaagaccccctcactgtaatggaagggtaccatctgcagcacgcagtagctggagccgctgaaggcctaggtgcagacattgtggcttgcttgcgaggcatcactgatggcggcatggaattctacacatctatcaaacccaacttttaaaaaaatctatgcatttctgtaatcacttgaacatcatgtggatcagtttaatgataataaaatgaaacacaatatataatcttatgattataactaactgttaagtttgtattcttcttggtccctgaaagagaaattttcagctcctacacttgcatcttgcatcatttacataggtaaaacaaattgcatttaggatttttcatgtaaatttagggtgaaagtgaaacaatacctcagaggtactgtcatcatgtgcaaggatcaaaaacaaaaatgacaaactaataaagttatgaaagttgggatctggggcaatgccttttgtagttgaataagtacccagaatcaatgatttacatatagattgagcttttcattttgtataatttccagagcataatcaaacattttatcaattttgttatttttcatatatattggaattgcattttaacatgtatcgattaagcaaatttggaaatcaacagatatgacaatgaatcagtgtgacatagggtcatagtcgaaaggttgaatgttgacattctcacaaattcaagattaatatatagcatatttctacagatttcattcgtttattttttggcggggaaaaattctcataatataattagcattcacggaacaattcattgatcctatttgatagcagaaaggagaaagagaaagtaaatgcattctgaacaagggcacataatgcaattgagaaggagaggagacggaaaagcaaacctggga

SEQ ID NO: 38451 - DNA, 16489 bp, Oryza sativa
  unsure (1)..(16489): unsure at all n locations
cggtgttgtgttggtggccccggaagtccggctccagggcgtcaaggtgtaaaaccacttaaacatggcgcacggcaaggatgcgcacgatgaagacaggggctggggaagacctcgcctccggttcagtgcgcggtgacggcggctgcggcggcggaaaggaacgacctcatgggcagcggtggactgcggcggcggcggcgcatcgggaagaccttgtctccggcggcggcggttggggacaacgtcggctccgggcgacggatggggacgacgtcgtctccgcctgcggccggccgcggtggatggggaagctccagcggtggggaagacctcgcctctcgttcagtgcgcgccggcggcggaaggggacgacgacgcgagtgagtcgcgcgttgagagggtgatgactgatgaggcgtaatcttcgctcggtcttcacgcgtggagagggtgaaatcgtgcggtggagatgggtggacggttcggattacatctgacctgcgtatggacggtagagactgaaccaggtgatttcaccagtacgattggaggggtccaactccttctttttatattaatatagatatagatgtagcagtgaagcatgtcgggagtaacgtaacccaggcatccaccatcaaaattgatccaacgggcctatctttcgtctctacagactacagggtacactagggagtcctctcgttcttgattcccgaggctgcagataatggctatctctgtagcttctttcgcgtgtcgactacggtcatgtgtggcgtgggccaccgatttcttgccggccttttcgaccttggtgacatcctgacccgtatgtcctgccgatcgacaaccggcgacaacgatggtcgatatatgaacattttatgtagagtggataagaggttctacgcaacctaacgtgaatatgataacgataaaatatacaataatatgtttgaaatgtgatgtaccatgaatacatatgacgatagatctaacgattagaaataatggttccaccggtttaaaaggtatggaagtattccagagatgtagcttaaaaattatgtttgttttaatgtctaacatttattgcgaagtgaacgtacctcaactggttagtttccttatggtggaacttgcccacttgggtttaagtcctaggcatgaatttttttcagtggtagacgacgtatccatcaacactaaggcgttcgtggtgactttatcaatctcaaaatatgatgtcggcctaatctctcagaggtcctcataggggtaggatgtaccttcatagacttctcacaaaggaactcataggggtagggtgtgcgttcataggggtgagtatgcgtacgatgtgagcgcctgcatatgtactttgtttctcaaagaaaatccaacattatttattgtttctattttagtttaatagataaaaagggaggtctttgtttctaaaaaaatgtccaacattaatagataaaaaatagggaggtgaagaacagtgttgcgtgcatgtgatggcaagcaggaggtggaggagatttgttttctaatttttctaaatcaattaagtgaaagccgatgatggggtgttttgttttttttaagaatttctaaggttctttatgtttttttataggacgtgacacatggcaacttaagattttcttttaaaaaatacatataattgtaaaaaataaaggatgtattaatttaattggtttttcttagaattttaggagatgatatatgatcatttatgagcactctggagagtgtttaattgattttttgttatgtacagtgatttagtataacataagatgtatgttcaattaatttttctttgttgtttagctgtctggccatgatagggtcaaccatcaaatgatgtattttatcttttatatagtagaatatagctaatgtgatttttgatttatttattgaattataaataaaacaatagctatgactatttttatattatgttagttaataaaaatagaacatgagataattgaattggagagaggatgggagagtcataggaggagggtaaaggggtagtaaaacaggagaatgggaggagattattgtttgaagataaacggaacggtcctagagttgtttatttttataaatacatttgatctcagatctattagaaaatactttaggtattgtatttttaattaaactacttaaattgttctaatttaagtgtatattattaatcagaaggtttaaaaatctatatgatttttttcttaaaaatgtatggattggatcagtgaacaatagctagtccatagattatatatgacccaaagtaatgattatttagattttactaaataatctaatggtgtgcaccaataaaaagtttgctatatgatttagataatataattgtttaaaatttatcataaaatattttttccatctaactaaatgaggaaaataggagataaaggatataggtggggaggtacatacgcacaaccagatgttttgattattctcataatttttattatttttctaatttaacaaaatgtcacgtggcagcgtagaagtgtttgtagaagtactacatggcggcttgagagcgtttacataatgtttaatgggcaaatagctaaatttgcttccatgtgataattttcaaatgaaaatatagttaatatcaaatatagtcgtagtattttccctatatacatctaattctgataagtttattagggtcgggtggatgtttcttgtatgtataaaaattcgaggagggaagaattgtccgtagtatgtacatacccaggagattttatttttctcagtcgtggatagtagcacgtattatacatgtgagaattttttcattttttttgctgagcattacgtatgcacggttctctcgttgcaattaggtgggaccgtggcatggccaatccttcttcttttttttcaatcataattatgtattttgttcctttttttggtgagtagcaaaatacggaagtacatatatgtacgtatatgtcacgccccgatttttgtttgggattaaaaatcattaaataatgcatttctagaaatttatattaaaatttaaatcaatttaatcaagtaaattattgagggtatttaaaatttgctttaaaaatcatggccaggaatattttataatattctatgtgccctaatatattctctggaatttcctgcgaatttttggagctcgagaagtaatttcaacaatataaagttcatttaaccaattaaataaaaagaaaaactaataaaaaatctcctctctccctttgggcctcttccggcccaaggtcccttgttcctccctcgcagcccgctcggcctccctccttccctccttacagacgggccgggctctccccctcggcccgaccctttgccaagactatttcgcctcctcccatcacctctgttcctccctcgccgacaggtggacccatgggccctacctgtaagttcttattcccaccccaagcccgtctccaaccgctagcatgccgccattgccgcccccacgtcgccgcctctcccgctcggttccgcctcccgcgctcgcaaccgacggcgtggaccggcttccctccacctccttgaccaaactcccccgctcgtcccacaaaaaaggaggcggccgagccgctaccaccccacgtttgcgccccacttcgctgatcgttgccgccacgcccggccatggttttccctccctgagcctataaaacccttccccggtgtctcctttctcgtttcccctaactcccgagtttccccacgctaaaaattgcgcccacatcgccgagcctatgcgccactgcagcgtcgtgaaaccaccaccaccggcttcgccgctccacgctacatgccggccgctgcaccacctcgtcaaaatagcgccggagctctgtttccacctccaacccgagccaccattgccattcgcagactccgatctccgattgtcgccgttaccgaccacctcgcgccgccatcatcggtggccgtccgggcaggccgttgccgccgctcctgccgcgcgcctctcccgcgccgtcgccgactatgctgggtcgccggctggccgcctccccttggtcccagccgcagccgatctgggccatcggatcagcctcggtctccatccgggccgtccgcgtggcatcccctctcagcccagcgtcggtgcctacgtggcgccacgtgggcgccaccttctccatgctaggctgccgtggccgccacgtggctgccacatgctgctcccgcgcctagtgcgcgcgtggaccgggtccaccgtgcgcccacctcccttgagccactgatagatggggcccggttgtcggcgccacctatcccctcggtgacatcataaatgatttaaattgcactataaatcattattaattctagaaaatcatttaagtagctcaaaacttctattaattcatatctaattcatacgaactccaaattgagccgttcaactggcaaaatgcatctaaaattgagttctacatgttcgtttacttttcatgcactatttgcttttttttattagtgtttttccttatattgcgtgccagtgtgtagtttctgccattttggaagatcgtggtcgcgaggaaaagatataaggttgttttgaagaagcaaggcaagtcacacattccccttgagcattttgatcctagtttacaaatgttttatcgttatcaaataaatatgcatgttttgccaattacatgagaatagggtttacctatctgctcgcttgtgccatgtttacttgttacccgtccttgtcaaccttgggtgataatttatctagctcgtgatactcatgttgacctagttagaactatatgcttagcaatgcttaattaccactagctcacttgatgggataattgcagtattagtccttttagtatcatggcgagctgcgtgctcgagacatccggccatgtttcattggtcgtagttatccaactaaaatgcgactgaatggtgagctgtgggtgcatggttttctagtctgtcacgaccggaaataacccaacaggcgttccttacgtgcgtgcattattccttgtcccaggaggcaaggtacaccaaaagttgatacagttcagagtttaacaagcggaagcgtaaatagataatttattacatgggcagcgaaggcccagcacacacaaagacaaacgagaaacagcggaagactagggcgacgaccacaggcgcttgacggcaggcacgagctagacaccaaagccttcatcttccagggactcctcttctgggtttgggaaaaattgagcaagactgagtacaaccaccgtagtcaacaagacacacccacaagtgcagaataaatgcaagggagtacaagggagttataatataaagggttagggtttaccgtaaacagcattaaaagacacttagttgctcaaagctattttgtaaatacggtcctagagctatacaatattattaaacaaggccgtgaacccacacgagcctgccttaacccaaggcctacgatgattcagaccgaactggcaacccgaccctgggtcccagctcatcccaagccaacccaggccaaccattccacattttagttgttaaacaggttttaagaattaaaacactaacttgggtacattgctcggcttgcccataaccgagggcgcggctattcgaatagattatactctgatcagaggtgtacatctttacccacaagacacatcttcctcacgtgtagccacgtgccacataccacctcggtatacagacggaagacgtgacatagtttccaacccatcctagccatagacaagagtaccgacccaatcccacctacggccggaacccccgggacaggtaggcagggctgagcccctagcagcaggacaccggccctgtgccatgacatctcgactaccgggccgcagctcgtgtagccttcatttgccctagagatgtccatcgacccccgacttcgtccatctccatccgtgtacttttgtttataaccagactgagccacaaacaaagccttacccactagacatgtggaagtacggtagtgctttacaacagaggcccgaagaccggtccttatatggccgaggtgctactatcaaaaccatgcaccccgagcccagcctaaaaccattttggggattttgaatagagggggcggggtgaattcaattccacaataatcaaaccattccatagtgtccaggtgatgagaaaattcccaaagtttagagttgtaaaaccacctaacgttgcctaattaaccagcgaagcatctacttaaattcataccagtggtaccaagagtagagtgtccattagttggggttttgtttattctagggtgaacaaggaaataataacaataacaataataaggtcataacaaaggtaaataggcatggctagataaaacagtgataacgcgggaatttaaataaagcgataatgcaataatttaaatcaaaataattttataaactgggattcaatatgttcaaggatgatgtgacttgccttgctcgctttcccaaacgtcggcttcaacttccacgaagagcggatcttccgaagctgcagcgtctacacgaccaacggaaaagaaaaggcttttactctaataaactccatataacaagcaggaagaaagcacaaaaatggggtcttgacttcttaaggaaaaattagagacttgaacggtccaattccgagttcaaatggccaagttatggccatttgaagtttatatgctctttaaatgaatatttgcgaatttcttcatttaaattttaatttaaaaaaaatggatttattgcgtcagccgaggggaggggcgcgcgtaccgggtccacgggggtggggcccacgctgcagccccacggtccacggtggaccgggcgcacccgggctcacaccggccggcgctgggggtcccacgcgtcagccgcacctaagggcgcgggcggctgacagccgggccccacgcggcagccgctcggttcgcccgaaggcgaccacgccggcgtaggcgggaggcggcgcgcccgcgcccctatgctcgccggcggtggccataggcacggcggagcggtggccgagagaggggagggaaagggggaaacgaagtggcggtccacggctcaccccaggtcgacggcgacgacggaaacggcgaccggagcggaggaaggcggcggcgcggctcgggtggatggggtcggcggtgctccggcggtcggcgagcgaaacggaggggtggacgaggtcggcgaggatgcggcgaagccgaagaaggcggcgccgagggggaaggtggtccgggacgacgacggcggcggaccggagctcggcggcgacggcggaaagagagagcgacggcgcgagctcgattccgacggggagtgagggcggcgagtggcggaaacggtggagggaggctcggggagggtttatatagggttgggagtgagagggggtggccggaggagggggaaacgggcgcgggagtcccggccgccattaatggcgccggcgaggttaggggaggggtttccaaacgaatccgagggagagagggagggaaaaatggggggaaagggggaggggatcccggggaataattcccccctatttattgcgcgcggggcggacgggggcggtgggattcgcggcggtgccggcgctagggcgcggggaaggcggcgggagcggcgggaggaaggggatgacgggtgggccccacccgtcagcgagggtggcgggcgggcccgctcgtcagcggcgcgcgcgcggggagaggccgaatgggccgcggggagaggagagggagggggaaggagatgggccgagccggcccaagagggagagggagggaaaagggactttttagagcttttctttttataaaaccattttaactttgtttatttcttaataattattatttgtgctctgaaaattccactaaaatttatttatgcattttagactcttaggaaatatacaaaaatcctccaagccttatttgacttttaactttgcaccttttaattgttggaggctttcacacggattttaattattctaggcataatttagaggatgtattttagggtcgttttgggacgtgacatagtcgcacccatggcaattaagaagcggttcgcgggatgcactagaggacttaccgcgcttaccacaagcgggaatgggtgactgcttgatctgtagtatagctttcctctggctgacgcatccaggcaagggtaagcgtgatggagttcagatgggccttgcgatggcctatgcggcttgctgattcgcctagccacgaggggggctgctcattgcctgttgaggagtgggggtgaaacctgaggtgtggtgtgcttggtcagagggggttatatgaagggtctcgtcacaatcactcaacatggtgacgtgtccggccgggcgcgttgacatgccggtggattgtgtcttgtgagtacagttgtgcacctctggccaaactaaaactattcaaatagctgtgcccgtggttatgggcgatcgaccagaatcaccgtgattagtctcactcttaataaatcgactcaatgcataggttagttcaggtgggatggttggtcatgttcaacgtggtgtagcgttgttcagtgcaggcataatattatcttaattaatcgaatgttctattgtttgctcaataaaatgctttgcaaccacctttatatcaatagccacaaacccctctttgtatccccttgcatgtctgcatcgattgttggtttggcttgctgagtacggtggtggtactcagccttgctattattctcccttttcagaagtgtagcgcttttgagctgaagacgaagttagaggaccaaggctcagaccctagttgagttttgcctgtggagtggagctgaagccccccgctaggatcgccttttttcgcttctgtcactttcttttcggtgtgaggactaaccggctcttctgtaagtatttacgctttatttacgtttggatctatatattaatttattgttttgtgtatcctggctgattcctggacagagatttaatacacaagatattccggaaatttgggctaaatttctgtgcgtgacagtatatatacgtgggatgtattttaaataaatctatataattgttttaaaatagtgggtccaccgaattgaatgaaaatcgagggttggatgtttttcttttttctcagaatttgtaagattttttcttctttattagagcgccacatgacatcttagaagcgtttgtaggagtaccacatggcggcttgcgagcgtttataggaagtttaatgattttttttatataataatagatagatgctgattctttttgaaaatttttttgacatgattctttttagaattttggtatcccagaaagttctcactccaaaaaattaaaacgtagtacgtattctggtaatgatatatagctagcaggttttcatgaacagttatgcggaaagctaatcgtcaagagtagaattcaatttcttgtaatttctctgggttgataatatttagagcacggtctttaaaaaccaattttgataattattttctattataatatgtataaaactgttaacaaatactccattcgtttcatattataagactttctagcattatccacattactatagatgctaatgaatctagacacatatatagaactaacgtcttacgttgtgaaatggaggaagtatatgattttattaaaatattttttaagactaatctatacacgtagtcactatatttgaatgaaaaatattttagaaatgattcataattaaagattctaaaatttaacctcactcttgtatagaacgacaagtattatcggcccagagaaaatatactatggattctattccaataataaatatataccaatctataaatatattctataccacatacaatccagagttctagactcgccataattagtatttaaaagtggtgctcataggggtagggtttgctgtgtgccttcatagggttgagtctacgtgtgttgtgagtgattgcgttgtactgcgtaaattttttaaaaaaaattaaagaagagttgtgctgcgtttcagacctctacttatagcgcagtagtgccatcatcccattccgaaggaaaaggaagaccgaaaaaaaaaaaaacattagtgccctcactgcattacagcaatggcgcatgctaagagcaatggatatcaagccagtgatgccaccagctcgctcgacgctctgagagagctctacggcaacaccttcgccgtcgtcaagtccatggctctcaaggccgccatggacctcggcatcgccgacgccatccaccaccacggcggcgccgccactctgtcccagatagtcaccagggtcgcgctccacccgtccaaggttccatgcctgcgtcgcctcatgcgcgtgctcactctctccggcgtcttcgccgtccagaagctggcgcccggcgatgccgcagcccctgccgacgaggccgaggcggccgtctacgcgctcacgccggtgtcccgcctcctcatcggcgccgggaaccagggacacatgatgtccatgctgctccacccgaacttcatcacccccttcttccggatcagcgactggctccagcgcgagctgcctggcccgtgcatcttcaagcacacccatggccggagcttgtgggagatggccgacgacgacgccgcgttcaacacggtcgtcaacgacgggatggcgtcggacagtatcttcacgatggacatcctggtcagggagcatggcgaggtgttccaggggatcagctcgctggtcgacgtcgccggcgggaacggcacggcggcgcaggccatcgccagggcgttcccggaggtgaaatgcagcgtgatggacctcgcccacgtcgtcgccgaggctcccggtggcaccggtgtcgagttcatcaccggcgacatgtttgagagtgttccaccggcaaacgctgtcttcctcaaggtatattaattggtctcgcaattctctcaagtacatttccgtttttttctaaaaatttggcgtcacacatatttaacacattttcagtcatttttttatgtgtagttgctatctctgtatatgtttatttctcgtttagctcctactcgacgtaattaattaatcactttcgatcctattctattacatgttgtgcattagaaaatttatagttttattacagtataaatgctggtgatttaaagtttaaagcgatttgttttgttgaaaaatatggcaaacccccttatttttgttgttcccgtattgctgtaacatatgtctaccaaggtacgtgcttttgctatggacagtgtcgtacaaattgtcgatggcgattgcaattaaagtcacgcgctttttttataaacattactgcgtaccaagctttttcaatataattagcagttgaattttggatataatgttcaatcattcagcttatttataaaaatattactcctacgtagacatcatcatttattttgctatgacctattgaaggtacagaggactttaaacatgacttatatattttatagtagtattggagaatactattattgtaaagatttcaaagttggaaaatatcatcgcatatgtccttgacacgttggtcagggactcacatttcattctcacaaatgatggtatttttcaactcatacatctttatgatggtattctcctaatatttgctatctgctatatatttatagtaaatttttaaataaaataaatggtcaaacattatgtacaaaagtcaacagagatatattctacaattatgggagtactggttagaggtttcgtaaaccacacaaattaatactagaagattcagaatgatagaaattcccttgttataaaatatctgagaaattttcatcttaatatattaaaatcatgtgcgtccatacataaaaattgatggctgagatggaaaatccctaccatcaaatctgtttaagatcaaatacaaatgggtcataaattaaagctattcgaaggcaagcatatatattatcagaataatatatgcctgatcaaaaatgaaaattagatacaactgtttagaaaaaagaatttcgtatatatatgcctccactgaaattcactaaatttatcttcaaaattgaatgtcactttcggtgcaaattaaggttgagaccagtgcaatgctaattatatttttgtaattgatgtcagactcttaaattttgtgtaagtcattatactttggttccaccgataagttattcactattacacctttaattcacattgggaattttagaaatgtccaattagtacaaggttagatgtacatacagatacatatatttacagaataatatatagttatggagggactgttatatatttaccttctgtctctcctgatataaatttattatatatttagtggattatgcacgattagggtgacaacgactgtgtcaagatactggggaactgtaagaaagccatcccaactagagacaagggagaaaaggtgataatcatggatatagtggttgggacagggccgtccgaccaaaagcatagagatgtgcagatcttgtatgatgcatacatcatgtttatcaatggtgccgagagagatgagcaagagtggaagaagcttttccttgaagctgggtttagtgactacaagattatgccaattatgggattcaggtcaatcatcgaagtctacccttgaagaagttgctgattcttccatgagcaatctgtgtgtgttgcttgggttgtttgtgaaattgtgatcagaccaatcaaataagtgtgtggtgtagccccaatcaaataagtgtgtggtgtagcttcatatctatgtattcgcagttctacttaatttgcctttgaaaatttcatgaaaatagtaggaataatgtatgtaccccaggacataaatatccgctcacctctgatggcccatcagtgacgggccaaagtgctagtcacggatggccgtcacatttgacgcgttctagggatgccgtcatcagtaagccctttgtctgtggcctgtcagaggtgtggttcagtgacctcaaacgggcaactgtcaactgctttcgattccaacccagtgcactattcacatttcagatgggacaggaaagagggcgattgtttgctggaaatcggaggtaaaaaagaactgtgaaaattattattttctaacgtgtactatgtgttggcaactttttgtgacaagttgacaagcacgattgtagcaccttatgccttgcggtgatcctagagtcgcgaaccacctcgatctagcaaagagctaaacctagatggattttgacaaataaaccggctagcgtagccgattttagataactacttgtctcgtgggcaaaacggaaggttttcaggacaaacctacaaagagatgtcgcactctcgcagcggcggcggatggtttacggcgcaaactgacaaagatggacaaattaagagaaaactaaaagcaatatgaaaaacgataatccatttaccggccatagtaccttctaagcgtcttgccaaactctcgggaagtatttcttcaagtatttcccgttgattgctcgctgaaaacgctccccttgaagtgtctccaaaaaatatgcgttccctcgaacaatgccgcatacccgataaggacctttccaactaggagaccacttaccgaactccctggatcgagtacccgaaggcaaaattgtcttccaaaccaagtctccaacttgaaacaactttgctttcacccttttgttgtatgcctaggccaccctcttcttctctttgtctatctcttccaaagccttcaaacgcttgtcaatgacatcatcaaggtcttaacaaatgtcttgtaatcttcacttaacaaatcatcttgcttgatataacgaagagaaccaagatttacctcaatcggtaaaacaacttcttgacaataaaccaactcaaaaggagtgactttagtggcaccatgtttagatatcctatgcgcccacaatgcttcggaaagcacttcatgccacctctttgggtgttcctcaatcttctttttcactagctttaacaatgtcttattactcgactcggcttgtccattagcctgagcgtagtaaggagaagaactcaacaatttaataccataagattcggtaaaactctttacttccttagacataaaagaaacaccttgatccgtagttaatgtttgcgggataccgaatctatgaataatatgcttcaaattaaaggcaattacctccgtataagtcatattcttcagcggcacagcttcggcctacttggtgaagtaatccgtagcaactaccacgaacctatgcccctttgatgacgaaggataaatttgaccaataaaatccaaagcccaacctcggaacggccatggtttgattatagagttcaacacggcggcgggcaccaattgaacattgccgaaccgctgacaagcttcacatcccctatagtatttgaagcaatcctcaatcatcctcggccagtagaaccccgctctcctaagcaaccaattcatcttgtgggccaattgatgagttccacaaattccttcatgtacctctcccatagccactttagattgatcttcatctaggcacttcaacaagacaccatctatatttcgggatataaatcttcatcaagcaacgtgcatttgagtgcttgccaccgaattttccgatcaaccttaagtgtgggatcttttaaatatcgaatcaaaggaattctccaatcctttaaatatcgaattttccgatcaaccttaagtgtgggatcttttaaatatcgaatcaaaggccggtcagaccgctcggggtcgccggtcaaaccggcggcatgtggccggttataccgcacttggtcaccggtcagaccggccgcgcaacgtcggtcagaccgcccctggtctccaatttcgccaatttcgcacagagatttaaaatcaagcaccggctcttccaataccagaaataatcccttcttcacattatagccagatgcttgttgagccaagtcatttgctctagaattatcatgcctagcaatatgtctaatagtaaaattatcaaaattggcaatgatatccaagcatgaatcaaggtacctatttagtgatccgtccaagcatttataaaatccggcgactcgttgcaccaccaattccgaatcaccaaaagcttccacgtgcttagctccaaccatctccatgatttgtaagccgaataataaagcattgtatttggcttgattatttgtacaataatattccaaacgaaccgatgcttcataacacatgccattaggtgaaaacaaaactacccctatgccttgaccttctttgcaagaagaaccatcaaaataaatcttccaaggtataacttcaactaggcaaacctcttcctcataagcaatatctacatgatgttctactataaaatcacatacattttggcctctcacagatttcaatggttcataagccaaatcatactctatcaaagcatatgcccacttgccaattctcccacttagaattggcctttgcaacatgtgtttaataacattggcttgacaagcaactatgcatgtactagataacaaataatgccttaatttggtacaagcatagtatatgcatagacaaagtctctctataaagacatacctcgtttcggcatccaaaagacggcggctaaaatatgtaataatatattccttgccatcttcctcttgtgtcaaaacggcaccaatgactttgtcttcggaggcaatatataaccgaaaaggctttccagctttaggcgcccgcacaacgggtggagtagataaatacctcttcaactcctcaaacgcttcttgttgttttgccccccatgtaaaatcggcttcttttttcaagcgaagtataggaacaaaagcatcgattttacctgctaggttagaaataaatcttctcaaataattcaccttacctagcaacttttggacctccttcttgcatgtcggcgctttgaaatcacgaattttttctatcttcttaggatcaatctcaactcctctctcatgcaccatgaatcctaagaatttccctgccgtcaaaccaaaagcacatttaagtgnnnnnnnnnnnnnnnnnnnnnnnnnnnnnnnnnnnnnnnnnnnnnnnnnnnnnnngtgtcncagagagactgtacgaaccaggccat

SEQ ID NO: 38452 - DNA, 2164 bp, Oryza sativa
  unsure (1)..(2164): unsure at all n locations
cagactgagtgccggagccttacggtatataacatggttcctttctcgtggtactaccttgaccgtgccgggtggttgaacaattaatttcaattatggctccctccccccncccnnnncccgcgtgatgagaatcgcctgtcacnnnnnnnnnnnnnnnnnnnnnnnnnnnnnnnnnnnnnnnnnnnnnnnnnnnnnnnnnaaaagtcatgacaacccactcaaacaaaccaacaaatcccgggcacctaaaagtggtggtatatatatcctgttccgtcataaagatttgattgttgccggcattaccatctaaaaaactaatcactttatgacccgaagcatcattgatcatcatgtcggctataggcataggatattcatctttgggagtagctttattcaaatctctaaagtccatgcaaactctaatcttaccacttcccttcttctccaccgggactatgctagaaacccactccgcataatgacatcgcctagtaaaccccgccttcaacaactgatcaatctcctctttgactcggtcatatagcaaaggattaaaacgacgaggtggttgcttgtaagggctaaaacccggtttaattggaagccgatgctcaacaagctcacggctaagacccggcatctcatggtactcccacgcaaagcaatcaacatactctttaagtagctcgattatcttaaccttttaatcggctctcatatttttgtttacaaaagttggccttggtttagttccatcacctatgtctacttcctccaatggatcggccgatgtaaacccttgtccaagtttctccacttcatcgaaatcttcaatagtctcaccaatatcattctttgtagaccgatattcttgcaccctcttttgtaaccactctaaattagcccctttactcattatacaaatttatatggcttagctgtgctacactagccggctttacagaggtagatacaaatttgccatcggaaatactaataaaatcatagctagaaagatccatccccgataagcattgaatattcccatgatgccactcaaaagtagcatcagccattgcaacctcggccgatgtatccgcttgaacaatctcaacatcatcgctgtcccattgaattaaacattgatgcaaggtagaaggcactcaataattggcatggatccaacaacgacccaaaataacattgtaattaccttgcacatcgacgatgaagaaagcggttggtaacgtcttgtttcccatggtaagctccaccgaaaagatacccttcgcctcctttggttcaccattgaagccattgagaatcatgttggtcttcttcaactcattatctccacgccccaacttattgaacaacgaatacgacatcaaattcacggcggtacctccatccactagcatcctagctatggtctcaacgcccttacgaggtagtgatgagtttcacgcgctctaagcccggccagcgcgcagttaggaggattggccgctatctgagcggtaccacccatcctaccctactacctatagggggccgtccgtcctacagccgcccgaaaaggaactgcagagaccggcttcccatcaatatgacccttgagatagagaggcttcatatgacaatttgactcatcgggtttctcaaaaaccgcatctttaggacctagtgaaaattgagcaacctcggcttcatccatagcacaaaactctataggcaacatatataccatgttgatatccatgtcttcttttgtagatggctcatctttagcaaccgattgttcttccttctcctctacaacaaccggttcttccttctctatggatttacgcctccataccggtggtggtcgcaactcattaaacctcctatccctttgctcttcggccttttgctctcttatttcttgggcccgaagacgttgcaaccttctcctttgagtagccgttaaatacttaggtatccacctaggtttcagctccgttccaggaggtaaatagtgccctctattgagtttacttgatgacgataaagcccccgcattgcccttannnnnnnnnnnnnnnnnnnnnnnnnnnnnnnnnnnnnnnnnnnnnnnnnnnnnnnnnnnnnngaattgcagttctaatggccg

SEQ ID NO: 38453 - DNA, 4521 bp, Oryza sativa
  unsure (1)..(4521): unsure at all n locations
gtgggccnatgaactcctgtacttgtnnnnnnnnnnnnnnnnnnnnnnnnnnnnnnnnnnnnnnnnnnnnnnnnnnnnnnnntggaaatgttcacatctacaaggcacgattggtggcaaaaggtttcagacaaaggcaaagtgttgattatgatggaactttctcgtcagtcggcatgctaaaatctattcggattattttagcgattcctgcctatttcgactatgagatatggcaaatggatgtcaaaacagctttcctcaatgaaaatctcgatgaggatgtgtacatgacacaacccaagggatttgttgatccacaatcagctaaaaaagatatgcaaattgcagaaatccatttatgggttgaagcaagcatctcggagttggaatattcgttttgacgaagtagtcaaggcgttgggctttgtcaaaaacgaagaagagccttgtgtatacaagaagattagtgggagcgcactggtgtttctaatcctatatgtagatgatatattattgattgggaatgatattccaatgcttgaatccgctaagacatcgctgaaaatagtttttcaatgaaggacttaaaggaagcagcatatattctgagcataaggatctatacagatagatcaaggaggctaattggaagccagagtacatacattgacaaggtgttgaagaggttcaacatgcaagattctaagaaaggtttcttaccgctgtcacatggtattaatcttggcaagaatcagtgtcctcaaacgactgatgagcgaaacaagatgagtgtgattccatatgcttcggcaattggatccatcatgtatgccatgttatgtacacgtccagatgttccatatgcacttagtgcaacaagccaataccaatcagatccaggtgagagtcactggatagctgtaaagaatatcctgaagtacttgagaagaactaaggatatgttcctaatttatggaggacaggaagagctcgttgtaaataattacactgacgcaagcttccaaaccgacaaagatgattttagatcgcagtctggatttgtgttctgcctaaatggaggcgctgtgagttggaagagttccaagcaagatacagtcgctgattctacaacagaagccgaatacattgccgcttctgaagcagcaaaggaggctgcttggataaagaaatttgtttctcaattaggtgtgatgactagtgcttctagccctatggacctctattgcgataatagtggtgccattgcacaagccaaagagcctagatcgcatcgaaagtccaaacacattttacggcggtatcacctcattcgcgagatagtgggtagaggagatgtgaagatatgcaaaatacatacggatttgaatgttgtagatccgttgacaaagccactccctcggcctaagcatgagacacactgtcggtgacatgggaccgggagtatcatgactagaggcttgggcagccgcgatcacccacgtggcctgaccccctcgggggggtcgggcccgagggtgatgtggccgcccctccttttgtctccccgaggggtcggaccgctcccgtttcggccccgagggctggggcgccccgaccccctgtgggtttggcgccacgtatatgggttaggtgagcacagtggggctcacctaaccgcatttattgcgggttgaacgagcgcgtcacgtcgcatgtaatgcagcgcagcgcgctcgcttatccggtccgtgaccgggcgcagcgtgtgaccggtcacagaccggtcagatcgcgggttaggtggtggcaggtggcctgttacacgcctcgccccgtcccgtcggattgatgagagcctccaggcacttgtccctagccggagacggcgtgccagctcctgaagatggcacgtcggtctcggtcagatatatgccaggcttcatcccaaccattgcaaggaagtcattgtatgaagaagggcagacatgcagcttgctaaactgacgcgtggtggacgagagtgaccggtctgtgactggtctgacgcctgtcatgtcataggcagacaaccgcgctcccgttttgcacctccttccagcggagtggaggtaggtatgacccatcccatcggagggtcattcggacagcagccattgcaaatctccgcccatttatgaagggatgacagggtgatctacgggagcagacgagtgaggacgcctggccacactgaagaacaagctgtgttttagcttccaagagaaggtgagccaagttttggtgaaaatagggtgggtccccacccaaaagaaaagtaggtagaagtggagcatgtgggatccccttgagttataaaaggaggaccttgcccaccgaagaaaaagagaaaaaggaggaagataactgagagaacacctaagctctctagctcttctgctctctgtaattccttcacactcagatccaccagaacacaggagtagggtattacgcttctcagcggcccgaacctgtctacgtcgctcgtgtcttgcgcatttgctctctcgcgaaccattccacagatcaagggcttggaacctcacttagcgcccccggtcgaatcggcaaaggggggcccgcgcggtctcccggtgaggagccccacgctccgtcacacacactagggcaatgagtataagatacgttcatgattgactctagtgcaagtgggagactgttagtgatatgccctagaggcaatcatagagatgattgtatcacatactatgtttacatatttatccgactttgttccttgaaatagataactcattattggttaatgaatatgcgattctttcatgagactctttatgttatgtgttgctatttctaaaggatccctgatcaaatatcatatgtggaacaaatatgtttagatgatcagcacatgtattaattgatgatcatgtctcatggatcatggtatatagataccaaattaataatgtggacacatgttggtgaacatgttagatagacccaacatgaggcactgcaagagccatatgtattgtgtcatcagtgatctcatttagtgttggtgttgaatccttagacctgagattgtcatggttcccaaaatatgtagtagcttacttaagaactactaaacgcaactccgtaattgggtagttataaaagtacttttcgggtatgctatgaaacatgtagtgggatatgaataatcaagatgggatttgcccctcctatggagagatatctctgggtctctcgatgttgtagattatggaagtgcatagccatgccaaaggtgactgaggagtcaatcacaagttatataatctatcaacaggttcgagtgaatgattgagctattagaggatggcacatatctagccttgagcttaattgatatcgtgaggcaaaggggttcatacaagtatacactagaggttcagccgatatgatctctatgtatgcccggtgggtcaatacgttctgctaggggccgctattgacgcgtggaccgaaaaggagttttcgggttacagccgagtgtacatgaacctacagggtcgcacgcttaataggccggaataaggagattgaatggaggtccaatataagcttaattcggatagggatctgaataggagtcctacgggccttggaggcccgagtgatggatcctatatattcgtgaggggtgtgaccggcggagggattgcatcacgtgagaaaccctagccatcacttccctccccgagcaaaaccctagccgcgcacgggtactagcacatctgcctgtggcgttccatccctgtacgtgtggataccggtagaggcgccactggtttgcggtgctgatcggcgggggagtacggcgaggagaacgcacgaggaggggaaggtcgagccggtgcgatcgactactttctctacatcgacgcgctctacttcgcgagaattccttcgacttcttagcaccttgtttcgctgcgcagcgcgtcgagtggtaacgatctatgatctaatacttgcatggttcctggtttacgcgatagaaaattttgatttatgctatcgtagcctacgtgtatcccaacagtggtatcagagcccccttgtatagtttatgatctagatcattgcatatagttgatatgcgggtgtagtagatgagatctattatgttgtatataagtttttaggtgatcggagcatgagatgaaccgatagctgcatgggttgatgagatcaatcggtaagtgtgttggtgacttcactggaatgtctagtactcaccaaggccgagcgtgattgtgttcatcggatagtccaatgtccactggaaccgcacgccaatgacaaaaaggagccaatgagattgacttggtttcggcataatttgattacgccgttaaggttttcacatggcgaatcatagatgagatctatgtaccctgtgaacttttcagggcgctgccctgaaacccggggacccgcgtgtgg

SEQ ID NO: 38454 - DNA, 1544 bp, Oryza sativa
  unsure (1)..(1544): unsure at all n locations
actgtaagaaattcctaaagcagctcaagcagaagcagcaggatggaaagagttccacctcaggtattaatgttatagaaattaatcatgctacttcctctactgattcttgggtatttgataccgggtcagttgctcacaaatgcaaatcattgcaggggctgaaaagaagtaggagcttagcaagaggcgaagtggacattcgcgtgggcaatagagcaagagttgttgttgttgcagtcagcactatgccattatctttaccgtcaggattagttttggagttaaataattgttattgcgttccagctttgtgtaagaacgttatctctgcttcttgtttgcaagcagagtgttatggatttagatctgtggacaatggttgttcagtctattataatgacattttctatttccatgcacccatgatgaatggcttatacattgtgaatcttgatggatgttcagtctataacattaatgcaaaaaggcaacgtcctaatgatttgaatcccacttttatttggcattgtcacttgggtcatataaatgagaaacgcatggagaagcttcatagagatggacttctacactcttttgattttgaatcatttgagacatgcgaatcttgtttacttggcaaaatgacaaaggcacctttcacgggtcaaagtgaaagggcaagtgaactattgggactagtatatactgatgtatgtggaccaatgagctcaaccgccagaggtggttttgggtactttattacctttaccgatgactttagtagatatggttatgtctacttaatgaggcataagtttgaatcgtttgaaaagttcaaggaattttagaatgaggttcaaaatcatttgggcaagacaatcaagtatctacgatctaatcatggtggagagtacttgagccttgaatttgccaatcatctaaaggagtgtggaattgttccacaactcactccgccaggaacacctcaatggaatggggtgtctgaacggaggaatcgtacattgttggacatggtgcgatcaatgatgagccaaactgatcttccgataagcttttggggttacgctctagagacagctgcgttcacactaaacagagttccatcaaaatcactgaataagacaccatatgagatatggacagggaagcgtcctagtttgtctttcctaaagatttggggctgtgaggtctatgtaaaacgtttgcaatcggacaaactcacacctaaatcagataaatacttctttgtggggtaccctaaggaaacgaaaggatattatttttataatcgggaagaggacaaagtgtttgtcgcccgacacgatgttttcttggaaaaagagtttatttcaacaaaggatagtgggatcatggtgcgacttgaagaaattcaggaaacaccgaaaaacgattcaacgtccacacaaccacaacaagnnnnnnnnnnnnnnnnnnnnnnnnnnnnnnnnnnnnnnnnnnnnnnnnnnnnnnnnnnnggatgctagtattcaatgccagcc

SEQ ID NO: 38455 - DNA, 678 bp, Oryza sativa
  unsure (1)..(678): unsure at all n locations
aaagctttaagatccttgacctctctcaaacctatcttgatggtccctttcttgaggcactaggaggaatgaggtccctccaagagctatattttttcgataacggtaacagagccacaatgacagtagacttgcaaaatctttgtgaattgacaacactgttacttgatggggggctatcatctgggaacataacggagcttgttgagaagttgccacgatgttatttaagcccattgaaatacttgagtttgcaaggcaacaacatgactggaatgttgccaaatgagatatctcacttaaagagcataagctttctcaatcttaaaaacaacagcattagtggacctatagcagtaggtatacagaatctgacttggttggattcattatttctcaattcaaacaaactaactgggcagataccagagctgccgagaagactccggaaattggatgtctccatgaacttcttgtcagggaatttgccataaaaatttggttctccatgtattaaagatctaatactgtcctgcaatcatattactgtttgcaagttgtaaaacttgtatatattggactagtaaaataatttaattgacggagaacttccccctctgttttagaatggggtaccaaggtcgaattcgacctgagttcacggttctcaatnngcca

SEQ ID NO: 38456 - DNA, 679 bp, Oryza sativa
  unsure (1)..(679): unsure at all n locations
atacttataacaacttttttggagaggtggcccacaaagaccatcattgccgtcatacagatgatggttttggtcatagaggctacaaagttgtgtccctgatggtactcttccagtaagattgttataagataggttcaaataacttaaatatgttaaatcagataggctttgtgggatttcaccatagaaattgttcttcgagaggtcgagtgattccaatgacttgatggccccaatcatgtatggaatttttccattcaaattgttccatgacaaattcaaatttataattccgtcaagagaaactatgccttcaggaattacaccagtcaaaaaatttgaagacaagtcaattgtcacaactgttactttttcttggttgtattgtagttcctgtcccttcatgttcacaaaagatttgtagtcacatccagatagtctctcttcatattttgtggtatcatggtttatcatcattcctgttaaatttgacaaatgctgaggcaggggacctgataaaccattgctggctagatccaaatgagaaagctttccaaggttggtgatgctgtcaggaatacttccagagaacatattgtgcttaagctgcagaaattctagcttggggtaccgagctcgaattcgacatgtagttataggatctcaatnnccctcn

SEQ ID NO: 38457 - DNA, 754 bp, Oryza sativa
  unsure (1)..(754): unsure at all n locations
cgcgtccnataggatgcactcggcacccncannggcccggttcttaccataaaaccagccattgtttggtgaagacaaatgctcatggattgtcctccttggtcctccccacccttgattgaattgtattggaggcatatgattgaacattggcggtgttgccccccatggcatgtagtaaggataagtataacccgacggcggcattggatatggaccccatgacatgttttgagaacaattatattgaggtgattccgaccgtcttggtgaatgaccaaattgctccctaggaggtgatcttggtcttttccctttgttgcgagctttctcaccaccttgtttctcgtacttccccaaaagcatatcaaaggtcactttggtcttcctaggggttttagaagttgaagcttcactattattttccttccaaacaccaacctccggtttctttggcactatcatctttggcctcggttcaccaatgacctctccttttcccttagtagattcggcttgctctggccgaatcaacaccttcttatcattgaaattaattgtattcatcggaaaaggatcatgatcaagcttcatcttggaaccatcgatgaacttcaatcgtccttcatctatggccgattgaacctgtcgtcgaaacacattgcaatcattagtagaatgagagtgagaatcatgccatttacactaagctcgacgtttcaattcttcttgagatggtacgatatggcctttn

SEQ ID NO: 38458 - DNA, 8001 bp, Oryza sativa
  unsure (1)..(8001): unsure at all n locations
ngtttgatctgtaggagcttggctagcactagtagaggctttatcttttaacataaaatcggccatgagagggccgaatttagttcttaaaaactcatcaaatcgaccttcaatagttgcgtctaacttatttttaaaaataaccatggatgaatctattgcagatgcatcttgttgttggatagattgtgttacctcttcattgcttaccaaatcaggagtgagcttaggacgtggcccaggcttgatgatcacgccttgacgagtcctagtgcacgcccttatcaacgcctcatgtgtgatctccttaatgtactcctccatggacttgcgatcttccccttcgaagtcatccaatgtgattggtatcacattggtcggctccacctccgccttggatgacgactgcttcgtcatggcaaagtcgaagttgagttgacattgaacggatctccccagtggagtcgccaaaaatcgtgttggcaacttttttgtgacaagttgacaagcacgatcgtagcaccttatgccttgcggtgatcctagagtcgccaaccaccttgatatagcaaagagctaaacctagatgggtttttacaaataaactggctagcggagccgattttagataactacccgtctcgtgggcaaaacggaaggttttcaggacaaacctacaaagagatgtcgcactctcgcagtggtggcgaacggtttacgacgcaaaccgacaaagatggacaaacctacaaagagatgtcgcactctcacagcggtggcggacggtttacggcgcaaaccgacaaagatggacaaactaagagaaaactaaaagcaatatgaaaaacgattcgattgattgattgtagattggttgttacaatagaaccggccatgtcccttatataggggttggtcttaccctttacaggccctcctccacatccaactcggggtagaaaccaaaggaaacctaaagcatgccttcccgagcaaggaaacctcgagacccgaggaaacacagtccgactcggacctgccggtcagaccggccacacactgccggtttgaccggccctcaaccggtggtcagaccggcccactcggaggaaaccggtagacttccaaatcttggcaatctttcctatattaatcctaggtgccaaatttgggtgtaaacgttatgtattgtgtcttacactttttttttgttatcgattgcaaatggacagaagttggatgtactatattcaccgttcgacactagagtatggggaagaggtcactgcattcctaaattttcctaaattttgcacataatgacaggaaaaataggttgagcaaatatatgttgtgtccatgtggactgtaagactaataaaatgttcgagaatagttcataggtgcattctcatttgatccttagaggattcatggagcactacagatgttggatgtcacatgctgatacatccatctcaaactaaaaacggaaaagtccattttacgccctcgaactcttatgcttgtccaaaatacaccctcgaactacaaaatcgaatataatacacccttgaactgttaatactgacacttaacccccctcccccgcccaagcctgtttttaccgtggtttatgacacgtcggctgctacgtcaaccctcgccacgtcggtgtggagatgcgagggcgacggtggtcggcaggtgctgcgagggcggcagttctaaggtcacgcctcgcctgattccgtacccatccattgtccgccggcctaaggttagagaaaacggggttgctcgcccatttggatgagctcgacacagagctcgtccccatgcccaaggtcgaagaaggttgccgtagcgacgatgcagcgcataggcgatggcgaaggcagacgaggtgggcggggctaaggtcgcggagggtggagctcgctgccacctgcgtttcctatccacctcaagctcatcggcatccgggccatctccaaccaccaagaccgcccaactacctatgccagggttatggatactacatacccaatactaatcgactaagcttggcagggcccaccacataccatgtcttatacgcaaataaacctagtatatagaaggagttttggataaggaaggaaaaatagagttctacatggaaacgacaaggactactcggattgtatccatattggtctccctagttttacttggacaagggggcatctatgggtataaatacaagccccctaggaggagagaggactagccacaagacatataaatcaacatagatcaatacaagccaacacatgccaagataagccgcaggatatcgatattagagataagtctagacaaaccaaatatggtgtctgcggaggccaacaagagggatctagcgctatctctgatttcgctgagtgcggattcgaggaggaagactaccctgtcgtccactttaagttggatatccataccgccaagttgacgatagctagataagttatcccaattattgtattggtgcgattgtgatgaataagagcaacaccggcttcagccaacaggaatagggctattacctgtcagataagaggcccgaacctgtataaaaatccttttctccatctcttttacctcaatctcgcatataccctgctaccaacaatccccatactatgcaaaataccgtagtcgtcatatgaaacgtcgacagtggcgcgccaggtagggggattttggtgcttaaaggtttcgacgagatgggtataagagatggattctccaacaacaagctactcgacgacttcggctgtgggtagatccaacccgaccggagtatgtcttttgacgagatcggaaccatcgtcatcaacaatttgatctatcgagatcgtccaagcctctacaaaggtacgcaatgatgtcaaactagtacgcaacaagataattggtagattggttttgaaattaatctactaatttcatagatacatccggcatgtatctacaaaggtacgcaatattctatatgtgatttatcatagctattcttcagatcaatacaatattgtcagatcaataatttattatgtctacctagagcatattttttatacaacatctattgcacgagtgtttccgatgttaggccaactacggtttaatgctgggggctcactctattttcttatgtctaaatcatgcttgtttacggtttacataatgtctgatatgtaatctactcattatatcctaataatactagaagatttatgcaattttttcagtacatagtcgatattctctgctatatatcttgtcttcttgacaatatttttcaggaacaattgaacacttgagtaggatatggtcgagtacaccatattatcgagaacgttctcaaaaaatgctgagttgtcgcacccaaccttccaacgtagaccgacgacttatctcatgtatagcaccggctccggctggactatttgagaaaaggttgttaacagataattcctcgcgaacgttgtcggcttgatcacccaacatgattgcgaacagagatcgggatatgctataagttgggtatgtgagtcatgttggccacataagatgcacatgtaataaccaactctagcacccctataggtgattaagagatgcctattcctagttatcaactagactgttgtagcgacatttcgccttctatcaatttaaatttacttgtggaccattgaactccatatattgttgtcaaagactctacgtctctatggtcttacaccgggatcgaccaagtgagtacagcaaatattgataaggggagtcgtggataacataagatgctttcgtgaatactgtttgtttccgtatgcctatctgcctataggtgatcgagatacgcctacacctggttctagaccagtagatcgtagtgatctctcatcatctaaaaattcatcttcaggtgatcgagatacgcctacacctggtcctcgaccagtagatcgtagcgatctctcaccacctaaaaattcatcttcaggtgatcgagatagacctacacctggtcctcgaccagtagatagtagcaatctctcaccacctaaaaattcatcttcaggtgatcgagatacgcctactccctgtccttgaccagtcggttacaggaatctctcgacatctaatgcgacaatcaacatcatcgtaatagcaacaatcaagaccgactggatcgtcgttttcactaggacgacattgtctaggactaatgacataaggacgacaacggacaaggttaacgacatcacgacatcacatgacgacgaagaaactcgagatccccagacttttagagggcccgaagacaaggtagtaggtccaggagtcgaacctctgactacgataattcctaattgtcttcattgtcatcaggaggcagttctcgcaggtcacgagaatgtcgtccatctattacgctggattcccttcaaatggtcgagatatgactacgactggtcttcgactagcaatgtagcaatcatcgaggatcatcgcaccacgacttctaatggtcaagatatgactacaattggtcttcaaccagcaacgtagcaatcctctgtcgcgcccggaaaaattccttttccagaacgctagtgtattaatccccgtcctaggaaaagccgaggtacaccaaacaaacatgatacaaaaggcacatctttattatatcaataatatttacattattacaaaggcacttcaggcctgacaaacaaaaataaacaacagcggactagcgggcctacggctccatcttcacaggcgctcaacaggggtataagccaggactccacctaggacttcttcttcaaagcttctcttactgaaggggggagagatagagcaagaatgagtataaccacagtactcagcaagtcacactgggagatgcatgaataatgcaagggggtacaaggggtaataatatagggttaggttttgcagtaaacagcatttaaaagtcacttagttgcccaaagctattttataaacacgatcctatagctacacaatattattaatcaaggccgtgaaccctggcaacccgaactgggtcccagctcatcccaagccaacctaggccaactattacacattttagttgttaagtaagttttaagaattaaaccactaacttgggtacattgctaggcttgcccataaccgagggcgtggctattcgaatagatttactctgatcagaggtgtacatctttacccacaagacacatctttactccgcattctatggccttggaacccgtcataaacatgtgacataacccttcacccatccgagctgtgaacaaaagtaccgacctatcccagcctacggccggtattctggacaggcaggccaggattgagcccctagcaataggatcaagaccgggtgcgccacacacataggggtgagaccacccgcgtactagtccagtgccatggcatctcgactaacgggcaccgtcccgtgtagccttcatttgcctagacatctcgattaccgagccacagctcatgtagccttcatttgcctcagagatatccaccgtcgcaacgatttcatccacctctatccgtgtccttttgttcaggactagactgagcaccgagttaagccttacccattagacatgtggttagtacggtagtgctttgcaatagaggcccgaagactggtccttatagtggccgagatgctactagcaaaaccatgcacctcgagcccagcctaaaaccattttgggagttttgaatagaggggggaggtgtatgttcaattccatcacaagccaatgtcgacccccgatattgtaaatcggaaatcttctgtgtttatcagtaccaatccctggatcagtagttggtacacacatacatagccgaatcacaacatatcacaaatgaattcaggctaagagagttaaatgcttacattagggccaggcaggccgacaactatcagagaacaacagcggaagacaaaataatacaagggcccggttgatgtcgcgaccgagaaaattgccttttcccgaacgctagtgtattaatccccgtcccaggaaaagccggggtacaccacacaaacatgatataaaaggcacatctttattatatcgataatatttacattattacaaaggcacttaatgcctggcaataaaaaataaacagcagcggactagcgggcctacggctccatcttcacaggcgctcaactggggtataagccaggactccacctaagacatcttctccaaagcttctcttactgaagaggggaaagattgagcaagaatgagtacaaccacagtactcagcaagccacaccggagatgcataattaatgcaagagagtacaaggggataataatataggggttaagttttgcagaaaacagcatttaaaagtcacttagttgcccaaagccattttataaagacgatcctagagctacacagcattattaatcaaggtcgtgaacccacacgagcctgccttagcccaaggcctacgatgattcagaccgaactagcaacccgaccctgggtcccagctcgtcccaagccaacccaggccaaccattccacattttagttgttaagcaaattttaagaattaaaacactgacttgggtacattgctcggcttgcccataaccgagggcgcggctattcgaatagattatactctgatcagaggtgtacatctttacccacaagacacatcttcctcacgtgtaaacacgtgccacataccaccacggtatacggacggaagacgtgacatagttcccaacccatcctagccataaacaagattaccgacccaaccccacctacggccggaacccccgagacaggtaggcaggactgagcccccagcagtaggacaccggccctgtgccatgacatctcgactaccgggccgcagttcgtgtagccttcatttgtcctaaagatgtccatcgatccccgacttcgtccatctccatccgtgtacttttgtttataaccagactgagccacaaactaagccttacccactagacatgtggaagtacggtagtgctttgcaacagaggcccgagcttagtccttatagtggccggggtgctacttcccacaactggcatgcacccaaacccaaccgaaaaacaggttttaggggctttgaaagaggaagataggggtatgtccaattccaccataagccaaccattccatagtatccaagagatatgaatattcccaaagtctaaagttataaaaaccacctaatgttgtccttttaaccagcgaagcatctacctaaagtcatactagtggtaccatgagtagagtgtccactagttggggttttgtttaatctagggtgaacaaggtaataataacaataacaataataataaggtcataacaaaggtaaataggcatggctagataaaacagtgataacgcgggaatttaaataaagcgataatgcaataatttaaagcaacataattttataagctgggattcaatatgttcaaggatgatgtgacttgccttgctcgcttttccaaacgtcggcttcaacttccacgaagagcggatcttccgaagctgcagcgtctacacaaccaacggaaaagaaaaggcttttactctaataaactccatataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaannnnnnnnnnnnnnnnnnnnnnnnnnnnnnnnnnnnnnnnnnnnnnnnnnnnnnnnnnnnnnnnnnnnnagcagcaattcaatgngcacat

SEQ ID NO: 38459 - DNA, 712 bp, Oryza sativa
  unsure (1)..(712): unsure at all n locations
cgcggccatgattgaccgccagctctnnnnnnnnnnnnnnnnnnnnnnnnnnnnnnnnnnnnnnnnnnnnnnnnnnnnnnnnnnnnnncctcactgcattacagcaatggcgcatgctaagagcaatggatatcaagccagtgatgccaccagctcgctcgacgctctgagagagctctacggcaacaccttcgccgtcgtcaagtccatggctctcaaggccgccatggacctcggcatcgccgacgccatccaccaccacggcggcgccgccactctgtcccagatagtcaccagggtcgcgctccacccgtccaaggttccatgcctgcgtcgcctcatgcgcgtgctcactctctccggcgtcttcgccgtccagaagctggcgcccggcgatgccgcagcccctgccgacgaggccgaggcggccgtctacgcgctcacgccggtgtcccgcctcctcatcggcgccgggaaccagggacacatgatgtccatgctgctccacccgaacttcatcacccccttcttccggatcagcgactggctccagcgcgagctgcctggcccgtgcatcttcaagcacacccatggccggagcttgtgggagatggccgacgacgacgccgcgttcaacacggtcgtcaacgacgggatggcgtcggacagtatcttcacgatggacatcctggtcagggagcatggcgaggtg

SEQ ID NO: 38460 - DNA, 676 bp, Oryza sativa
  unsure (1)..(676): unsure at all n locations
gagccattgaaacctgtaacacatgtcganatccatctcggtacccagtttggactttagttgaaccaccttctggacataatattattggaaccaagtgggttttcaaaaataaacaaaatgaggatggtttgattgtgagaaataaagctagacttgttgctcaaggttttactcaggtggagggtttggattttgatgaaacttttgctcctattgctagaattgaggcaattagacttttgttggctcttgctgcttcaaaaggttttaaattgtatcaaatggatgttaaaagtgcttttctaaattgttttatacaggaggaagtttatgccaaagaaccaccaggttttaaaaatcctgattttcccaaccatgtttttaaattgtctaaagctttgtatggtttgaaacaagctcctagggcatggtatgataggcttaagaactttttgcttgcgaaaggttttataatgggaaaggttgacaaaacgctttttgttcttaagcatggtgataatcaactgttcgtttagatttatgtggatgatatcatcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 38461 - DNA, 680 bp, Oryza sativa
  unsure (1)..(680): unsure at all n locations
tgggnnattgagnaccgtgaactatcgattgaattagagctaagtacccgtttctctaactgacacgcatgacagaaactatgatctatcttagtacatggaagaatagctaatttgtggagactctaaatagcagctgaactgggatgaccaagacgacgatgccacagggtagaggattgggccaggaagctgtgggcagcaatagtaggtgcagcagtaggtagagtgtagaggtcaccacgactattgcagcgaagaatcatgcgccgggtacggaggcccttaacagaaaaaccaaactcatcaaactcaatggaacagttattgtcacgagtgaattgacgaacggaaagtagattgcgaaccaaagagggggcgacaaggatgtttttaagatcaaatttagtggttcctataggtagaaaagaagtgccacgacaaataacaggaatagtatgagcattgccaacggtaatgaaggtatgggaattgggaagacgagtaacgagaataccgtcggtagaggacatgtgtgaagtggcttctgtgtcaagcacccaaggacttggactttgcacggacaactgattgagggcagcaatcagacctgcctgatcccaattgggctgagattgctgtattggtggcaagcccggcattggtggagagacatatgg

SEQ ID NO: 38462 - DNA, 675 bp, Oryza sativa
  unsure (1)..(675): unsure at all n locations
tgggncattgaaaacgtgagatacggtcgaattcgagctcggtacccccgatagtccaactgctagagatagagatattagtgtacaccacgctgacatgtcaacgtgttgtgccacgttagttaaagtggcagaaaaaaatttaagaaatagtcttatctctcccgtctgctaaatatgtaacaacaaatccaaaagtgttatttgaagagtggcacagtttggtattgtaataaatactgtagttaagccccccacagtagctctaataaaaaggcagccagtatatatactggatatagctggtcgtcgtctttgcattgtctccttgtccggtacgttggttggctctagcttagctggtgctcgatcgcgaacatcatgtggaggctgaaggtggcccagggcggcggcgctttgttgcggtcgacgaacggcttcgccgggcgagcggtgtgggagttcgaccccgaccacggcacgccggaggaccgagccaacgtcgagagggtgcgccgcgacttcaccgaccaccgcctccgccgcccggagtccgccgatctcctcatgcgcatgcaggtatgtgttgtgtgctcctccggcttgataataattgtcgctttggagaaggacacggtcatctacagaaaacaattttgaccaaataattcgcan

SEQ ID NO: 38463 - DNA, 10399 bp, Oryza sativa
  unsure (1)..(10399): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaaccattaacaagtaatcctaatgtgggagggtttggtcagggggatgcagaaatagtgcttcaggatccattacgcgttcaaggccttttgttcttcttcgcatccgttattttggcacaagtttttttggttctcaaaaagaaacagtttgaaaaggttcaattgtacgaaatgaatttctaggtcccgggatttcttaccatcaagttggtaaaaagccgcgatttattggcgattgctagaattctctatgatccattttggaaatcttttttttgtttagactattttttgtttgcgagatgtcttgtctgcaattccttatttctatcatctcatgcaaaacgaggagaatgcaaggcaagggcgagaacaataaaaggaacaaatccttttaggagggattgctggtcttcttaatcctctattgggcacaagaaaaaggcttttttgcctttttcttgtgtcgattcttcttgtatcgaaatatgaatcttttttcttcctattcggcaaagattactatttcttctttatttgggtctgtctcttgaacctcttttgcttaggttcaggcgatgtagtggacaaaaagagggaaagaaaatatggcgtgggacaaattttttgtgaccaaatagaattgcttgacttgttcaattaagttcaatttagaacttacagaaattttgcaaaaaaaacggatactcttccattgaaggctgttttttatttttaggctagttgagtagttttaattaaggttttattagtttattactctaaattaaatcaatgatttacaagagacttcctccggggaataaaatattggatcctcgattgatcctttctttctcctcgcttcataaaagtgaattaatttcattggcgagggggttataaatcaactgatggattacttcactaacattattaacaaacaaaattaacaaacaaaacgaataaatagagggattctgaccatcagagcaaaggctttctctttgttatttttacaaatcaaaataggaaacccgtttgtaggttatggaatagattaaaaaagtcgggttataagagtaagaattccgcgggtcctttccgctctaatcagataaaagggggtaaggacccgctaagttcctattttttcatgtttacaacctggtccctccaattactatagagatgaacccaatccagaatatgaaccgtaaaagaaaacacctattaaaccaatcacagcaataccggttacagtacctatcagccaaagaggaattcttccagtagtatcggccatttcccctactttcctccacattttatcaagtggtcatgctagagacaaaaacagtcatggatagttataaggatggtatccttccaaatggggataagagaattcttactactctctttctttctctcaattgaagaagtaattggaaaataaaacagcaagtacaaaaatgagtaataaaccccagtatagactggtacgattcaattcaacattttgttcattcgggtttgattgtgtcatagttctatagttggaatttggtttatcgttggatgaactgcattgctgatattgatcccaagaaaaaaacagtaggtacagctagtccgtgaacagccagccatcgcactgtgaaaataggataggttcgatctatggtcattgagggcctcctaaaaggatctactaaattcatcgagttgttctaaagaatcaaaacggtcggttattaacggaattccttgtcggctttctgtgaaatactcgtttggccgaggacttccaaacacgtcataagctaaacccgtactgacaaataaccaacccgcaatgaatagggaaggatagtaatgctatgaataacccagtatcgaatactggtaataatatcagcaaaagacgttctcccgtgcttccagacatgctgagctccccaaatttttgtacattcaaaaaaggaattgattccgtaaaagatgggatcaaccagtaaatagaaaattactgatatttcatccttgtgagattgtcaattttgtaccaaaggtgtattttgagtataccaaattagtatagctatccttcctatggcacagcaatcctgtttcgcttggtctcgaaacagaattctttttttctcttctttgttccttgtctatagggtaagctatatggtattcaaggcatcaatagaaaacctcaattttgagggtcctacttaattttcaccggcttcggaatagtagaataattcggaatagggctcaagatcttgggaaaatctaagttaatgatcaacaggtttggataaagaatttaggaaagatattcttatactgacacaatacaaagagaagtagatgcgaaagctatcccttcgaatccaacctttccccttaaagaatttaattggttagcataatataatatctaataaatagaaaatcaaatagtagataatctgttatgaaagagagaaaacattctttgaagaatcaagattcgtaatcaacccttgccttgtttactaactttcttgaccaaactgcaagcgtggaactttgccagttcttaggtttccgaaatagtgtaatggaaaaagaagtgcttcgaatcgactttgattggggttcgaaaaaggaattaaaaaaaagtaaattcaggaaagatttcctttttttaggagaccctcgaggggtcgtggaatgcttttcttctcctcttattccatatggaatacaatcaattaaaataagaaggaataggggaatattcgactgttcgctccaaaaagaaggttaaatcatcctattgaaaaagaccaaaatagaaagaactttttcaaattcaattctttatttttcactggggttagctgatctagttcttaatatttttactttactcaattgacagattacacagcaaatctcttgattcggaattagggactcatgccccatctgatgaatccattttcttttacacttctgtatctcactctatcttgttttttagtattatctaaaataaccgatgaattatgaattttccataacttaggtaagtgctttaccaacatatgtagtgtagtaaaaaaaatggaatttaaccctttcatgcttactataactagttatttcggttttctattggctgctttaactctaaccctagctctatttattggcttgaacaagatacgtcttatttgaaatgaattgaatgaataaggcagaaaagaaaaaatctctcttttggattcctggtattctacgcactaattaccaattctttttttcttggtcattgagattcgtggataatttagactactatttagggataaatcgtacctcttttttttatcccctcgaacaaatcgaaatgattgaagtttttctatttggaatcgtcttaggcctaattcctattactttagcgggattattcgtgactgcgtatttgcaatacagacgtggggatcagttggatctttgattgagtaatatttcttttttgattgccctcctctctggtctggaggaggtcaaattggaattgcaatttgttttgttaagttattttgccctgcttcgacataagatagatggaatcacgctctgtaggatttgaacctacgacatcgggttttggagacccgcgttctaccgaactgaactaagagcgctttcaaaaatcaaatccttttctactcctaatgtgtctcacgtacgtatagtatccacaaattcaagttatacccgctttaatcgacctcctcactactgcctataaagaagaaagaagtaataggtagggatgacaggatttgaacctgtgacattttgtacccaaaacaaacgcgctaccaagctgcgctacatcccttttccaaattgttgtacaatgtcattgtacacaattcctatcttgttttccacatcctaattttcttgtctttttctatctatagagaatcctcgtgtcatttcttctttttggtctcatataatcaaggaatggtatatatctaaatccaatctaatttcacctataaaagaaagattactattccttggtaatctataggaagggattgtctttttcgtttttagttcggaatttcgcctaaacaaaagaaatacaaatgatcttgggcaataatatctgatcatatacgtattccaataaggaaggaggattttcaatgcgggatataaaaacatatctctctgtagcacccgtgctaagtactctatggtttggggctttagcaggtttattgatagaaattaatcgtttatttccagatgctttgtcattcccctttttttcattctagttgttgctatgtgaggaatagagttcttcgtgacatgataaaaaattcccacttttcaatccctttttagtataggaaagaaaaagaaagaaaagatagattgggttggaccttagagtcatgaaaaatttggtaaatctcatttttgaaaaaagaaattcaattaaaagcagtatccaagctaagtcaggcctcagaaatcagagcatagaaagaggctgggttggctactaaaatgaaaggattttgcttcaaaatccttgctaatttgacaaggattgtattccttaattatttctctattttttattacttaattgaaaaatttccaaaaatttttattctaatggattttcttcttcctcttcggtttcaaaatagaggaataaaagaataagtagaagaattaagttaagtcaatccaaaaaggaaaggaggttcatggccaaggggaaagatgttagaatcagagttattttgcaatgtgtgagttgtgttcgaaaaggggccaatgaggagtcggcagggatttctagatatagtactcaaaagaatcgccacaatacacccggacaattagaattaagaaaattttgtcgttattgtcgtaagcatacgattcatgccgaaataaagaaataggagcatcttgtgttcgatctttccaaagatcaaaaagaataagaacttcctatttaatatatagagcatagatagaatacaaaatacaaatcaacttgtctgatttccattagatattatttcatatgtatcgagggtattcatctaatatatggaccaaagagagactatttcttctggatccaaaattaataaaataaacaaatctatttttttttcaattttaaaataaggaataaatcatgtatacatctaaacaaccctttcataaatccaaacaaacttttcataaatccaagcaaacttttcgtaaatccaagcaaacttttcgtaaattcaaacaaccttttcgcaaacccaaacaaccttttcgtaggcgtcctcggattggcccgggggatcgaattgattatagaaacatgagtttaattaatcgatttattagtgaacaaggaaaaatattatcgagacgaataaatagattaaccttgaaacaacaacgattaattactcttgctataaaacaggctcgtattttatctttcttaccatttcgtaactatgagaatgagaaacaatttcaagcccagtcaatttcaataattacaggtcctagacccagaaaaaatagacatattcctccattaacacaaaagttcaattccaatcgaaacttaagaaactccaaccagactttaagaaacaacaatcggaacttaagttccgattgttgatgttttattcgaaagggccagactatatataaagaaagtaatccaatttagattcttgggtttgttataagaaagaacaatggggaagaaaaaatagtttttttatttattgcaacatgctcgttgattcctaccacttaatcttaatttattgtatcttcccggagttacctctccgggaattcttttttaattattcctgtatattacttttttatccctttaattgataatctttattttattggaaatcgtgtaaagattatttgaatttaatacagctacttgtgcaaggattttacgattaagaatcaattctttcttgtaaagattgtgtattaatttactataattatcgaatactttatgtatccgcgttgctgcgtttatccgactgatccacaaacgccgaaaatccctcttttgcctgactctatctcgatgagaggaaacaaacgctcttcttacctgttgagtaatcattcgattaagtcttaaatgagcccctctaaagtttgaggcaaatgaacgcatttttgcccgtcgtctccgagctatatatcctcgcggaactctggtcattgaatcaaattaaccttaatgaataactaatgatttctcttcttttagccatcctttttcccattaataacaaaacgaattattcccatatataaaatattagttccaatggcttttgctactataaccttcccaaccacaattttctcttctactcccttcagttatttcgcacgatactaaaaaatagtgggttccatcgtttctatggttcccttttaaacggcgaggccctctctatacaccggagccctttctttcatttcatcaaagggtattgtgaacttgtatagttcacattctttggctctacctatccattatagagtaaatagctcttttcacaataagagttatccatacagtgacggcatttaattatgaaagttggctaagtagctgaccctcttagtccgtttttttaagataaaggagcataagcctttatctttttattactatttcctccgcttaatgaatagccgtttgctaccaatgggggaattgcttcttatttccaatctagatgattggatttgcaccaaaggaaaccagaaattccatataccgtagaaatctaggatagagaagctctatcctattcattggtaccgatcatggatacttcaaaaattgtcttatttgtttgaacccatgatccgaacgagtcgcacatacaccctagcacatgttcctcgacgctgaggacatcccttaagcgcggccgattttctagcatttcgtattggctgtcttgcgtttctaataagttgtttaaccgttggcatgtcgtatgtatatagaaaaaatggattggtttagatcgatcttaacctgaatgattgatcattatgaagtatttccattaaattgcataaaacccgaatttagggttgaaataaatttacaagaaatctggccactaccaatccttaaacatttctggaaaccacactggatcagtatcgcagtgctcgtcaagcatttcatcccctacaatatcgacaagtccataagctttggcttcgtctgctgacataaaaacatccctttccatgtcttcggatacaacccaaaaaggcttgcctgttcttagtgcataaacccttgtgatcatttcgcgaactttgtgtaactcttccacttctagtaaaaattctggtgttcttgcccgataataagcactagcaggttggtgaagcataatcctcgcgtgggggaatgctatacgcttggtgggttctcctccaagcagaatgaaggacgccatggacgcggctattccgaggcatattgtatatatatctggtgtcaccgtttgcatcgtatcaaaaatcgccattcctgagattaaccacccgccgggggagtttataaacaaaaaaatatcgctaattccatcttctatactgagatataccatgagacctgtaatatgattcgtgacctcgcaacgaatctcttgacctaaaaaaagtgtcctttctcgatacataacattgtataagtcaacccaagtcgcttcttcatctccgggaatccggtaaggtacttttggaacaccaatgggcatattagattaatattattaaatttaagtaagaaaactacactttaatatggaaacgtaagaatggaagagaaagaaagaatccgcagtttattgttttcactttttttcttattctatatgaatactatagattctattaatacgtagattgaaataatacatagattgaaagattatacatataagtaggataagacagattgaataaagaaaaaagaatgggtgattcgaatactaaacaaaaagagatagggatctattcttcgttttttccaaataagccaagctgcccattgcatattggcacttatcgagtatagaatagatctgcttctctttcttcttacgaacagaattggcttcttatttttaatggaatgaaataaatattcacgctttctgacacagaatcccctagaagggttaggtacataggatatggatagtctttgccaatgcgataaaataaagtgacatcgtgtctatttttctttgctaaaggggtatttccatgggtttgccttggtatcgtgttcatactgtcgtattgaatgatccgggtcgattgctttcggtgcatataatgcacacagctctagtttccggttgggctggctcgatggctttatacgaattagcggtttttgatccctctgatcctgttctggatccaatgtggagacaaggtatgttcgtcattcctttcatgactcgtttaggaataaccaattcgtggggtggttggagtatttcaggaggaactgtaacgaatccgggtatttggagttatgaaggcgtggcaggggcgcatattgtgttttctggcttgtgtttcttggcagctatctggcattgggtatattgggacctcgaaatattctgtgatgagcggacgggaaaaccttctttggatttgcccaagatctttggaattcatttatttcttgcaggggtggcttgctttggctttggcgcatttcatgtaacgggtttgtatggtcctgggatatgggtgtctgatccttatggactaactggaaaagtacaagctgtaaatccggcgtggggtgcagaaggttttgatccttttgttccggggggaatagcttctcatcatattgctgcgggtacattgggcatattagcgggcctattccatcttagtgtccgtccacctcaacgtctatacaaaggattacgtatgggcaatattgaaactgtactttccagtagtatcgctgctgttttttttgcagctttcgtagttgccggaactatgtggtatgggtcagcaactaccccaattgaattgtttgggcctactcgttatcagtgggatcagggatactttcagcaagaaatatatcgaagagttagtgatgggttagccgaaaatctcagtttatcagaagcttggtctaaaattcccgaaaaattagccttttatgattatattggtaataatccggcaaaggggggattattcagagcaggctcaatggacaatggggatggaatagctgttggatggttaggacatcctatctttagagataaagaagggcgcgaactttttgtacgccgtatgcctactttttttgaaacatttccggttgttttggtagatgaagagggaattgtgagagcggacgttccttttagaagagcagaatccaaatatagtgttgaacaagtaggcgtaacggtggagttctatggtggcgaacttaatggagtaagttattctgatcctgctactgtaaaaaaatatgcgaggcgttcccaattaggggaaatttttgaattagatcgggctactttgaaatcagatggtgtttttcgcagcagtccaaggggttggttcacttttggtcatgctacctttgctttgctcttctttttcggacacatttggcatggggctagaaccttgttccgagatgtttttgctggtattgatccagacttggatgctcaagtggaatttggaacattccaaaaagtcggagatccaactacgaggagacagccagtctgaggccgcattgctttggtatctttcacctctcttttttgatttgacatgggaaacatctcccatcccttctttgactctttttccttttttatacgggaaatgatcccaaatgacaaatgaataggtgtggaagttataattgtaaataaaccacgatcgaatctatggaagcattggtttata

SEQ ID NO: 38464 - DNA, 17948 bp, Oryza sativa
aaatttcttccttccaattttgtttgcccaaaaaacaactttttttctctcgattttgtcgagtcattacaccgattcaataaatgatcatcaagcggttcttattcgaagaacccttgccttttgtttagcttgagactcaatcatcgtggctctagtatgaatctaaggttttaattgaactgattcataggatcgcaacaagataatttctaccagaaaactactccaatttttgctttatttatttatctagtaaaacaagagtaaatctgcattacgcacaaaaaaaagaaatccaaaatagggaagagaaaaatcaagaggcctctaatgatcaacatttgggaaagaaagatagacgagccaacttgagattttttggcattatcatcacaaagaagaaattctggatttttcttatttcatatcttcaaggcaaatcgacccaacccagtggctgatgaagttttgaaccttttttctaatatccgttgaaaatttgtgtgtttctgtttgagccgtacgagatgaaattctcatatacggttctcggaggggggttcgggttagttacctatctcaataaagtatatgattggtttgaggaacgtcttgagattcaggcaattgcagatgatataactagtaaatatgttcctcctcatgtcaacatattttattgtttagggggaattacacttacttgttttctagtacaagttgctaccggttttgctatgactttttactatcgcccaaccgttacagaggctttttcctcggttcaatacataatgaccgaggccaactttggttggttaatccgatcagttcatcgatggtcagcaagtatgatggttctaatgatgatcctgcacgtatttcgtgtgtatctcacaggtgggtttaaaaaaccccgcgaattaacttgggtcactggtgtggttttagctgtattaactgcatcgtttggtgtaactggttattctttaccttgggatcaaattggttattgggcagtcaaaattgtgacaggtgtgcctgacgcgattccggtaataggatcacctttagtggagttattacgtggaagtgctagtgtgggtcaatccactttgactcgtttttatagtttacatacctttgtacttcctctgcttactgccgtatttatgttaatgcactttctaatgatacgtaagcaaggtatttcgggccctttataaggaaggcatctcatagagagttctaattctcatatatcatatcgggtaggttgtggtatttcattgctacaaacatgggttattctaaaataagacatgtcatttagatacttctcttcaactccgaactattgtgatacaaataatacaaatagttgaagttaattttacgaaagaaaagaaggcggattatgggagtgtgcgacttgaattattgatttggccatgcagatagagagttggatctgccacattagaattcacgaccaaaggtgtctccatatccaatcaacacgtaagtcccctgtctagtaaggataggctggttcacttgaggagaatattttctatgatcatacctcaaccatgtcatccatgaagaggctccgtaagatcccatagagtagaaatggaataagtcatgtgacatgatccaattctctatttattacacttactttttattatagtatggaaatgcattcattttctttgcatcgattgcgatctgcaatactatcggagtaaaagaagggatctaaggaagaacgtaggctaaactttttgattttttattagtaacaagtaaatactttgtttggacgtaagaaacttgcaatattgggggggataaataccaactaatcaagagacgcgagacaatccacaaagcaattgatcatgatcaaatttgtaagcccacttggatattgagcatttacccataagagtaggattcttttcaatgaatagttgtaggtgcaacttcggaaaatagaatctgataaagcttttcttacttagagccattgagccattatataccttattctattatggatcttctacggttttatttctttcattcttgctcgagccggatgatgaaaaattctcatgtccggttcctttgggggctggatcttaaagaattcacctatcccaataacaaagaaacctgacttaaacgatcctgtattaagagcaaaattagctaaagggatgggacataattattacggggaacccgcgtggcccaacgatcttttatatatttttccagtagtaattctaggtactattgcatgtaatgtaggtttagcggttctcgagccgtcaatgattggtgaaccggcggatccgtttgcaactcctctggaaatattacccgagtggtacttctttcccgtgtttcaaatactccgtacagtacctaataagttattgggcgttctcttaatggtttctgtgccgacgggcttattgacagtaccttttctagagaatgtcaataaattccaaaatccatttcgtcgcccagtagctacaaccgtttttttaatcggtactgcagtagctctttggttaggtattggagcaacattacccattgaaaaatccttaactttaggtcttttttagggatttttcagtttgattcattcaatcgtgaagtaccgtgcataggtatctaggaaatagttacttccaagtgaatcttccctagatacctataatctattttattatgatccatttcgcgaaaatatagattgtcccaaagatgcaaaattgttttattttttctttttattctaactcgaaaaagaagaagaggaaaaaattgcaatggatttaaaactagaacttattcttaggtaaatccattgggagatgcttctctagagtgtcccatatctgttttccatcttgcatacgaaaactgtcaattctcatcagatcttcttccgtcttactcaaaaggtccaatagtgtatggatattggcccttttgagacaattatacgttctagaaggcagttctaattgatcaataaaaatacaattcaatggaattctttttttgtttttctttagattagttaatcttttttgaaagcttaaaaggggggaagtaaacctgtttttattttcttggaaacgagtaccctcttcctccgtgtgaagaaaaggaagaaataaatcaatcaaattacgagaagcctcataaagcgcttccttaggggttaaacttccattggtccatatttctagaaaaagtatctcatattttgcatttccattcccacaagcaaatactataattcacatttcgaacaggcatggatacagcatctataggataacttccatcttgagtgtctttctgacttccgtgtgatatccgcgatctctcttgatccgtaactcaatacggaaatccgtgggttctgtcaagttagctataggttgtgccgtatcaacgatttctacggaaggcggtaagataatatcttgggcagttatgtatctaggacctttgacgcaaattgatgcggttctaactccatagagattacttctcaatacaatttctttcaaatttagtaaaatttcttgtaccgattcttcaatacctgctattgtagaatattcgtgcggcacgctcccaaattttgcatgtgtgatacatgttccttctgtttctccaagtaaagctcttcgcaaggcaataccaacggtatccgcttgaccttttctaagcggggacagaatgaaacgaccataataaagacgcttactatctactcttgattcaacacacttccactgtagtgtttgagtggatcctgctacctcctctcgaaccatatagactagtattattatttgatcattgaatcgtttatttctcttgaaaggggtttaattcttttacagacgtctttttttaggaggtcgacacccattatgcggcataggtgttacatcgcgtatacaacttaatcgtacaccacttttagcaatggctcgtaatgcggcatctcttccactaccagcaccctttaccataacttctgctcgttgcaaacccactgtacgaatagcatctacagctgttctttgaccagcatagggtgatgcttttcttgagcttttgaatccacaagtacccgcggaggaccagaaaaccacccgaccttgcggatctgtaacagttataatagtattgttgaaactagcttgaacatgaataactccttttgttattctacgtgcactcttccgtaaactaaaacgcgcattcctacgcaaaccaatacgtactttcctacgtgaaccaatttttggtatagcttttgtcatattttattatctcataaatatgagttagaaataacaaaaagaaaaaaagatacaaagatatccgtttcagggtaaaatatatcctttacttgaatttttttatttggaatttggacattttcgcgggtacttttttttttactttttagaaagtcaagttcttttttcgaaagattacccctgtctttgtttatgcttcggattggaacaaatgactctaattcgtccacgcctacgaatcagtcgacattttgtacaaattttacgaacagaagctcttattttcatatttccgtattcctttcttaaactatgaatttactcttttggaaaaaataagtctctttgtttgaattttagaactttgaattttttaccctagaaaaaaaaaagaaaaacctaaccctttgaatctttggtatccttcaaatcttcggtatccttcgagtcttcggtacgcttcgaatccttatggggaagtctataaattatacgccccttgcttgaatcataacgacttacttcaattttgaccctatcccccatcagtattcgtatagaactagaccggatctttcctgaaatatagcccaggatgatggtgtcattctctaggcgaacgcggaacattccgttgggtagggcttccataactaaaccctcgaaagtaatttttgcttctctcgggttttttttttctctcctatttttcttttctgtcatatttttttttctcctatttttctttttttattttcaaataaaaaaacgttgtatttttgtttgaaaaataggaagttcaagatagaatttgggtactataactataggtggggcgattaccgctataggcggggcgattaccatatataacataagacttctcccccaattctgtttagtcgagcttctcgatctgtcattatacctcgagaagtagaaagaatagcaattcccattccgcccaaaaccttaggaattccttgatagttggcataaattcgtaagccaggtcggctgatacgctttaaaaaggttctagttctatatattccctttctagtctttctcttttgatgtcgcaaagttgaaaccaagaaatatctgttactttcctgatgtttccgaacactttcaataaaaccctctcgtagaagtattttaacaatgttttcggtaatatttgtagatactacccgaacagttccttttttattcatgtccgcgtttcttatagaggttagtaaatcagcaatagtgtccttgcccataagactcaaattttaggttcctcctaatttttctataatcaacatgttctcttttttcttttcgttttggattctaaagcatatacgtgaaacacaatctactaattttttatttgatctatatcttgtctactagtatttataatacttcaggagctaatgaaactattttagtaaaattcaattctctcaattcctcggcgatcgcgccaaaaacgcgagttccttttggatttcctttttgatcaatgataaccgctgcattgtcgtcatagcgtattattataccgtcttcgcatttgaactctttacatgtacgtacaattacagctcgaattacttcggatctttctagaggcatttggggcactgcgtctttgattacagcaacaataacatcaccaatacgagcatatcgctgattactagcagctcctatgactcgaatacacatcaattttcgagctccactgttatctgctacatttaaaagggtctgaggttgaatcatattattttgatttcaatttgttatttcaatgcaaaaggatgaaagaaatattgtctttccagaaagaagaacctggttttttattttcaatactactttttttggggggttatatttctaaccgaagaaattgacttcgtatgggcattttgctggcagctatggaaatagctgctctagctacagtttcggatactccgcccatttcataaagtattcgacctggtttaacaacggctacccaatattcgggggatccctttcccgaacccatacgtgtttcggtcggtcttattgtaaccggtttgtcgggaaatatacgtacccagatttttccaccacgacgtgcatatcgtgtcattgctcttcgtcctgcttctatctgcctcgccgtaatccaagtgggttcaagtgcttgaagagcatatctaccaaaacaaatacaattgcctcggtaggattttcccttcattcttcctctatgttgtttacgaaatctggttcttttggggttatagtcgatggttctctcttagttccatctctactgcaaaactggacatgagagtttcttctcatccagctcctcgcgaatcaaatgagaaagtgtgcaaatttctctaattccacaatattctaaaatattacggatagatacacattaataggaaaggttagggtttttaatattgaatttattaaaatactaaaatatatagtcaagaaagaggatctagaatatatctagatgtgtatgtttatttatctatattctatatttaatgtaattctttttttttttttttttaatctcctttttttattttactcttattgaatcgcggtaaagtattctaattcaataaaaatttcgcgggcgaatatttactctttcctgtcttatttgttaattcataaccttatcaaataagacaatttttttggtttgttccgccatcccacccaatgaagtattgggattcttttcaagaaaatcctatccagtcataggttctgtcgttcccactgcttctcctttaatggttaggtttgaatctcgcaatggagcttccaaaaaatttctttccgagtcaatttctcagttttattaactcgggacgctctttgttattccttgaaatttgtatttcttgtttcaatcaaattacgatttcgaattctctgttatttttattatattgatgctttatcacattgctttttatgatgtaattcatagaccatacatattggaatcctatatctttcttatttctcttccttctttctatcatccttccttttatctacatcccctttagttttgcttcacaacttagaatcctatttttttttaaagaaaaaattgcagttgctacacgtatatgatagatttactcatttatgatagatgtatttattcatatagtgactgtttcttagttaggatctcgacaatacgaagcaataggttggttattagttcattttctataattacatagtagggttcattctatttttttttaatcccctttttgaaccctaaaaaaaaactaacgagtcacacactaagcatagcaattttattaaaagatttctcaattttcattaaatcttatagaaagaggtagaatttcttctttttttcagggattttagggaaaataaggctcttgtcattttttattctattactgaacagaatgggaagacagggttggttattcttcgtctacgaatatccaaattttaactcctaatactccatagatagttcgaattggatagcagcaataatcaattttagcgcgaattgtttggaggggaagtctaccttttttgatgcactcggcacgcgcaatttcttttcccgcgagacggcctgcaattttacttttactccctttatatctgttttttagttaattcaatggcttttttcattgcctttcggaatgaaactctattttttaattggaaagctatatattctgcaagaatgttaggttgtctataaggttctttcactttttcgatcccaatattaagtctctggtttacagaattaacttctttttgtagatctttctctaattcttcgattgctccttttttctttaataaattggggaatccaatatggattatgacgtggattgtatcgatttctttttgaatttctatatgtgtaattacttcggaacttgagcctgagtccatttttttattatgtgtaattacttcgaaacttgagtctgcttctatttttctattcgagccctttttcctattcttttgtatatagttcttgatacaattccgtatttttttatcttcctgtagaccttcagaataattttttggttgtgcgaaccaaaaggaatggtgattttgggttgtaccaagtctgaaaccaagtggatttattttttgtcccatatttttctattctattttttttaccgggaatcaaatcttagatggatctaaagattatttcgatttctttactatatttagtacaattgttatatgacacatggttttttttatgggagaactacgtcctcgagcccgaggtctgaatttattcataatagtactcctactgacttcggctttagtgatgaataaatttgctttgtcgaaatccctataatgagtagcatttgctgctgccgaataaaccaactttaagatgggataagatgctcgataaggcatgaggttcaatatcataacagtttcttcgtagtaacgccaacgaatctcatccagaactctttgtactttgaaaacggacatgtggatgcgtttttgtgctttgaaaacccgttcgaacttaagtagacgatcggttggtacttttcttgcgagtttccttagcccactcttcttcttctttatcctaggggtatactttaccagtttgaaacttgtcataaataaggttattccccgcttacctatttcttttttttttattttgaatctttctattctgaattcagttaacgacgagatttagtatcctttcttgcactttcataactcgtgaaatgccgagttggtacgaattcccccaatttgcgacctaccataggatttgttatgtaaataggtatatgttcctttccattatgaatcgcgattgtatggccaaccattgcgggtagaatgctagatgcccgggaccacgttactattgtttctttctcctccttcatattgaccttttctatttttgccaataaatgatgagctacaaaaggattcgttttttttcgtgtcacagctgattactcctttttttccattttaaagagtggcattcgatgtccaatatctcgatcgaagtatggaggtcagaataaatagaataatgatgaatggaaaaaagagaaaatcctttagctggataaggggcggatgtagccaagtggatcaaggcagtggattgtgaatccaccatgcgcgggttcaattcccgtcgttcgcccatcccattattgcaaattccaaaaatgcaattttccatattcctagttacgtatttacttacggcgacgaagaataaaactatcactatattttttccttttcctagttcttcttccaagcgcaggataaccccaaggggttgtgggtttttttctaccaatgggggctttcccttcaccgcccccatgggggtggtccacagggttcataactacccctcttactacggggcgtttacctagccaacacttagacccggctctacccaaacttttttggttcaccccaacattacccacttgtccgactgttgctaagcagttttgggataccaaacggacctccccagatggtaatcttaaagtggccgatttaccttcttttgcaatcagtttcgctacagcacctgctgctctagctaattgcccaccccttccacgtgtgatttctatgttatgtatggccgtgcctaagggcatatcggttgaagtagattcttcttttctctcaaaaaaccccttcccaaactgtacaagcttcttccaaagcatacggctttctagatgtatatgacgatctctagacagatggatcttatatgaatcgtatgatgaagtaccacatgagtggatatataggaaaggaatccaaatctgccgaatcgctcatgttatgatcttctacatcctaggtctccgcgttccgtcatctggcttatgttcttcatgtagcattcagatcgaatgactctatgaaattacgtcgatacttctacatattatgggtaacgtaggagacatccctattttcccccgggggtcttaattaccactgcttagctttcaattcgcctctgaccatcaaattaaatgtgaataacccgtcctcctctctttgaaacaaggggcgcttccggttctgtgcgtgcttcaaacaattttgtcttctccatattaccatatctctagagtcaataattttctatgaggaactactgaactcaatcacttgctgccgttactcaacagttttctgttgaggtctatcccgtagaggtagtcaaattggatcagtgatcgatttctaggtttcgtcgtaaacctaattggttacttccaattacgtaaatcaatagttcaaaccgcactcaaaggtagggcatttcccattgatataggaacttttgtaccagaaacaatagtatctccaattatagcccctctgggatgtaaaatatatcccttctcaccatccccatagtgtatgagacaaatgtacgcatttcgattagggtcgtattctatggttacgattctaccagatatgtctttttgattccgtcgaaaatcgattttacggtataggcgcttatgacctccccctctatgccttgcggtaatgattcctctggaattacgacctttaccacaacggtgccgtccatggatcaaattatttcgtggattggatttcacttgcctatctatggttcccttgcgtgtgctcgggataggtgttttgtataaatgtttcgccgtattattaagtattctcctttagtttttttctctatctagaagtggaatagaataacccggttgaagggtaatgatcatacgtctgtaatgcattgtatgtcctagaatagggcccattcttctaccctttccgggtagtcgatggctattcacagctactaccttaacaccaaagaagagttcgacccaatgctttatttctgtcttagtgaatcccgattcgacattaaaagtatattgattctttcccaataaacgaagacttttttctgtaaatactgcgtatttgattccatccataaatcgactttccctcctatgctctgagttccagtatcgataagaattcgagttcttattgttcttatgttatggtatgaatataccataccaattcgttatgtatggatgatggatgagattccatggatagagagccagttccaatagacttatggaacgttccggttcgcgtgcatccagcaggaattgaacccgcaaatttaccaattatgagttgggcgctttaaccattcagccatggatgcttaacagggatcatcgtacatcgtaaataaccaattttcatatagaaagacatatcatagaaaaatgaaatcgaaaatattcggagatggcaaatattcggagatgactatgaaaacacctctctggatcctcgaattgaaagagagattgagagggatccagaatcctaattctcgctatttggaatggatccaattctattgagtctgactcatagtgatcatttctctttagcaaagaatgaccttggttatcaaaggattgaacaaccgggatccgtttacttatgatacctagttgacattgataacaaggatctaatgaattatgagtttaatagatcctctttagcagaaagacgtatattccttgctcatcacttattcccaaacctcgtatggggctaatcgttttcatttaccatctcagggaaaatccttttcgttccgcttagccctatcgggtattttagtgataggttctataggaactggacgatcctatttggtcaaatacctaatgaaaaattcctattttcctttcattaaggtacgagggcttcttattccacaagaaaagaacgaaagcaccttttcattctttcatatactgggggtttttacttggaaaagacaatgttccatactaaaggattcgggtccataaccacgagttccagtgcactagatcttgtagcacttagcaacgaggccctatgaatagacatatagaatttttggtcgggaaattcgaatgaatcattgagtgaaaaaggagcaaagaatgacaaaagacgagactctactagtcttcactcttgtggtttcctcggtttctgttttcttattcgggatcttgcttttcatggttctcatctctgcaactcgcgattttcgcgagagaaccaaatccaagttggtgaagatcatgatttgggctggcatagtagtgattacctttgcaattgcggttcgaatctatccgatctttatctttttgctcaaagaacgaataaaaccccttgtcgaagccctttatgataagcttccctggatctgggaagtttctctttcacggtattgggatcgtttgatcgatttccttgatcgctacttatgggcgtgcgctcaaaggatacaaacagggattcgcaaacaaaaaggggaattcgtagtcactttttcctgtcgcgtaaaaaaaaggctttacgcgagagcaatagaggttgggatacatctatctcttctgagcaacctcttttggattcttaagaccacccttgcagtaggataccgtctgctttgggttctttattatattatctccttcgagggatttttaggatcgttcaggctatatttagtctattttggcttttactgtctccttttctcagggaagtggttaaggacctcagaagatagaggagagcgccaggcgcagatttccggaatacttctacggggaatgctcattgaatgcgcattctccgtattatgccttgaagaggactcgaacctccacgctctttagcacgagattttgagtctcgcgtgtctaccatttcaccatcaaggcatcttgaaagtgaatcatattccatgaatatgatatctatctaatgtgatatcttgaaagtgaatcgtattccatgaatatgatatctatctaatgtgatatatggaatatatgacaaaggtggagtcttggagtatttcgatcgatcggtcatataggcctgagtcagacatcaaatagcttcgatttgcattatccgtaggacaccttatatgtatcaaaatcaaaaagatgtacaatccaatttctcgattcaatagaagcccaaagaggtgcatatggtacccaaataaggataggatagatatgtcaaaagcaggtctgattacacctattcctaatcctaaatagaatgtaaggacgtggggatttctatgtaaacagagtatcctatttccataggctcgaatgaccccttctcataataagaatgtgcacggtctggtccggtatggaatgaacttataatctgatgatcgagtcgattccatgattataagttcattaccctagcgcccattcccattttgggcggaacagatctactaattcttttattccagttagtaagagggatcttgaactaagaaatagacctagcagctaaaagagggtatcctgagcaattgcaagaatggggttcattgatattcctggtatagtagatgctatcacacatacagtcatactcaattcgatggaattgtttgatcttaaaggggatcttctataatttcgcacataaggggttatttcttggtttcgtccagtcattaataacttgactatttttagataatagtagatagaaagaacgctcgtaaggagtcctattgaaaccaagaaatataggcctgcttgccatccacaccagaatagatagagttttccgaagaaacctgctagtggaggaaggcctcctagggataagagacatagggctaaagagagagccaaaaaaggatctttcgtgtataatcctgcataatctcgaatgttatcagttccggtacgtagaccaaataatacaatgcaagcaaaagttcctagattcatggagatatagaaaagcatataagttatcatgcttgcatatccatcatttgagtctccaacaattattccaataattacatatccgatttgccctatggacgaatatgcaagcatacgtttcatgcttgtttgagtaatagcaaggagattccccaatatcatgctaagaatagctaggatttccagaagaagatgccattcgtttgatgagaaataaaaaggaatatcgagaattcgcgtggctgaagctgaagcagcaactttcgaagtaacagaaagaaaagcaacgactggagtgggggagtcagagtcgaaaagaggattcctcgcttctttctctcatgcaaaaccgtgcatgagactttcatctcgcacggctcctaagtgataaaagaaagaagaacttgtcttctttcttttttgattaccttcctcgcgtatgtataagaccgaatccattctttttcgaaatcgatttcgaaaaagaactactaatccttaacttttcgaggaatccttcatcagtggttgtgaatgactgactttttcaatcctttcgaccttggttccgtaggagcaagtcagaaaggttgagaaatagaaccatctgatttgattcgttcccaatagccatgagatgatcatcttagggtgatccttttgtcaacggatgctcctattacactcgtagtctctgaaggatgagaacccactatgtagcatctacgtcgataattcaagcattgtatacgtcattagtccgattctttgtaggaactacccgtaataacgagcttgcaaaatggatctgtttatcataaagagattcgttgttcctgaccctgcttcaccttaattgttatttgaacaaaaagatcacaataaacttttggtaaaagttctgtcttggtcggagtggggatagcatttctcttctgcatatctatggagttttgcaaaacccaaacacctcagagatagatatagaggtaggaatttgtcgaacgaaccacactccttcgtagacgtcaggagtccattgatgaaaaggggctggggaaagcttgaacccaagtcctacagtgatggatataagcgcaattgaaattcctggggagttatacatttgtgtattgataagaccgttcacaatttcttgaagctcgatctcccccccagatgaaccatatagccaagagaaaccatgaaccagaatagaagagcttgccccacccatgagtaaatatttcatagtagcctcattagaccgtagatctctcttggtatatccagacaataggtaggaacataaactgaaacattctggagctacaaagatagttattaaatcgttagcaccacataaaaacattccccctagagtagctgttaatacgaataacagaaactctgttatagccatttctgtacattcaatgtactctacggatagaggaatacataaagttgaacataataaaataagaaattgaaagatttcgttgaaattgttcgtttggaaatttcccgaaaagctaattataggttcttctctccatcggaacaatagggccgttatgcttattactaaacttgttgaagagatgaaatagaaccaaggtctatctttttgatcagaggttaaatcgatcatcagaagaagaattaggccaaaaattaggatacattctgggaaaatgaaacttccctggaagagaagcaaatgaaacgctttcataaaaattctcgtagaatcgagaatgaagttttcattctgtacatgccagatcatgaattagtaactgcatccaatctccgaaaagtcccgattgtttcgatttttggaatgggatatttacggaatccccatgaataggatcaaaccttattccatgctatttccataagattcctctttcttattcttaagcaagcccccgagagggcttagttgatcatgatttctgttttctctttcttttcctttttgtttgtttcgagaaagatatcgtccgattctccttctattgattcttttccgatcgagatgtatggatccatgtgtctacatacctagattctgttcatggattaacgaaaatgtgcaagagctctatttgcctctgccattctatgagtcgcttcctttttgcgtatggcacccccaccccctttggcagcatctactaattcggaacttaatttgaaagccatatttcgacccggacgcttttgggatgcttctaataaccaacgaatggcaagtgctcttccttgtttagatcctatttcaatcggaactttccgcgtcgatccttttttattacgtcttgtttttactcctatattgggagttactctacgtattgcttgacgtaaaaccaatagtggatttgtttctgtcttttgttgaatctttttcacggctcgatagagaatttgataagccaatgatttttttccgtctttcataatacggttaaccaccatgttaactaatcgattacgaaaaattggatcggattttgcagttcttttttctgcagtacctcgacgtgacatgagcgtgaaagaggttcaagaatccgttttctttttataagggctaaaaacgaatcacttatttttttggctttttgaccccatattgtagggtggatctcgaaagataggaaagatctccctccaagccgtacatacaactttcatcgaatacggctttccacagaattctatagggatctatgagatcgagtatggaattcagtttactcacttaaaattgagtatccgtttccctccttttcccgctaggatcggaaatcctgtattttccatatccataccatcaagtccttaggtttccgaaatagtgtaatggaaaaagaagtgcttcgaatcattgctatttgactcggacctgttctgaaaaagtcgaggtatttcgaattgtttgttgacacggacaaagtaagggaaaacccctgaaagaatttccatattgaccttggacatataagagttccgaatcgaatctctttagaaagaagatcttttgtctcatggtagcctgctccagtccccttacgaaactttcgttattgggttagccatacacttcacatgtttctagcgattcacatggcatcatcaaatgatacaagtcttggataagaatctacaacgcactagaacgcccttgttgacgattctttactgcgacagcatctagggctcctcgaataatgcgatatctcacaccgggtaaatccttaacccttcctcctcttactaatactacagaatgttcttgtaaattatggccaataccaggtatataagcagtgatttcaaatccagaggttaatcgtactctggcaactttacgtaaggcagagttgggttttttggggttgatagtggaaaagtcgacagataagtcacccttcctgtccctctacagaaccgtacatgagattttcacctcatacggctcctcgttcaattctttcgaagggatccttttcctcgttcgagagtctccgcccttcttccactccgtccc

SEQ ID NO: 38465 - DNA, 1860 bp, Oryza sativa
tacatgttctaattgaacactttgccatttatgattaaaggagaagattgttcttttaccaaacatatgcggatcaaatcacgtcttataataagaagaaatctttctcggtatcaatccccttgcccctcattctttgagaatcagaaggatccttttcgagtttccatttcttcatttggaatctgggctcttctatcttcgacttattttttttttgctttattctttatttatttcatttcgatttttccctcttcctctatccctatcctctaggtacagcgtttgcatcaatagagaaccttttcctctgtatgaatctatattattccattccaatttcttcccgaaacttcccaagaaaaatcccgaattggatccaaaattgacgggttaatgtgagcttatccatgcggttaggcactcttcaaataggaatccattttctaactggctttcgtgctttggtgagtcgtccgagatcctttcgatgacctatgttgtgttgaagggatatctatatgatccgatcgattgcataagacccgcggtagcaatagaacggggaaagtatacagaaaagacagttcttttcaatttcgattatctatatattagttcgtttctatttctagatatctatttctatatattagtattagttagtagtactattctattagttagcgatcccggctctgtgagttctttcttccgtgatgaactgtcggcaccagtcctccattttttctctgtggaccgaggagaaagggggctcagcaggaagaggattgtaccatgagagaagcacagaggtcaaccctcttcaaatatggaacatggattctggcaatgcaacgtagttgggtcctcatatcgatccgaatgaaacagtctttctacagaggtcaatctttgcctattaggcaagaggatagcaagttcgaaattctgtctcggtaggacatggatttctattactatgaaattcataaatgaaaatgaagtagttaatgggagggctaccattatcctttttcttgtatgtgttcctaagagaaggaatttgtccatttcatgtttcgaggtctcaaaaaagggcgtggaaacagatagaaactcttgaatggaaattgaaaagaaatgtagccccagttccttcggaaatggtaagatctttggcgcaagaagaaggggcgacccatatcatcttgacttggttctgcttcccctctttttttaagaataccgagtcgggttcttctcctaccagtatcgaatagaacatgctgaacaagatcttcttcatggaaacctgctcgatttagatcgggaaaatcgtacagattttatgaaaccatgtgctatggctcgaatccatagtcaatcctattttcgataggaccggttgacaattgaatccaatttttcccattatttgactatccataatagtgtggaaagaaagcccggaggaagggtggccttgagtttctcgcccctttgccttaggattcgttaattctctttctcgaggggacggggaagggatataactcagcggtagagtgtcaccttgacgtggtggaagtcatcagttcgagcctgattatccctaaacccaatgtgagttttttctattttgacttactccccccgccacgatcgaacgggaatggataagaggcttgtgggattgacgtgatagggtagggttggctatactgctggtggcgaactccaggctaataatctgaagcgcatggatacaagttatccttggaaggaaagacaattccgaatccgctttgtctacgaataaggaagctataagtaatgcaactatgaatctcatgg

SEQ ID NO: 38466 - DNA, 1369 bp, Oryza sativa
tgggtattttggtttgacactgcttcacgcccaaaaagaaggcagctacgtctgagctaaacttggatatggaagtcttctttcgtttagggtgaagtaagaccaagctcatgagcttattatcctaggtcggaacaaattagttgatagtgataggatcccctttttgacgtccccatgcccccccccgtgtggtgtggcggcatggggatgtcaaaaggaaagggatggagtttttctcgcttttggcgtagcaggcctcccaaagggaggcccgcgcgacgggctattagctcagtggtagagcgcgcccctgataattgcgtcgttgtgcctgggctgtgagggctctcagccacatggatagttcaatgtgctcatcagcgcctgacccgaagatgtggatcatccaaggcacattagcatggcgtactcctcctgtttgaatcggagtttgaaaccaaacaaacttctcctcaggaggatagatggggcgattcaggtgagatcccatgtagatctaactttctattcactcgtgggatccgggcggtccggggggggcactacggctcctctcttctcgagaatccatacatcccttatcagtgtatggagagctatctctcgagcacaggttgaggttcgtcctcaatgggaaaatggagcacctaacaacgcatcttcacagaccaagaactacgagatcaccctttcattctggggtgacggagggatcgtaccattcgagcctttttttcatgcttttcccggcggtctggagaaagcagcaatcaataggacttccctaatcctcccttcctgaaaggaagaacgtgaaattctttttcctttccgcagggaccaggaggttggatctagccataagaggaatgcttggtataaataagccacttcttggtcttcgactccctaagtcactacgagcgccctcgatcagtgcaatgggatgtggctatttatctatctcttgactcgaaatgggagcagagcaggtttgaaaaaggatcttagagtgtctagggttgggccaggagggtctcttaacgccttcctttttctgcccatcggagttatttcccaaggacttgccatggtaagggggagaaggggaagaagcacacttgaagagcgcagtacaacggagagttgtatgctgcgttcgggaaggatgaatcgctcccgaaaaggagtctattgattctctcccaattggttggatcgtaggggcgatgatttacttcacgggcgaggtctctggttcaagtccaggatggcccagctgcgccagggaaaagaatagaagaagcatctgactctttcatgcatactccacttggctcggggg

SEQ ID NO: 38467 - DNA, 1623 bp, Oryza sativa
  unsure (1)..(1623): unsure at all n locations
ctcccgaaaaggagtctattgattctctcccaattggttggatcgtaggggtcgatgatttacttcacgggcgaggtctctggttcaagtccaggatggcccagctgcgccagtgtaaaagaatagaagaagcatctgactctctcatgcatactccacttggctcgggggnnnnnnnnnnnnnnnnnnnnnntccgctcttgcaattgggtcgttgcgattacgggttggctgtctaattgtccaggcggtaatggtagtatcttgtacctgaaccggtggctcactttttctaagtaatggggaagaggactgaaacatgccactgaaagactctactgagacaaaaagatgggctgtcaaaaaggtagaggaggtaggatgggcagttggccagatctagtatggatcgtacatggacgatagttggagtcggcggctctcctaggcttccgtaaagagggatgccatggggaaagaggatcagttgagcccttggcaaatagcttgatgcactatctccattcaaccctttgagcgaaatgtggcaaaaggaaggaaaatccatggaccgaccccattatctccaccccgtaggaactacgagatcaccccaaggacgccttcggcgtccaggggtcacggaccgaccatagaccctgttcaataagtggaacacattagccgtccgctctccggttgggcagtaagggtcggagaagggcaatcactcgttcttaaaaccagcattcttaagtttaagatcaaagagtcgggcggaaaaaggggagagctccccgttcctggttctcctgtagctggattccccggaaccacaagaatccttagaatgggattccaactcagcaccttttgttttgagattttgagaagagttgctctttggagagcacagtacgatgaaagttgtaagctgtgttcgggggggagttattgtctatcgttggcctctatggtagaacccgtcggggaggcctgagaggcggtggtttaccctgtggcggatgtcagcggttcgagtccgcttatctccagcccgtgaacttagcggatactatgatagcaccgaattttgccaattcggcagttcgatctatgatttcgcattcatggacgttgataagatccttccatttagtagcaccttaggatggcatagccttaacgttaatggcgaggttcaaaagaggaaaggcttgcggtggatacctaggtacccagagacgaggaagggcgtagcaagcgacgaaatgcttcggggagttgaaaataagcatagatccggagattcccaaataggtcaaccttttgaactgcctgctgaatccatgagcaggcaagagacnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaccgtgaaaacggggttgtgggagagcaatacaagcgttgtgctgctaggcgaagcggttgagtgccgcaccctagatggctaaagtccagtagccgaaagcatcactagcttacgctctgacccgagtagcatggggcacgtggaaatcccgtgtgaatcagcaa

SEQ ID NO: 38468 - DNA, 563 bp, Oryza sativa
  unsure (1)..(563): unsure at all n locations
atgtatgggggctgacgcctgcccagtgccggaaggtcaaggaagttggtgaactgatgacagggaagccggcgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttccctgggattggctttgggcctttcctgcgcagcttaggtggaaggcgaagaaggcccccttccgggggggcccgagccatcagtgagataccactctggaagagctcggattctaaccttgtgtcagacccgcgggccaagggacagtctcaggtagacagtttctatggggcgtaggcctcccaaaaggtaacggaggcgtgcaaaggtttcctcgggccagacggacattggtcctcgagtgcaaaggcagaagggagcttgactgcaagactcacccgtcgagcaga

SEQ ID NO: 38469 - DNA, 513 bp, Oryza sativa
aaccgtgctgagctcccaagcagtgggaggggaaagtgatctctgaccgcgtgcctgttgaagaatgagccggcgactcataggcagtggcttggttaagggaacggaacccaccggagccgtagcgaaagcgagtcttcatagggcgattgtcactgcttatggacccgaacctgggtgatctatccatgaccaggatgaagcttgaatgagagaaggagaggatgaagttggaagaaagaagcagaggtccgacgtactaatgattaatgttcaaggatatagagtgtggtagtggttaggagtccaatggcacccagaagcaatggttttgttctcactgcgtgagtgcacagccttcgttggctgtccatgctggaggtgcagtgctgtggcggtgcgggctgcgcgagcggtaccaaatcgaggcaaactctgaatactagatatgacccaaaaataacaggggtcaaggtcggccagtgagacgatgggggataagcttcatcgtcg

SEQ ID NO: 38470 - DNA, 780 bp, Oryza sativa
taaccaatcccaacatggaagtattgaaaaaacttatataaacaaaaaatctcaaatatccctcatcgtgagacatataatcatcactataaataagaaccaggattcctacagtagtaattagtattaacataatagaagtaagcgggtcgattaagtatccaaattctaaggaaaaatcattattgacggtccaagaccatagatattgatagatagaacttccatttatttgttgaatagacaggtgaactgagaataccatagctatacttaaaagtaaaacactaggaaaagcccatatgcgacgaagattttttgttgctgttggaacaagaaaaagtccaaaccccattgacataataactggaagtgggagaagagggattacccatgcatattgatatgtatgttccataagaaaagaaattgcaatttttacttgaaaattttacttcaatttttctataaaattgaaaaaagtttccgattcaccaaactaattcttatctatttctgaaggaataaaaaaatactagaattcttaatttttcaaaaattttctcattgaaacaatcaaaaaataagaataggttttgttggttaaagtcaaaaagttaatgaaataacttcgttacctagttattacctaaagaaggacttttattaaaatacaaaaaaaagattgaatcattttactttaatattcttttgtattaaaatgaagcagctcccttggttcgtaactcaaattgattggaattcaattctggaatactt

SEQ ID NO: 38471 - DNA, 530 bp, Oryza sativa
  unsure (1)..(530): unsure at all n locations
cggagggacgcaggaggctaggttagccgaaagatggtaaaggtttaaggacacaaggtgaccatgctttttcagggtaagaaggggtagagaaaatgcctcgagccgaggtccgagtaccaagcgctgcagcgctgaagtatgagccccgtggactagccattgcttctccacgaggctcataccaggcgctacggcgctgaagtatgtaacccatgccatactcccaggaaaagctcgaacgaccttcaacaaaggggtacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgccccctcgcaaaagggggtcgcagtgaccaggcccgggcgactgtttaccaaaaacacaggtctccgcaaagtcgtaagaccatgtatgggggctgacgcctgcccagtgccggaaggtcaaggaagttggtgaactgatgacagggaagccggcgac

SEQ ID NO: 38472 - DNA, 7486 bp, Oryza sativa
  unsure (1)..(7486): unsure at all n locations
tctcctccgacttccctagagcctccggtagcacagccgagacagcgacgggttctccacccatacggggatggagcgacagaagcatggaaataggataaggtagcggcgagacgagccgtttaaataggtgtcaagtggaagtgcagtgatgtatgcagctgaggcatcctaacgaacgaacgatttgaaccttgttcctacacgacctgatcaaatcgatcaggcacttgccatctatcttcattgttcaactctttgatgaaaagatgaaaaaaccaaaaaaaagctctgcccttccatctcttggatagatagagagggagggcagaggcctttggtgtcccttccagtcaagaattggggcttcacaattactagccaatatttctctcatgcctttcctcgttcatggttcgatattctggtgtcctaggcgtagaggaaccacaccaatccatcccgaatttggtggttaaactctactgcggtgacgatactgtaggggaggtcctgcggcaaaatagctcgatgccagaatgataaaaagcttaacacctcttatttgactttttcactattttgaaatacgaaaaagatccaaatccaaaatgcaaaggtcgtcttattcaaaacctcaatcatcacatcccctctctcccacttcacacctcggaacgcactgttcttatagagagaaaggggctttcccatcttcttaacccgaaatgaaatggctgaggagagggaggttccttttggggggtacccccgggaagagatccagtggagacggggtgggcctgtagctcagaggattagagcacgtggctacgaaccacggtgtcgggggttcgaatccctcctcgcccacagccttccaaaggggaagggcctttactttccccctgagggtaggaaaaccatgatcgggatagcggacgtaaagctattgaacttgggtatgctctttccttttgtcgaagtggaatcgtagaacagaatgtgatacgatgagataaaatgcaatagaaacaaggatagcgaacgggttacctactcctaagggtcaaagcaagccctttaattcaattctttattcttacattaaagaatgaatcaaatctccccaagtnnnnnnnnnnnnnnnnnnnnnnnnnnnnnnnnnnnnnnnnnnnnnnnnnnnnnnnctgaggaacaagggggattcgacctcctagagttcaactcccgctctcaacccatgaacaatatgagtccgaagcttctttcgtaactcccggaatttcttcgtagtggctccgttccatgcctcatttcataggtaagcccagagtggctctatttcattctatttcacttcctagcacttcctatcatttaatatccatccctttggtcttattgacataagagatgtcatttatagtctatctctttctatatatggaaagtcaagaaattctcatcgaaacatcgagaaattgtgcatatagaaaactctaaagaaagaaaaaaaggagacccatgccatgattttcaaatcttttctacttagtagtctaagtttctcgatgaggataattaattcggtcgttgcggtcggactctattatgggtttctgaccacattctccatgggtccctcttagatcttctttctccaatcttggattagggaagaaggagatattcgcgactcctggtggtttcattatggggcagctcatgatcttcatatcgatctattatccacctctgcatctattctttcttagctaaacgggtggaagatccatccaatttggttatatcatggactcaaaaaacggatctgaatgtgactgaaatgcacgatcttcacaggtatcacttttcacgatacctaaaaggtggaatagcgattttcgaaccatttcctataagagaaaggtttccattactttgagaaatggattctatatcaaactatagctattgcattaaagaagaaaagaaactaatagaagtcgaagacgcggaatggtagtgaatagagagaaagattcttctggttttcttgttcctgaaaatattctatctatctcctagacgccgtagagaattgagaattttcatgtctttcaattctcgtactcgtaattggaaagttacggaaggagatccatcattttgcaatgaaaactacataaaaaactctggacaatttcgaaatcaggccaagcgtcttaatacatatgcaaaaaaattcattattggcccaccattgattagaagatttaacttgtatgaatcgctattggtttgatacgaataatggcagttgtttcagtatgttaaggatacagatgtatccacaattcatttagagttacttaatagcctatttcttataccatatctctatcccgtgaaattctcgagccgaaagatggatgcatatgctatgtttcattttgctaaatgatatcaattaaacggtgtatcaattccataaattggatatagcaataaataaatcagcaaaattcttttattttagatagaagaaacttttcttctatctaaaataaaagaatgtacccttctatccaaatccaatttgcatcgataaaataaatccaaattccagtagtagatgaataattgcaaatttttgtgtgtacgagattagaataacttcaaaataactgacataattttttatttttcctgatcagaaaaatacatgaaaaagaaaggaggtagaaaaatttttggatttatggttaaagaagaaaaagaagaaaactggggttctgttgaatttcaagtattcagtttcaccaataagatacggagacttgcttcacatttggaattacacaaaaaagatttttcatcggaaagaggtctccgaagacttttgggaaaacgtcaacgtttgctggcttatttggcaaagaaaaatagagtacgttataagaaattaatcagtcagttggatattagggagcggtaatttcatcgttcgaattttttttcttattttattagtagtcttatagtagtcttagattttgcattttgatgagcctcgttttgaggaattcatggaataatccattttcatggaataatgaattaaggaagaaaggatatgagtctaccgcttacaagaaaagatctcatgatagtcaatatgggccctcagcacccatcaatgcatggtgttcttcgactgatcgttactctcgatggtgaagatgttattgattgtgaacccatattaggctatttacacagaggaatggaaaaaatcgcggaaaaccgaactattatacaatacttaccttatgtaacacgttgggattatttagctactatgtttacagaagcaataacggtaaatgcaccagaattcttggagaatattcaaataccccaaagagccagctatattagggtattatgttagaattgagccgtatagcttctcacttgttatggcttggaccttttatggcagatctcggtgcgcagactccttttttttatatttttagagagagagaattaatatatgatctatttgaagctgctacaggtatgcgaatgatgcataattactttcgcatcggaggagttgctgccgatctgccttatggatggatcgataaatgtttagatttctgtgattattttttacgaggagttattgaatatcaacaacttattacacagaatcccatttttttggaacgagttgagggagttggttttattagcggagaagaagctgtaaattggggcttatcgggccccatgttacgagcttctggaatacaatgggatcttcgtaaagttgatctttacgagtcttacaatcaattcgattggaaagtccaatggcaaaaagaaggggattcattagcacgctatttagtacgaatcggtgaaatgagggaatccatcaaaattattcaacaggctgtagaaaaaattcctgggggcccttatgagaatttagaagtccgacgctttaagaaagcaaagaattccgaatggaatgattttgaatatcgatttcttggtaaaaaaccttcacccaattttgaattgtcaaaacaagagctttatgcaagagtggaagccccaaaaggtgaattaggaatttatctggtaggagatgatagtcttttcccctggagatggaaaattcgtccacccggttttattaatttgcaaattcttcctcagctagtcaaaaaaatgaaattggctgatatcatgacgatattaggtagtatagatatcattatgggagaagttgatcgttgaaatgataatagacagggtacaggtagaagctatcaattctttttcgaacttggaattattaaaagaagtctatggactgatatggattctacccattttgaccctcttactgggaatcacaatagaagtactcgtaattgtgtggttagaaagagaaatatccgcatcgatacaacaacgtattggtcctgaatatgctggccccctgggactgcttcaagctatagcagatggaactaagctactttttaaagaggatatcttgccatcccgaggggatattcccttatttagcattggaccgtctatagcagtcatatcaattttattaagttttttagttattcctttgggatatcgctttgttttagcggatcttagtattggtgtttttttatggattgccatttcaagtattgctcctattggtcttcttatggcaggatatagctcaaataataaatattctttttcaggtggtctacgagctgccgctcaatctattagttatgaaatcccattaactttttgtgtactagcaatatctctacgtgcgattcgttaaaataggatctttttcctctgaaattcattgaatatttatcctccttttcttattctatattcaggttagtaagttaaactagatagctatatgagtgaaacaaaactgcttattaatttgtagtaaaaagaaaaaatctcatttcctatgtacaagaaaaaatggaagtaaacataagcggtgtaaattctttaccccaaggttgagattttttgattagtcatcatatcttgaagcgggcaataataagggattcccgatacagaaagttgtaatcataagggaatccatcaaaagttagtgagggattagaaacactaaagtacataaaggattagtaatgagggaatctaaagcattagatatttttcctcataaaaggaatcataataaggacttgaaattggtggaaatgagcaagtagtactttcttcggattccgatccagagtatgttcccattcacttgttaaggaaatggctatcaagaacgaattaaccctttattccttttttctttttaaatacccctcggggaaagaagaataggacaaaagatatggaatgcaatacaaaaaaaaagatctttatttattctttccgtcgtttatccatattcatacagaattcttcatgaactaatacccaactcttttcgtttattaattgttataacgagtgttttattccaagattaagttattgctgaacaaagaaaaagtaccattatattataaaggatgagatgaattccgaagcgttttttattattctagcagacagaattcctttggtctaatttaggacgttgaaatcgattttatcttagataattctaactacgcccaagaagataataacgaaatgaaacagtactttccttttttctgatcatagaggagccgtatgaaactaaggtttcatgtacggttttggaatagcggtgggaactgtgatgttatcgtcgactatgattatccaacagttcaagtacagttgatatagttgaagcacagtcaaaatatggtttttttggatggaatctttggcgtcagcctataggttttctggtttttctaatttcttctttggcggaatgtgaaagattaccctttgatttaccagaagcggaggaagaattagtagcaggttatcaaaccgaatattctggtatcaaatatggtttattttatcttgtttcttacctaaatttattagtttcctctttatttgtaacagttctctacttaggcgggtggaatttgtctattccctatatatccttttttggatttttccaaatgaataaaatggttggaattttagaaatgacaatgagtatctttattacattaactaaagcttatttatttctcttcatttctatcacaataagatggactttacccaggatgagaatggatcagttattaaatcttggatggaaatttcttttacctatttccctgggcaatctcttattaacaacttcttcccaacttgtttcactataaaataagataatacaataacagtaagaatattttcaacacaaaagtcctctcaaacaagagaaagaaacatacctttttcatagatatttcgaatatgttccctatggtaactgggttcatgagttatggtcaacaaacaatacgcgcagcaaggtacattggtcaaagtttcataattaccttatcccacacaaatcgtttacctataacgattcactacccctatgaaaaatcaattacatcggagcgtttccgggggcgaatccactttgaatttgataaatgtattgcttgtgaagtatgtgttcgcgtatgccctatagatctacctcttgtggattggagatttgaaaaggatattaaaaggaaacaattgcttaattatagtattgatttcggagtttgtatattttgtggtaattgtgttgagtactgtccgacaaactgtttatcaatgactgaagaatatgaactttctacttatgatcgtcatgaattgaattacaatcaaattgctttgagtcggttaccaatctccataatgggagattacacaattcaaacaattaggaattcaactcaaagtaaaatagacgaagaaaaatcttggaattcaagaacgattactgattactagaatttttttgttagaatccaaaagttctttactaactagaaagaaaaacgaatacctactgcttattgcaaattattcctgattttaaaccagagtagattttcgtgatgtgatttctaactatagaaagaacttatatacaatatacaaaaaaatttcctaatcccttttttcttccttgaatcttttagttttagtcagttcatgaaaaaatttatactattaatttcttcttatccataatggatttacctgggccaatacatgaaattcttgtgctatttgggggatttgttcttctactagggggtctaggggtggtattacttaccaacccaactttttctgctttttcgctaggattagttcttgtttgtatatccttattctatattttattgaattcctactttgtagctgtggcacaacttcttatttatgtgggagctat

SEQ ID NO: 38473 - DNA, 1957 bp, Oryza sativa
ctcataaataacgttcaacaaattgggattcatttagcaaccgatttttatcttccatttgaactcatttccataattcttctagtttctttaataggtgcaattactatggctcggcaataagaaatacttagaatgagtcaaaattataagaatttcaaatctaaaataaatcactaaagaaccacaattttgatttagtaaaactcatctactgccaacaaataccttcttttctcttttgttgtgtaattgttctattctaattaattcaatcggttcaattcttgtccccatattgaaatgaatcgagattgataaggagttagttaatgatgtttgagcatgtactttttttgagtgtctatttattttcgattggtatctatggattgatcacaagccgaaacatggttagagctctaatatgccttgaacttatactgaattcaattaatctaaatctcgtaacattttctgatctatttgatagccgccaattaaaaggagacattttcgcaatttttgttatagcccttgcggctgctgaagcagctattggattatccattctttcttccatccatcgtaataggaaatcaactcgtatcaatcaatctaattttttgaataattagacatagaatcttctaaacaaagggacacatataataataatatgaaatagtaacatgaatactatttattatttgagaatatctattttttgagtaggttattccatagtattcttttttacttagttgaatttttgcaattcattgatattgcaatttgaatattgcaataatttatattgaaaagacgatagccaatttattggctaattcgaattcgtatatacaattcgtataattatgattgttgaagcccaaaattaaagtctcttggctcttttcatgctttctcacaaacggattaagaaatatattgcattatttgttgaagtttggataaaccattgcttcgtctggtgtctacaatacatttgattgatatagtactaatttcattttgaccagatcgaaaatttttatgttgaaaaggaaaatttatagacccaatgtcacattccgtaaaaatttatgatacatgtataggatgcactcaatgtgtacgagcttgtccaacagatgtattagaaatgataccttgggatggatgtaaagccaagcaaattgcttccgcgccaagaaccgaagattgtgtgggttgtaagagatgcgaatccgcctgcccaacagattttttaagtgtccgcgtttatttaggacctgagacaacccgcagcatggctctatcttattgatacgttacaaaaaattccacttgaatcgtctgattcctctttaccgaagaagcctgtgctcaaaataatcgagcacgggcttttctggtcaaaacgtatcttgtctttatcactttatcatgagttcttttccttggttaacaatacttgttgttttgccgatatttgcgggttcattaattttctttttacctcataggggaaacaaaatcgttaggtggtatactatgtctatttgtttattagaattccttctaatgacttatgcattctgttatcatttccaattggaggatcccttaatccaattaaaagaggattctaaatggatagatgtcttcaatttccactggagattgggaatcgatggactttcattaggatctattttattgacaggatttatgactactttagctactttagcagcttggccggttacccggaattcccgattattctatttcctgatgctagcaatgtatagcggtcaaataggattattttcttcgcgagaccttttacttttttttatcatgtgggagttagaattaattcctgtttacttacttttatccatgtggggggggaagaggcgtctctattcagctacaagtttattttgta

SEQ ID NO: 38474 - DNA, 3102 bp, Oryza sativa
atgcagcttcaacttctcttggccaacgcaatttcaaaaaaagaatagcctactcctccgtctctcacatgggtttcattattataggaattggttccataaccaacattggactcaatggagctattttacaaatattatcccatggatttattggggctacactttttttcttagcgggaacggcttgtgatagaatgcgccttgtttatctcgaagaactgggaggggtttctatcccaatgccaaaaatttttaccatgtttagtagcttttcaatggcttctcttgccttaccaggaatgagtggttttgttgcggaattagtagtattttttggactaattactagtccaaaatttctgttaatgccaaaaatgctaattacttttgtaatggcaattggaatgatattaactcctatttatttattatctatgttacgacagatgttctatggatacaagctatttcatgttccaaacgaaaattttgaggattccggcccgcgagaactctttcttttaatctgtatctttttaccagtaataggaatcggtatttatccagattttgttctctcgctatccgttgacagggtagaggctctgttatccaattattatcctaaataggattttttttcttctactagtccgctctatattccatagtggaaatactcaaaaattcagaaaaaagtaaaagagtctaattagatctatctcgaatttttgagaaccctttgagaaggcgttcaaggggttctcaaatcaaacacaaaaatggaagttttttccatttcattaaggttttatgttatgtaatcatttagatgggtaatgtaaatgaaccataactatgtaaacctattcctaatagattgataccaaaataacagatccaaattataagaaatcctatggaagctacaaatgctgacttcgtacccttccaatttggatttgttctactatgtaaataaattgcaaatatggtccaagtaataaatgcccaagtttctttaggatcccaattccagtaggatccccacgcctcattagcccatactgctccacaaagaatacctatggttaaaagggtaaaccctagactaatgacacgataactccaagaatccaaacgctcaattaattgatatttgtaataatttggaaataaaggaaaaaaggtgctttttaaagcacttctttttgcatagaaatattcaatctcattaaagaaaaatgttttgcttaaaacatttttcttctttttcgaaaagaaatctaaattctttcgaaatctaatcattagaagagcggcggataataaggatccgcacaaaagagtcgcatagcttagtaacatcatactgacatgcatcattaaccactgagattgtagagcaggtactagtattgtggattgatgcatttcagttaaaagacccgacgtggcaaagccttgcgttaaaatagtactcggcgtagttattgtgcttaaatcatttttagagttctgtatcttaggaatcatatgaagaatatacagagcccatgaaaggaagatcaatgactcatataaattacttaatggaaaatgtcccgaagaagcccaacgagaaactaagaatcctgttatacagaaaaaagtggctatcattcctttttctgacgaatcacgcaatcccccaagttcacgaactaataaggttattaaatgaatcgtaatcacaattgaaattgttgagaaagaaatatgagttagtatatgttctaaagttgcaaatagcataaggagaaggtcccattacaaaattggaaatttcgaattgaatccattttattttataatctattgtattctttttcgagactgccgccactcggactcgaaccgagatgcttgagcactgcttcctaagagcagcgtgtctaccaatttcaccatggcggctaagttgaaataacaggtttattaaaagaatattaagttattttctcgcgaatcgtcgagattggaagattccatagaatttaggacattagaatcttcattaaaatagacttcgtttggtagtatcgttgcgaattttttaacaaaaaaattcttgctttgcccaatagaaactttgaaagagttggaacaattttttctcagttgcaatatagaactaatttttttgttaatttaggataagataggtagaagttgtaagtcttattgcaggaatactctacttttcataatagaatcccctttttttatttattatacggattctattacgaaaagttcattgataggaaaagaatatttaggtcacagtataccaaaaaccctttttttatatatcagagaggtttgttctaagaatattgtaccgaggaattcgacacataaaagtaaactcattaattaatcctaattattcctaattattcatattaaataattggaatttttgggggataggtcaattcatattatcccaaaaccctattatttgtttgttgccgagaaaaaccctttggttttggatgctcgctgacgccagaaaatgatcttgattttgctaaagaataagattgtactatggaaaaataagtctttttcttccaaagatttttacgaatacgcttttttgacatcgaagtacgtttttttggaactgccattcaaaaaggaaattacttttttctagttgtatgtgaaagacatctattgccgcaaatcaatccatctttcttctttttcttagtatttatacttagatactaaaagatattgaaattctgaattcttttttacttcattgtgtctaatgcggataagacaagagttttttaacatattatatattttttttagactttgttttaataatatagaatatatacaaaggttttctatttaaatcaatttatatttcaagtatactctccatatacagatataaggtatgggggcctatcccccatataagacgggaggataaaaggaagggaaaattcaatcaaatagttaattaaagtattccagaattgaattccaatcaatttgagttacgaaacaagggagctgcttcattttaataca

SEQ ID NO: 38475 - DNA, 1886 bp, Oryza sativa
cacgtatggttacccgatgctatggaaggacccacccccatttcagctcttatacacgcagcaactatggttgctgcggggatttttcttatagctcgacttcttcctcttttcatatccctacctttgataatgagtttcatttctttaataggtacactaacacttttcttaggagccactttagctcttgctcagagagatattaaaagaagcttagcctattctacaatgtctcaattgggttatatgatgttagctctaggtataggttcttatcaagctgctttattccatttgatcactcatgcttattcgaaagctttattattcttgggatccggatctgttattcattcaatggaacctcttgttggatattcaccagataaaagtcagaatatggttcttatgggtggtttaagaaaatacattccaattacaagaacttgttttttatggggtaccctttctctttgtggtattccacctcttgcttgcttctggtccaaagatgaaatccttagtaatagttggttatattcacccttttttggaataatagcttcttttactgcaggattaactgcgttttatatgtttcggatatatttacttacttttgatgggtatttgcgtgttcattttcaaaattacagtagtactaaagaggattcgttgtattcaatatcgttatggggaaaaaggatatctaaaggagtcaatagagatttcgttttatcaacagcgaagagtggagtttcttttttttcacaaaatctatccaaaattcatgttaatacaggaaataggatagggtcctttagtacttcattggggactaaaaacacttttgtctatcctcatgaaccgggaaatactatgctatttcctcttcttatattactgctttgtactttgtttattggatctataggaatccattttgataatgaaataggggaattaaccatattatcaaagtggctaactccctcaatcaactttttccaagaaagttctaattcttccataaattcatatgaatttatcactaatgcaatttcttctgtaagtctagctatttttggtctattcatagcatatatgttttatggatctgcttactctttttttcagaatttggatttaataaattcctttgtaaaagggggtccgaaaaagtattttttccatcaactaaaaaaaaagatatatagttggtcatataatcgcggttatatagatattttctatactaggacctttaccttgggtataagaggattaaccgaactaacgcagtttttcgacaagggtgtcattgatggaattaccaatggagtaggtcttgctagtttttgtataggagaagaaattaaatatgtagggggaggtcgaatttcgtcttatttattcttttttttatgttatgtatctgtgttcttattctttttctttcttaaggaattcccctatctcctgcctaagtagctttcctatttgccgattttttccattcctctgtgtaaatagcctaatatgggttcacaatcaataacatcttcaccatcgagagtaacgatcagtcgaagaacaccatgcattgatgggtgctgagggcccatattgactatcatgagatcttttcttgtaagcggtagactcatatcctttcttccttaattcattattccatgaaaatggattattccatgaattcctcaaaacgaggctcatcaaaatgcaaaatctaagactactataagactactaataaaataagaaaaaaaattcgaacgatgaaattaccgctccctaatatccaactgactgattaatttcttataacgtactctatttttctttgccaaataagccagcaa

SEQ ID NO: 38476 - DNA, 683 bp, Oryza sativa
  unsure (1)..(683): unsure at all n locations
tagtagcggcgagcgaaatgggagcagcctaaaccgtgaaaacggggttgtgggagagcaatacaagcgttgtgctgctaggcgaagcggttgagtgccgcaccctagatggctaaagtccagtagccgaaagcatcactagcttacgctctgacccgagtagcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaaatgagctcccaagcagtgggaggggaaagtgatctctgaccgcgtgcctgttgaagaatgagccggcgactcataggcagtggcttggttaagggaacggaacccaccggagccgtagcgaaagcgagtgcttcatagggcgattgtcactgcttatggacccgaacctgggtgatctatgccatgaaaaaaaaaaagcttggatgagagtgagcagaggtgccgagnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgttgaggcgcagcagttgactggacatctaggggtaaagcactgtttcggtgcgggctg

SEQ ID NO: 38477 - DNA, 1343 bp, Oryza sativa
agacctattgcaatgcagttcaagtatggccagaccaagattgtctatgcagagaactagagaagttaaggctgacagtggtacagtcaggcgtccctgctaacctgaccgtgcaacctacactggaatcgcaaatccaagaagctcagaaagatgatgaaggtataaaagagttaataaaaagaatacacgagaagaaagacaccagtttcaccatagatgaccaaggcatagtgtggtacggatcacgcatctgtgtaccagccaagaaagaattaaaagatatcattttaaaagaagcccatgagtccgcctactccattcatccaggaagtacaaaaatgtaccaggacattaagggatatttctggtgggctggaatgaagcgagatgtcacggaatatgtggctctgtgtgatatttgccaaagagttaaagcaaagcatcaaaggccagctaccgatccccgaatggaaatgggaagagatcggaatggatttcatcaccggtttgccaagaacccctagcgggtacgactccatctgggtaatcgtggatcgactcacgaaatcggctcatttcgtgccagtgaaaactacctttgatggaaataaactggcagaactctacatgacccatgtcgtatgtagatttggttgtcccaagaagattgtgtcagatcgaggcacttagttcacctcaaggttctggaagcagttgcatgaagctctcggaaccgatttaaattttagtatagcttaccatccgcagaccgatggtcagacagaaagagtaaatcagatcctagaagacatgcttcgtgcgtgtgccctggatttcgaaggcacttgggatcgttgtttgccgtatgccgagttctcctacaacaatagttatcaggccagcattcagatgtcgctgaatgaggcaatgttcggaagaaagtgctgcacccccttgtgctggaatgaggtcggggaagcactagtgtttggccccgacatactcaaggcagcagaagagcaagttaagctgatccgagaacatttgaagacagctcagaaccgccagaaaagttacaccgacaatcggagacgtgatctcgagtttgaaaaaggagatcatgtgtacctgcgggtatcacctctccgtggtatgaggaggtttgggatgtccagcaagttagcaccccgctacatcggcccctacctcataaccgccagacgtggcgaagtggcttatcagcttgagttacctgaaggtctcgcagatgtgcacaacgtgtttcacgtgtctcagttgaagaaatgtcttcgtgttccagaagaacaagttcccctggg

SEQ ID NO: 38478 - DNA, 1579 bp, Oryza sativa
cgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaagggaatcggtccttaagtgcgagagcgggaaaccgtacacccggtatgttcgccggtccgcggttttggaaattcatttagttcgcaagcaccgacccaggtgtcgggttttccaagtctgttgtaaaactccagttttacccaagttgttactcagattttaagtttgaaggcgaccgtcgatactcgcacagagtgcacgaatatcgaggcgcaactgggtggttacaaggggacatggtataacagttaacaaaggaaggatcaaatgtaacaaattaggtaggtctgccaatctgccttgcagacgggacaacagattaagtgtgatcctatcaatgcataatatttcggaagcaatataattaaattctaaatagaggctcaagatgttcaaaggtggctggccttgctcgagatccggagcttgatcctcgaaattctcgcactgcgggtcttcgggctccgaaactacacgcgaaacgggacaactcaacaaacggcgaaaataaagccctattaatgacctctaagcgtgccattagatagatctcgagatttgaggaattttggaagttgaacggagtcaatcggatttacggtgggaagatattgaatttctaagattattggatttttggtctaaaggaaaaaggatttatttaaatccttttttggaaaagaaaaagaaaagaagggagggagggaatatagacttttctcggacggctagggcgcggcccaagagaaatggagcggtctggccgagctaaatgggccggccggcccaaggcggcccaaactcgcgcgcgcgggagggaggagagagagagccggtggaccgggctcaccatgcgcggtcccgggtgggacccgcttgtcagtggctcggctcaccgggcggagggagcacgcgacgcacgcgcgcgggcggggaagggacgcggtgcatgcgcgcggtccgcggtggacgcaggtgcggcgggcccacgcgcagcctcacggctcgcggtggaacgcgcgcacggggagggattgaccggggtcggctcgatccggtctaggctgagctggcgccgacgtggtgcctacgtggctgccacgcgggccggcgggaggtagacgacgacccggctgcgaatggacggcgggcggcggtggcgagcggcggtgcgaaccacggtgatacgggcaaaagcgtgcacaccgggcggttgcacgtgacaaggggagacgagccaacggctcggattcgtcggaggttgctcgacggcggcggattgcggcggcggcaaccggcggcgagagaagagggaaacggcgacgaggtcacgagagaccgattcccggcggtgagagcatccacgcgaccacgggaa

SEQ ID NO: 38479 - DNA, 25966 bp, Oryza sativa
gaatttacaatagtcagaaccactttatccataccttaaatgcaaaagtgatatctgaactgtcaatttgaagcatcactctcctgagcttatcttctttggattgcccaagcttcatgaatccctacaatgtaaattccataaatacttgatatgttttgaatttctttccatttctttggattggccttacttcatgtttgcatacctgatcactcaaaaccatgcacatgtttgaaaattcaagcattccaactgctgggacttgggttgatctacaaatttctatgtatgatttattgagctgcaaaagggcattaaaatagattggttagaatattacaacatgtggctaacgagcgtgatctatcagaatgtctgtgaataaatattgaatattacctctcctagagtcgttgcctttttcttgcaatgatgaaaagtatttgccaatgcacacaataccatctgcggaatgtcattcgaggaaaatgaatacagcaaatttggaaaaagaatcgaggggaacaggagatggtaaatctgaatttacctgctgatgttggggaagacagagaatgctatctactacaggtgacttgaaagcctttgacaaagcaatgtccatgtggtcaaatgtcacctgtaatacttatattagacaacaggacactggaacaggaaagtaaattactgatcttgtgaaagaaatacaatgtggcaatgtttcatcatccaaacaaaagataaatttattttggcgaccagcgttagatccaggcaactaaaagcatgaaatacactgtcaatcgcttgtttagtagtacaacagtcatgcacatacaaatttctgtttggtggtaagtactacactagaatcatgttctagtggtctaccgactaccggccagaagaagtcaggcaaagagacacagatggacccaaccgcaaggaagctttacagttgaagcaactactgtgaacttgacttacatcaatgtagacatgaacaaaggtgatttcctttacaggaaccactttgttggttatacatgttacctatcaaaagatgatttccctcaaaagaaaaaaaaaagctatcaaaagacggcatgacttacaagtccaaattcttgatcagaagactcttgtaaccttgcttcaaaaacctctacagcgctcctggaataaataaaaattaagttatggactggcttaccttatgatggaacaacatgttagtgcaaaaacgtaatagttgtcactgcaagagaagtgggttacctgcaaacaccaagagcttttctcatgtctccagaggctgcagcgactttctggtataagaatattaagcaaacattgttaataagtgaacacgtcaatttcatgctaactgcaccatgatgttctccttaacaaaaaaaatacctatgctgccttgtgaactgacatatttcaaaatgaactagctacaaatgagtacttgggtagtaattggacttaccctagcacaaaattcaagggccagtggttcaaaaacatcatactcgagaacctatgtgtagtatcacaaaaggtaagcaacctatttaagtcaagtaattgaacacagatgtgcacgagccacagttggtcacatgataaacgaattaccttcagcctatgcttaattatgtcagatatttgatccttggaataagcacggaaagtcacaacaagtggtttgcctgtaaattagtgttataatgccaaagacatgttaatttctttcatacaatttatgttaacacttttcttgctagtatttggtaaatgcttacaatttaaggactcaagctttggaagaaaccgatccgctaggtctatagcatttgcaatacctgaaaaaatagcaccaattgtcgattggcaaaacagtattttgatattaacataattacaaaagtacaagaagcatcctttgacatctaacctatcagtatgcatcttgagaattggtaagtcgtaagcatgaaaagatcatgtagcacagcccggtctcttgttattaagtagtccatctcatccacaacgaccaacctacagaggagcagtaatatgaaaattgtgatgccaggaactaaatggcacgaaaaaggccaggttgtgaggatgggtactgggctcaagcagtccttacaacatccttcttggggctgattccttgtgggaaaacatggtttgaagttgctgaagtggtgacagtttgcaggttgccttcttccgagtctgaaacttcgcaagtatctgcatcaagaacttgtcagtgcctgtcagcattgcatagatatatcgagtcaataattaggcaacagtaaataccttactaaaaatttcatgcgtctttgctaggcttgtacaattgatcgataaggcatcaggtgtctccattccggtctacgaggacaaacaaccatatcaacaactacacactcctatttcaggaatcttacagaaccatgagaaattgaatttacctcgtctgcccaacgcgccacgctctccttaaccttgttaatcgacaaggtcttccctgtaccagggcacccgcacacatacaggctccctgaacgctcctgctccacgcaacccttgcagaactcaagcacgcgactctgctcatcatctcggcagaccaatccgcaagagggcaccgtagccacgtgaagcgcctccttgaccacctgcatctgagcgggatctgcagaacagatgaattctttcgtcagatcccaatcagaactctgagccctactgaaatgggattctggagacttgcctcgaggattccacttgggcttctcggccgcgacgaagtcgccgtaaagccgcttcctagatgacctgggcgacgccgagagcagcttcggggtgccaacctgcaagatcgagcaattgctcctcattgcaacagaataccaggtaatatgcagcagcagcagcagcacgccagcatctgcatagtcctgcactagagatcgaggggaggtgggggacttacgattccgacattgggggatttgtggggggatgtgaactgagacgcgtcgggtgaccctgcggctcggcgagggctcgtgaggcgccgcttggcgcttcgtggggtggcgattgccgtcggcgaggccgtgcccgccgttgacgcgctcgctgtggcgctgcgaagcgtcggcatcgagagagagagagagagagagagagagagactgtgggatcggaggcgggagagatttgggagggaaattggggaggaattgtttgtgggggatggggcgagaggtgggcgacaagaaaaagggcgcggtggtggagagtggcgcgagagccaagcccgccaaagggtttcccaccctcgcgcgggaacgacacgaaagtgtgaaagggcgcgttgaaaattttggggaccgcttaatgcttcgcgggtatgggtcccccggaagcgcatcgtctgccgtcgtaactataacggcacgtctgccgtcgtaactataacggcacggccatgccgttggcaaatcctgatcgttccttttctttggacgattaggatttagaaggatccaaataccaggcctgcaagtccatttcagcccactaaccaatcggctggtgtggcaatataggcgttgcaaccttctgacgcgagagaaatggcgcgcggcaagcagataacttggcgccaatttcacccattcattttagaggatagaaacctatagaaatcagttttcacctttctctccaaagggtctgatgccatctcttgatcgagagtttcaagaggccaaagtatatgcaagcaagatctgagttaaagaaatgtcttcactggataattctgaagatcgaggtaccccaacaacaacagagactccaaataagtaagtcatattatcatcttcatctgtaatacatataattagttctcctatgattaaaacaatattacaattgattgaagcaatgagattgagggagatcagacgctagtacgaaagcaatcgctgcaagaaaaacctgctccttctgagtcatcaaacttgtgagtgccatatcaggatctgattcatagttccatatgtaccatctaaatccagtccgaccatttcatttcatatcttacattaatcatgtttggtaaaataagaagcgatgccatgttttgcagcacaaataacacaccttcttggatacctcgaataggcatgaattttagttgtgctgatgaggcttggaacttttgggtattctatggaggtcaagtaggattcaatgctaggaagaagtatgagaacacaagtaaaattgacaaggtagttacatcatgtagatttgtatgttccaatcagggctaccgagcacaggacaagagagatcacttgacaaaacttccccgagctgagacaagaacaggttgtgatgcccgaatgggaattaccttagatagggattctggtctttacaccttgcatgatttatctattgaacacaaccacatgctccaactaccagagacaagtcatctaatgtcttcacaacggaagatttctaaagcacaagctactgaaattgaattggccgatgattctggaatcagtcccaaaccctctagcttcgtctcttccattttctgctcatgcatgcgtgcttgacttctctgattacagcaaccatagctgcgtactgttgccaatgcttccaggactgattgctgctagcaacaggagccaaattaattgacaaaaatgatgggaagcaaacctgggtaatatcagggagcttattgctgttattggcagcaaaaatttatggttgaagccactgaatcggcgctcctgctttgcagtgattgagagatgcgtggagagagagacagaggtgagagatgaagatggggaaagtgaaatcgataaaaaaaagcatcgggacttctctcgcgtcagaaggttgcggcgcctatattgccgcaccagccgattggttagtgggcttgaatgaacttgcaggcctggtatttggatccttctaaatcctaatcgtccaaagaaaaggaacgatcaggatttgccaacggcatgaccgtgccgttatagttacgacggcagacgatgcgctccctcctctcagtgagacggttacagtgtacgggttcatacctgtacccattcgcccgctcatcaaagagcggctactcccttcgaaatggcgagttgtgccgcacgcgccgccgccgccgcggatagcagcctggggatcagccgcctgcgcccctgtggctgggagtcggaggccggagatggagtaggagcgctggagcgggcgtcgggcaatcggaggagaggtcagccccggcggtcggcggcgacgtctcctcgaggctcggtcaggaccgagcgaggccaggccagcgtcgacgtcaagcaagcacgaacaggaggtgaggagcgcaggaggctggagcgtcgtcggacatcggcctggcggccggcggcgggcgagtcgggggctcgcgggcccgagtgtcaactgtcaagttggctatgtgacctaggttacaaagatgagcatcagatgtgctgctagtgggccgtgggccgtgggccagttggctagggaagaccgttgggccagttggaatcgtgtttttataggcctggcaactctgtcaactacatctctactatttaaaaaattaaaaggtgtttccatcgtctaaaaattaaaaggtgtttccgtcgtccgtccgtgaaaaagggcaaaaaaaaaaaaaaggtgaaaaaaaatcaaatccggttgcatcataataaggcaaaaaaaaagcaaaaaaaaaattcatacaaaattcaatcggacaacaagcgattgagaaaaaaaaagggaagaaaaataaaaacatcaccgagaagccaccaacgccgtcgtcgccaccgaatccgaccacggggcgtcgtcggatcccctcggccgtcgccactactgccggattcatccacgaccaccgccgacgccaccaccgtcgccagaggaagaagagaggcgacggagggagctgtcgctgccaaatccgcaagcggtagccgccaccaccgacagatccacccgcggaggctgacgacatcgtcgtcgccgtcgacgtcgccggatcttgagggtggagaaggcgtcatcaccgagagggagggacgggcattgaggcaatgaggagagggaaagggagagggggagggacgagtgtcaccgtgcgttatcaccgccgtaccccgctgtcgccgcgccttgccagcgagacaggagggagagggggagagggagtggcgccgccggagtggagaagggaggggaagggaagcggcgccgctggaggggtgaagggagagtcggcgccggtgaggggagggggagaggccgcgtcgtgcggggaggcggccggcggtgggaggggggatgggggatggctgagccgatcggggagggggagagggagggttagggttagggttttgattgattggaactgatctgagccatccatcaaaacaaacggctcggattgatcgagcgttgggctggcctacatcaccggaccgcaccatttgggccacacgtgggccgatggtccaacacatttttggttacggcccgcacggcaagtgaggagtgtggggatattatgtagactttggtcgcttgcaggctgaagaaaaaaataggctgaaaatggctcatagagaaagaatgatttttatttaaataaatgcttaaatgatgtttgtattatcaaaattagcaattaagctcagtaaattccaagaaaatttcaaaaagtgtaattaatatggagaatttaatgaaaattaaatccaaccatatcattttatttctcacacttattttacttgtaaattaatttaattatatacctacctacttaaaaaatacccaaaatattccagaaaatttgtatttcatttaattataatttaatatgttgtaattcaattttctcttttttttctttccgtggcaatgcacgggcagttttgctagttattcatagaaggaaataatagttaattttactctcttgaactatttgatttgagaaattatctatttataaactgttttttcctcattaccagtaaactataaaatatgatccattttactgcttagtagattttttactctttgtatcttcttttcatgttgatttttgagttgtatttttttaagccaacgatgacactattactaaagctcaaaaatattttcaaacattttcatgactatttgtttggacttagaaatctcgatgtttaaattaatcttagatgcttccaacctatataaacaggtttagaaaaaaaaagttcttagaaaaatgtttagaggcagggtgtattgcacgtcccaaactttgtcatttaggtgcaaacacaacgccttagtcacgtgagcatgtggcatacaacatcaaaggtaatcaccttttactgacgtggcgactatatggcggtgttgacttggtcctcgtcatacgtagcgccatgtggtgaccacataagcgtcatgtcaacaccacgtaggacgaagatcatgtcaacaccacgtcagcgaaaccaccctccaaaatcgtcgagggagtcaagttacaccggttttaatagttggaggtcaagatattgtggtttaaggatacgaattagatttgatcactagttaagggactcaaagtgaacttattaaaaaaaaaggtgtttggacttagcttcggcttggtcttttaggttgggactaggctcaaacctgactttttagcttgagctagggtgcacaattctatttgaatttcttccgtaattcgaagctcccggaaccacttggttttataaaatcctttatcgaaattcttcatatcaatgggcttgtattttgaccctaaacgaaattgtgaaccttggtgtagtaaaaatggcttcagtgatgtctgaaactaagggtagatactcgacgtaatgtctgcttggaagcataaaccaatgattttcatagtaccctacgcaatacagtaccgtgcgaattggactagtcttcaaatcaaaccagataagatcatgagctgccatgtacggtgaaacggttgccagctcgtcggcttggtcatctcagccggcgcgcaccgatgaccgatgccccctcgcagcatatggccgagctgggcatcgcacatgatgggcctcgtctaatcccgtagtgcgccgcggcccgtgcggcacgccatgtgcgacgaggcctccccttatctggaacgccgaaaactgaaagcccttgtgccccacacacacaccgccgaacttctgtcgttagccttctttccttcgtccgacccagatcccgcatcacgagaaggcgcgtcggctaggggacggaacggagaaaacgaatgtcgcgtttgcaccggcgcaatccaatcccaaccccagttgccgccgtcgccagcacaagtacgccagtcggtcacaccgcaccactacgctgcgctgtgcagccgacgcgcatcggctcatgcacagcacgcaccctcggagtcgcggaccggggtaaactcgtgagaacgctcgccaaccgctagctgtcacccgcgtgtgccggcgtgcgtcgcgtccggcaacagcgggttaaccggcgaggcgcgcgcctcctcgctcgtggcggggcgtccctgtctcccctcagcctagacacgtcgccctcgatcggtgatcgagtgatcgacgtacgggacaccggggccgcgatcggatcggttttcttgggagatcgagagctctttttcacgacagcgacggacgtgcgtttgcgtgaaagtcttgtccgcctagaaacttaacgagctaatcctggtgacggattggtcagatactcggatcgggtcgtggacgtttaccggccggtcgtccttgtccattcgttattcgtactagcgcgcaggcggcaaggaagggaggcgtcggaggccggctggtcagctactactaccttcgtaagctcttatccggaaatcatgatgagatgttattggtggccataatcttggccccgtatcggcatggacccggcctcccttcccagacgtcacgactcacgcgccggagcccagccgttgatgcacgaattatggccctcgacgaaacgaccgtgacgggttttaatggcgggttcatgcacatgcacgagcacgctcgttgccagttgggatcatgcaccaccctcggtataaagaggggtcaatgttatccacaatgcagttgtagcggctgttcgcggttcatgggttgagaggcgagtactctcggagtcagagagaaaccgatctgaatttttcgcatgcccgtttccttcattgagtaaactaatcccttgaaaacaaataccatatgatgtctctatacgtttgaggtaatcatttgaactcgcatgcacagttatgtatactgaaacgttgcgtaactgaacaaaatcagtcggtgcacgtcatatgctctgtcgcacagggtaacttaggcaggtaatctgccgaccttacatgcttttcatctcgcgtacgagcacgtcttcttcagctaaaaagcctcaacccgtccccagctagcctgtatcgatctccatctctcctggatatgcacaaaaacctattctcaacctcccattcctccggtcaacttaaaaaaaaaaacgcattcgtacttatcgcgaaaataccaatcctccaaaattgaattaatttacgccactaactaaacagcacaggtcgtcgtggaatatactaggtcaaccaatatgaaaatccactcgagcgataagcaccgcgaatagcaaggcgacacatggcaaaacacggcgcttccctcccaaatcaacgcattacgcatatccacccaaccttcttggttgcttcggctactgccggttctgactagtaggaggctggggagcagggccgcgcggtgtctcggcgcgtacgccgtcaaagttcggcagcgctcgcggacggccgggcgggcggtcgtccggcaaatccacgccacgaccgctgaattttcggtcgcggcggcgatcgacccgctggtggaatttgagcgtgggtgacggtggaatttgagcgtgggtgatgggctaggtgcacgtcgtatcagcattgcattgcgacgccctactgaaattgatccggttgtttcgcactagccaatagacacacgactacacgagctgctgcctacttgggcttggtttagtgcgttacgacaagacaacttttttgctgagataattaggagagagatacttaggcgtcagtataaccgaaagttcacagtaagtgaagtagtaattgtgtagtgcatatgggattatttccaccgaccgtgcttaatttatggtttagaactgtcgaccccgtctataagtggtatcacacagtcgttttgagtatagtgtaaagaaggccatagcatgcagtctagattggttgtatttgtattcttacgtgctcaacaacccgagaagataaggagaaagctcagaaagacaactttaaacgctcactacatattacaaaattggttgacaagaacgtttggtgctaaataaaccgaagagggaaaactcagttgaggtcaactgcctatcctagatatctatcactaccgaaagccgggcggggcgaaactgcaaaagcctttcgatgaaagttacgtacgctcacgatatggaataacatataggaaaataacagagctacgacgtcgttcattgacgatattgccgacccaaaatcatcatacatgctgcgccgttcgcttcgggaactagtattccaatatagaatcatccacaagtataaaccacaagcaaagtagggcaagcgaacgaagttttcatttgatagtattcttttacgagactagcgagagaaacagagacgccgtttatccattcagcgaacctcgttcgtgccggcctacctagggtgggcaacgcaagtgcgcaacggatagagatgtccgcgttaagcattacatcgaatacaacgtcggcgtgagctgccccaacgcaagagaacatcgcgattcacgacgacctggacatcacgaggccacgagcgcatccgccgttcacagttcacacaactagaggtcacctctccttcatccggataagctcaagatctctttcttttctcactttgcacgattatttattgcctttctctgcgaacgccagccacaggcacagggcccggcccacccgcggtttccaaaattgaatttcgaatcacgctgcagcagcgtggcccacacgccatgctggcacgctccccttgtacagctgtaatactccacttccacctagcgcagcagtatataaagacgactcatctgctaattctcgaggccaaactcaaagacaagcgaggattagcgatcgataactggagggagtatacagttggaaaattcaaactagacgctgatcatatcgagggagagttcaactcaactggagcgcggagatggcaacgcccaagctgtcccctgtatcgccggtgcggccggaagataagcagcgcgcgtcctcctcgtcgtcgtcgggggcggtggctgcgcctctgagggtgcaggacgatacggcggtcgaggagtacgagcagtacctgcggcttccggagctcgcaaggctgtggaaggataggtgctgtccggagtgggccgacgagggcctcgtcaagccggcgctgcaggcgctggagatcaccttccgcttcatctccgtcgcgctctccgacccgcggggctacgccagccgccgcgagctcgcgcggcggctggaggcgctcgcggcaagggaggtggagctggtggccgcgctctgcgagggcgagcagtgcccgccgctggccgagctgagcgcgtccaaaggcgtgctcccgcgggagcggagcgcgtctgaggtgtggaagattcccggtagcgccgccgcggtggtgtgccaggtcagcgaggccagcctgctcccgcggctcgccgcttgggacaagtccgagaccgtggcggccaggatcaagtacgccatcgagagccagatgcagggctgcgtgttcaccctcggcctcggcgagcccaacctcgccggcaagccggtgctcgagtacgaccgcgtcgtgaggccgcacgagctgcacgccctcaaggcgaagatcgcgccggagcccaagaccggctccgcaacaaggagaacgaggcgctgttcactatccaccagatactcgagtcctggctgtgcgcggcctcacagcttctcacccgcctaaacaaccggatcgaagcaagaaactgggaggccgcggcgagcgactgctggatcctggaacgcgtctggaagctgctcgccgacgtcgaggacctgcacctgctgatggacccggacgacttcctgcggctcaagagccagctcgcaatacgggcggcaccgggctccgacgcgtcctcctgcttccgctccagggcgctgctgcacgtcgctaacgccacgagggacctcaagaagcgtgtgccatgtgtgcttggcgtcgaggtggaccccaacggcgggccgagggtgcaggaggcagccatgaggctgttccacagccggcggcgcggcgagggcgaggaggccggcaaggtggagctgctgcaggcgttccaggccgtggaggcggcggtgaggaggttcttcttcgcgtaccggcagctcgtggcggcggtgatgggcaccgcggagtcgtcgaccaaccgcgcgctgttctcgccggcggaggagatggaccccctggcgcagatgttcctcgagccgccctacttccccagcctcgacgccgccaagacgttcttggccgactactgggtacggcggatggccggtgacggtgactctgcttcgtccaggcgaagctgagcggcggaaatagtggcggatggatgccgccggaccctgaattttgcagtctttcaaggttgatgatacatttaatacatttatgatttatttctgtagggtagtggtcgcgttcatctttcagttcgagtaaatgttttattgggagacattttggtttagatttgattactagatggtaacgggaaaatgatctaggatcatatatttcaattagagtactgatgatgtatataatgctctgtaaatatgtttcaatggattatgtgtccgatattgataatgtttgatgtactacgaattgtttcaaaggaaaaattatttcctaatcagatagtagtattttttatatatgtttatatacctagttacagcaatgctctataaatgtaatcctggtgatgaatcaaatcaagaggatgtggctcaggccatcttttgagacttaagctgaccatgtcctaatagaagatttgagcggacttggtatatatggacatgagttagagtatgcaactaaaagtaacgaccgagctgtttatgtaatacttgcacatgacagatttggaagaacaatcaattaccccctcatcaacagagaaaaaaaaaggaagaaattccagcgactaatccggacatcacaaaaccgataaggtagaccatagaggaaaaaaacagcattcagccaaagatcattgtactgaagctatacaaccgcatttttacagcttatctaactgactaacatgccaactactacaggaagggttaaggaaggttcaaattaagtaggctgcttctagaatctagacgtgttagacacaatttcgccgttccttacgttcaaagaaccggtccaagtccaactagatatgaactagctagaccaccattttgtccagatcatcccggcaggtgcactgggcaacatgtattcgtcgagaccgcgtcaccagcacatgcctcccagtcagaggcagtctgagttcctcggtaggacgacccaaatggctaaaccagtgggcgattgcacgcaaatccattgtatctgcgcagctgggtataattcctcggattgcactagccggaaagggagatgaacaccatcagcatgcaaatgggcatacaaatacaacatgagttgtctattcatgtagtggtcgtaaaaaaaaaagaaaaagcaaaacactatatcaacattcaaaggattataaccttttcttttctcaattactgcataaaaggcacacttgcaaacacaccatcaacatgcgcccattcatttcaaggtactcccaaaaactctccgcaagcgtcgtcgccaaccttaaacgtatctacgtgtgtagaacgaagcacctttcatccctctgtcatatagtattacttttagaaatctccctgccatctttgatgaaccaaaaaggcctagtacgaaggaaaggagatcaaaagggcatatgggccatttctgacggtaaggcctaatttattgggcctacatgccagcatgtccaacagcaacatcatgactcacgatgccgacgaaattgaaggaataagttcatctgaagtcccttaacttgtcaatgaatccgattttcatccttcaaccagaaaaccagatataacagatcctcaactatcaaaaccggtgcaaatgagatccctcggtggtttacagcggttttggctgacgtggctagtttgactcggtcttcatctaaagtggcgttgacgtgacacttacgtggcagtttgatccgaaaaaataataaaaccaatgggactcacatgccagtttcacacacaaactaataaaaaatgatggggaccacatggaccccacatgctagtctactcacccctcatcttcttcctccgctcccctctcttcgtctcccttacgctgggaatgggccccagatacgagaagagcggccacaagacatctctctcttacgcgcgctcgctggtaggccaaggagctcgaggagggaggaaggatgtcgggaggggacacgaggtcgcctagctccttcctgtcgatcatcgcccttctctccgatggccgccacgagaaacccgctcttgccgccggcgcttagcatggcgcgcggatgcatgctgtccagcctcggcgctgctgcagaaggcggtaactaggcaacatgataaatcagtaactaggcaagctacaacaatgcaatcaagaccttcatcccagctcagttgccccaattgcatctaatttcaatccaaacaaatcaaggcatccacaagcgtagcatcttcgatctaaggataatgaataggaaccaaaaaaaagggcgaaccccttcttctgctcgggattactcgagcgcgacggcggcgccgacggccttgagcttggcggtgagcgccgggaggcctctccgccacactcgtcggcctccccgcatcctccctctccgctatctcatctccatcctcgtcatctcctgatgaggtggcggtgcgcggctctcgtagtcgtcatcgttgggcaaggagggagagggggccttcttgccgccggcttgctccgaccacaacggcaccaccgcccctgctctgccggccgaagaagggagaaacagataagtagggagaaacagagaggatagagatgatatgtggggtcacatgggatccactatattttattattttgtgtgaaactgacatgtgggccccatggttttattattatatttggatcacattgccacgtaagcgccacgccagcgcacgtcggacgaagacctggtcaaacgatccacataggcaccacgtcagtcaaaaccggagataaatactatcgagggacctcgattgcacggtttgataagttgaaggatgtgttgtatccggttttcaagactaaggatcatatttggcgacaaattgaggtatctagaatgaacttgtttcgaaattgaagcatctgatctaaaggatcgggcttcggcccagttaagatacatttagggccgattcaggaggcccgtttcccgtgaaaccaactttccggcaaggattgggccgtccccacgtggtttgggcctcccacataggacattgcactgaactcaggaaaaatctgtcatatcagtcagagttcggaatcagacggtgtcatggactatggagtggctggctactgcctactggttactaccatggtgtattggtgtgaaagatgctgaatgacacatttggcacttgaagttaatacgacaaatgttacaacttaactccagtagcagagtagtaataatagttaattaaggtactacaattattcgcctttattcccgggctacttccagcagtgaagtacgccgaggcagctagctgcatgcaatgcatgcatccttggctggcgcatcacgcgcgcaggcagccgtttgagtggttcggggagaggaactgaacagctttgctgcacgtcaaactcttgcgctctttttgtctgcgagccaacatttaaagcccagatagctgcgcaccatccgcggaagcaagcaaagactgtagtacatggagtagacgtaccaggtgctaccactttccacgctccaatacctcaacagtagtaaactacaaaattaaaagcatcttttcgaggaataggagtactaattttagggggaaaactatgaaatccacacattgatccatgcataaaaggtactagtacaacaagttaaagttcccacaccagtacaccacatggacaatgcaaagctcgaatgatcaccgaatgtaccaaacagaaatacaagaaaagcttaaacgcgcactgcagtcatacagtcaggtatgcattgtacttggagaaaggtaacaggagctgctaaaacaaaagataaatttattaaccgagcggtgatatggcattggcactggcactgcgaacctcacttgaacctggtcaggtcgagagtgacctcagcctcggacggcatcaggaactgcctggaggccatctggatgacgtcgacgtcgtcagggtcgccgctgccactgccgctgcttgggccagcttcactgtagtagccacctgcgttggcatggttgctggattggcaaccgaaatccaggctaaccgggtgggttcccgggaacgggtggtacaggctcaggcaagaagaatgcaggccctgatcaacgctaatcccttgctgctgctgctgctgcaccggcggtgccggcacatgcatcccatagtgcaggttgccctgcgggacgaacgggaggtagtacccctctcgctgatcgttgtaggcgttgaggtccggcgccagtgacatgttcaggttcatcgccgctagctgctgggtggtcggtccagccgggttacccaggccaaggtagatccccatttccgatgggttggtgccggtgggctcctgtgtggcaacggttggacctgcgctgaccgatccggcaccgtgcacaatgacgtcggaaggcggtgcaggcacggccggtggcggcggtgtggtctcaacggccgacgggtactggctgcggatgtactcttcaaggggggagagctgccccggcggtgaattcaccacttgcacgctcttcttcttcatccgacgcttcgacttcaggctccgcttagtcgcgttccaatggttcttgacagcattctccgaccggccagggaggcatcttgcgattactgaccaacggttcccataagtcttgtgtgcttcgatcagcatcctgtcgtcctcctcagtccagacgtccttctgcagtataaattgtacagtttttgaatactaatttcatccacgcaatcggcgacacaacacaagaaaatatgccctcgaaccttctaagatcggtagatagttggaataatttaaatctaagcagtacatttattaaggatagaaaaatatatctatatatgatcattaacggctaccatattcatgcagggtgttgtataacactgttgttgtttactccgtagttataaatcaagaagagatttaaccttataaaatgtaatacgcattaattgaagtaggtacaattttggacagatttgcctttgtttttttttcctgcagggacatgatgagtctgaatctttgatcttgtagcccaagatctactgattttctagtcctaaaaacatcatataaaacggaggctttggattactcggtgcctagaacattaagattagcatacacaacaaccgcaacaaaatgaattatttcgataatccctatgctagaatactgcttagcatgattttaatgtaaatctaaaaagaaatcacccctcaaaatcacatggatgaagaaacccccttagatctacataataatataggaatcaagaagttaagagtaaaaccttgatgtctgggcgcaaatgattggtccatctttcgcgacactgcttcccgatccgacctgggaggctctttgcaatcgttgcccacttacgatctccatggagtatcaccatttgtttgagaactctgaaaacaagttaacacatagatataaaaaatcttgttagtgagaaaaataaaatctcactagaagtcgattgatctattacttactcatcttcttgccttgtccatgctcctttgaacgacccagggttaccattgttgcccccaaatcgtgacgactgctgttgaggaacaacaacccctactggaacggtagccatggcgctatagctagctgctagggccccctctggcatcacaaagctagatggagctatgcctatccctgcaacaagaaaccccatgtccgggactgccatggtgatgggagcaccaccaggactttggtagtgggcaccggtgccatggctagagcttgcaaagtacatatgcggcatcccagatcccatcatcgtcggatcttggttgaggaaggagttacctgcagccgccatcaacttgttctttgaggttggaagcatagatttttgattgtgggtggaggattttctaggaaagacagaatgaggtcgattgagagaaagtcaataaggggatagaatagtgtgatggagacctgagtcctctctttatataggagaagagggaatgcatcagccgttcatctgtgaagtgatccaatggtcacaaatagagctagattataaccttccaggtctcttttaagctgtccgtatagcccaggaggttgtgtacaccaagtgcatgcaacgtttgaagaggtgagctggcagacaaaagggtgttgtcaatataaaattcatatcagtagtggcaatgagctgccagtaggataggcattgagcaaaggtatatggctgtatctgcatgccatgcaaagcactctagtgtacatcccatgccaggcatgaatatgaacgttgagtgtgtgtctaccaccatggttgatttggctacagtccttgagcatttaatccagtagtactgatcaagataccataagcaatgctgtaatgcatcaataggatggacggctgtttcaagagtccggccaatgttcaccaaagtatttaaacaggttaatcttattgtcatcacaaatttagaatttgttatcttcagaagtatcaagaattaaactataaaaatactgaatgttaactacccgcggatttaagcttttagaaatctggcgttttgatttcacatacgacaaagatttgtcgtattagtgaaactgcatactaaaaccgacatgtctaaatagggatatatattcaatgccgttacatatctagcagaataaccggtaattagtcgaggtaccgaagaaaaaacaaatgataaatggtgcatgataactactatctatgggataatacatcatatatatgctctaaagtaacgggtttatccttaaatttttggcattttgatgtcgattgtcccattctctctaagtgaaacgccaacaccaattcgtactagctaggttcatccatgtaagcaattgagcggcagccatctgataccaaaaagacaaaatagagataaaggaaccatagccattggatgaagaatgaccaatggagctaattggtcctcatgagtcatatccaaatgggagcggttgttcaaagactgattgataagtatataagaaaactagacgttggggcgccgtaatggcacgcctcctgattacttcatccaattacttcatttgctccttgtactttccaaggagaatgcttaaacgtatatgattaactacttaccacaaatgattagtacagtagcagcttgagccgtgacatctttaacttactaactaccattaaccctaggtaatcagtgttacacaacataacgttttacacaagctttcttagggcctgttttgtagagctccaactcccaaaatttagcttcaggagttgagtatggagtggagttgtggagctgcctaaacccaactacacctctctagttcattctatgagagcgcttcacctagctccgctcccattttaggtggagcagaaactatttggctgggctttagctccaaaaaagctggagctggagctgtgccaaacaggcccttagtacacggaagccttttagaagggccaaaacgtgtacaagattaaacaatttcagctagaaagctttcaccacataggctaacaatcatttggaaccacaaataaggaagaagtcaatatttattaaagaggattgtcttctagtttatgcaattgtgctaatcttgtgtaggtacataaacgggattctcagctgagaagtgaggaccaaactgagatgaacaagctcatttgttgtaaaggtcacttggagtatttggtcaccataatcatacattcattcatgggtgtccaatttgaaaaagtttcaatgtttgtgcagattttatttcttcatggatgccaactagtcagcgagtaactttatatgtgtggcatttgtagttgatgattgtactattgatgtactcgtagcaggtagcaacaaatatgatcaaaatggattcttttcatcataaggtaatggaaaacgattttctttatggaaaggatcagggaatcaatttgctggataaaaagagccttgaaattaatcgggtattagcacaactacagatttgatttttccatacgaggcctcccccaggctataaatggaccataactgaccccgcatgcaaaaaatcgctcccctggggggcggttcaaggccagtctgcggtaatgtattatcgcaagtggacctcttattgtgcaatgacccgcaccgagccactgacaccctctctccacctccctctctctagctatcccgtcctctctctctctctctctctctctctctctctcagcgtgcaatggcagagggcggcgaaggtcagccttccttctcctgctctcccatcacctttccccctccgctccgatggtgactgagcatggaggcaacggatcgacgacgatttctttgcctctcttgtagacccaccgctgactggccttgagaggggtggatccggcgatggcatggcaaagaggaggcggcagggaggttgagcgcagccacatgaggatggatgatgaggacattactcctttggatacgcaaaatacttctcatgttttcgtacaaggtccaatcactagagctcacacccgacaattgcatttataggtgagcttgttcctaagtacttcttcatgtgatttttaggaaagattgttacctaataattttattatgattaggaactatggagaagaacaaggagagaagctagaagatggacaagatcatcaagggcattcaagtcaatatggaggcccaaatcataccatgttcgagtctacctcgggctccctgagcagtctgtgcaaaaaatgtcgcacaagtcacattcggactccatcttcgacgttctacctatgtatggaaaggtaacaagaccgcctttccaatggacctggtctcacatcattccttcaaagtcaaatggaattgttgaaacacgtggcgtctagaatatgtacgggtgttgcatcaccgtcttttgggctgttgggccgtgtatcgtgttggaatcaaataaggatgcatccaggtgtccttgcctccttggtcgaccttagaacctatatatattgtagccactatcaagttagggttgggtttacttagattatttataccattccagtttcgtcgttcattgatttgtggaaccccaacttcgagttattaatcaatcatctgcatttgtgttgcaacctttcttgttcttgcttatgttttcaatttgcagcaacaaggtcaatcggtttcgacatggttgataaccagagaagacgtggtgctgcaattatagggttcggatagtgttgatcagaagcacgataatgtgtcaagtttccaccaaattgatagttttctctacttgacggaagatcaggcaccccgttgccatcaacagatctagtgcggtgaccttgggaggggcggggagtagtgaagagggtcgcatcgtgcctctctcttcagcctgtctcggtggcggcgatggcagtggaggtggcgcatccgcacgatggtggtggcgtcggccggatccggcggcgaagaagacggtggaggtggccagatcttcatttgttttatgtttgtttgtggatggagttcatgtttgtggatgtggatgaagtttatgtttgttcgcatttggtttttggttctgtttcaatttcaatttcaagtaatggattaatggattctgttgttgtcgtgatgaacttttggatctggatctagagctagggtttgtgagaggagaagggatttggggatattttgattttattttttcacccaaaaaacattatcgcagttggccgtcttaaccggtcatgttggataatcgattcacccatgcggctggatggacctacgataatctctattttcgtagacacttgtgggaaggcgggctgccattcgactgcgaaaataggttttggccgagaatgtaaaaacactttatgtagtagttgttaatagtgaaatttggtaagctccaaagtcatcatcggcctagagtcagtatcgacttcagagccatggaatcggccgatgggaattatcaagtcgccaatagtcggattcttagtagattcggttatgaaaattaatctactaaatgaagtttatctagaagtgaccgagttcaaggaggatgcggcatgtcaatttatctattaattaagaatagtctattagtttccttttatctttagggaagtatgtttagtgttcgataaggactttatgttttccttttatctttaggaaagtttctttcttatcctacaaggattagtatctacccatgggtatacatatatacacccggggttattgtaattgatctctcgatcaatactactctcggcgcatcgctaccttcttttctgaggttttacttatcaaccggcggaatttggcacttgacgcgggcctgcatcgattcagttcgatctccgacgaaggggtaagtcttacgttccatcggccctggtgaatctatcagctacattggtgttgttcaaagctgtatcgcttcgatctcttggatcactctagtttggttgatatatttgcctaccttatatctcaattctatctctaattgcattgtgtttagaaaagcatcagtttagttgggactgtcttggttatgtctgatcttctgtcttagccgatatatctctacaatcacaatgctgttataaatagacttgttatatccatcacattagacagatctatcggctcatcaagtattagattatcatatataatctcatgctgcatcggttaggtccgacctagtgttttatcgcggtactagccgataagttatctggacgttgcatcggcttacaaagattacatacaagttggatttagccgattgcaacaaaggtctcactgtttatctaaatcgattggattttatggcatcggacttttagccgatgtatatgctttaaccatcggatcagtacttatcctatcatattattattagccgattgatttctattggattatattatttttatatcttattatcatcagacgattgtctttatatcattgtctacattgaacatatagctgattgcttaaaaccctatcgacatcggctagaatcagcatcgactaatatcggctatcggctgatattactccattggcttgtcagccgatctgctgtttacatatcttgtcagctgcatgatcaaactgactggcacgcccgcatctcattaaaatcttggacatgcactggagctaagcagatctcctaggccagtgtgttttttttgcatcaatagtagtgtagataaatgggtgtcacgccctgattttcttttagaactttaaaaatcatttaataatttatttatataatttatttaatatgtaaatcaattaacaagtgaagtaaatgggaaaccatatatctgtcaagaccaaatttccatataattatgattaatcggtattccattgattgtttgtatcctctcagtccgacaactgtatttcattatccacaacactgactttatttagttttaagggaaaccaaagctaaaaactaaagagtcattggtatttccaaaggcatgttttaattaacatatattcttagtatgatcgatcgtcatgacaataagatccatttaattaattgttatatctttttgaagtgggaacttaatttatcagagcgacttattgggatagaatacggagtggaaggtattgatggatagattcctcattcctagcacagcatatgacattgcgtttttacattgcaaaatggggatggttagggtgataaaattgatggcccggtaagcccattagttgcgtaggactatgtggttggccagctttgggaataagtccagttcaactccttcaatatatgtctaatatgattcatctccctccaactattaaaacaggtacaatttgattctctcgacagtattgacggtggctttcattgatgtggctaattagcttggtctatccaactgagtcagcatgtgagacccgcatatcattctcactccccttccgttcttccccattcctctctttcccccttctctctctctctctcttccccctttggcccttcctcccatggctgtctcctcttgtccctcttctccacagcggcggcggtcgcggtgggactacaagcgggagcagtgacgggacgacgagaaggatcaacggcgggacgaagaacgggagcagcggcggctggcagtgagcgctcctcttctctctcccaccctggcatgcaacacgtaggctccctttcacaccagcttttgccgtggggaaggtacttttgtctcctctccttagcgatgacgtcagagagggacgattgcaatgagcaccgatcgggctctccccgtggcgccatctcatgctcccacgcacgccgccgcgacatgctcgatgaagaggctctcctgggcgtcgtcatcatccaggatttggctcccagggcgttcagggtgtgcttgccaagctgcgctcatggccaccacgtggtgtcacacctcctgactcccaggtggctccaggtctcgactcaccgccaccgcctagagctatgcatgggtcggccactgcctaggaacgcatgagtcgggagggcaagagaggagggaaaatgggaagttggaggtggcaaaggggactcccttcgcccttagccggcgcaccatgccacacctccctggagttcctccgtcaccgccgctctattgccaatgccccgcctccccgctaacg

SEQ ID NO: 38480 - DNA, 19373 bp, Oryza sativa
caacggtataaaagggacccctgggaggggtgcaaggcatcgaatctcatcgccaacacaccaccacagcctacaaagccagagcatacggagccaagtcaccgggggatttcgtcgagtctatcgattacgatctcgtcggtatcatcggatccatctactcctattgtattttgtggcttttccatattaatcccatgtaaaacttgactagggctattacctgataaggggtctgaaccagtaaaatccttgtcttctgttcgcttgatgtcgtattacgtagatcctcgttccaacgtaccccaataccctaatcatccggtctacgagtatcactcgtcgacatttatcataactgatagttgtagcgcccgttccgtcgtggcacctagcggaaaaactatctcttaaaaatcctaattgcgaaatctgtttctttgcttgttgtctagtgtccgtgccatctcagatctcaaatccccgatctatcgtcgagttcatcccgaatccaaatccttcctaaatcaaatccctccgcaaaagtctatttcgcctccctcgggttcgatgggccgaatccctctcggcccatctccccctccctccccggctctctctctctctctctctctccctctcccccgcactgcccgtacgctgcgcacgcgtgctcgtgagccgcgccgagccgagcgcccccccgccctcgctgctgtttcctgccgacgtcgcccaaatcgccgcgccgcccgttgcttcccgcgcgcgcgccatggtggccgaccggccagtcgccgccgccgtcagcgcctgcccgcgcctgccgctcgtgtcgtcgctccgctccaaaccgcccggccgtcatcgccgtcgtcacgacccggcccccgccactccacgcgctagcctccaagggacggaggcagagctcctcctccctctgctgcgtcgcccccgctccctcctccttttccccaaagaggcaaggggcaagctccctttctcccttcctttttccttttcccctccccgccggcgtcatccgtctctgttgccgttttggccgcgagcgccgagcgccagctcgtgccttgaccgcccaaggtcggtttccaaaccgacatcgtcgtcctataaaccaaggcgccctcccatcgattcctcctcccgttcgcttgccgccaccgcgccattgccgcccctctgactcgcctccgccgttcatcgccaagcaccgggagagccggtgcgttcgtggacgcggaagggaactccgggcgctcgccttcttcctcttccccggcctgaggccggagagatcactcccgtgccgtcggcccatcgtcactgcgccccgtccgcacggtagcgcatctccccgttctccctcctcaatccatctcctccccttagttttcggtagtagcatgtgtagcctccccgtagctagccggcgccaccccgaccgttgccgccgctcgctgtgtgctcgccgccgtcaccgcccgtgctccgtagcgcccgaccgtcgccggcctcgctcggcgtagctccgcctaatctgacgctagcaacggattcccgtagccgcgtagatgctctcaccgccgggaatcggccccttgtgacctcatcgccgtttcccccttccctcgccgccggttgccaccgccgcaatccgccgccgtcgagctccctccggcgaatccgagccgttggctcgtctcccctcgtctcatgcaaccatccggtgtgctcgctttcgcctgtatcgccgtggttcgccccgcctttcgcagccgccgtccgccgtccgttccggccgacgtcgtcgtctacctcccgccggcccgcgtggcagccatgtaggcgccacgtcggtgccagctcggccaagaccgggtcgagccgaccccggtcagccgctccctccggccccgctcgcgggcgcggtccaccgctagccgtgaggctgcgcgtgggcccgccgcatccgcgtcctccgcgaaccgcgcgcgtgcaccgcgtctctctccctgaaccctagcacgccccgcgtgcacctcgctcacggtgagccgagtcgccgacaagcgggtcccacccgggaccacgcggggtggacccagccccccggctctctctcccctccccgcccgcgcgcgcgccttgggccgccttcttgggccggccggcccattaagctcggccgagccgccccattctctcgggccgcgccctagccgcccgagggaagtctaatttccctccctccttcttttcttttcttttatttttcaaaaaggatttaaataaatccttttcctttagaccaaaaatccaataatcttagaaattcaatatcttcccaaccgtaaatccgtttgactccgtccaaacttccaaaattcctcaaatctcgagatctatctaatggcacgcttagaggtcaataatagggctttattttcgccgtttgttgagttgtcccgttttgcatgtagtttcggagcccgaagacccgcagtgcgaggatttcgaggatcaaggtcaagatctcgagcaaggcaagccacctttgaacatcttgagcctatatttgaacttaattatgttgcttgaaaaatattatgcattgataggatcgcacttaatctgcttgtcccgtctgcaaggcagatcggcggacctacctaatttgttgcatttgatccttcctttgttaattgttataccatgttcccttgtaaccacccagttgcgcctcggtaatcgtgcactctgcacgagtatcgacggtcgccttcaaacttaaaatctaaaaaacatcttgggtaaaacttgggttttacaaaagacttggaaaacccgacacctgggtcggtgcttgcgaactaaatgattttccaaaaccgtggaccggggaacgtaccgggtgtacggtttcccgctcttgcacttaaggaccatttccttagaatttcatccgaacataagacaagtacgaccacatgggtggaatgggacacccctggctgagtaactagcttattgggggagccatgatgctaagagacatgtggattcgccggggtgtgtcggggaggacccctgggcttcctggcacaatatggtctggacctaatctggtgttggtctgggacccctctcgttggcatatggtgaacctgtgtcggctttcgaaatgccttgtcatgaaagccttaaggtctctagtcgtggccgttctgcacggactggatgatccgggttagtaatgtcgtgtgggtaaagtgtacctcctctgcagaggttattaaaactgttcgaacagccgtgcccacggtcatgggcggatgtgaggtgattcctagcgtagttttgtttgactactgccttgtgaaatttgctgttgtggaatgggtttgatgtttggaaaatctgcggctgatgagatcagccaggcccgggtggccgtttgaaagctgttggccgggtgccaatcttaatcaattcaaaagactgatacattgcacatactccgaccggacgagacgcactgtctcatccgtgtcgtttgagaaacactcacctagttgtttcagaaaagagttcaaataaaatcaattgcaaaaacaacagcctttctttgaagcctgcattaaacacttatttcccatggcttgctgagtactcctgtactcacccttgctctatataaataacccccccagttgctgaagaagatgaagcggatcccgctgacgaggagttcttccaggagcaagccggctacgatgagttttagggtttcggcctagtccccaagtcgcgcctgtgatgtttggtccaagtcttggcttccgcttcccttttgtaatgcagttgtgagctcgggatctgtccgcagcccaacatgactgtactcctactctataataaagagacctctgttgctgtgatattctgttttcctgtgataccagcactgtttcctgggactggtatcgattaacaggttaatttggagcgtcacgggctagtcctggtcgggactagttcggggcgtgacaatagtctagtattttctaaaaaaaatcgctagcccaattgtcggggaggtagcatgcccctagcctcaggtgcagtaggtctcagtgacggcaacatgctcatgcggtagaaagatacagtggccctgacccagggaggggcggatgtgtcgtcctcaaccttgggtgtgacgggtctcaatggcggcgatgatgatgacaacaagcggcaagggcttggctttgaggttggggtcaacgagatggcgaagtcagatggccttgcggggaagagacctgctgcaacatggagacggttggaaacagagcttgaggtgacgccggatccacgtggagcttggggcggtgacagatccaactagagctcgggtccatttgtcgccatcttcatcacctcttctctccctccgcctctttgttcgcctctgcctcttccatttggcgctgcatgagctcgacggaaccaggccaaggttgatgctgcgggtagggtgacatgtcggtggcggattgtagttcttcagaggcgggcaagatttaggtgatggactgcggatggtgggcgagaggcaggcagagatcgatagcgaccgagatgagtcagggaagaggagaccaagagaggaagaagcataattgacatgtggactcccacaaattgttttgatttttttatgctgattggactaccacgcataagccatatatgaccaaaaccgttctcgagtgagtcatgggggctcatccggttttaaaagttgagtgtaaatgatgtctatttttgaattgatattgtaattcgtaccgtcgcaataattaagggaaacggtctccttaggaatatgttaattatcgtattatgacaacaccattttccatgtaagtacggtaaaatgagggaaacagtcggtagaacaataaaatcgtattcgtttccttctcttattttgtcactttctattattgcttccatggaaattttcgtcaccattttcacccatactcaaaagaatatgccaaagacacgaagttcgtagcaccataacagacaatccaaccaacttgaactattaacatgtgaggtatgtcgcctaaaaatgtctacacacctaagtcgaagcagcgactcgaatccaagaacacgcgcacaaggctcaagcaatgcatgtgaacgggaacgcgtccagatacagaataagtggacggaatttattctgaaccgagggaacaacgcaggatttgccgttaagctatgtttgacgttgcatgttttcaccgccgtggatttccgcgcgcaaccagtggctagcccacagacggcgacacctcattctcccttctcccctctcctctcgtcgccgtgggtccaatccctctccctcatcccccgtcggcggcgacggagactaaaacgacgacaacgccccgtcggcagcgacggggactgcaatgacgacaacggcggcggcgatggccgtgaggcggcgccacggcgctagcgaggagaagcagtcggacacagcgtgatgaggaagaagagggatggaagaaggaatgacatgtgggggccgcgtgggccccaccatttctctagctgacatgtgggacccgcgtggcccctgctatttgtaaatgattttttctatgtagctgacatttggggccaacgatttttattattttcaaggatagaattgtcacgtcagcgccacgtcaatgccacatgggactgtaagttcaagtgccttaaatttggttttggtgattaatgacaaatctaactatatgagactaatcatttttatgagcctttctttgactagtctcatttggatatgaaagtaaaaatgatgagaggtatgtattaaacttcacatattctaacttggtctctcttgtagatccaaaatatagtgtgagcttcctatttgatctttattgattatgtgcatatgcgttccttcatatccatatgtatgcacatcttgagggggagcttattctatattttgtttattataagatttctatcttgatttgaaatcatttttcatctcatctctctatattgtttatatcgggttattatccatcaccaaagagagaaaatattgaaagatcttcgattaaacaatttgtgtaattgttactttggtgatagatgataaaccgatgtttatgggattaacctctcttttgcataagttgtctactaggttatttcccgataatgagatgtggaagacatgcattcttttgtgatggaacttaatcatgacaagaatgaaatgcatggagataaaacgatatgtaccacttcttatctcctactttttgataggttcatatatatgatttctatgttattgatatataagtgtgagactaatgtttactcgaatgttatattatttagtctcatttacattgagaacatggagatcatgaaggtatatgttttatgttggtctacatcattagtacatatgccttctctatatgtataggataaacccccattggtcattctctaattatgcatacacttgaatctcttgtatatttatttgtatgcatatatttagggggagcaaatcctatacatttattgtgcatgttccagatccatgttgttcacctattatttatatcggatctttacacttgagcttgcatacgagtatatgacacttgtaatgttaatgaatactcaacaagcatatacatatctttcatatgcaaccggttggtcatcaagtgaaggatgacaaccgatttgttgagactaatgttctcctttgaggtgtgaaaaggaataggtcccactacgatgaggctaatgaatgacaccatgggttagtggtcaccaagccaaggacatcgtcatgttggtaagaatgaagtcaaacttgtgatgagaataaagtcttgacaaaggatggataagacctcggcataaacatggttcaaccggatggtcacaagtgttgatctcggctcaagcttgaccccaagatggatggcgcaaggcaaaggtataatgtagctaagaatattttcttagtcttttcccggtcttggtgtttggtgtagaccggatttgctagataggcgccgtactatcaagaggggtctatgaagcgagcttgtggatgaacttgtgccatattagtttatatgcatgtaggtgtattttgtgggcttgtctaaccaagtgtgatgagttttctcaagtcctaaaccaagagataagtgggcatgtccaataggagtgagtgacatcttgtgggtatgtccggtggatatcctttggagtgtgagccctttatccttgacttaagttgtgtttcttggatggatttttcatggtttggatggccctttgaataagctttccatagagtccaagaacgccgaattccgatacccgagtcaagagatatcgccgttttactaacggtcggttgagctgaaaagtgacatgcggtctgaccgtgggccttaggccggtctgaccaggtctgttagccggtctgaccggcatggtaaggccggtctgaccggccccactggtctattgcactgatctggtttttggtggcgatacagagccgccagagccgcaaccggtcagaccgagccgacggcggtctgaccgagccgtggatggtctgaccggccactacactgcggtcggaccggccaggttgagtgggctcaatgattgccctgtaacggctacttttatagccgttacaaagtagtccagtctgaccggcctcacaacggtggtctgaccggcagagcataaagttggggatttcggttccaacggctagttttggtggttgggggcatatatacccactccccagcagtaagggtaaggttttggcactccattgcattatcttgaatcctttcaagagctatcacacccttgtgcacttagtttatctagtgaggtgttagagagtgagttaagccaatccaagtgcattgcttcattgctagtgtggcacttgatcattctcggcaagcatcctagacttgttacccttggaggttgctgcctcctagacggcttgtggaggtgttgtccggtgacctctccgaggagattgtggaggaggtctggcgccgtttgtgagtggtttggagttcaccaccttcggagtgaaggaagaactaccctagtgatcgaggcttgggtagtcctctccgtgggccggctcccaccttgcccaccccttgacgaagggggcgtgcgatagcttcgtggttgagcggtggagttgggctcgcctcaacggggattaggaaaccggcgagtttccgaacctcggtgaaaaattcgttgtctcttgtctcatttatttattgcatttacatttgtgcaatttattttcatagagacatatttgagcccatatcacctaggtttacaaaacttaacttagttgcttagttaaccttgcacctcaccttgcctagcaacttaggttagttttgtttaagtgccattaagttttaaaaccgcctattcacccccctctagtcggcctccttgatcctacagggacgaagacatagtcaaaccagccacgtgggtgccacgttagccaaaactgccttccaaaccgccgagggatcttatttgcaccggacagttgagggaccggttgtatctggttttgggttgaaggacgaaaatcggattcggtgtaaagttaagggacctcaaatgaacttattactttccgttttgccttgctggcccatcaactaaggcccgataattccatatcgccatacgggccatgaagggaagagccgcacgccaaagcccactggagtaaaagttagccagcgagggaccccgaacccgcgacctgcggacccaactagggcggcacgccgccggccgccccaagggccaagaggcttcctccgcgagtccgcctccgcctctctcctcctcggccggcaacacgccatgatgacgccaacacgacggcggccgaccaatctacactcggagtccggcgaggtaactaaaacccctagttgctcttccctctctcggtacaatctaacacggcaagttcgagccgcgttttccagatctcgatttttattttttttgaaaccgagccagactttgctgatgttttaagcagagagaaagttatttacagatctcgaattctcgattccctgctgaaatagtctaggcaatttgatggagtactagtaacttcaccggatactctcaccaatacggcaaagttttgtacggtcgcccgtttcgtttgcaagtactccacttgtcgcctagtatatgttttctgccgggtcggccgaaaggaacggcgaccaaatttcattaagatggggacgcctagtatatgtgaagcagtcatttttcaccaagtattagcatcccctagtcctctctagtccttgaaatgcgtatttgaatgtgtggttgcccttccgcttgattgtgaagcttttccgtgtttggaaaaaaaaatacatgttgaaatttgttgatcattctgattttctcaacctaactcttatgcaattgcccgtatgaactgcaaggtttagtcagggcgcctgcgcctcgtttccctgttagttacaccggcccacaacttgcttagtttccatgtgagaatttgcttgcgaaaaagtgaaagtccttttcctccctgcttttgcctttcatttccttgtgacgatagacaagattttttccagtcgtgtgcttgttttggattattgcaacttttgtggataataaagccgctacttgtaagtaaacgaaaaaaaaatgttggctcagcatgaacacacgtttgttgttccttcaattttctttttgtaccaagatgtttcctgaagttagcatggcaagtaggaaatactgatctgtcttgacgttgattcttctatgaacattgtatcgatgaacatccaggttgcctccaatctgtcgcctctaatctgtatgcatcatcttaagcaaactatcacttctaatctttagctaaaatcgttaaaacgaccttttgttttctgtgttctgtggaggcttcaggcttgtatagttgtatttaggaccactgatcttaaaatcttcataacatatgtttatgagtacatttccttcattggaccaccaagcattaattttgataagcttttgcaatgcagtttttccatcactgtttctctataatttcattctcctatactacagaaactaccagctcattgagacaatgctaaagttatcctaaggagttgactgactagaaatttgtaatgtactacagttcgtgtagatttctattgggggatgcagaaccactattcctttcctctatggtactggcctgctcatatttgtaagtatgctacaattcttagactagaagacatgtgcctttcaacattctcgtggcattgaagaatacttgtttcacaatatcaacatctaacaaactgtctaacaactcaaggaaagggtaaagcatttggctacgagaagtttctgtttggagggtaatgtataagtgattctgtactaaaagaaaatagatcgtcgcgttgtttttctttaaagttgctagagagtgactgaagatttagagatcctctcattaatgtggaaaaatgagtagcaaagttagatggattaacaagggctcagtagttcgttttcatctgcgactctgcgtcgggtggagtaatactaatagatatgcgtaggcactatggaggggtcaaaaagtactattattaggacctccaatataacgccaaatagactcattactcctaaggacaaatgaacatacaaaagggataagcaaagcagaaatgatgggaaaaattacagtgagtgcgtaactcctgtatgtactcagaatttaatccttgctcagggttgagtcatttaattatgcatccttttgtgttgcagattcaccctgaacctgcaagttttcagtaatcagtttgcacgattactaagacttgttttaattgttatgctggtgcaacctagacctggtatatatgttgcccaacaatcatgtcataactgtgacatgtaaagagtgtccattatgaactgcttaatttgtcagcatgataacgaaattttgttttcttcccaacaaaaagttgggggcgtcactctttttccagtttcttcactgccaaggagcagagttaaaggtagacttggaaattgacagtgacatatcagaattcagagcataaatccaaacagcaatatttattatggttgttgaatgggtgctgatgtggaactaaagcaaacgatgccattagaagaactacaaaaatatctattagtttcttttcaaagaattcacaatactgttgctgcggtgattgagaattggggcaatgttcagaacagatggccttgatcatgtttgaatggagacgtcgattcatctcccagcttctcaactgactacatggcttcgataatgttcgaagatgggatccatagaggcgcaccatcgtgtatcagacatgttggatattactaagaagataataggagcagtattgcaaatttgccacatcgaaccaagtactgctgtaaaatttctatcttcattctgccgtatgttaaaaaatactctatcttgcagaataaacacaaatacgcaactcaagcaggtaagttgtaagagtttccctttctggtggagagtaaacttttgcagaggttcaactataccatattttctatcatgcggttcttcagatttcagtacagttgaaagttgccaaaacaccaccagaacatcagaaacaacgacggttgttgaatgagacgttgaagtttgcctttgtgcacattctgccgcaaaggatctgttcagccgcgagacctgtaagtatcacggtattatgagagaaaagaactcttttgagcattgtagtagtgttccttgaattttatttttcaattattccctattattttctgcaggtatgttttacttatttcagcttatggaggcctattcttttgagctaatcgttgacggattcccaagatcctaaatggtatgttttttgcaaaagactttcttcatcataatttctttgagaaatttttgcaacaaaatttccactttctaatattaaattcatttgtttgtgccccaaataattgtcataaactcagtttcatccatcatctatatagaaatggcctagtacagatacagttgctgtaatgcgctgcgcttgattttaagttgcttggaaaactaaaacttgtattcattataacttgttccattgttatggttaaggaaacatgttatctaactgtcatgcttctctcaattgtttcaaattcgggatgcaataatgtttttttacactgaagattaattttgaggaaaattgatggtggtttgcgttttactgtactactattactattacaattttggagtaaacaatgcaaatactagtgtttgtctaaccgaccacgtctttactctgttggttttacaaatgtatcataaaacatcatgacttgtgtagactttatactgcctctgttcctaaaatgttgtcgccattggtaactaatttagtttcgatccctaataattagatggttaggctacatgaaaatccctaaaatcccttatattttaggatcgggggagtacctactatatgcaactaataaggtagtatacccctgatatccatttctatcaccatccggttacatccccagcattcagtaaaaattcagcattcactgctacactacttatacacactggatgcagcagaaacgaaaaaagaataccatcttcttttcctgtccactctggcgtccggcctataggagatcttgaaatcataccgtgaggagtattgagcatgtgattctattgtggttgtgatgagcctgctgtttcagctgtctggtacttggttgactcttgcacctgctccatgacgaaggtaacgagtggctacgtacgccgtggccgtgctaatcaatgggcgagctctgtgaagaagctaactcccaaccaactattccaactcggttattaaagccaatggtaatcgcccaacgctgcatgctgcactttacccttgtaaaactgtgagcgttttcctttggtggatagaacagttgggatgcgatgcacggggaaaagggaattgcagacacgccagaaaggcagagacattgccggtatctatcacgtgaaaatgtgatgctgcaacttgtccgtcccatgtatgaattcaacattttgggtgagaaaacatgtttttgctgttgtttacgtagcttaccgcagggattacctcctgcgtgttagactgcaccagtcaagaaaacccactacgttacgtgaagctagcagcatcgatcgcactagtgtcgctctctggaagtaatagcctcttaagttagctgcgagctaagcctgcaattatacaccgtctccgcctccccttcccatgtcacaaccaaccttggatatattaactccctctcccgctgctccactccactcccacaccatcagcgagcacctagcggtcgcatcgctagctgccatctcctggtgagatccatcgagacgcccggcacgacgacgatggtgtcgcggaggttcaagcccgtggaggagtgcagctcggatgggaggtcggagcagacggtggccgccgacttcgacggcacgctggtcaggtcgcggagcgccttcccgtactacctcctcgtcgcgctcgaggccggcagcgtgctccgcgccgtcgtgctgctgctgtccgtgccgttcgtctacgtgacctacattttcttctccgagtcgctggccatcagcacgctggtgtacatctccgtggcggggctcaaggtgaggaacatcgagatggtggcgcggtcggtgctgcccaagttctacgcggaggacgtgcacccggagagctggagggtgttcaactccttcggcaagcggtacatcatcacggcgagccccaggatcatggtggagcacttcgccaagacgttcctcggcgccgacaaggtggtcgggacggagctggaggtcggcaagaacggcaaggccacggggttcatggtgaagcccggagtgctcgtgggcgaccacaagaggcaggccgtcgtcaaggagctacgcgacgcggtgcccgacgtcggcttgggcgacagggagacggatttcgacttcatgtccatatgcaaggtaaatttgacgccccctcaaactcattttttgctcatagtaatagtactgtcgtgttgattgttaattgcagtgatcaagtcctgcgacgaattagtagtagcactgccaattactggcaactacgaactggttagaccatcttgtacataaattccgtatagaatgctctgtttatttcggaattactgcattccaaacaagaaacatgaaaattggaattaagtatagtctccatcacacatattactttcataacgtggaattagcacatcagttacaattgatttttgctatgacgaagctatgaacaccgcctactataaattctgcaatctgtacaaacatgcagaggtttcagatcagagtagagtggtttcagatcagagtagagtatgccacagtggtcgagcacgcgaacagcaggggtgtatagtcattgtcaggccatttatgacactgatctgtagatgttgctcagcccattatgcgaaacccagtttaagcttcctgcactgaccggtcgctctgttccaccaacatccttaatcagtaaactaataataaggatcaaggtcattatcagaactcacaaaacgtctacgtcgcacatactagatcctcacctgaagcttaacaactcgaaagctcgagcaaatgatcagaaaaggaatctggaggcgggcagagccagagcatggaaggaagccgatggtttttactcgcccgtggcccgccggattgaatgcgtggattcactcatgccagtatgccacggtcgagtcagtccgtccggccggctggctggctccattatttacggttgtttggtgagaattcaagccttgtcccggccgcattgaaggagatcggccggctggcgcgtgagacatcagagctggtgctggctgtgcctgccagatccacggctgcccttgctttccctttctttcttcctttcttccagccggtaatgcagagaaccactgaaataaatactgccattcatggtcttgccccttctttcccttctccatgggacccgtctttctgtcactgccccgggggtataacgaatttctctcgtggaggggaaatcacccatttatgggcgccagtcttgcagttgttgcggtacagtaatcgctgtacttctttaccactgctctggtctactctcgcctattgattggctgatacacgtcaacttaaatccaacagtttaactccgaaaaaacataattttgattaagcatgtgaagatctgtcatctgtggaaccatcagtagtggactgtactgaattgtaatcgtggtaggatgtaggtttggcgtacatggcgagatgaacaagcatttatatattcgataaaataagaagtgatggtgatgctgtgatttttgcatcagtgaagtgtttgtaacatgcatgctgcgtgtctgtgcaggaggcctacctcgtgacatcaaggaagtacagcgcggtgcccaagaaccagctgctgagcccactcatcctccacgacggccgcctcgtgcagcgtccgacgccgctggtggcgctcgtcaccttcctgtggatgccgttcggcttcgcgctcgcgctcctccgcgtgtacgtcaacctgccactcccggagcggatcgtcttctacacctacaagctcatgggcatccgcctcatcgtgaagggcaacccgccgcctccccccaagaagggacatcctggcgtcctcttcgtctgcaaccaccgcaccgtgctcgacccggttgaggtcgccgtggcgctgcgccgcaaggtcagctgcgtcacgtacagcatctccaagttctcggagctcatctcgccgatcaaggccgtcgcgctgtcgcgggagcgcgagaaggacgccgagaacatccggcggctgctggaggagggcgacctggtgatctgccccgagggcaccacctgccgcgagccgttcctgctgcggttcagcgcgctcttcgccgagctcaccgaccgcatcgtgccggtggcgatcaacaccaaggagagcatgttccacggctccaccgtgcggggcttcaagctcatggacccctacttcttcttcatgaacccgcggccgacgtacgagatcaccttcctgaaccagctgcccaaggagctcacttgcagcggcggcaagtcgcccatcgaggtggccaactacatccagaagacgctcagcggccagctcggcttcgagtgcaccgccataacgcgcaaggagaagtacagcatactcgccgggaccgacggccgcgtcccttccaagaacaaggagaaggaaaagaactagcgagtcacagcctcctatcgatcggagtactccgtattcgcccagccgactagtgtcactcatggcttctatctattgtttacgatttattgttgtttttcaagaagttggtaaattacatattgtttccgagaaggatctccttggaaagaattcttttgcacttctttaataggtatcttctagctttaatagatagagatactcatacacatgtttaacgtcaggaggtatctctatattgaagaaaagtacttccattttaaaatgttactccctccatttcacaatgtaagtcattctatcatttctcatattcatattgatgttaatgaatttagacttgatgttaatgaatttagacatatatctatctaaattcattaacatcaatatgaatgtgggaaatgctagaatgacttacattgtgaaacggagaaagtatccaagtatcgaaccagatagaacttaattgctaatacaatatttgcaacaggctcttttgtgcaaatcagtatgcgatttctcgttttaatttctcccctcgtatgggccgaacagtttgataggccgaagaaagtaagccaatattagagtagtaacaaacaggatatggccttttgtgcagggaaaaagtccattatgatgctctcaactattgccggaatcagatataaccgtaaaaataatataaaggcatgtttgacagaactctatctcaacctcttctaaagtttgtttggcatagctctagctcaacgtctcctggaatacaagttcagccaaacagtttcagcgctacttaaaaagagagtggagtagctgaagtgttctcacaaaataaactagaaagatgaagtagtgtttagacatatccacaaccgattttcctatttcgcgctcgtgtgccataagcattgctcgcgcacaagcgcgcttgctcttgctgagccttgtgggccgctgtcagattcagagtccataaccaatattatgattagcatcaagtaattaatgtctccacgtggatagttttttataaccatggattagttatgtgctaaatttataactttaaactcaaaatttagaggaaaaaaagcataatttgaattttcaacttgaatttgaaacttttaacccgacttttgaaacactcaacttaaaactttaaaatatttaactcaaatgtcaaaactttcaaataaaaatttcaaaactgtcaattcaaattttaaacaactcaaaatttgaaacttttgcctcaaaatccaaagctttcaactccaaaatttaaaaaattcaacttaaaatttaaatctttcaagtaaactttttgaatatttcaagtaagatttaaaactttcaactcaaaatttaaaactttcaactccaaaatttgaaaaattcaattcaaaagttcaaaactttcaacataagttttgaaactttcaactccaaaattcaaaactttcaattcaaaacttaactttcaactctaaagttaaaactttcaagtcgactatgtattgcctactaatttagtagaaatgtcactgtttatgctaattgtgattacacgtgattagcgtaaaggggcacaggtacgtgcaacttgagatctcgacaaatttaagagttggagccctgccaaatagacccaaagactccctccactatcgaaaccggctcatttttcctttcttagcggtgtgggcgatgtttttatcctatgtagcacctatgtggtacattgacctagtctttaggacttgttcagacaatccccaagctagggggagggattagaaaggattgcgaaaatgctaatagcacgattagcttttttccttcctttttggcccgttgctaattttcggacgcgtggattttcgtcattggacttgtttgcgggtggtctatttttctttttttctggtttgtcttcctctgtttttgagcaggctgaatattaatagagctgtaatacaagcacaagggcctcatagtcaatacctttcattttttccgaattaatttttaaattcattttaaatttatatgtacaaactttgtacgtacagaaaaaaatgtataacaaatgaaacaacgaaacagttattgcattattgtgcattgcattactaacttgatgttgtattgaatgcatatacatgtaatatttgacaattttaatccatttccgaaccgagcttgcatcgactccgcatcatttccgacatcggaaataatctgcatccactcagaacccactttaaaaatatggcatatatgatcactatccatctgaatcttctccttttgcatccctgctattgtacatggccggttaacctcattatcagattcagctgaatctgtttctttttatgtgtagaaggtgtttggacttgaaatttctgatatatgatatgcacttttgtatcagtgttgtattattcttctaatttcttgaaactgtctgtgaaaattttgagtgggatgtgcaagggaatatgctcgtgcaagactgcctcaaacggattacggatgcatgcggttgcaaagcgcaagttccattgtaatgtccattactccagtctccattcaatataactagctgggtggcccgcgtaattgcgcggctagcaccca

SEQ ID NO: 38481 - DNA, 1773 bp, Oryza sativa
caggaaactcttttgctttcaacattctataaataaagacccaatcaactttgtcgtatgctttttcaaaatccaccttaaaaaggacaccactttgttttttctgatgtaaggagttaagaatttcatgcaggatcagcacaccttccattatgaatctatttttcagaaacgctgtctgattttttgagatgatatatgtcataatttctgtaatcctattcatgagcactttggttataatcttaaaactgacattcaggagacaaataggcctatatttttgaatttgagctgcatccttaattttcggaatcaaggtaataacaccaaaatttaatctatcaatgtcaaccaaccctttgtgatagtcattcaccaattttagaagatctcccttgatcagatcccaaaactgagtataaaactcaccaataaaaccgtctgggcctggagctttgtttttcttaagctcgaaaacaactattctgacctcttcctcactgaaaggtttggtcaacatcaccttgtgttcttccattattgttgtaacccctctcatatctagaaaaagtgtgttctgtttaggatgaccaaacaaatctttgtaaaagctagtaatataggttaacaacttctcttgcccttctatttcaccttcctcctgagttaaggaatgaatatagcttttcctttttctcccattggccttggcatggtagtattttgtattacaatctccctctaacaactcattttctttactcctttgaaaccatttaatcttttcttctctaatcacaaaattcagtttatcctccaactccttcctttcttctctatcttccttgctcatcccacatctttcaaccttcgcatccaaattttcaattttctcaagaatgctttctttttccctcctatatctcccctcccaattattattccaaccattaagttttttcctcaaagctctaaatcttttctgccatctctcaatactagatccataataattaattttccaaacactctccacaatttcttttaaatcttctctaagaaaccaactgagttcaaatttgaagctcttatgagtaatctttaagactccagtatctatgcgcaaaggattatgatctgaaatgcttctagttaaagtttttgccattgtgaggggatattccttttcccaatctgtgttcacaaaaattctgtccaatttttctaaagtgggattctcttgattgttacaccaagtaaactttctcccacctagaaagatttctctcaaattagcttgctctatgacagcattaaaaatgaaactccacctattataccctccagctttgtttttatcactttcctttctaataatattaaaatcaccacccatgactaaaggtttcatttgtttctgaataatgttagccagttcagtcaaaaacctatccttgtgtgcattttgggctgctccatatacagctatcaaatcccagcagaaattggtttgcatattgtcacgtcccaaaacgactctaaaatacatcctctaaattatgcctagaataattaaaatccgtgtgaaagcctccaacaattaaaatgtgcaaagttaaaagtcaaataaggcttggaggatttttgtatatttcctaaaagcctaaaatgcgtaaataaattttagtggaattttcagagcacaaataataattattaagaaataaacaaagttaaaatgattttataaaaagaaaagctctaaaaagt

SEQ ID NO: 38482 - DNA, 11773 bp, Oryza sativa
cggctgacgcgtgggacccacggtgcggcttagtttgtggctcagtctggttataaacaaaagtacacggatggagatggacgaagtcgggggtcgatggacatctctaggacaaatgaaggctacacaagctgcggcccggtagtcgagatgtcatggcacagggccggtgtcctgctgctaggggcgcagtcctgcatacctgtcccgggggttccggccgtaggtggggttgggtcggtactcttgtctatggctaggatgggttggaaactatgtcacatcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttggattaaggcatgttcgtgtgggttcacggccttgattaataatattgtatagctctggaatcatgtttacaaaatagctttgagcaactaagtgtcttttaatgctgtttactacaaaccctaaccctttatattataacccccttgtactcccttgcatttatcctgcacttgtgggtgtgtcttgttgagtacggtggttgtactcagtcttgctcaattttttcccaaaccaagaagaggagcccctggaagaagaaggctttggtgtctagctcgtgcctgccgtcaagcgcctgtggtcgtcgccctagtcttccactgtttctcgtttgtctttgtgtatgctgggccttcgccgcccatgtaataaattaactatttacgcttccgcttgataaactctgaaatgtatcaacttttggtgtaccttgcctcctgggacaaggaataatacacgcacgtaaggaacgcccgttgggttaattccggtcgtgacacatatcttgcaattcaattttaacatgaaaatctccttttgaaacagccaacatactcagtttgtcaatgttaattcctaccaaaaatcctcttgagtgacccatagccggcaaccactcccatttcatatttttgttaccacttagacctctcaatagaccagcagagaaatcctgctttatggactccataatcccaacaaaatcaatgtttttttccttaatcaaatcttgtaaatgactagttttttcaacctgacccattcctctaatattccaaaaaagtcctttcatttttttcctggtttttttattatattttttcctactcatctttggagtgaccttgaaaatctcaaggtttcctcttttgtttttatgcttactaccagaaaaatgagagcctttaagtaaagagtcaatgtgctccaaatcagagtcatatccctcagaagagcacaattcatcaagcaaattttccacagggaattctatctcagttttagattcacaattcttattcttcataacctcttgttcttttaaaaataaactaattctagcacattctaagtctttaatcaaagacaagtttgaatcaatattatcaatagcacagcctaagttaactcctaaaatactagccatatccataagggccacattagaatcttgaacaaaagaaggaatcaagtcctgacctttgttgatgaatgcattttgcgcttccttcctttcaatcgccacttcctgcaaatttcaatcgtcattttcaatcggcacctatcacgcttttaacgtcatgatagccagaaagaagaattctgagcaaggagcacaaatacggaacgactgccgtccacatcgcgagggatacatgtaatctgaagatgacaaagcctactcatgtcgccaactgttaaaggtcgcctgatctatgtcagtgtgcggctaatacgcagctactaatcaaaagcaatcattttgaagtgccatcatacgtcttattctttgtgtgttttttttttctctttgcaagaaataaaatcttgcaggtaacaactcttgcagaactatactaatttatgacaagttcagatcaagttgaggtagttcttgcaggtaacaaactcttgtagaactatactaatttatgacaggctcagatcaagttgaggtaatcaagcatttctggttctgcatttcagtgttcatgcggtagaaagtggattgagaagtggggagtattcaaactagcaaaggctacgggagttgcaccaatcacccaattttggttctgtgggcatatatatgcttcgttggagatatcgttcatatctttttagataatggaatgaaatagcatcccgacctttattcgaaagagttacagccaattattacaaactagcactctgtaagagtgaagttcaaatagaagcaaacacaccaaccaaactagacaaaataacattattccagtttattggtaaatctccatccatgattggcaaacagttgcataaccatcgtttcaaccttacgacatgcaacaattaagaaatctgcatcttcatcacacttttgtaactgtgcccacagacgaagccaatatgttgccttgaaaatgacctgcatataagtaatagtaggtgatttgtcaaaaaccctatcattcctactcagccacagtgcccaacacaaggcagaagctccaacaagtatcagtttgctctttttgtttatgactccttgaagccaatcatcaaaaatatgagatatgctaataggaatatataaaccaaaagaaaactgaactgccctccaaataaactttgtaaaatgacaatcaatgaacagatgttggatagtctcatttttcgtacaaaagcaacatcttaaattaccagtccaattccgtcttgctaaattatccttggttaacataactcccttaagcaaataccacataaagatcttgatcttaagcggcatcttgagtttccaaattaacttatttctgtcaatgtaaccattattaattaaggctaagtacattgatctaactgagaattggccattctgatgatagttccatctaaaatattgttcatatctaccaggccgcggaaaagaacatgacatgcaggcaaggatcaaaacaaaaccttctactggccataggttgatcgatcaggaagggagacggaatttctctgcaaccacacaaaatgctggatctctctttgatatctactgtttgtccgtaaactttccccaagtagattcactccatcccaaaatgattggagggcttgagcagtactaccaaaaatgttggtagaagagtaggacagcgcatctagacgagaagacacccttgctgaaagttcagaacagatacatggtaagctcggcgttttaaacctggttaatcggaagcactcactgatctagattgaaagacgcatgaatccaaccatgcgtatctaccttcgagttcaaaatctgggccatccaactgatactgtcgtgaatcagaacaacgcaatcgagccaacatcaaatcgttgctccagggcccatcaggaggaagagagcgaaacaatcaaaatcactgaggaaggaaagttacttgtacagaaacaatcaaaatcaacttgctgcaagggtgtgcacatctactttctgtttctttctctccctttcattccattacaagtagcacttcgatccttaattcgtctctgcctctctccagaaaaaagaagagtaatatgaatatatgcattctggtgtcattaataggcaccatgttcccgacataccactgtaaatatgaaaaaaaaaactgaagagtataattgggaggaggggagaagaaaaacaaccaccaggcgtctccgtcatcaacaaggagaggaaatccaagttatactcgtacagtgatggcgatgcaacttgcacaccctcgcttggcggctagccgtggctcacgtttccgctgtcgctcgcgcgacgccgaggcgaggcggggccgggccgcgggggtggcccaggcgcgacctaggactggtcctcgcggccgctcgccacaacgccgcccccgtctcgaccgtccaattcgggggcaaaccaccaaccgattccaccggggcgatcgaaatctcctccggcccgtttggccgggtcgatcccaacaccggctcgatgggaacgtggcgcccatcggggcccccctctcgacgccctcccaaccgtccgtccgctcgtaaacaccccccaccccccaggcccgagatattttccgttaccgtctcggcgtctagctaggcgcgccgtgtcgccactcgccagcgagcggaaaggtccgaatcggatgggtgcctttcgggaaaaaaaattgccgaaacgcgcgtgcgttccgaaccgtgctggtggttggtgccgtgatgaacgtacgaggtccgcttgctaggcgctatcatcagttcagcgtcagtgtcgcgatttgcaaggagaaagacagtattggtagaggtagaattttaactcaatcatttctacaaccggtgaactactaggacacggaataagagacgctaactggaggtatctccaaaaaatgtcagctcaggcgtcgagtagtgagccgcatcagcaccaccaccgtgttgcacgagagcagcaccggtggggaggagatgtgcaagcgtgaggccagagtggagtgaagcccatgcgcgacttcactgtacagatgagtccatgggcgaccatgggggcgggcatgacttgcctagcgcagtgtggtgaccgattgacaccgcggcttaatggcggacacgtgtgggacgggagccgcggagggagcaacaaaagcctcgaggcttcacagttgcagcgccaccgccgcagctgttggcacgtgaacagaggtggacacgtttgagagttgcttctggtctcttttttttttcttgttctttcaagttaaaccacgtgaaatgagctgaaatgtcgttctttactacatactgtacactgtactagctgctctggtcaagctttagccgattatgtacttcgtgtcaaacgatcagcaacttaaatggctatattgatgttttggatacaatatgcagtagcagttcttttagttatccataaataaatttttaaatgcttagtttaaaaatatttttaaaatagcacgtacagatttttcttgaaaaatatgaaacgtgctagccttttagcatgcacaaccatcaaagcataggccaaaaagcaaggcttgagaaaaccagaggcactacggtgcatcatccttccttgaaatggaattctatgctttggttccaaaaaataaaaatagtacttgaaagtacagaatataccggattttcaacatgcataactattaaaccaaagcctaagctataatttgacaaaaccaaagatattatgatacgccatcctcctttgaaaacgaacttgaatgctaaagcacgatacattcataatttcataaacttattagactattatagatttattataataaaaaactatggttaaagtcgtatattaaagactgtagaaagcctaaatgtcaaaagtaagtattgcattttcttctgaagggaaataaattttattgtacaatggcaatgtatagcggttaaaggtttcttgaattttctaatataaaaggaatggcccaaataaacaagttttttcctaaaataattctgagatgtctttctggaaagtatatttggcttttttgcacacttatgaataataagtaggagacaataagaaaaaagtcacagaaattcggggtggccatacccagcacacacgttgatgatgagagaggggagccgtacaggagagtgaggcggtctacggattcttcggccgcacactcatgcaatgcatccgggtggcacgcacgaaataaataggcaaggcctccctacacgctcttcgtcttctcccatcactcttcttccctcttcactcgctactgaacaccatctcatatttttgttcttgatttttttttctctcccccccccctccaaagtatatactgcttgccattcgtatctcgagtgtgtgagcgcctaattttggctcaagcctatattaaggaggggcgtaccgtatcgtttctattttgtttcgtgaaactggtgtcaccggtagcggcagtagcaggagtgctagatccttcacgagctgcgtgggggtggttgaccaggacacgcctcccggatcctgaaataaggccaccgctcgtttccccctccccctcttcctcttcctcttcctttgccaccccctcgcatttagccagcctcccacggttgtggagctgtgtgggccatttcccaaccgtcgctccggtgggtggccgggagggtggtcgctgcgacccatgggcatccaggtcgcggccgtgacgtcgtcgccatgcgccgtcacgacgtcgtcgtcgtcgtcgctgtcgccttcgtcgtctgccgccgcgacgacgtcgcggcggcatggcgttcttggaggtgtcaggctgtcgagagggcagtcgtcgctggctagctggagcgtcggtatgacccgccggcgcgccggcgggcaccagatggcaaggcgcgctctcagcgctagcattgacagcatcgggagcgacggcggggacgacgaggagttcttgcggaggattcaggagctggcggtggggctgcaccctggcgccgctggctgcgggtggccggcgagcgtggagcggagcgcgagcagcgtggggttgccgctgtcgctgcggatgctcaagcggaagaagcagcagcagcagcagcagggccggtgggacgagcggctgatcgactgcgccggcgagtccgcgcgcggcgcggtggggcgcgcgttctcgtcgatggtgctcatcatccgggagctgcagagcttcacgctgcagatgcggcaggcgctcttctacgaggacctgcagcgcgtgctcgcgcgcgtccacgccgagatgcacgcctccttcgtgtggctcttccagcacatcttctccggcacccccgccctcatggtctccgtgatgcttctgctcgccaacttcaccgtctactccatgggcgacagcgtcgcggccgccgccacgctcccgcctccccagccccccgcggcgactgtggcgatggtcgacacccagcacgcggagcagtctcattcccaccagcggttcgaccatgcctcgctcaagacgttgtccatcggccgaacggcctcggtgggtggcaacagcggcggcggcggcaaggtgcggccggtcgccggggcaaccggcgacggtcgctcggacgagtggtcaaatcggcaaagcggcgcggtgttgccgcaggatgcgtcacagggtacgccgggagctggcgcggaggaggccgtgcccgtgtcagaagcaatggccgtggaggagacagaggacgaactggtcatctggaaaaggatagccgatgaggctaccaggatgcaggcgagcgttcgcgccgaggcgctgatggacccggacacactggggcagctcgtggcgccggtggaggccaagctggacacggaggacacggcggagttcgcggcgacggaggagcggtacgagcgagccgtgtccgaggagccagacaactcgctgctgctgtccaactttgcccagttcctgtacacggtgcagcgcgaccacgatcggtgagttgctgcgcgccacgtcgccagccgttcgacgaaatggccgccggggcctcttggggttttacgggcgctgaccgaggtggtggttttgcgcggatgcagggcggagcactacttcaagcgggcggtgcgcgcggagccggcggacgcggaggcgatgggtcggtacgcgactttcctgtggaaagcgcgcaatgacctcgcggccgcggaggagacgtaccaggaggccatcgccgccgaacccagcaactcgcaccacgcggcagcctacgcgcacttcctctggaacacgggcggcgatgacacatgctaccccctcgactgatgcgcgtgcatgagccatgcctccgcgatccaacacctccctcccccaacaaaactcaacacacacaaaaagaagcaaaggatatttttttaccacactccaagaacaagacgcacttctccaccctgcacgtgcttggccgaccacgccgctacactacactacactactacgcgctagtagtacagattttttcttcttgtggttgctcgtctcgcggtgagccggtgagtaatattggggtgatccgcggcgtacgtgctgctgcttcccgttctggaaatccggcgagcggggcacttggccggaaacggcgggagccgcgctaaagctggtgtgatcgatcgagttcgctgctcgcggccctacgggtttgccagttgcgtttgcccgagggacccgtcctattggcacggatgctttgcggcgtcatggagagagatgagagtttgctgtgtttaccagtggagtgaatactgtaatacagtgcatagcagcaatccaatttgcaacctgtaattgtgcagacgaataagaggctctttttttccgcaccaactgcggcttgcacttaattttctcttcaactagcatggtagcacgcgcagattgtgcggctagcatcattatattttctctcatataatagcatatatgttttttcaatatattattcaaatatattaaaataacaacataattttaaattttgcaataacttgtaatattcatattgtattttatatacgtgttagttattaataatttttaatattaaattttagttatttgtaaattatatatattcctatatggactctagactcgtcttttaatatttctttttttaaattccgaattttcagtaaattgtatttctatatagactctaggctcttctttcaatattatttattttatttctgaatttttattatttctaattgtatttctacgtggactctaaactcatctttcaatattatttcatttttaatttcgaatttcagttacttctaaattgtattcctatattgactcttcttcccatgtttttcttaatctcaaattttagttatttgtaaattgtatttttatacggactcttaacttgtagcgcccgttccatcgtggcgcctagcggaaaaatttaaattctaagaaccctaattgcgaaatctgtttttttttcttgttgtcagtctccgtgccaatccctaatctcgaattcccgatctatcgtcaaattcaaatcccgaatccaaatccttcccaaatcaaattcctccgcaaaagtctattttgcctccctcaggttcggtgggccgatttcctcggcccatctctctctctcccccagctctcccctcgctttgcccgtgcgccgcgtgcatgtgcgcatgcgcgtgagccgacgccgagccgagctctccctctctctctcgttctcccgctctctctgcccgctccatccccggcaagctccccgcgtgccgttacctcgcgcgcgcgctcgcccgcgcagtcgtcgccgtcgtcagcagcttgctgcccgtgcctgcgccgtctggccccgcgccctgccgcgctgcgccgcctgcgccgcgccctgccctgcgagccagcgcgcgtccccgagccgcgccgcctgcatccgtccaaaaatcggaggcagcgcctcccgctcccatccctcttcctccccaaaccagcatagcgcgagccttctttctccccctccgtttcccgctttcctctctcggcccgacctctgctctccctccgctcggagctagcgccagggcagaggagcggccgcgccgcgccagcccgtcctccacgccgtttgaccgcgcccgtgaagcctatcccatcccctcgaagttccctcgccccctagtgccgcccaaggtcggtttccgaaccgacattgccgccctataaacccgagcccctccccaaaccaatctttcccattttcgccctcgccattgccgcgccctgccctgttcgccgtcgccgttcgtcgtcgcgcgtgtcggaggagccggcacgagcgaggacgcgtgacgtggactccgggcgcaccctctccttcctcttccccggcccgaggccagagcgatcacgccccgcgccgtcggccatcgtcactgcgccccttcaccccgcacggtagtgcctcctccccgttccccctcctcgttcctcctcttccccttagctttcggtagaagcttgtaaagcctccccgtagctagctggcgccgccctgactgctgccgccgctcgctgtgtgctcgccgccgtcgccgcccgtgcttcgtagcgcccgcacgtcgccggcctctctcgtagtgtctccgtctaatccgacggtagaaacggacaccggtggccgcgtagatgctctagtccggaggaattgaaccctagtcgcgtcgttgccgtttccttcttttctcgcagccggttgccgccgccgcaatccgccgccgtcgaactccctccggcgaatccgagccgttggctcgtctcccctcatctcgtgcaaccacccggtgtgctcgatttcgcctgtatcgccgtggttcgccccgccgttcgcagccgccgtccgccgtccgttccggccggcgccttcttcaaccttccgccggcccgtgtggcagccacataggtgccacgtcggcgccagctcggccaagaccgggtcaagccgaccccggtccgccgctcccctctgccccgctcgcacgcgcggtccaccgcgagccgtgaggctgcgcgtgggcccgccgcatccgcacccaccgcgagccgcgcgcgtgcaccgcgccccgctccaaaccctagcgccgcgtcacgtgctcctcctcacggtgagccgagccgccgacaagcaggtcccactcaggaccacacgagatggacccgaccctccggctccctctctcctcccctcccgcgcgtgccttgggccgccttctcaggccggccggcccattatgctcggccgagccgcccctttctctcgggccgcgccctagccgcccgagggaagtctgtttcccctccctctttcttttctttttcgaaagggtttaattaaatcctttttcctttagaccaaaaatccaataatcttagaaattcaatatcttctcaaccgtatgtccgtttgactccgttcaacttccaaaatttctcaaatcttgagatctatttaatggcacgtttagaggtcaataatagggctttattttcgccatttgttgagttgtcccgtttcgcgtgtagtttcggagcccgaagacccgcagtgcgaggatttcaaggatcaagctctcgagcaaggcaagtcacctttgatcatcttgcacctataatataaatctaagtacttcttttccgcaaatattgcatgaataagtttaacacaagtatttcggccgcgcttgcgagatagcctgccggccccaatcctaattgctgcaattaccctccttgaattattgaacacttaaaccacctttgtcaactgttgtgcttcgatgcacgggcctacaggcacgcgcatcggagcacctcccctcaaatttaaaacatccaacgatgggt

SEQ ID NO: 38483 - DNA, 4720 bp, Oryza sativa
attcctgcagcccgtcacctttgatcatcttgcacctataatttaaatctaagtacttcttttccgcaaatattgcatgaataagtttaacacaagtatttcggccgcggcttgcgagatagcctaccggccccaatcctaattgttgcaattaccctccttgaattattgaacacttgaaccacctttgtcaactgttgtgcttcgatgcacgggcctacaggcacgcgcatcggaacacctcccctcaaatttaaaacatccaacgatgggtaaaacttggggttttacaaaagacttggaaaacccgacacctgggtcggtgcttgcgaactaaaattaaatttccaaaatcgcggaccgggggacgtaccgggagtacggtttcccgctcttgcacttaaggaccgtttccttggaatttcatccgaacataaggcaagtgcgaccacatgggtggaatgggacacccctggctgagtaactagctaatcgggggaaccatgatggcaagagacatgtcgattcaacggggtggtgccggggggaacccccgggcttcctggcacagtatggtgtgggacctaacctgatatcggtctgggacccctctcgttggcatatggtgaacctgtgtcggctttcgaaatgccttgtcatgaaagcctcaaggtctccagacgtggccgttctgcacgggcggggtgatccgggttagtaatgtcatgtgggtaaagtgtaccccctctgcagaggttattaaactgttcgaacagccgtgcccacggtcatgggcggatgtgaggtgattcctagcgtagtttgactactgcttgtgaaattacttttatggaatgggttcaatgtttggaaaatctgcggctgatgggatcagccaggcccgggtggccgtttgaaagccgttggccgggtgccaaccttgaatcagttcaaagattgatacattgcacatactccgaccagacgagacgcactgtctcatccgtgtcgtttgagaagcactcacttagttgtttcaacaaggagtttaaataaaaccaattgcaaaaacaacagcatttcctttgaagcctgcattaaacacttaattcccatggcttgctgagtactcctgtactcacccttgctctatataaataatccccccccccagttgctgaagaaaatgatgtggatcctgctgatgaggagttcttccaggagcaagtcggctacgatgagttttagggttttggcctagttcccaagtcacgcctgtgatgaatggtccaagtcttggcttccgctttcccttttgtaatgcagttgtgagctcagcatctatccgcagcccaacatgattgtactcctactctgtaataaagagacctctgctgctgtgatattctgtcttcctgtgataccagcactgtttcctgggactggtatcgattaacatgttaatttggagcgtcacgggctagttccgttcagggctagttcggggcgtgacaaaagatggtatcagagcacaggcttggccctagggcgaaacccgacgtttaggatgaccctaaggatactaagttcaaaaactacttgctcaaaggcttctttttgctttctttattttcagtagtttattgctaaaatggttactgatcttttctccctctttcaaaattgtagatggtagtgaacgccagcttcagttcccatagttttggtgagggtcaccacgtcgctcagcttcgtgacctcgcccgcttccttggcttctcgtgtcccgagtacacggggtactctgtggaccgtgttccccctcgttgtgagctttcggtgtacctttaccctcgtggaggtatacacggggctggcctttgcccacaccacttcaatgtggccaggcccactctccagatcgtgtaccaggacctctcctggacagcacttcgtcgcttggtccacgactacagccaccgcctcgggggctctgccttccggcagctcccacgccttccttctggccgcactgacactaggtacccttgtccgtaccgcgagcctcagcctgtgctgactcgcatggttgagctttctgaggctcaagccacccagcacgacctactccttgaggcttaccgctctggaggcccgtctggccgaggagggtgtcacctcagttgacactgcgtcttgggactcaggccgcctctgccacgccagccacctgtcttcccacagctcccgcggctcctttcgcactcccagtggcccacgctcccccagctcgcgtgcgccgtactctccagtgtactctccctaccctcacccagttagcccttcctacactcctggtcacaccccagtcgcttctcccgccgtggcccacgctttatctgcactgcgcggaagcgtgttgttggttcttccactatgttccgctttgactacccagctcccccaccgccagcagctcgtgctgctgccggccctcgacaggttccgccggtctcttcgcgtcagccgatcgacgtctcttcgactgaggagccgactacaggaggcagccaggcaggcgaggagtagaggaggccgtcttcagcagttgtccgtgtgttaggccccttttgtgccaccgccacctctcttggagtcgtggcgaggtaatgcgtgcgtgtgtttgatgtgggtgttgtttggtagtctggttctcctaggtggtgtgcgtacagtcaagctcggcgtagctctgtgacttgtccacacccgttgtatcagatgtctttatgatttgagaaaaccagtttatgcctagtgtgtgctatctgagttgttatttattttgcttcttgtcttccttaagtgcttatctggttcttatctcgccccttttctgggagtttagatggctagccgcccccgtcgcgctgctcgtgcaccagcccgcttcggctttgaggaaggtagagttgagccagaagcagatcatgagtcagctaatgagcagtctcaccacagcaaccgttcgcaccgtaccgctccccgcaatgcagaagtcgagcaatcccaccgcagcaatcgctcgcatcacacagtttcccgtaattgtcacgaccggaattaacccaacgggcgttccttacgtgcgtgtattattccttgtcccaggaggcaaggtacaccaaaagttgatacatttcagagtttatcaagcggaagcgtaaatagttaatttattacatgggcggcgaaggcccagcacacacaaagacaaatgagaaacagcggaagactagggcgacgaccacaggcgcttgacggcaggcacgagctagacaccaaagccttcatcttccaggggctcctcttctgggtttgggaaaaattgagcaagactgagtacaaccactgaggaggtgcggggagggtttaaatagagttagaagggggagagggcggccggaggggaaggaaaccggcgcggcgctctcgggctccatcaatggcgccgtcgagatttgcgggggcaaatccgcccgtttgaacgcgagagagggaggggaaaatggggggaaagggagagggaatcacggggaataattcccccctattgattgcacgcggggaggacgggggcggcgggattcgcggcggcggcggcgctagggcgtgggcgaggcagcgggagcggcgggaggaaggggatgacgggtgggccccacccgtcagcgagggtggcgggcgggcccgcccgtcagtggcgcgcgcgcggggagaggccggatgggccgcggggagaggagagggagggggagggagatgggccgagccggcccgagagggagagggagggaaaggggtctttttagagtttttctttttataaaaccttttcaactttgtttatttcttaataattattatttgtgctctgaaaattccactaaaatttatttacgcattttaggcttttaggaaatatacaaaaaccctctaagccttgtttgacttttaactttgcacattttaattgttggaggctttcacacggattttaattattctaggcacaatttagaggatatattttagggtcgttttgggacgtgacagtaatgcagaagtggaacagtctcaccgctctcactgcactgccagtcacaattctggtgaagaacgcattccttcgccaccccatattcaaaataacatgcagcacttgatggcagttcagactcaaatcttgcaaggtttagccacagccatagccggtattcagcacaacgcgcatggaaatggccacccccacatgggcaacaacagatccaagcagacagactttctgaggtctcgtccgccagagttctctcagaccgtcgagcccgttgaggctgacgattggctgaaggatgtagagagaaaactcaacttagtgcagtgtactcctgttgagaagacgttctacgcctctcaccagctaagaggacctgctgcagattggtgggagaattattgcaatgcacatgtcgcgaccgagaaaatttgcattttcccgaacgctagtgtattaatccccgtcccaggaaaagccggggtacaccacacaaacatgatataaaagacacatctttattatatcgataatatttacattattacaaaggcacttaacgcctgccaatcaaaaataaacagcagcggactagcgggcctacgg

SEQ ID NO: 38484 - DNA, 14569 bp, Oryza sativa
ggatatcttcagatctgattttcagttggtggtaacctgacctcaagtcaatttttgagaaaactcttgctcctttaagttgatcgaataaatcgtcaatccgtggcaacgggtacttgttctttatagttacttcattcagggctctatagtcgattaccattctctccgagccatcctttttcttaaccagaagtactggggctccccaaggggatgagctaggtcgcacataacctttactttccagttcttcgatttgtcttttaacttctgctaactcattagctgccatttggtagggtctttttgcaattggagctgtgcctggtgccagttctatggcgaactcgatctctcggtctggtggcattcttgttaattcttccggaaatacgtcgggatattcacagactatgggcaccgactccaaggaggtgacttgtaaacaggttaggatagaccgacttgcggtaggggtgttaggggtaaagcggacttgctttcctccaggtccttgcaaggtgatggactttcggcacaatctatctgtcctttgtgcttagccaaccaatccatccctagaatgatgtccaagctttgcgagtctaggactatcggtttggctaggaagtcaacttcctcaattctaaggttaacttccgggcatatttgagttgcccttatattccttccaggggaatgtactatcattggtacacgcaaattttgggttttccaaccatttcttttcacaaaagcttgcgatatgaaagaatgggaagctcccgaatcgaacagaactattgcgggtacggagttgacagagaacatacccatcacaacgtctggagcatcctgagcggtttctgcttgaatgtgattcacacggcctcgaccaaagttgttggaagcacgtgaaccttgtccacttgcctgagagctaggacgagactgagctgccgctggagtaggagttctggcagtgctaccattagcatgccctgagttggtgttggtaggattctgaggacactgtctagcatagtgacccatctggttgcaccggaaacactgaactgctgacggtccctgcggtgacttgaaagaggtaacactgttaggcgcagtatcgctactaggggcacgctgctgtggctgaggtgccggacggtttatctgaggacgaggggcgtagcctggctggcggttagcctgggtgaccgactggtggtattgcatgggttgaccgtagcgagggcgaggtgcgcctcgggaagaatttccctgatggttagacttgcgtttcttgtattcttcggtagcctcttttctggcatcctcaagtagaagtgccttgttgatcatatgttgaaaagtggggaagtcatgagcaagcaactggagtctcattccaactgcgattcctttcaagaatttcctgatcttcttcttatctgtgtctacttcctcaggggcgtaccgagccaacttgttgaactgacttaggtactcattgacactgctgttgccttgcttaagtctgttgaattcttctttcttcatgtcaatagtgatttcaggcacatgagctgcacggaaagccgtagcgaactcatcccaagcaatgttagtgggttcagggtgtgcattgcagtaattctcccaccaatctgcggcaggtccacttagttggtgagaggcgtagagcgtcttctcaacaggagtacactgcactaagttgagttttctatcaacatctttcaaccaatcgtcagcctcgacgggctcgacggtctgagagaactctggcggacgagacctcagaaagtctgtcagcttggatctgttgttgcccatgtgagggtggccatttccatgcgcattatgctaaaaactggctatggctgtggttagtccttgcaagatttgtgtctgaactgccattaagtgttgcatgttggtttccacatgaggtggggaagggaggcgttcttctctagaattgtgactggcagtgcggtgagagcggtgagactgttccatctctgcatcacgggaaactgtgcaatgcgagcggctgctgcggcggggttgctcaacctctgcgttgcgggaaacagtacgatgcgaacggttgctgtggtgagactactcattagctgattcatgattttcttctggctgtcgcgaccgagaaaatttgcattttcccgaacgctagtgtattaatccccatcccaggaaaagccggggtacaccacacaaacatgatataaaagacacatctttattatatcgataatatttacattattacaaaggcacttcaggcctggcaatcaaaaataaacagcagcggactagcgggcctacggctccatcttcacaggcgctcaaccggggtataagccaggactccacctaagacatcttctccaaagcctctcttactgaagaggggaaagattgagcaagagtgagtacaaccacagtactcagcaagtcacaccggcagatgcatgattaatgcaagggggtacaaggggataataataggggttaagttttgcagtaaacagcatttaaaagtcacttagttgcccaaagctattttgtaaacacgatcctagagctatacaatattattaatcaaggccgtgaaccctcacgaacctgccttaacccaaggcctacgatgattcagaccgaactggcaacccgaccctgggtcccagctcgtcccaagccaacccaggccaaccattccacattttagttgttaagcaagttttaagaattaaaacactgacttgggtacattgctcggcttgcccataaccgagggtgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacccccgggacaggcaggcaggattgagccccctagcagcaggacaccagccctgtgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccgaaaaacaggttttaggggctttgaaagaggaagagaggggtatgtccaattccaccataagccaaccattccatagtgtccaaatgatatgagaattcccaaagtctaaagttataaaatcacctaatgttgcctaattaatcagcgaagcatctacctaaatttatactagtggaaccatgaatagagtacccactagttggggttttgtttattctagggtaaacaaggtaataataacaatagcaataataataaggccataacaaaggtaaataggcaaggctaaataaaacagtgataacgcgggaatttaaataaagcgataatgcattaatttaaatcaaaataattttataaactgggattcaatatgctcaaggatgatgtgacttgccttgctcgctttcccaaacgtcggcttcaacttccacgaagagcggatcttccgaagctgcagcgtctacacgaccaacggaaaagaaacggcttttactctaataaactccatataacaagcagaaacaaagcacaaaaatgggttcttgacttcttaaggaaaaattagagacttgaacggtccaattccgagttcaaatggccaagttatggccatttgaagtttatatgctatttaaatggatatttgcgaatttcttcatttaaattttaatttaaaatagatttattgcgtcagccgggagagaggagcgcgcggaccgggtccacgggagtggggcccacgcggcagcctctcggtccacggtggaccgggtgcacccggctcacaccggtcggcgccgtgggtcccacgcgtcagccgcacccgagggcacgggcggctgacggccgggccccacatggcagccgcggggcgcgcccgaaggcggccacgccggcacagccgacgggaggcggcgcacccgcgccccgatggtcgccgccggtgaccactggcgcggcggagcggcgcccgagagaggggagggaagggggaagcgaaacggcggtccacggctcaccccgggtcgacggcggcgacgggaacggcgaccggagcggaggaaggcggcggcgcggctcgggtcgacgaggacggcggcgttccggcggtcggcgggcaaaacggaggggtggacgaggtcggcgaggttgcggcgaacccgaagaaggtgacgccgaaacgggaggaggtccggggcgacgacggcggcggaccggagctcggcggcgacggcggagagagagagcgacggcgcgagctcgattccggcggagagagagagcggcgagaggcggaaccggacgaagggggtgcggggagggtttaaatagagccggggcgagagagggtggccggggaagggaggaaaccggcgcgggaggtcggccgccatcaatggcgccggcgggattaggggagcggtttccaaccgaatccgagggagagagggagggaaaaatggggggaaagagagggaatcacggggagtgatttccccctctttattgcgcgcggggacggcgggaggcggcgggattcgcagcggcggcggcgctagggcacgggcgaggcggcgggagcggcgggaggatagggatgacaggtgggccccacccgtcagcgagggtggcgggcgggcccgcccgtcagcggcgcgcgcgcggggagaggccgagtgggccgcggggaggaggagagagagggagggagatgggccgagccggcccaagtggggaagggggaaaaaaggactttttagggtttttcttttcataaaacctttttaactttgtttatttcttaataattattatttgtgctctgaaaattcaagtaaaatttgagggctccttttagaccaaggagaatttaacaaaaattctccgggccgcatttgaatttttcttgtacgtattttagtgtttgccaatttcttttcgaattttaattaattctattattccttttagcgaatgatttttaattcgggatgaatttatcaggacgtgacagcacacctcgaacccactaacattccatggaatgagttcgctacagctttccgtgtagctcatgtgcctgaaagtactattgacatgaagaaagaagaatttaacaggcttaagcaaggcaatagtcgtgtcaatgagtacctaagtcagttcaacaagttggctcggtactctcctgaggaagtggacacagacaagaagaagatcaggaagttcttgaaaggagtcacagttggaatgaggctccagttgcttgctcatgacttccccacttttcagcacatgatcaacaaggcacttatacttgaggatgccagaaaagaggcaaccgaagaatataagaaacgcaagtctaaccatcgggggaattcttcctgaggcgcacctcgccctcgctttggacaacccatgcaatatcaccagtcggtcactcaggctaaccgccagccaggctatgcccctcgtcctcagatgaaccatccggcacctcagccgcagcagcgtgccccaaatggcaatactgcagcaaatagtgttacctctttcaagtcaccgccaggactgtcagcagttcagtgtttccggtgcaacctgatgggtcactatgccagacagtgccctcagaatcctaccaacttgaactcagggcatgctaatggcagcactgccagaactcctactccagcagcagctcagtccagtcctagctcgcaggcaagtggacaaggttcccgtgcttccaacaactttggtcgaggccgggtgaaccacattcaagctgagaccgcttaggatgctccagacgttgtgatgggtatgttctctgtcaactccgtacccgcaatagttctgtttgattctggagcttcacattttttcatatcgcaagcttttgtgaaaagaaacggttgtgacggagcgtggggctcctcaccgggagaccgcgcaggcccccctttgccggttcggccgggggcgctaagtgaggttcttcgccctcgatctgaggaacgtcagcgagagaggaagtgcacaagacacgggcgacgtagacaggttcgggccgctgagaagcgtaacaccctactcctgtgttctggtggatctgtgagtgaaggaatacagagagccggagagccagagagagttcaggctctagaacccattcgctagagtcccaacccctttctcttttttctcctccccctttctctcctaggcctgggcctcctttttatctggtcaggggtcaccacaagggcctccaactacctaagaaaggaaacatgctttttacaatgagggctagtctacagccggaagtgacctctgacaagcagagcacacgcctcctgccccgctcgcccgcttttccggtggacgcccatttcaaccttcatttaatggccagcgacttccttgccatacttgcgctgaagcctggaatggatctgaccgggactgacataccaactccaggagttagcacgccggctccggctagggacgagagccaggaagctctcatcattccgacgggatggggcgaggcgtgtgacaggccgcctgttgccacctaacccgcgatctgaccgatctgtgaccggtcacacaccgcgaccggtcacggaccggataagcgtgcgctgcgccgcattaaatgcggcgtggcgcgctcgtccaacttgctataaatgcggttaggtgagcccgctgtgctcacctaacccacacacgtggcgccaaaaccacagggggtcggggcgccccagccctcggggccgaaacgggagcggcccgacccctcggggagacagagggaggggtggccacgtcaccctcgggctcgacccccccgagggggttaggccacgtgggtgaccgcggctacccaagcctctagtcacgatacccccggccccatgtcaccgacagtagcccccggcgtcacgccagggcaatcgcccccctcgagggaagcgctcgggcgtgacgccactccttaggcccggtgacaggtggggccggtccctacaggcgggcagaaacccagcggtcgcaaatcgcgcgcatcggcaaaggaaaaccgaccgacaataatgagcggcctctttaagaccgctacattactcgagcagcgcgcgaatcgggacgagccggttcgtttcgcctggagacatgatgatggcgcttttcacggttggcgggcgtagttaatgcgcgcacaatctgccccatctcaaccgctacggccgcacatctgccgcgtgcgccgcaaacgggcgagtggggttagtggaggcgtgggcgcgagaaacgagggggcgaggtagcgggcgcgggaagcgaggagccgggcatagcattggcaagggtgtaaagacgccgagcaagggattcgtttctttcctctcgccactcttccccttgccttcgccacttgtgctctaactcttcgtttcctgtgccctacccttgccgcactcgctcgctctcaagcttctcctccgccggtgtcatggcacggggctccgcaccgctcgatggtagcgtgctgccgccttcccgcatcgtgagcgagaggcaggccgggctgccgcgccgattcatgccggaatctgccaccggccgggaggtggtcgcgctgggtgagggacgcccggtgccacactacccggggcggtccgtcttcttcctctctttcgcaatggcggggctggtcccgccattctctatttttttcatggatattctggagttttatgatctccagatggcgcacctcacccccaacgcgataatgacgttggccatcttcgcgcacctgtgtgagatgtttatcggggtgcgtccatctctccggctattccggtggttcttcaccgtacagccggtgtcgccgccgacggtagtcggtggctgctacttccagccgcgggggcaggtgctaaaccgctacattccctgcatcctccgcaaaaagtgggacgactggaagagcgattggttctacacccccctcgccgatgaagcgcgcttccgacttccgagccagcccccggcgcaggcctccagctggcgggcggcggtagatctgggagacggctacgacgccgttcttgaccgcctggcgggtctgcgatcccagggactcacgggggccatggtgttcggcgactaccttcgtcgccggatcgcgccgttccagcggcgcgcccagggcgcctgggagtacaccgggcccgaggactacattaggacccaccaggggcgcaaatgggactgggaccctgaggacttcaggatggtggtccaacgggtgctgaatctcagctccgtggaggcatccctcatcccccaaggggtcctccccctctgctgtgatccagagcgcgccaagatcctggccatcatgcaggtggtcggggcgtccggggagcgggccccccgaggccacgatggcgcgggcgggagccgcaggggggaataatctaccccgggagggggtcgtgcttctgggccctgcgacgggggcccggggggcagccgccctgccgacgcccggggaagaggaagcaggagggtacccctcccccatctcctccccgagggggcggggcggtgcgtgccagcagcaggcgcccggagggtgccgtgccgacgccgcagcccgagggggagcgaaagaagaaacggctccgcaagatgggggggatcgtgccatgccgggggaacctcatctcgcccccgaggtggtcgtttagccgacctccccgcaggttcgtccccgcgcccaccgcggccgtattcattctcccatctcccaaggcgagttttcactcacccgtttctttttgtcttctggtttttcttctgcctcagcgagatcccgtcgcgcccccccgccattccaagtccggccggtctgaggccgaggagacggcgaccgcggaggcccggaggcgggaagctgaccggcgagaagccgcggaccgcctccgggaagccgaggaggctgcccaggaggccgtccgggttcgccaggctgaggaggccgctcgggaggaggccagactccaccgggccgaggagtccgtccgggaggcagaggcggcgcgcgcacgccagacggcctgccaaacccccgacccgactccgcccgaggcgacgacgacttccgaggccacccacgacgaggccgcgggcgcgccgctcgggcccgacccctcgggcgacgcttgggacgagccagcttcgggggacgcccccgagtccggcacgtcgatcggcgggccgagccgcgcggcacccacaccgaggcggctctcccctctgtcttccgctgccccactgagcgcgaagcccttcctgcaggccttggccgccgcgaacagcacggtgctggactggttaagtgcccagatggaggccctacaggcggagcgggcggagctcgacgcggcgtgggcgcgcgtcgacaaggggcggcgctcggtggaggccatggtggaggcgggccgcaaggcgcaccgctggcacacctcacagctcgaggcccgtcgtagggacctggcggagatcgccagggaggtggaggaggagcgggagactgccctcatcgccaccgccgtgctcgacgaggcgcgggacgacctccgcctctaatacgggagccgggcggcggagctagaggagaagctcgacgccgcccggggagtccttgacgccgccgctgcccgggaacggtgggcggcggagaacgaggcggcgtcccgtcagcgtgaagagggccttgaggctcgcgccacggcgctagaggagcgcgcccgcgccctggacgcgaaggagagagacctggccgaccgcgaggccgccgtcgccaaccgggaggcaacactggtggcgcacgaggccgcctgcgccgaagaggagtccgcactccgcctccgcgaggacgcgctcaccgagcgggggcgagctctcgaggaggccgaggccgcggcgcagcggctggcggacagcctgttcctccgcgaggcagcgcgggaggagcaggcgcgccgcaatctggaaggcgcctgcgccgagaaggccgcactggatcagcgggccgctgagctcgaggcgcgggcgaaggagctggacgcgagagcgcacagcgacggggcggccgcgggccacggcgacctagccgcccgcctcgcagccgccgaacacaccatcgccgagctgcagggcgcgctggactcgtccgccggggaggtcgaggccctccgcttggcgagcgaggtagggcccggcatgcttcgggacgccgtctcccgtctagaccgcgtcgggcggcaggcgggcctctggggcgggcggtacgcgaagtacgccgccaaccaggggggcctcgcccagcgtctctcagagatggccggggccctcgagcggctcccagaggagctcgaggagacgatcaagtcatcctcgagggacctcgcccggggggcggtggagctcgtactggcaagctaccaggccagggaccctgacttctccccgtgggcagcgctggaagagttccctcccggaaccaaggacggcgcgcgcgcgcaggtccgggacgccgccgaccacatcgtccacagcttcgagggtacggcccctcggctcgcgttcgcgctcgactccgacgaggagggcggtgacgacggtgcggacgacagtgacgacgaggccgacgacccgggcgcgttggagtgagcccccaggcccccgccaatcttaataacttctccttcttcttccgaggccttcgggcccccttcttgtatagactgatttaatctgcaatcaagtaaagaggaaatttctgcgtcggttctgtttgttgtgtgtatgagacgaggacggtctgtgccgcggtccttctgtgtcttggcttgaacaagggctcgtgcccaggccccagcctcaaacggcgcgtgtcggggctagtgcctggggagatcctcgtgtcgagactggccaggccgggagcgtggtgaccgagggttatggatgacccgattgtgggcctttgccgattcccccccagagttcaccacgccccggggcacggctcggttctgggccccgtttggcgattttagccggcccgggccaccgagggcagggtcgagcacgagcgtgctaattcaagccaagattcttcaaaaggaaacgatggcacagacacggtcgtcaggaaatcgaaaatgcttttattgaaatacagaagagaaaaaaggtaagtatgtgcatatggtagcccccggccaaccctgcacgcccggggggtgcggggttggcccgagcccgagacatgacacccgacccccactaggggtagaagcgacgaaggtgttcgatgttccacgggttaggcaactctgtgccgtcgcccgtggccagccgaacggagcccggccgagggacgccgatcactcgatacggaccctcccacattggtgagagcttgcttagtccagcacgcgtttggacgcggcgtaggacgaggtcgtcgacgcagagtgatcaggcccggacgtggcgctgatggtagcgccgcaggctctgctggtagcgcgcggctcggagggccgcgcgccgccttcgctcttccaagtagtcgaggtcgtctcggcgaagctgatcttgatcagcctcgcaatacatggtgacccgaggggacctcagggtgagctcagatgggaggaccacctccgcgccgtagacgaggaagaaaggcatttccccggttgctcggcttggcgtggttcggttcgcccagagcaccgctggaagctcctcgatccacgagtcgccatgcttcttgaggatgttgaaggtcttagttttgaggcccttgaggatttccgcgttggcgcgctccatttggccattgcttcttgggtgggcgggagaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgacagcgacatacagatactcgaacccgcccggggcccgcctgaacggacccaggatatcgagcccccagacagcaaacggccacgaaagaggtatggtttgcagagcctgggccggctgatgggtttgcctggcgtgaaactggcacgccctgcaccgccggaccaggtcgaccgcatcgttgagagccgtcggccaatagaaaccctggcgaaaggccttgccaaccaaggtgcgtgaggcggagtgggctccacactcgccttcatggacatcggcgagaagctcgacgctttgttcccgaggaatgcacttcaggaggactccgttagccgcgcgccgatagagggtcccttccaccagcacgtagcgcttggagatgcgccggacgcgttcactcccttcgcggtcctcgagtagagtcttatctgcgaggtacgcctggatctcagtgatccaagcaatcaatctaggggagctgggagcgctcccctcgggtcccgaggcctgggctccgacgggcctcgggggccgttcaggcgcgtccgtctcccctacggggtcgggtcgcgccgacggctgggcaagcctttcttcaaaggcgcccggtggggtctgggctcgcgaggaagcgagccttgagagttcgttggcgaccgcgttatcccgtctgggcacgtgccgaagctctatcccgtcgaaatggcgctccatacgccgcacctggcgcacgtaagcgtccatctgcgggtcagagcactggtactcctgacagacctggttaacgaccaactgggagtcgcctaacaccaggaggcggcggatccccagtccagctgccactctgagtagcaacggctcatctggctccggggcgaccaagactgggggagaactgaggtacgccttcaactgagtgaaggcccgctcagcctcctccgtccaggtaaacggcccggagcatttgaggagcttaaataggggtagtgccttctctcccagcctcgatatgaaccgacttagggcggccatgcagccggtgacgcactgcacatccctaagcttactgggggggcgcatccgctctatagctcgtatcttctcggggttggcctcgatgcctcgggcagagaccaagaacccgagaagcttgcccgcaggcatgccgaacacgcacttatcggggttcagctttatgcgggcggagcggagactttcgaaagtttccgctagatccgagagtaaggtctcttggttgcgcgtcttcacaaccaagtcatcaacataggcctcaacattgcgtcctatctggctacccaaagaaattcgagtagtacgttgaaaagtaggacctgcattctttaacccgaaaggcattgtcgtataacaataagttcctatgggggtaatgaatgcagtttttcctcatcctccctagccatgcgaatctgatgataaccagagtatgcatctagaaaatacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctcacggatgaatccggcctccagaagtcgcgccacctcctcgcggatgaaggcttgacgttccggggcctgccgccgcactttctgtcggaccggccttgcgcccggccgcacggcgagacggtgctcaatcacctccctggggaccccgggcatgtcagaggtcacatcgaagtccacccgctccgtgcggaagttggcggaaccaccgaaggtgaacgggaggtcgatatgacccaacggccaggtgtgccccggaaaacccaaaatttgcgagtaccaatgatagtacattccccttgtcggtgacatggggccgggggtatcgtgactagaggcttgggtagccgcggtcacccacgtggcctgaccccctcggggcggtcgggcccgagggtgacgtggccacccctccctctgt

SEQ ID NO: 38485 - DNA, 4383 bp, Oryza sativa
  unsure (1)..(4383): unsure at all n locations
ggcctgtcacacgcctcgccccgtcccgtcggaatgatgagagcttcctggctctcgtccctagccggagccggcgtgctaactcctggagttggtatgtcagtcccggtcagattcattccaggcttcagcgcaagtatggcaaggaagtcgctggccattaaatgaaggttgaaatgggcgtccaccggaaaagcgggcgagcggggcaggaggcgtgtgctctgcttgtcagaggtcacttccggctgtagactagccctcattgtaaaaagcatgtttcctttcttaggtagctggaggcccttgtggtgacccctgaccagataaaaaggaggcccaggcctaggagaggagaaaaaagagaaaggggttgggactctggcgaatgggttctagagcctgaactctctctggctctccggctctctgtattccttcactcacagatccaccagaacacaggagtagggtgttacgcttctcagcggcccgaacctgtctacgtcgcccgtgtcttgtgcacttcctctctcgctgacgttcctcagatcgagggcgaagaacctcacttagcgcccccggccgaaccggcaaaggggggcctgcgcggtctcctggtgaggagccccacgctccgtcacccctagaagggatataagggcaactaaaatatgcccagaagttaaccttagaattgaggaagttgacttcctagccaaaccgatagtcctagactcgcaaagcttggacatcatcctagggatggattggttggctaagcacaaaggacagatagattgtgccgaaaggtctatcaccttgcaaggacctggaggaaagcaagtctgctttacccctaacacccttatcgcaagtcggtctatcctaaccagtttgcaagccactcctttggaatcggtgcccatagtctgtgaatatcacgacatatttccagaagagttatcgagtatgccaccagaccgagagatcaagttctccatagaattagcaccaggtaccgcaccgattgcgaaaagaccctaccgaatggcagctaacgagttagcagaagtcaaaaggcagatcgaagaactggagagtaaaggttatgtgcgacctagctcatccccttggggagccccagtgctcctggttaagaaaaaggatggctctgagagaatggtaattgactatagagccctgaatgaagtaactataaagaacaagtacccgttgccacggattgacgatctgttcgatcaacttgaaggagcaaaagttttctctaaaattgacctaagatcaggttaccaccagttgaaaatcagatctgaagatatcccgaggaccgctttctcaacgcgctatggtctgtatgagttcacagtgatgtctttcggactcaccaatgctctagcattcttcatgaacctgatgaacaaaatcttcatggaatacctggaccagtttgttgtggtattcatcgatgacatcctgatatactccaagaatgaggaagaacatgttgaacacctgaggctgataatggaaaagctcagggatcatcaactattcgctaagttctcgaaatgcgaattttggttggaccgagtagcatttcttggacacgtgatctcctccaacggtgtcgaagtagaccccagcaagtttgaagccgtacttgcttggaatccgcccaagaatgtgtcagagatccgcagtttccttggcctagctggatattatcgaagattcatcgaagggttctctaagctagccagacctatgaccgagctgttaaagaaggaaaagaaattttaatggtctgcagcctgtgaagatagctttcaagaaatgaagaaaaggttgaccactgccccagttctcaccttgccagatatacgaaaatatttcgaaatcttctgtgacgcatcaaggcaaggcttaggatgtgtcctaatgcaagaacaaaaggttgtggcctatgcatccaggcagctcaggcctcatgaagccaattatcccacccatgatctcgagttggcagccgtggttcatgctcttaagatctggaggcactatttaatcgggaacagatgtgaagtatacaccgatcacaaaagtcttaagtatatcttcactcagaccgagttaaatatgagacagagaagatggttggaactaatcaaggattacgatcttggaatccactatcatcctggtaaagccaacgtggtcgctgatgcgctaagtcgcaaggcctattgcaatgtagctcaaatacggcctgaccaagatcacctgtgcagagaattggagaagttaagactgaccgtgatacagtcaggtgtccctgccagcttgacagtacagcctaccctagagtcgcaaatccgggaggctcagaaagacgacgaagggataaaagaattaataaaaagaatacaggaaaagaaagacacaaatttctccatagacgatcaaggcacagtttggtgcggaccacgcatctgtgtaccggccaagaaggagttaagagatctcatcctaaaggaagctcatgagtccgcctactccattcacccaggaagtacgaagatgtaccaagatatcaaggcatacttctggtgggctggaatgaagcgagacgtcgcagaatacgtagccctgtgtgacatttgccaaagagtcaaggcggaacatcagaggccagctggtctgctgcaacccctaccgattcccgagtggaaatgggaagagatcggaatggatttcatcaccggtttgccaagaacccccaacgggtacgactccatttgggtaatcgtggaccgactcacgaaatcagctcatttcgtgccagtgaaaaccacctatgatggaaagaaactagcagaactctacatgacccatgtcgtatgtagatttggctgtcccaagaaaattgtgtcagaccgaggcactcagttcacctcaaggttctgaattttagtacagcctaccatccgcagaccgatggtcagaccgaaagggtaaaccaaatcctagaagacatgctacgtgcgtgtgccttggatttcgaaggcacttgggatcgttgtttgccgtatgccgagttctcatacaacaacagttatcaggccagcattcagatgtcgccgaatgaggcaatgttcggaagaaagtgccgcaccccattgtgctggaatgaggtgggcaaagcattggtattcggtcctgacatactcaagtcagcagaagaacaagttaagctgatacgggaacgtttgaagacagcacagaaccgtcagaagaattacgctgacaatcggaggcgtgaccttgagttcgaaaaaggagatcatgtgtacctgcgggtatcacccctccgtggtatgagaaggtttgggatgtccggcaagttagcaccccgctacatcggcccctacctcataaccgccagacggtgcgaagtggcttatcagcttgagctacctgaaggtctcgcaaacgtgcacaacgtgttccacgtatcccagttaaagaaatgtcttcgagttccagaagagcaagttcccctgggtaatatcgagctggaaaagaatctgacctacaaggaaagaccgatcaaggttcttgaagaggcagaacgtcagactcgaaggaagaccatcaagctctacaaagtctaatggagcaatcattccgaagacgaggcaacctgggagcgagaagatcttctccgcaccgagttcccggacctgctcccttaggtgctgaatctcgaggtcgagattcttgttaggggggttggtctgtagcgcccattccgtcgtggcgcctagcgggaaaattatctcttaaaaaccctaattgcgaaatttgtttctttgcttgttgtctagtgtccgtgccatctcaagatctcaatccccaatctatcgtcgagttcaattccgaatccaaatccttccaatcaaattcctccgcaaaagtctattttgtctcccccgaggtcgatgggccgaatctcgctcggcccatcttcccctcttccccggccccctctctccccgggcgctctctctctctctctctctctctctctctctctctcgctctcccatctctccctccccccgctcggcctcgcccgtncgctgctcgcgcgtgcgagagccgccccgagcgcctctctccccgctcccccgctcagcctcccccgcacgccgcgcgcgcgtgcgcgtaagccgccgcgccgagcgccccctccctttcccctcgctctgccgcgcctgcagccgcgcagccgctcgtcctctcgagccagcgtgtgcgagcccgcgcggacgccgctcgttgctttccgcgcgcgcgtgc

SEQ ID NO: 38486 - DNA, 17814 bp, Oryza sativa
  unsure (1)..(17814): unsure at all n locations
ttcctaattgtatttctatatggactttatagtctacttctaatattccttatttttaattccgaatttcagttatttcctaattgtatttctatatggactctagtctcctcttctaatattccttattttttaattccgaatttcaactatttctaaattgtatttctatatggactctagtctcctcttctaatattccttattttttaattccgaatttcagctatttctaaattgtatttttatatggactctgccttttctttttctccgattaatgtgagaatttctagaccatgagagcgaatgtggaggcttctttttctattcctttaataatataactagctgggtggcccgcgcaattgcgcggctagcacccaaacaaaatcatatattttttttagtatgattttacttaaaatttattaatagctatctcattgtcttaagactttgaaagaccaaaccttatcatcctcgtgtttctaattatatattttttaaaagtcacaccagttgctaccccttatatcatcttcttctttatttgcttgctcgatctaccactatttttattcattcttcttggaacctttaaaaattggattttatagtttttagagtttattgtcatgttgggttttatttttataatttctagatgtcccgtcaaacgttgccattatactcctctacgggccatccattgtctctactctttattgttattgagattttaaaaatcgaacataattatcgtttgggttcatttttattttctagaagtcctgccaaaccgtcagtagctttgccattgtactcctctacggctcacccgctgcctaccttctttattgtcattgagacataactatcgttggaattcattctttattgtcattgagattttaaaatcgaacataacttatagtttcattttttataatttttagaagtcctatcaaacaatgccactatacccctctacagcatgttcgccgcctacttctttattgtcattgtgattctaaaaatcgaacataactatcgttggaattcattttttattttctagaagtcccgtgaaccgtcggtggctctgcaactatactcttatacaccccgcccgctgcttctcctttttattatcattgagattttaaaaatcgaatacgattatcaatgcagtttgtttttttactgtctaagaagtcccagcaaccgccttactcgtttgcttcatgtagcgcccgttccgtcttggcgcctagcgggaaaattatctcttaaaaaccctaattgcgaaatttgtttctttgcttgttgtctattgtccgtgccatctcaagatctcaatccccgatctatcgtcgagttcaattccgaatccaaatccttccaatcaaattcctccgcaaaagtctattttgcctcccccgaggtcgatgggccgaatctcgctcggcccatcttcccctcttccccggccccctctctccccgggcgctctctctctctctctctctctctctctctctcgcgctctcccatctctccccccccccgctcggcctcgcccgcacgccgcgcgcgccgagcgccccctccctttcctctcgctctgccgcgcctgcagccgcgcagccgctcgtcctcgcgagccagcgtgtgcgcgcccgcgcggacgccactcgttgcttcccgcacgcgcgtgccgtggtggccgaccgcccggtcgccgccgccgtcagcctctgcacgcgcctgtcgccagtgtcgccgctccgctccaaaccgcaccgccgtcatcgccgtcgtcattgcccggcccccgcccctacgcgcgcaagccgccaagggacggaggcagcgcccctcctccctctgccgcgtcgcccccgctcccctcctcctttttcccgaatcggcaaaagggcaagcccctttctccccctcctttttcccctttttcccccgccggcgtcatcctccctgtcgccgctttggccgcgaccgccgagcgccagctcacgccttgaccgccctaagtcggttcccaaaccgacattgccgccccctttaaaccccagctccttcccctccaatctccctcgttttcgcctcctcgccatagctgccgcccccgtgctctgttcgccgtcgccgttcgttgttgtgcgtgtcgaaggagtcggcacgagcaaggacgcggaaggggacttcggccgcgccctctccttcctcttccccggcccgaggccggagagattactcccgcgccgtcggcctctcgtcacagcgcccctcctcatctcggtgatgcctccctccgttcttcctcctcgccccatctcctccccctagcttacggtagtagctcgagtagactccccgtagctagccggcgccgccccgaccgttgccgtcgctcgccgcgtgctcgccgccatcgccgctcgagctccgtagcacccgcacgtcgccagcctcgctcggcgtagctccgtccaatccgacgctagcatcagattcccgtggtcgcgtggatgctctcaccgccgggaatcggtctctcgtgacctcgtcgccgtttccctcttctcccgccgccgtcgagcaacctccggcgaatccgagccgttggctcgtctccccttgtcacgtgcaaccgcccggtgtgcacgcttttgcccgtatcaccgtggttcgctccgccgctcgccaccgccgtccgccgtccattcgcggccgggtcgtcgtctacctcccgccggaccgcgtggcagccacgtaggcgccacgtcggcgccagctcagcctagaccggatcgagccgaccccggtcagtccctccccgtgcgcgcgttccaccgcgagccgtgaggctgcgcgtgggcccgccgcagctgcgtccaccgcggaccgcgcgcatgcaccgcgtcccttccccacccgcgcgcgtgcgtcgcgtgctccctccgcacggtgagccgagccgctgacaagcgggtcccacccgggaccgcgcgtggtgagcccggtccaccggctctctctctcctccctcccgcgcgcgcgcgagtttgggccgccttgggccggccggcccatttagctcggccagaccgctccatttctcttaggccgcgccctagccgtccgagaaaagtctatattccctccctcccttcttttctttttcttttccaaaaaaggatttaaataaatcctttttcctttagaccaaaaatccaataatcttagaaattcaatatcttcccaaccgtaaatccgattgactccgttcaacttccaaaattcctcaaatctcgagatctatctaatggcacgcttagaggtcattaatagggctttattttcgccgtttgttgagttgtcccatttcgcgtgtagtttcggagcccaaagacccgcagtgcgaggatttcgaggatcaagctccggatctcgagcaaggcaagccacctttgaacatcttgagcctatatttggaatttaattatattgcttgcgaaatattatgcattgataggatcacacttaatctgttgtcccgtctgcaaggcagattggcagacctacctaatttgttacatttgatccttcctttgttaactgttataccatgtccccttgtaaccacccagttgcgcctcgatattcgtgcactctgtgcgagtatcgacggtcgccttcaaacttaaaatctgagtaacaacttgggtaaaactggagttttacaaaagacttggaaaacccgacacctgggtcggtgcttgcgaactaaatgaatttccaaaaccgcggacaggggaacgtaccgggtgtacggtttcccgctctcgcacttaaggaccgattcccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttgggggtctcccgacgtggctgatccccacgggctgggtgatctgggttagtaatgtcgtgtgggtaaagtgtaccccctctgcagaggttaacaaactgctcgaacagccgtgcccacggtcatgggcggatgtgaggtgattcctagcgtagttttgtttgattactgcttgtgaaattgctgttgtgaaaaggggttcgatgtttgaaaaatctgcagctgatgggatcagctaggcccgggtggccgtttgaaaagttgttggcccgggtggccgtttgaaaagctgttggccgggtgccaaccttgttgcaatcctaaagactgacacattgcacatactccgactggacgagacgcactgtctcatccgtgtcgtttgagaagcactcacttagactttttagaaaagagttcaaacaaaatcaattacgaaaacaacagcctttccttgaagcctgcattaaacacttatttcccctggcttgctgagtactcccgtactcacccttgctccatataaataatccccacctagttgctgaagaagatgaagtggatcctgctgacgaggagttcttccaggagcaagccggctacgatgagttttagggtttcggcctagttcccaagtcgcacctgtgatgattggtccaagtcctggcttccgctttccttttgtaatgcagttgtgagctcgggatctgcccgcagcccaacatgactgtacttctactctataataaagagacctctgttgctgtgatactctgtctccctgtgataccaacactgtttcctaggactggtatcgattaacaggttaatttggagcgtcacgggctagttccggtcgggactagttcggggcgtgacacttcacggcctgcctgacgtccctcctttttaatcgtcagtaggattctatttgatgttttattaacaatttttatatgtcgtatcaaccgccaccactctactcatttataggcctgttacttaatttatttttattccaaattttaattaatctcgtgtattgggttcttatatgaactcttcttttaatgttccttatttttaataacgaatttcagctatttttaaattgtattcctacttggactctcatttccttttctaattttagattttattttatttttatttccaattttgattaatcttgtattgggttcttatatggaaaattctttcaatattgcttgtttttaattccgaatttcagctatttttaaattgtattcctacttggactctcccttccttttctaattttggattttattttatttttattttgaattttgattaatctcgtattgggttcttacatggaaacttctttcaatattgcttatttttaattccgaatttcatctatttttaaattgtatttctacttggactctctttttttcctaattttggattttattttatttttatttcgaattttgattaatctcgtattgggttcttatatggaaactttttttaatattgcttatttttaattccgaatttcagctatttttagattgtattttctacttggactctccttttcttttttttctttttctctgattaatgtgggaatttctagtccccacaaagttgttttaataatataatagatcccaacaaaagtacaccaccctcaccctgatcacactatcacacacgtcggtatccatacaaccaatatgaccccaggcacgaacaatcctaattgtacgcaaggaaattcgatctctagtgcaggagaattgtgaaaaggaaaaagacaatcattttggcacaagcaggacaacctcaccaggcagcaggaatcagacgcaattcatgtgggcgcgtacgctgggctacgcagcggctgcggtggtagtcggtatcacgagggagccctgcggcggcgccggctccgacggctcgacgtagctggcaatgtccctcggcttgacgtgcactcgcagtccattcttcatgaaaagcgtcagcgacatcttctgctccaccttgtgccccggcacgagctccaccgagttgcgcagcagcacggcggacgcgatggatttcatctgcaggtaggccaggtccttgccgaggcacgttcgcggcccgccgttgaacgccacgaagcggtacgcgtccttgacaggctcgaagcggctgccgtcggccgatagccaccgctccggccggaactctgcgcagtccttcccccatatgctctccattcttcccactgagtagatggagtaggtgatcgccgagccggccggcaccactgtgccgtcgggcagcacgtcgtccgccacgacgtacttggaatcctgcggcacagacgggtacagccgcagcgtctccgtcaatgccgccttgaggtacaccagtcgctccagctcgtcgaagtttagaggctcctccgtccacctcgccgtgtcgtccccgcgcgtctccctgagaacggaggcgatctcgaggaccaccttgcgctccacgtcccgcctctgcatgagagtccagaagaaccagctgagcgcgacggacgacgtgtcgcgcccggcgagcacgaagttgagcgcgatccactggagcacgtcctccgggaacgctttgcccttgctgtcgcgcttcttcatgaaccgggacagcaggtcgtccgacggcgtcgccttgcgtgccgcgatggtctccgtcatgtgacggtccaccacggcgaggctgtcgcggaggctccgctcgctgccgacaccgaacgccttcttgatgcgccacaacaagctcgggaacaggaacctctgcatcgtcgcctcggtggcctcgtcaaaagcgttggcgaaggggttctccggcaagccgggggacagcgtctctgggtccttgccgaaggtgaggccgcagatgttatcgaaggtgaggcgcaggaggaggtcctggaggtccacgcttgcggccgcgttgcagtggtcgtcgaggatacgccacaggcggtacttgatggagcggttggcccagcgtgccatggcctggcgcaacgtccgggtggtgaactcgagggctgccgtctttcgctggatcagccacgtctcgccgtcggagttgaagatgccctggccgaggaggtcgtggaacgatgcctgccacatggggcccttggggtagttgtcgaagcgcgcgcgcaggatgtgctcaaggttccgcgggttgcacgtcaccgtcaccagcccctgccgccgcgccaggaatggcagaggcaggatgcacgtctggtacgtcgcggcgtcacccgtggcgcgcaggttgtcggcgatccagtcgtgcacccgcgcccggttcagcacgacgctgggtaggctgccgacgagcggccacatccgtggcccggacagccgccgcgacagcgcccagaaccacaccatgtacgccgaagccaatgccacggcagccgcggccatggcgtaggggtgcagctgcaacacgccgccatcggtcgccatggccctgcgtgggtgcgttttaagctcgcaaccacacaccttgctaagtggagatataattaagagggggcgggtttagcactatgtgatttagaaatggtgcggtgcgcctggtgagttgagaaatgtgtttggcgccatcgtgtatatatatgtgcacttcacacgagccgtgtggcgttgcttcccttgtcggcccaagtttaagtctctcaagtttttgaattcaacaaggggaaataaaattcattgctcttgttcatacttcttgccttcttggccattcttcctaacaagaaatttagcgacgttgttctgttgttcactccagtagataaacaaattgtgtttggtgctctcttctctttttttttttttggcaaacattgcaacagaaagcgaggagcgtcctcggtattggactatcgcggactggtttcggcgcagaaaattcagtgcgtgtatcatcttgatataagtctctgtttttcctttcgtcttgctgttggtgcaaactagggagaaggttgcccatacttttaccaatcattttcgtcaagtgtttccctagaagcagcgcaggcagcgcaccaatgttgtttcgtataaccggccagcgaaagtagtaggtgagaaatatgggtctcctctcttaccaatattcatccaacctactagtaacatacaacaaagagagaaatttcggataggaataagttcgtctgaggtcccttaacttgtcaacgaatccgattttcatccttcaaccggaaaaccagatacaacaggtccctcaactattaaaaccggtgcagataaggtccctcggcggtttagatggcggttttggctgacgtggcgcctacgtggcaaattcgactcggtcttcatatgacatggcacttacgtggcaatttgatccgaaaaaataataaaccctgtgggacccacatgtctgtttcacatacaaaataataataaaaaaaatggtgggacccacgtgggccccacatgtcatcctcccatccctcatcttcttcccgttatcctctctctctttttcacgatgtgcactggggcagcgggcgaagtggggagacggcggctggagcggcggcgcgcgaagaccaccttcgatcgtgacgagctcgaagaccacctctgcgttgccaccgccaccgcggcggcggccagcacccccaccgcctcatccactccgaccacgaccccgccgccctccaactccaacctcctcctccacccaccgcccggcgccgcgccctccaagtcccaccgcatcggcctccctaccaatcccaattgcaaccccaaaccctagcctcccctctcctccctgccccccgtgatggaggtcgagatcaagctccgcctccccgacgccgccgcgcaccgtcgcctctccttcctcgcgccccgtctccgccgcgcacctccgcctctcctccttcctcacgccccgcctccgccgcaccaccgccgcgctccgtgtccatctctacggcctcgacgaccgcgccatcctcgcgctcaagcgctgcccgcgcatcgacggcggcgtcagccgcgtcgaggaggtcgaggagcctctcgaccccgccatcgccctcgaggatgagaaggcgttggtggcgagtggaggaggcggtggttgacgcacgtgacgaggtaggtggtgaatcggtgggggcgtggggcgccgtgagagagcatgtggacgcggagcgcgtcgcggatttctcccgctcccctcggcctccgcccgcgtctcctctccttccgccggccgagtgcacgcgccggtcctctcctccctccggccggcgcccacgcccgcgcctgcgcaccgctcctctcctccctccggctgacgctcgtgtgctgcttctttcccagcggctgccggcaataggcccgagggggcggaagtggaggaggctgcgcctctccaagccgtcgttatctccgccggccggcgagactgcgagaggagggaggagaggggagagagatggagaaatgaggaagaagaggagggctgggagtatgacaggtgggcctcacgtgggtcccaccattttttaatgtgaaactaacatgtgggtcccacgggttttattattttttccgatagaattgccacgtaagcgccacgtcaaacgaagaccgagtcaaattggccatgtaggcgccacgtcagccaaaaccaccctcaaaaccgccgagggacctaatttgcgccggttttgagagttgagggactcgttatgtctgattttccgtttgagggacgaaaatcggattcattgacaagtcaacggacctcaaatgaacttattcctttcggatatgccatggtcgtcggccttcgaatcctgggcggcccactttgcatggtggatgggccattatgtttagctaaggaaacagacctgattcggctggattcaagtccaattttagccaagtttgattcgtatcctttgaactacaaaaccatgtaaaaagatagagagaatctattatatgccactcgaaattacccggcttccatatatgctaccgaaaaagttacatttccttctatgccgttgggtttcaatttttatctctttagtgccactactgttagactactgttaagttggtgttaagtaggccatgaaaagacactagtgcccttgttccctctgttttttctcaggttcctctcactctcgtttctgttcttttcaccatcgtgcatattccatcaccgagacactaactgagctagctcctgtagtcccacactcccactattgtgtgacatcgtctgctcctctccatgcataccagagaggttgctaatatcggtgaaccacctccacaggctctgctgaacaagcttccgtaattaactgtaggcacacatttaattatccttgattgcaagcttgcagtcatttgatgtaaccattggcacacatttaatttgcatcaagggcacatatatactagaccatgaattaactatcggcacacatttaattattcttgattttagcttgcattcatttaactaatcatcttgattcgctgggagtccaaggatgaagagagtgctaggcgcatttcagatcgttaattagtgatagcatggacagaagagtgagggtaaaacagatataggaagaaaaatctaacatgttaactcacttaacgggagctagggtcaactgacttgacggtggtggtatcaaagggatgaaaactaaaactcagtgggcataaaaggaaacgtagaattttcaatggcttttaaaggaaatgagtaattttgagtggcatgtaagaaattttctcaaaaagatatccctcaactattaaaaccaaatcaatttaccacagtggacagtttttgttttgaagcttgtttcatcctaagaggcattttgacctggttaactcatatcataggtcctttgtcaatcttctatctgcttctttcgttcttatctcattttctccgcttgagtgtggccgcacctcaccacctccaccgcacacaaccatgtcacgaccacatcccccaccgtcggcaccgagcagtgccaccaccaccaccccttgccagtgccccagggaccgatcgatctgtgaaactggtgtcgagggcaaagaggcaccggaggagccgagtgcgatgaggcagtgtctagtgccaagcaatggacacctgcatcgggagaggcagagccagtgatgggaacttgatgctagcatccacatccttcctaaagcctaggcaatgacaacggatcaggatgagcttcgccccgcctctaactctgtgttgtaagggtggacaaaaaaaaactcgtggctcgttagctcgctcggcacttggttggctcggctcattgtgtttttctaacgagacgagctgacaatttagctcgttaaagataacgagctagctcgaattggctcgcgagttgctcacgagccaatgatagcccaacccacaagcccatatggaactagctatgtctttgtcgacaaatccttgggtcaaaatcacccagatttttttctaccgttagattaagatccagaggacacaaaaaatgctacatatttttttctctgactagtcagatcacaaaactacatgggctcgaattctagcccatagaacaatacaaaaaattatacaggccataactgcaaatacatcatggcccataatgatcaacttcacatccaataaaggttagaaaaaaacaaaataacacagggagaccacaccagttcgcacaaatcccctagatcgagcaaaacaaatcgagcacgccatagacagtgaggagaacgagaaaaagaagaagaagcaaattcttaccaagaacattgaggtcaagaagttgaaatcaacaagacataatcttccaggtaacaaattacctagcacaaaatccacctttacctttccccattgacttcaccatattctgccagtcatcttttaaatcaaacaaaaacaactcagttctgtaaaaatattggagaaaagcacttggaatagtgaatttcttttggagaaaagtgcttggaataggaaatttctttagatcaagtagttaaaagtatgtaactttttcagaaaaactcgtaacaaaaactatcaatctatagtcagttacagttacaaataacaaaagttacatatataactacagtacatctaaactgtaactgggctgtaaatggaatcattcttaaatttcttaaaaaattcagtacttatactgcgacattaaaacatttccccaattataacaaactctaaattatgttacaaatatataaagagctatctatctatagtcagttacagtgagaaataacaaaagttacagatgtaactactgtacatctaactgtaactgggttgtaaatggaatcattcttaaatttctttaaaaattcagtattcatgcagcaacattaaaacactttcccctagtataacaagctctaaattatgttacaaatatataaagaactatttatctacggtcagttacagtgagaaataacaaaagttacagatgtaactacagtacatttgaacagtaactgggttataactggaatcatcctttgatttttttaaaaaaaaattcagtgctcatgcactaactttttttttgcctatgacaaaatgttctaaattatattacaaataacctaatcatgtagggtcaggtatattgcaatctcaaaaatcaggagatacacaatcagatggatatgaaatgagaagcaaaattgtgtctgaagaaatgagaagcaagaagacagttaaaggtgagaatcattctcacctagcattatggaccattttttatcttgtcagaaaatgtcatctagcaaaaatttatatacaacaaattagagatagtagcatgataaatttttaaagaactatatatctatatccagttacagtgagaaataacagaaattacatatgtaactacagtacatattgactgtaactgggctttaactgcaatcatgcttgaatttcttcaaaaaattcagtactcatgcaacagcattaacatttttttactattatgacttgttctaaattgtactacaaatgattgaaacatgcaacgcctgatagattagaagctcaagcaacagtgaatacagagtcaaatagatgtcaaagtgacaaaattttctcagaaaaattaataagcaagaagacacttgaaggtcagaacaatggacagatagcattatgcaccaaatttgatcttgtcagtcataaaatctagcacaattttgtatacatgaaagcatgattttttttttgaaaaactatctatctccagttacagtgagaagtaacagaagttacatatgtaactacagtacatattgactgtaactgggatgtaactacaatcatgcttgaatttcttcaaaaaaattttgtctaatatacattatctaaattatattacaaataacctatctatgcaggttctgttacaattcgatctcaagtaacagtggatacataatcagagagatctgaaagagataacattaatttcgtctgatgaaaaaagaagcaagaagacaactaaaggtcataatcatgataacctagcattatggtccatatttgaccttgacagacaatttaatctagcacatatattagagatggcggctttgaaaaatctaaagacctatctatctatagtcagttacagtgagaaataagaaaagttacatatgtaactacattacatctgaactgtaactaggctataacagctttcatgcttgaatttcttcaaaaaaatttagtactcatgcagcagcattaaatattttcccctattataacaagttctaaattatgttacaaataatataaacatgcagggtctgatgggttacagtctgaaaaatcaggggatatgcaatcggagagatatgaaagtgacaaaattttgtccagagaaataagaagcaagaaaacattgaaaggtcagttatcatgctcacctagcattatgcaccataaaatgatcttggcagacaatataatctagcataaaattatatacaacaaattagagattgtagcgttgataaattttcaaggactatatatctatagttagttacagtgagaaataacaaaagttacatatgtaactacaatacatatagactgtaactgggctaaaactgcaagcatgcttgaatttcttcaaaaaataaagaatttcttcagaaaaggagtcactttgtcacaacggactgaagattttcctcaagtgaaaatcatcttcagaccgtggtgtttaacaaagcacaacaattagattagagcctaggataaaaaaaacagagcattgtggtccaaacggtcatatctccagttgtgtacaaatttgcccatatattaaattttgtacataatttgcacatatctcaaacttctgtgcacatatattaaaatcactcgacaacaagatgtgacaagttagctgatgcagaagggaatggaccagaagggaatggaccagacagggtgttgttgttgagcctcccgattaaatttcacagcaaatgagttaactgactaacaagctccacacataattaacatgggaacaatattgggatgggacgatgggtcattcagaataaagaagaaaaaaaatcatacagatatttcaggcatgtgaatacctccaggcacccaagtgaccttggttttgctaccattgaaatgcattagatcaacattagactgaaaccctccaaattatttttcagtttgctgaagtatgagattttaaaaagctcatgtcgactgaaactgtgcaatagcctgctccaagattcaaaaaatactgacaattcaaatagatttacgagcgtgctatcccctgttcccaattcagaaatagtgccaattatgttcccaagttcagaaatagcgccaattcaaacagatttacgatttacgagcgattgacaatgaacaaaagttcagaagagaagaaagagcagatgcaaccaatagcccataatttctcaaagcaacagggaccaagttcaggtattggcttgctgctaactcatttagatcagcactaaaaagttcagaacatgtacaggaattttataaaccaaatagtacagtagaatacaatctgaagaaagcagaacgcatgtaggggtttgggtttaatttaaccaagcaactcagcatactaggaaatcaaaccgtacatctctgaaacgaaatgattcatatgctgcagaaggcaacacaaaacatacttggggttcagttagcatgcatatgtaaaacgaaattcttcagatgcataagaattcagatatatgcagggagttgacagataaatcatctctgaaacgaaatgcttcacatgcagaaaaattcagactcatgcaaggagtttaacagatcagtcaactaatcactgaaagtgaaatgcaacattcagataaagttgcaatgatgcttccctactatattcaaatcacacataaatcaaagcaaaaataatcaactcatgaatctgaccccctccctgaagaaaattcatgcagggatccaaaaaatgatcaactatctgggtgattagaaaaaaccctaaatccacctcgaattaaacctttaactccatcaaatacccctgaatccaacccccaacatgaacacccctgaagaaaaatcgaaccaaaaatacaaaaaccctcgtggattagaaaaaaaaacatagaacaccatcgaatctggtcgtttgcaaacaatggactagtaacaaaacaccctagactgaactgaatcaaactataactaaaaacttagggaatccaaaacctaaacggattccaaaactaaaacaagtgattctgaatcagatccatacgttgggagcaaaaaaaaatcgtcatgtattgacccgaatcttctaaacctagccctattgacattgaaaaaaccaaaacacaagctaatgatgccagcaaatcagggaagaaactcaaaaaacactctctctcgagttgtctcccccagcgagcgcgcgcgctctctctctcccgccggggagctgctcgtgctctctctcgccggcgagctctctctctctctcgacggagaaaacgagaagagaaaagaaagaggagaaagagatgtagagaaagagcgagaataaagaaagagagcgaggaaacaaccaacggttacggacataatagcgcggaatccaaaatttaacatgggttggcccacattgactcccaggccatctgctcacaggccacacggtctcatccacacagggaaatgcacgaatcatggcgcaaatcctacggatagaaaaacgacaaatattgggggtgaaaatctgttgacaaagatctagcaaaatcgaaccccaatgcccagcccagcctctcttcccttgctctagaacagccgctagctacgccacagcccgcaggtcacaggagcagcacatcccagtgtcgttgccgagggcgccagcgccgctcgcccgccgctgcccaacaccggcatctcgcgcccccagtccctagcgccaccgccactaggaagcagctcgagctcctcccctggcgcatgtatcccatggcaccatcaaccgtcccagctaccccttgtgggctcacgccgctgctgcgttccctcctggcctctagtctgtatcatcgtcgatctgccaatctgccttgtcgatttggttggtgattttgtttggttgatcttttggttcgttgatccaggaaattaaccaggcttcagatctggtaaatctcgggtagctggttgtgttattggattcaatttcccatatttcaaactgatgtgcacaaaaaattcatgtcaagaattttatttgctagttgcttatttttattcaattgcaaaaatcatttctagcagctcctataatatcagatgttatttttgagacttcgatgttattttgaagtgaagactagtcaagagtgcattggctcgcgagccaaacgagctagctcgagcttctaggcaagccgagacgagccggggttttagctctttagcataacgagccgagcctagccagctcggtatccacccctacagtgtcgtagtgactagctgcaatgcttgacgcgcaccctccccctctctgtcaccgtcctcctcggtaatcgatgaccacaagggctcatgctgctgggcgagcgcatacggaatatgcttcaccccttctctagctccgcgtcggtggtggtagtgatgcgacggccgcggggatgtgtttgcgacccgcccttccctccttgttgctgcccttcctataaatcaatgaccttgggggttcatgtcgccatgtgaacgtctgtcagatgtgattcatggaagatggaggcaggaacggccacagtagcagttgcctcatcgacgagatgtctgtnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 38487 - DNA, 13361 bp, Oryza sativa
  unsure (1)..(13361): unsure at all n locations
ttaatatttgaattcaaattcaaatttgaaacgggtatataaacttttgacttataaactttgggtctataaactttaggtgtataaactttagatgtatagaaatactatatacagaaaatatttgaattcaaattcaaatttgaatcagatataattcaaattcaaatttgaaacgggtatataaacttttgacttataaactttatgtctataaactttaggtgtatataaatactatatgtaaaaaaatatttgaattcaaattcaaatttgaatcggatatataaacttttgacttaggtctctaaactttagatgtgtaaacttgaggtgtataaactttaggtgcataaatttactaaaataagaaagtaatgcggtgtcaaaaaaggaaaccaggtggagggaaagagggggagggggggcgaattgatcgctacccccatcaccaggcgagcgatcgcccattagcatttccgcttgacaagcaccgtactggccttcgcgagctcgcactactgcagcaccctacctcctcacaattgtggaaccaactgctgctgcttggaggaggaagagaggggaggagggaagaaagaagaaatggctgacatgtgagccacattattttttcccttttttttaaaaaaaaaaaagattgtaatagtaatgccacgaagattgcgtgctgcgggaaagtcgtcatgggaggtcgattcggccgccgcgacggctgaacgagaaggccagtgaagatgcaccattttcgctagcggtggcaaaccatgagcgaagatacattttcactggcggataacataatggagccgccaacaaagatagttatcgttggcggttgccttataacagtcaccagtgaaaatgatcttcgctggcgcacttaagctacatggcccgccagcaaaaatgcactttaccagttgcttgctgacacgtgacccgcttatgaagatatttaattattttttaggaaaaaattgaaactatttttagtttgttcacgtacttaagaatcacacatagaggatatattcaatcgagcaatcgatgataaatgttttcttattgttgcttgcaacatctattgataattaatagggttaattggaaccatgtcattataaatttcattgtttggaaaaatgtcattaatgttcatctatttggtattatactatcgcaatttcacaggtataagagcatgctactacgtacccctcactgtatttctaacattttaggaccaaattacccctttatttttcttcttccttccctctcttctctctttcagccgacgaactgtaatgacctcatgctcgaggagatggattctaatcatttgggcaaatatccacccgtttattacatgccaattaaatggttattaaaaaaaaagacaagatggatcaatatgtaatatacatcatgtaaagccttatcttatgtcatacacttgtcatacataggtaatgacactaaaaaaatgagttcaataggagcacccaacaaaatataccattgaacaaaacttcagcacgacaaaaacaagaaggttaagatcacggtctgacagtgtatcagcactattaacgtatccacaatttatactcattatcatgcctcaaaactgaacggcaactatccaacactgatccttgggttctttcgttgttacagtatgaaaattgaacccatcatattcacccaacaaaaagaagcattcagcttcagtgcacaaatccaaggataaaagcttaagacaaaaaacgtacagcagctgccaacttctgttcacatctgttggaacagtctcaagcatcaccatgaacaaaaacacggtccttatcatcaagaactaggaagaaacagcttttctttcttcatcatcagtgatcggtagtttcgtaggcacgtcaaagcttgcctttagcgtgcgaagtctttactctgtgctgattaatgcctggagcaggggatgccctgattctgcaattgaggtgcccgcaccattagatcctggatgccctgatctacaacagcaatgcctgcagctgcaagaccaaccaactgttagcagccaattacacatggaaaatatgacgggatggatgatgtcaatgaccaaccaactgtcaatgatttctaaggcaattctgaaaatattataactagtttggtgtgtttacagtcctgggagccaatactggagctgctactagcatgagttcaggaacaaggtaacttgtgcaggctagaactatagtaattgacatcagcagcatggctccaatgtgcaccaattcggcgtcacattggtcaacccattttctgggggtgcctaacagggcgaaactaactagaatcaggctctaattcagtagtaatcccatagattggataaactactaagtaaaaactggcttgacctatgtatcttttggtctagtcttggtaaaattgaattggtttctgttgttgttgagtccatttggacccctggtacctgtgcacctatttcaggctggctggctggccatgtgtcacacaggtctttttggttaattcatttgaagattttgcctaagacttgctgcatactaagatacctgccgggcatttgaaatttggtaacccacttcattgtcctgtacatatacaaaggcttctgttcgctgctagtactaccttagctgaccagaagttaggaatcaacgatgcatttatatgtgtgtttagttcacgtcaaaattgtaagtttggtttaaattggaacgatgtgacgaaaaagttggaagtttatatgtgtaggaaagttttgatgtgatggaaaagttggaagtttgaaaaaaaaagtttggaagtaaactcggcctaacctgcatttgctgttttggttgaaataagattcagagaagattcgttggtaccattaaagagaggaccaattttccagttgctcactaggtgatttcaaccagaagctccggtcgaagccccatgttcataagaccatgctagcaaaaagataaaattagtaaaacaaagcagatgttcaaatatcgctgggataatataccactctcaaacgccaaatagaccgttcttagcaccagcagaggtggggaagcgcgcataataccaatgcctcactcaagatgtgacaggcaagccccactgctatatgaagagctaaggggctgtgtggttttcgagacttattttaaggtcctgtcacatcgaatgtttgaacactaatttagagtattaaatatacactaattataaaatccatttcataatattggactaattcgcgagacgaatcttttgagtctaattacgccataattttgacagtgtgatgctacagtaaacttttgataattatggattaattaggcttaaaaaattcgtctcgcggattagctctcatttatgaaattagttttcttattaatctatgtctaatactctaaattaacgttcaaacatccgatgtgacatgggctaaaaaatttttagcaccatctaaacacccccacacaagcataaacaggagaggggttccatgttccatcaacagtgaaggtaaagaatactggcttgccaatggtatacagaagggaacatctttgggatctggagaggtgggcatcactgccaatatttagaatcacaaatgtaagttacttctagattagacaaaaagaatgaaaaacttaacgtaagaatcagtaacagtatactatatgtaggtgcagcacgtgctcttattagggaacttgctgcctatggagtcccgaaagccagaacaacaacaacgaacacgaggaagagctcctcaagggggatcccatgggatcattttgtaacctagtttgtaaaaactctgggttttttttctctcttctcctaatatgaaataggcagagctcctgattttacccctaaaaaaacacgaggaagagcatcagatagaacgccttacggacaaaaacaacacaagggtcattcttgtgctgtcgacatacatagcatcctcttgcttattgtaatgaatcccatgtctttctagccaatccttctccatacctcagatgctatctgcatttaagtgatcaaattttcaatatggcaacatatttcaaagatatttggaacaacttaatagcacagatcgtatgcttcaatatgggtaaatggattggcataatataacttctttttaaactgaaactggcataatatgaccataatgatggaaaaaccatgtcaccgcctcaccggtcttgacttcctaggaagttgggacgcttgtgtcgggaggggtttgcatcgatacctcaaatcaaacgcatcactaggcggtcatgtcagcctgcaggggattccctggtcggattgaggcgtggcgaggacggcgctagaggtggctgccggcgaagcgctcctaattgaacctagagcagcactgctagctactaagcttcgtagcaagttggattataggcttaaacaaacaatcggcagcaaaaaaactccgatcgggtcaatcggcgccactgttaaaccctacctattgactattcccgccgaaggcaccggggtgggggggaggagcatgcgaaggccatgacgagatagatacttacaaagggacggtgcaccaggtcaccaaccaattctgtcgacggagtcgggggcgatcgccgcggcggcggcgagttggggaggagaggcggccatggagcttcgcgtggtgagttgggtgactggtggtaccaagaaaaaacgtgcaataaaaaccaccaattaattgaaaacccatgaaaactatatctaaatttctctaagttcatgaaaaaaaaatgcagagatggttatagttttgaaattattttacacaaaatcttaaatccgatctccaagaggaaaaaaagggacaaattccatgtgaatattaccctgatactattcatccttttttttacactcaaacgaagttaaatttagacttgatatttagacataatgtattttatgactatacctatatctaatatttttttaaaaaacttttatgtttgattttcataggttttatttgatggtttttacttaatatgactcaagtatgaattatttaccagtagaactacgtagattggggtaatatgttgtttttcaaggggcgaaaacgactcagaaatggatggaaaccacctttaccgctttcgttttcaaatctttttaagaatcacaataaaaaaaatcctgaattcaaaaatggaatcgaatattatcggatacggaaacagagctaatacaaaatgacgcggatatgggaacggaaatatatcggaatataaaaatccctctaagtgagcttccaagtgtttttttttctaaaacaatagataaaatccaaaattttagcaactaacatcccagatcacttcgtcacaaaaccgagtaaagtttgtacttactgccacaaagtgaggtgcatatcttgatctctcattgtggcaatcacaataggaagtgcagaataatgcatcacataacacaatcactcacagagtgaaagtcacatttaaattgtagtatgtcttctgctcaggtccaaatcccccaaaaccacgaattccgcgtggaccgcgtcgaggaaaaaaccgaactttcctagtgtcccctccacactctcatcgcgtgcttcctgcgctcactctcttctggaagagcttattcccggcgcgaccatggcgatggcggcgctgcgtgaggcctcccgccgtctggtctccaggagggagtccccggcggcctacgcgcgccccttcctcctcacgcactcccggggcatcacctacaggctcttcatcggaggtaaacctcaccccccgtctccgtctcctcccgtttcctgactcgcgcatgccgcttgtgtaacatctccaccatggcgtcatcacagcgctgcagatctttgctcgctcgccgtctctcgtgcgtgcagatctgtgtgattggcggctcggcaagtcggcaagcctgtgcatgcatagtgttcgacgaaatgcccgagagacgcattcaccctgagtttctatccttttacagggctgtcccaattcgcgaccgaggatagcctggcagaagctttctctcagtatggccaggtactagaaggtacatttacttgtaacttaccagagccgagcctagagcacactttggtttatacttcttgtcattactagtaagttggaaactgttcttgttcaaatgcagcaacaattgtcaccgataagatgaccaacagaccaaaaggattcggctttgtgaaatttgcctccgaagaagccgccaataaagcaaaggaagagatgaacggcaaggcaagctttttgaaacagtgtatttttagttcagcctaggccttgtttggaatgttggattaccacatgaacttcacaggaaaccccaaaatccagtttaagggttggttgtttctttcctagcaagttcatgtagaatatcagtcttgcaaacaaggccttagaagttagaagcacactctgtttttcctacttgatttgattaacgcaaacttgcaacaggtattgaacggccgagttatctatgtcgacattgcgaaggccaaaatgaatcgtactacagattccagtccaagagcgacaggtcctcctaagccacctgaccgctgttgatagcatgcgtgtcatcttcatactttcctttttatctgctgcacgagtagtctattgttagattgggagtacctaaaaccatagagagtaatatgaacgatattacaaagcttagaatgttgaatgtccagttttaaagttcaggtgctaatggattttcatccaaagtttatggggaggttattgggacttcttcctattattattgagaagttcatgcgtaataatactggatttccagttttgcaataaaagaagatgtgcccgatcaacagctcagattatgatataacatcacatgctcttgccgatcaaatactgtgccctttccttctttgtcatggacagtatctataatgctgtcgccatgaaatgatctgaaaagtgctgttcatatagttgcatatgctcttgatgaagctgtggtagaacagtgtccttcctccatgtctgtccagtgttctgtatggaactaataatgaattggtgttttcaagtactcctaacttaaacttcatttgatttccctaaaactgtggaacagtaccttgattatacggaaaacatgaattgtaatgcgatggacagacggcacatttttttctgcattcttgtattatttgaagggaaaacattactctttctttttcaaattgaaacgtaaaaaagcactactacatgagattggaacatgcgaacaatgtcaattctactaggcttaatgtcacatcctaggatcagctcaggtgttttatctcctattttaaatggatgataagcacctggccaatttttatagtttaagaataatgtaactacggtggaagaaaaatacacgcgagttctctgctcgatttgtacactgatgaagagaaggccacattttgtcctctctttttcctaaccgcagccgccgatcaccggagcaccacggcggcgacgaagctcagcacggccatggcgctggcggcggagcagcacaggtcgatgagcgcctcgcgtcgcgccttgctctccttcctccccttcctgctcttcacgaactcgtcatacctcctcttcgcctcgtcccgttctctccccccgcctatcctctgttcctccattgccgcagcgaggaggcggaggcttcgctcgccgctcgccgcggcgccgtcggcgtcctgcacggcgaggctgacctcgctgatgttgccggccccctcggagcaggtcacggtggtctcgaacttgcacccgcccagcaccaccgcgaacctcaccagcgtctcgccggtgtaccagtgccggtccaccgccacggcgcgccggctggacacgttcaccgctcggccgcgggcagggtcgacgaccacccagctcagctccagctccgccggagacagcgccgcctccgccgccggcttcttgcactccacggcctccacccggaacggcgagccgaggaaccacggcgacgacgcgggcgtctccacgacacgggagagcaggggcgcccccctgtagtagacgtccaccgccgagacgagctccgacgggaggggacctccgccgccgccgccgagctccccggcgtccgggcgcgggaacgggaacgcgtcggcgaagagccggcgcggcgggaccacggacagcagccgcgggtgccccgccatggacggccactccgcgaggcagagcgcgcgccacgtctccgggtccgcggcgagcgcccggagccccgccgtggcgcagctcgccgccgccagcgaccgcccgtccagccgccgcagcgcgcgcgccagcacgtcggcgtgcaggtcctctatcgtagtagtcgccaccattttctcttcttctctccctggcgccatcaccctctctctcctcttttgtacgatgaaccggtgataactactgcgcctccgccgtggtccggcttttatatagcactcctccttgtgtgccctactagtagtaagcgcggtgaactctggtcaaaaccacagccgtcctggctgcgacgtggtccagtacctgtacagtgcgttggtgtgtttcacaattttctttcgttttaacccgcatgccggtgtggccgtgtgggcgcggcttgcagtgcagggcgccggcgtggcagccgacgagaaggggtcggtggcgcgtgccagggccgcgctggcgcccgtggtacggcgcgacgcggctcgcctcggcgtatcatctcaggccgcgaacgcgtggcgcgccgtgtctcctccgtgccacgccgcggcgcgtctacctgactcttgagtcggtacgcgtcgtgcgatcggctggttggtcgggcgcaaccgcaaacgcaagcgagacgtgccgttcgttgcacttgacgtgacagagaaccaaaagaaaaacaggttttgtttccctgtgcctttcacggcgaccggtttttctggcttgatggcaaagcaaatctgttgtgcaccggtgtaccgtgtgtccgtgtatctgattcttaattgcgtttagaaggatatcgttttcctcgcgggggggagaaggccgtcgaacgatcggcacggcatctgcataccgctgagatgctgacgatgggggcggctcaccggcattaatgtcctgggagagtgagatcgagggctactggacgtgttacgtgtacgacggcttggcctgcgtacgtacagctaccgtgtgctgctgcgctgttgctcttgcagatttctcgtcaagaaaggcgcattgatacagggatatgtacgtccgtgtgtgtcgttcctatcctctcgcggtgacacgataagcctctcctaataattctttttagcacacgagctttctcctgatcttgcgattttctgcatgatctctcgttcggtgttcggtgaagcaatcaaaatgagaaacaaatgtggtaactttctgcttactactctatccatctcataatataagaaattttagagttatgcacagttattaagatggaggtagatggaaaaagtgaatgatggaggtttgtgattggttggaaagagaatgctggtgaagaagttgttatattttagaacaaattcaaagagaagttattgtattttgagacggaatgagtagtttagatgcacagcaatgctacgctgttgttctgtgattgtgcttcagctggggaaagcagagcaatagtattcagagtttagaactgtttatatgcataatgcaattttctcgcgctccatttttgaagttcctcagctttcaaagcctgggcgatcagtctgagcatgtcggtagagtcgcggtcatgattgccagagcaattaaactgaagattaaataaagtcatattggagtagattcagattggccccgcaataagataatcatatatatcctttgatttcttttctcataatggtttctgaagccttggctcggccggccgtcatgggttgcctgaactagcatcagggtttcggggcccaaatcctcatatggtcatatataactgcatgacgttgcaatatgtatggcaaggatctattttacatgggtaaatttgtttattaccgctgtaaaaatcacgagctaaaaaatacatgctactccctttatcccataatataagacgcggtcaaaattgacacggtctccaaaactaatctttaacctataattttccatgtactataaggttcctagccacaaaactataaccatatgaaagtaaatttaaatatcaatctgatataatttttaacaaataaaatttattttatactccattcgtccctaaatatttgatgtcgttgacttttttaaacatgtttgactgttcgtcttattcaaaaacttttctgaaatatgtaaaactatatgtatacataaaagtatatttaacaatgaatcaaatgataggaaaagaattaataattacttaaaatttttaaataagacgaatgaccaaccatgtttaaaaaaaccaatgacgtcaaacatttagagatgaagggagtattatactaagtgttagtgaaatattttaaatgctaaatctttaaatacgtgtgcgtcttatattataggatggagggagtacgtcattagtatgtagatccagagatccagcctttatatgtcattatcatgttacgatgttatgttacaactcgagtatctttaagatggtactaagttatccgattttacattagtataatgttttgagttaccatgtttttaagagaaaagatagttttaccaaagatttggatgctactatggtattacttccttcatctcagaataagtttgttttccatctatttgtcttacagagacgccatctttttcagcgatcattgcattagagtattgggagacaaacgtattgagatttgctaaagtggagaataattatattggagtttgctaaagtaagaacattctttttttttcctttgtattggcatgggtagaaatgggctaaaaatgaagtcttagtgatggagatagtacacgggaactgtctaaagatttcagattgcagatttcaggcttcaggcttcttttgtttgagaccaaaattaaccaatcaaaaaataaatgttgatattgccaaattatttggcttagggcttgttcactttatagtcacttttaaccttaccaaaatttggttatactaaattttaacacatttttacattaccaaatttttagtgctagatatgttttgtttgaagccttatcaagttttgatggaatttttacgagtggaaacttataaaactacgggcctgttaactttgggcctgttcactttggcattgccaaaattttggtaggatttcttatatagttaccaaaatttgacagtaaactaaatgtagccactttttttggcaactttaccaaaatttggtaaggttgaaaatggcatcaaagtgaatagaccctttgatgccgaaaaaaaaccttaccaaattttggcaatgttgtcaaaattttgacaacttgccaaaattttggtaggatttcttatatagttactaaaatttagcagcaaactaaatgtagccacttttttgttaactttaccaaaatttggtaaagttgaaaatagcatcaaagtgaacaggccctaccaaaggttggtagggtaacattaataagaatatgtataatttgttgccttacaaaaatttgataataccaaaattagtagggttaaaagtgacacaaaagtaaacaagcccttaccaatcaaaagcctagtcaattttccccaaaaaattagtaattaccattgtaaaaaagaaaaatggtaagatcacaaatggtaaagaaccatataagccctaattagagctaaagaatgcagctcaggaacatgtggcagtgatctcggcacaaggcatgtttcggagtaaaaacagattcttcaaaaaaataacttcatacagacagaaattcaacattttcagtctaaaaaataagaagatatttggagggagaaatgtcccttcaaacatttttttaagaaaaaattatgagcatgttaggatcaaacacaaaatcttggagttgaaattacataccccttaccgctccactgcactgtcaagtgcatctcagcattttagtctcacagagaaccttctgttgtgttctagactgagataattattttggttaatccaattaatcattatctcgagttacaacattttttctctctagagaaacatctccattttctcatcgtctcccggtttaactgcattattatatacttcctccgtttcttaatgtaaatcattctaccatttcacatttatattgatgttaatgaatctagacatatatatctatctagatttattaacatcaatataaatatgaaaaatgttaaaatgacttaccctataaaatggagggtgtaaaacggagagagaagctgttttctgcgcagcttgtttatgactcgcgcatattccttgtggacaattagtcattgaactaggacaagtctagaagtggaatcgtggaaagcttcgattaggtaaagaaaatgaatgtaggaacttcatctggaccaaatgccacatttgacatccaagttaagattccccatgttgtctcatgcgcgctcgcaagcctctcctttgcatgtcgccgtgtcttcagcggtcaagccgccttcatcgatcctctatttgcacgttgtgcagtactgaattatactataattctgattcagtacaggtgaagagtttttttaaaaaaaaactgaaaacagcactagagtgtcttttcattgaatagggcgtacaggtgaagagttagaagagtgctttggcagcacctccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 38488 - DNA, 7067 bp, Oryza sativa
tcggtcgtcggtgagatccttctcatattgtcgcggtcggccgtcgttaccggtcaccccgcatcggtcctcccctcccgaactccctcttctccttctgaaggtcaagggcgaccccgtccgccctccgtcctcgcaagccgccatcgggcaatcgtcgtcgccgtcatcttcctccgcgccggccgccgcttccggtgaggacctctcctcccttcctttttttttcccgtccccctttcttgccgatctccgcctcttggggtgcgtcgccgtccccgtgcgcgccgctgtcctccggccgcccgccgccgttccacgtcgccggctgctgccgccggtggccgcatgccgccgccgccgcgccttggctcggccgggccggcttcgtgccgcgcctgtgcccctggctgccgctcccctcggccgcccgatcggctcaggtcgatctgggccgtccacgtggtggaggcgcacccgaggccacgtgtggaccatgtccaccgtgcgccctccccctttgactcgctgacgtgtggggcccgcatgtcggcgccggccgccccttgctgacgtcagcgaggtccttttcctttgtaaaaataaataataattgcgcaataattcgtgaataattctagaaattcatataaatggctcaaaacttctaaaattcatatctaattcattcgaactccgaattgagccattcaacttgcaaaattcatctaaaattgagctctacatgtttgtttactttttatatactgtttccttggtttttattagattttttcctcgttttgcgtgcctacgtgtagaatccgtcgtttcggaagatcacggtcgcaaggataggagttcggaagattgtttgaagaagcaaggcaagtcacacattccctttgagcatgttgatcccaatttacaaatgttttactgtttgcaaataaatatgcatgttttgctaatcacatggggtcagggttttacctatctgctcgcttgtgccatgtttacttgatatctgtcctttgtcaaccatgggtaataaatcgcctagcttgtgttactttgatgacttagctagaactatatgcttagccatgcttaattaccactagctcagttgatgggataattacagtattagacctttttagtatcagagtgagctgcgtgctcgagacatctggccatgcttcatggtcgtaattattcaactaaaatgcgactgaatggtgggctatgggtgcatggttttgctggtcgcacccatggcagttaaggaccggttcgcgagatgccctggaagaacttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgctggggacgagggtgaaacctgaggtgtggtgtgcttggctagagggggttatgcgaagggtcctgtcacggcctctttccggtatgtcgtggtggcatgtcggcgtacggaaacgtgtcgtggggctgtgtctcgtgggtacagttgtacacctctgatcagagtaaaactattcgaatagccgtgcccgcggttatgggcggtcgaccagattcaccgtgattagtcccatcttaataaatcgacccaatacactgtagttcaggtgggttggttgggcctgttcaacgtggtgtagcgttgatcagtggagatttaatgttactttaattactcaacagttttactgttttgctcaataaaatgttttacaactgcctttatgcaaatagccacaaacccctccttgtatccccttgcacatctgcatcgttggagtaagagtaagagtccggtcaaaaaaaaaaagtaagaaagcgaggcaagcaatattttcatggatcctgcaccgcctacttatgtggttctcattcttcgccaccatcttcagcaagctcttcgtctacgtatgtaaaatgaagtagtgacttagattttatgtgttaataatattggtggtttgtgatattatatgtgtgaaagattagtttcttgttatgagatttcggagtataatagatgattggttttgtgaaataacggttgttgtttaccggccgggtgtggctggttagactgtgggttatgtggcagtcagaccggccagcgatgtaggatctcttattatgatcgagttttttgttgcaagatttaatttcatcctcatgtgaattcacgcgtgttttatggttttggtgcagcgaatctgatcattcatgtacttcacacgattctctagctagatatttgcattcactgaattagttgtatgtgcagaggaattcatggcaaccttatcttctgctgcttgcaaattaatccatgaacacttctaacgccaaaccgttgagaattctttagaattgtgcgctgggttagttcatcgatttcgctatgatgaagtggacgaatagggaaataggcacgatcagaaagtttgattttctgtttcatgttattctgacgaaatgtttttgaatctagctaaatgtttgcttagctttattgagcacaatgcattggattaacggggacgctactgagccttgattaagaatagtctgagttttggatcacgttaggagtttatttaggatcatcaatttttgacagtatagcttctgtaaccacaccttagaacataccgtatgagtatgtgatttgaaaccaattgtttcagcacataaacttgtagtatccattagaattatgacatgttgtcatgctgatcaacttgtttgatcatcaaaatagttctttttttttgttcatatctgtactgattatgctgtagctcacaatctttagtacttttccaagactgatcgttcgcacgtgcaatataagttcgtgtaccaaaacgagcattttacatgttcatgtactagattacattcacctaacaagttcgtgtaccaccgatgcaatttactctattatatacttaagcttaacagttccgacaaaagaaaactgtgaccaataattcatcatagtaatccattccggtggatgtaaaaataaattcatatcattccctgaactctgaatttctccgagatgtttcttttgtgcgcttgattgctttcatcttgttaaaccgcactgaaattcatgcacagtaacaatggtgttcaatgttcattgacaggctgatcccgtgcaacgtgtccgcggtgtacgaggaggacgagatctacaacgtcgaggaccagccgccggctatgaacgagtcgagcgtgcatgagtgggggaggagagccgcgacgccgaggcgacccgcatggccgagccgagcagttggagaagcaggtgctgaccttcaacaccgccgcccgcgcggaggggagcgcctcgtgctcgcgcacggcttgcggctgcggtccgacctcaccctcgccccacgcgcggcgcgcctcgatctgccgcgtccctttcgacctcgccgacttccgcaaccgctcgtcgtcgccggccaggacaagacgtcgggatcggattctccgccttcgtgcgcgcctactcgcacttcctgggcatccgcttcctcttcgccgcacaggacatggaggccgtcgcgatctagcaatggcagcggcggaggtcacgaaccgagcaaggagcaacgacatcgacaggacttcgccacgacgcgtagacacggagggcgcggggttctccagtatcttcagcgatgggtgaatccgtggatcccaggtagatgacgatgagcagcgcatccagggccaaatcgttcagcggccaaactcggcgcgcgacgcgagtcctaaacagaaccgaaccgaacctaagctacttccgatgctgactcccgtttcttcgattaatctactataagtatcgcacctgagaaccacctcctgcaatcagcaaccagtgaaaaatatcatacaatcgcttatttgtttatttttttgaaaagaatacaatcgtttataattattcgcttatccctttcacagcattgagagatttcaggaaaaataactcatggagcactccaagcaatccatccatgagctccaggaggacggtggtgcagattccggctccggctccaaggctgaagcgaagacagatttggtggcaggcgggaataagattcaagaagaaaacaatgatagcactgcgttttgccgggggtgtcgtcgccgcctcatccggttcgccatcttgaccatccggttcgttctcctagcggggttgcaccgcgaatatttagggatggtggccaagtatcgtggaactggttttggcctgtttttcacatgtcatgagtatgctctcattgctttcattattgtagttagctatatgggttactagtcgtcttgatccaattatgccgtttgtgtaagttctactttttttaacacagctcccttgtctctagaatcaaatatttacttcaataaatatccgtcgtatatattgttctatctgctaaaactgtcgatgtacttcctccgtcccaaaataagtgcagtcatagttttccgcgcccaactttgaccgttcgtcttatttgaaaattttttgaaaaaatttaaaaacataagtcacaagtaaagtactattcatgttttatcatctcataacaacaaaaatgctgattataaaaaaaatttaaataagacggacgatcaaagttagacgcggaaactcatggctacacttattatgggacggagatagtacaatcgtattgtttttcaagtagtatttctttcaactttttttcattggaaggtctatttataattacgttatattgtacgcggttgtcttttccaattatgataatcatggaagaattgcagagttgcacatgttgttccgttattggtgggtaggaacaattgcttaggaatttctcaaattgcgtgtatgcacttctatttccaaaataaaatttctaaggaaacaatttctcacaacatgttgagtcatcatgatacggagaaaagctcattcgaatccaaatactccatggaatccgaatccaaatgtgatactcgttgtcattgtttctattagcagcactcgtccatgatcgacctttgagaccgcacatcgatccggagctgactagggcaatcatctagtccctgatcactatacactgaatctcgggcctaccttctcctcttcatcatcggtgggagtgccgttgtgtctatcatcgtgctatcttgtccaattcaaccacattttagtgtgtatctctgtaaatagcaacttacacatgtattatgacgtcgcataatcgcattgtcacttttcatatgagaaatgttgctcttgttacacgttatgacattacattgtcacttttcatatgagaaatgttgctcttgtcacacgtgcattataacgttacattgtcgcttacaaatgcatctcctcctccatgtgtggattgggtattttggtctataccaaaatatggtagaaaaaaagattcaaagtatatctgtggcatataaaatgacatgatccatacggttacaaatagataaatagtaataatattttttcgatacaaaaagacatgatcaaacgatgtctggctttggttctagtgattgtgtttttatcagtttcagtgtttcaaccaccatttcctcgatattgcattctaattcagaaactgttgttttcttcttgatgggattactcgttggctgaaatgttggatctttcttgcaagaaagatgtgtgctgccaagaggctgccgattttgcaaagtgtgtcagaaaattttgtctgaatttattgtggtgtttgtttgtagcaacggtaatggtaaaagaaatgtacttgtattttatagtgtaaccggtgtgaattcattcggttcagattcagtagtgttgattggcactgctgcgttcaatttatttatttatttatttatttatttatttattttttggaaaagcgctgctgcgttcaaattcaggctcaggctcgaggaatgtgttcactgtatagaatacaaatggaaaatgctaaaaatggcaaatggttttgtgattcagtagatcaagcaaaactatttatatcggtattacatcacgcacaacattgagagaacttatgaaccactatattgagaaatcttatgaggcattcagaaacacgagcattatattgagaaacttgaattgagaagttttaatagatgatctcatgacttagaattacttcgttcaaatgaaatctcatggatggcttgacaaaaatacctacaaaacttctgctgtcaagtgcaaataaatttggttattagaattacgccactctccgtgcgtaaaactacaaatatactgttaagtgcaaataaatctggttattagaattacgccactctccgtgcgtacaactttgagatacacttaatagtgcaatgacaatgggtgtgtggttttattctgtattcaatctccaacatgttcataatttatttttaaaaaatgtttgaagtgacatctctccctctaaatctacaaaacccagtgttaattaactataaatactttcagttatgacgtccggctgtttagagggacatctctccctccaaatcttgtgttatttagctataataaatactttcagttatggcatctagctgagaccggagcctgcaggtaatactggcatactgctagaactcatgcgttaatccctcaacgtccacaacttccttcgcaacctttggttgcattatacaatgtttggtaatactggcatactgccagaactcatgcttgaatccctcgacgtcaacaacttccttcgcaacctttggttgcattatactccctccgttccataataggtgacgtttttgattttttatttgcaacgtttacccattcgttttatttgaaa

SEQ ID NO: 38489 - DNA, 20006 bp, Oryza sativa
  unsure (1)..(20006): unsure at all n locations
attcctgcagcccaataataattctaaaaaattttgaataagacgaatgatcaaatattgacaaacataaactcgttttatttgaaaaattagtgcaaatataaaaaaaaataagtcatatgtaaagtaattttgataataaagcaaatgacaaacaaaataaataataattccaaaaaaaattgaataagacgaatgattaaacattgacaaacaaaaactcattttatttgaaaaattagtgtaaatataaaaaaagataagtcatatgtaaagtacttttgataataaagcaaatgacaaacaaaataaataataattccaaaaaaatttgaataagacgaatgatcaaacattgacaaacaaaaacttaaaaaactcaaaaaagcaagtaatataggacggaggtagtacaatgttttagggttttccgtgtagacatctgtggacaagtgccgacagccatgaaaacgccaggccacatatggaagaagtgaattttattttgttatcactccatacagtggaaagtatattgacatttcagctcatttaatccacgagtcttgccatccctctcctgtggcttatgcataactatttttatttcgattcgtcatagccggtgaaaggtacacagatcactcagcagcttttcctttcctgcgattgctaccacctgcagaggctccggtgcctcccatctccacaaggtagtagatcattgagtcgacgtcctcgccaaatatgctataggcttccatgacctggatgtagttgaagcccattgccaggaggagctgcatgctgcgggttagcacggtgtccgggagaacgaagcactcctcgccaactctatcggcagtcccagctgaccgagaagacccactaactgcagaataggaaatcatgatggtttcagcaaacctatcaaagtttctgtatgtggtctaccaggtagtccaatgccaagaatggtgggcttactcgcagcagaagaagatggctctgcccctgatgttgatgactctctgaagttaagttgttgttgctgctgctttagatactctgctcgtgaggcctccatcaccatccgctctatttccttctctgtcaactccaaatcagagtatagtcgtccttcagccagaagtgcctgatgttgccggcaagaaaagaattaagtatatttcggtttatactctaacaattcaaggtaaacctgattaatttgtgcagatgttgagatggcaagtaccccttgaaaacaattaccagtacttacattctcaatctgctgatcttgctgtgcttttattgcaaccttcacctgatccctgtcaacgttatttgtctgtacagaaaggaaatgaagttcatttattaacaaagaataccagttggcaaacactcaactgtagaataggctataagggcaatgataaccatggaccaagacatacccctctaagggaactaaatcccaggcctgcccctactgtcagcccacgaggatcaaccaccgaattgtaatgattaccatgatggtaacttagcctaattggagggacatctgtattgtagcttccttgaaaaatgttaatgggctctgcagtaagagcaaacaatatgagactatgaaagagtttatgcaactacagagaagggttaaaatcctatagcaacatatgtgttacagttacctgtactataggaatatatgtgaatcggacgattgtacatctcagcaaatgcctggatctccatattgttcccatataccttgagaatcaagcatgtcaacataaattatttgcagtggaagaaggtaaggttctaaatttttccttgtcctaagtcctaattttattttgaagttgaaaaacaagcgctcagtatctacatgatagcattatttttaataaaaaaaagaaattctgaaagtcagggaaaatgcacagctgttgtgtggaagcataaatggttaaaaaaattaaatgcagacgttcattaagatctgcaaaacaagattcaaacagctgaaaaacatgctttccaggggcgcacatgctctatagtagattaaaataaaagacaagtcagctgactgaaaaacattagtttcataacattttcaaaaaaaaaatacgaggatgttcacaagcacagcacaacggttcgaagacactcagtgtaaggaaaagcagcaagcagttggaatatatcctaaacagccaggatctattgaatagcataccttatctcttctttttctcctacaatatgatgtaaaaccttccgtcatgaactgcgagaaatgatcacgttccctttcctggaagaattgataacaataatgagcatatcagccacttggtcaaaggggaagtcactgttacctcatagtctaaaatagatcaggtattcaggtttcaggaaactggggattacttcgggctttcgaggcaatatattccagaatacagaatgcccctttcaggaacagtgatttattgtggatgagatgtgtatacaatcaaaatcacatcagaaatttgaattatactccttgttctatgcacatggtgctaatgtgtcaagtaactcagacgacagggagtaattacgatttcaatgcatgcctaataccatgctgcaaactcaaattggtatgttcttccaaatgctttcaacttcttaaagaaaactcccaaatgcgtgaaatatacagaaaaagacactagaaaagcaatgtcctggtgattgcatagtagacaggagatgcattaaaaaaaatacagaaaccaaaacagaacactaggaaagaaaaaggtcctgctggcataaagacaggagcatccctcaaaacttctctctttttttccatgtgaaactgtgaaagtagatgactgggcaaaagacggtgaagaaaatcatgctgcaaacaaatagatccttgccaagaagtttatcagttcaacgataaacgatacagttgagtctggacttgaacttgaatcaaatgcttcattaacaatgaactaggcatggcttcacatttgttgcacacgatataattgtttaatatgtcatttcacaaaatatgtaagtcaaaaggtagaacagacagcacttttcccttggtaagttcattattaaattttaattcctgtataactagctgagtgctacctctaaggaaacagaacagcagaaaccaatatctaccctgaccagcaaaggagaagcaagttgcaactatgtttcaaccctaactaacagtagacgaaactgcaggctgtctcaaactagtaatgttccaccatctacccatattgcttccccaaacttatccaagatcttacagagccaataacttagtataaaatagtgagataaattatgcgacagggtagagaatgagaaatattaaccaaatattaatgttggcttatgaattgaacctagggacggaatacatataatatacggtgttactactcagatgcaacgacacaacataccatataatcaacacgcatctgcctagccctgccaatagtgaacaaataaggggcaaggttgaatgcaacagattaacatgttagaacactgcctccaagcttgtgaatctagtttatggattaatggcaaaggatatagatgtaacaataaacataccatgtaatcaacacacatctgcctagccatgtcataagcttctggatcaccataaacttgatctgcaactgctctaaacagacaattcccatcttcagccatcttattgatttcaaatcctctcactcgtcttaggtcatgttcaaacatgcgctccctttcctgaggaaatataaactacattagttgttgtcaaaaacaaaaaggtgcctgtttgcgaatgtgacaaacctaccattaacgataaaaggaataatgttattgtatcatgcaactacaaaggatccaaacttccaaaggatctatgacattatctccacatcctagacatcatcttcatgccatgcaatcattgacaaatggcaaagctgatataggaaatacgatattaaagttttcatataaaatagaagcagacaagagatcataccgaatcataataattagaggcgtaacaggggccctgctcatctgcactattatacccttcactatcagcaagtgatctaggtgaagaaggtcgggaacccgaagcagatgaccgaactgccactggtggccaagcaactggccttcttgaagatccaatccgtgcattgtttgagcttccagaccccattctccttaacccattattaccagacgatggtttcggtggtggggctggtggagctggtggaggtggtgggtgtgatgctgcaccagcaatctgtgatggaccaatacctgactgcactagattttcctgctcaaactgatcagaaaactggaggcctgttaattcctccaccaagaaagcaggatcgatcacactggagtcgtctttgggaggtttctccataacagccctctcctctgcagagcttgaactctctgatgtgggatcatctagccccaatggcttattactattactgctgttatcagcatcctccactagatggtcagttatattgtctgaagccgtgagctccgatggatgctgatgaggctgcggcggcagctcctcctcccgggcaaccgctgatgtcgcctgcagttgctgctgctgctgcagtgtctgtgaccccgagcggctggagctggacgaggagccggcagccccgcgctgcacgaagatcctcgtcatctcccactctcctcagagaaggctccacgtctacgcaccagcaaccctcctcgaatcagagggccacgagcgcgcccttatcgcgcgtgcggaccttgggggcggtgaatctggcgcctcctccgccgccgctgccaagggagctgctcctctcgtcgtcgccggcagccaatctgagcattccactgccaattctcatcagaaccagggcgacaccagtccctcctcgcactcggatcacaaaaccctagctccccgcgagatcgagacgcgcaggctagtccccttcggagagggcggcgagccacccttcccaaaaccctaaatcgcccgccaacccgatcgattcagcagaaaacaacaccgatttctctcccaggctctctctctctcgagggggtcgagcggattacctcgtcttgggggaatcgactggtaggcgcccttcgattcagcgagcgatgggggggcgcacgggttcggggccgacgcggcgatggggagattggagctagggtttatgtccaaatcgaaatcaacaaaaaattttggcttcgccgcgtgaattttttttctctcgctgttgttttggggattctgcttcgggtggatggagagagagagagaaagcagctgtatggtgaggtgaggtatcggaagaggacgaagacgatggagatggaagaaggggcgaagagaggttgggtgtgcaaaactttttatacgtggagggggagcgctaccaggcgatgacaagtggggcccacatggcagcgtccgttgggatggacggtacgtcgcgatgctgttggttttgcgtcgatggaaatccagtggcccgcgtttgtggcatttgcacgggatggttcgtcagctattgtctcgcagtttcatggcagtgattaattccagagaataatcggcgaagcttctttaatatttcttataaacacgaaacaaatgcagacgttcataatatgcgtacactcatagttataaaaacacaaacacatcttacccctatagaaacctctagaatattagactatcatatcttgattaattggcatgtgggataattgatttttttttgcaccggtcagaccggggggaccagggcatgtataccagtcagataggagtgatgatgaataatgttatcaagtgatgaacatggacatgtctgatggttgcggttagaccggctagggtaggccgatcagaccggagtatggcgagcggttgtaggataaggaggctgactagaggggggtgaataggcggtttttcaaacttttggctaaaaccgagtttcgtatgtggaagcgtaaatcaaaatggttttgcacaattcaaaacctaaatcaactagtctcaagtaaatgcacaaagaaactagcctatgttgaggtttgcaagcttagggtgataatagcacaaataaactctagtatgtaaacttgctcaaagtaaatttgcacaaaataaaggagacaagagacaaggaattttcaccgaggttcggaaacttgccggtttcctaatccccgttgaggcgagcccaactccaccgctcaaccacgaagccatcgcacgcccccttcgtcaaagggggcaaggcgggagccggcccacggagaggactaccaaagcctcgatcactagggtagttcttccttcactccgaaggtggtgaactccaaaccactcacaactggcgccaggcctcctccacaatctcctcggagaggtcaccgggcaacacctccacaagccgtctaggaggcggcaacctccaagagtaacaagtctaggatgcttgccgcggatgatcaagtaccacactagctataacaatgaaacaatgcacttggattggcttaactcactctctaacacctcactagataaactaagtgcccaagggtgtgagagctcttgcaagggttcaagataatgtaatggagtgccaaaacctcgcccttgctgctggggagtgggtatatatacccccaaccaccaaaactagccgttggaaccgaaatccccaactctgtgctccgccgatcagaccgctgttgtgaggccggtcagaccggactactttgtaacggctagaaaactagccgttacagggcaatcattgagcccactcaacttggtcggtctgaccgcagtgtagaggccggtcagaccgtccacggctcggtcagaccgtcatcggctcggactgaccggttgcggctctggtggctctgtatcgccaccataaaccagaccagtgcaacagaccattgaagccggtcagaccggccttatcacgccggtcagaccggctaacaggcctggtcaaaccgtcctaaggcccacggtcagaccgcaggtcacttttcagcacaaccaaccgttagtaaaacggcgatatttcttgacacgggtctcggaatttggcgttcttggactctatggaaagcttattcaaagggctatccaacccatgaacaatccatccaagaaacacaacttttctcagggaaaaagggctcacactccaaaggatactccaccggacataaccacatgaggctacccaaacctataggatttgcccacatctctctttgtttaggacttgagaatactcaccacacttggctagacaagcccaccaaatgcacctacatgcatatgaactaatatggcgcaagatcatccacattctcgcttcatagacccctcttgatagtacggcgtctatctagcaaatccggtctacaccaaacaccaagaccgggaaaagactaagaaaacattcttagctccattatacctttgccttgcgccatccaacttggggttaatgcttgagccaagatcaacacttgtgaccatccagttgaaccatatttatgccgaggtctttaccatcctttgtcaagactttattctcatcacaagtttgacttcattcttgccaacatgacgatgtccttggcttggtgaccattaacccatggtgtcattcattagcctcattgtagtgggacctattccttttcacatctcaaaggagaacattagtctcaacaaatcggttgtcatccttcacttgatgaccaaccggttgcatatgaaagatatagatatgttcgttgagttttcattaacatcacaagtgtcatatactcgtatgcaagctcaagtgcaaagatccgatataaataataggtgaacaacatggatctagaacatgcacaataaatgtataggatttgctccccctaaatatatgcatacaaataaatacaagagatgcaagtgtatgcataattagagaatgaccaattggggtttatcctatacacataaagagaaggcatatgtagtaataatgtagaccaacataaaacatataccttcatgatctccatgttctcaatgtaaatgagactaaataagataagactcaagtaaacattagtctcacacttatatatcaataacatggaaatcatatatatgaacctatcaaaaagtaggagataagaagtggtacatatcattttatctccatgcatttcatccttgtcatgattaaggtccatcacaaaagaatgcatgtcttccacatctcattatcgggaaatgacctagtagacaacttatgcaaaagagaggttaatcccataaacatcggtttatcatctatcaccaacgtaacaattatacgaattgtttaatccaagatcattcaatcttttctctctttggtgatggataataacccgatataaacaaatagagagatgagatgaaagatgttttcaaatcaagatagaaatcttataataaacaaaatatagaataagctccccctcaagtgtacatacatatggatataaaggaacacatacgcacataatcaatcaggatcaatgagagagctcacactatattttggatccacaagagagaccaagttagaatatgtgaagtttaatacatacctcccatcatttttactttcatatccaaataagactagtcaaagaaaggctcataaaaacgttagtctcatataattagatttgtcattaatcaccgaaaccaaattaaggcacttgaacttacagcggtcagaccggccagtctgcggtggcgcggtctgaccggccgacgttttgtcggtttcagtttcgggttatttatttgggtatttgtggataattattgtttatgaattctagatggatattatgtgtgtgctaccatgagtcaagttggtgagaacttgtgatcgaatatggtttcttagttgatgcatgtgtaggtgaatcttgatgcctcgggagggtagtgtcgatgatggatccaaagtcaactcaggagaagatgacgtcaggaagatcaggatatcatgcgggatgcttagactaaagatcaatgcacgtggttggtgaagattttatatggtatatgatagagatattgtgtgcgtaatggatgcagggtcgaaattggagggagtctatatttggtacagttggagtttgtaaggttcgtttttttgtatgggaaggttttctaggggattaggacttcttgtacaacgttgattcgtggttttaggttgcttacctcggatataaatagagagggtaggtgtagccttccgatatcgattttgagagagttgagtttagagaaaagttagggtttcgagtttagtcgagattttcgtaagaagtgttgttattgttgtactttgtaaacacagagaagtaataaagcttcaatctacattgagagatcttcgatttatgtttggtcgggttcgacagtccaaccgacgagtcatcggcggatagactgatggcatcagcgcggtcagaatggcaaatacgcgacggtcagaccggcggcggcgacaggctacagcggcgcatagggcggtcagaccgaagcgactacacctgccatactggaggtcatcgagcggtcagaccagcgcatctactccgatcagacagatcaccatcaaatttgagcataacttttaattccactaaaagttcacccttttaattggcttagttcttgttgttcgatcctacgctgataaacaagagaaatagatcaatatattgagtgaaaacaaataaaatagtttattggaacaaataaaattaaagaggataaaggatcaaaatacctcttattaatagcacattagtattggtggattggtaggtaaggggcattaaagaaataaaaattttcgatttgttaaccaagggtggataagaagataaaaattaatttatttagagtaaattacactttggactaccttttctaaccaatgtttcagtttggactagggataagatgatattttcactttaggctagataagtttgcaaaaggtttcaccttcaacccccttcttacctctccaaactccaggctctagctcgctctcttgtcgaccttatgtgactgtgagcatggacatgttgaggtcaagcttgaactttccgaagggcggtatcaatacggcaacccgaaagctcgttatcaaagtggtctcttccgctgtcagatcaaaacgggtagggatcggcccagcctagaacaactcgcttctcataaaaacgaatccctttgtgcctggaagaatgttgaagtctagagagcggaagatatttaagtaaggatgttatgccaggtagcattcggtacaagagtgagacggaggtagctcgagcctagcggattctccccgttacctggacctgcctcccccgcggtcaaaactctcctctccagcccctctggctgggccagaagcctcgtctcctttaactgaggactgactgcgcggagacgattgagcgtgggtccctaacgattttattttaggagtgaagccttggcaagccccaacgcttgaactttaagcaattcagcaagccccaatgcccgtggagatcatcaaccttgagcttggccgtggcccctgtacagtcgtcgtgatgatggtcaagctcaccaagctagagcttgggacaaaacgggacgaatcaaagctctcgaatggcagataaaggatgaaaacaatgagcagcgctcaagggccacgggccacggcagcgaagcagctcctggcccccatgttggaactgctcgaggactgtggcagccagtggcactccattgccatagcagcgagagttgcacgatgatggttgcgcaggagctgctcgaggatagtggctgcattccaaggcaacggtaggcggcacttcagaaggctatgcttgagtttggctagttcatcaacttgagaagaaagaggagagaagatagaaaagaagatccaaattgaaataatttgcaaagttatctagtccaatgtgaaaatgatgtcttgtccctagcccaaattgcatctttggtaaaaagaggtggcccaaagtacagtttactcatttatttaagaacaaagtttaaatttcaaaaattaatttattttaggagggatgggagtacccgcgttggcttcacaaatagccataccccgacgattctgggcatgtcgctttgcttcgtccgcagcgggggcagaacggtcacttccgcctggacaccctttcccaagggaatctgcacacgattgcacgaggcccctgcagccggtctgcgcatggaatgaccacccaacacaaaagtcgtccgattgcacgttctctcgctcttgtcctgttgcacaactgttgagatttttcacagtttcactttcacaggtcacaccgtcacagctactgtaactgcttacgcatcgctcggaccagcagcacaaaaaagttaaaacaatggagcgagcgagagaggtgatttcaaaatggggtaccgtccaggagggaagtaaaagctttttgataaagcaagaattcacatatgctgcaacctaacgtggcgtccacagtgtgcagtgctacaaaattgagcgaatatgcatgtctccgtaggctttatggaagaaaaaagaccaatagcagtgccagttggtgataacacagtcacagcccacaatgtctgatgtcagacgactccgtccaatgatctccgctttgcaaaaatgcaaatttcaactcgctgttttcaacacaacaacaagggtgtgctcggcaccctttttcccaactcatctctctcgtttttcatgcacacgctttttaaactattaaacggtgtatttttttaaaaaaaattctatatacaagttgcttaaaaatcatattaatccattttttaaaaaaataataaatatttaattaatcgtgtgctaatgaactgctctgtttttcgtgttactgttccggatttggaacaagcatatgcgaacacaccctaagtgcaccaatgagcttgtcaagactaaaacaacctgttccagtaaaaaaaacagactaaaacacctgttgattttctttttgaaagggtaaaacctcttcctgcagtctgtggctgctcaaaaattcctgtggtacgacacaaaaaggttgtatttcatagatataatgcaaataagcggtgacgtactgacgtcctaccacgaaaacaatatgcaactggacaaaactgtatggtcttgggcaaaactgtaccgaaatggcattcttcttcctctacgttggttgccattaccccactgtccatccacgctctgcaagcacttcacgaacccgtgccgccacatcaatggcatcgttcaggggagggtagctccagttgtctgacatctatggagaaaaaagaagggtgataattcgtccctaagataattatatcttcatattgagtattttcaaaactttcatcacggtgaaacagatggataattatcttaattacattgaatgacctcctttggtcattccggcgaaaaaagaaacagatggataacagaaacgattgcatcagaaaagactcaacatcgcctactcgggaaaatgaagcacgtgtgggagggggcaattgaaataaccaggactgtataaaacctcaattgatccactatacgtgaatatttagcgaacttacatcttctagtccagtgaaagggcggacagcacctctttcatgcagcctgttgtgaaaatccgagaatttccacctgcagtgctcagttccaacaacataaacaggtttcctgtaaatagaaatgttaggaaggtcggttatacaaataaaaaaaatagtgaaaagatacagatgaataatataagctcacccagtgctacatgcctcacttagcatactaattgagtctgctgttatgacaaaagcatcagcccatgcaagatgcccaaggtgtgggttgggtcctgcatcaagaaaactggctgagaaaactttcgtagagcacataaagatgagtacatcagacatgtctcattttaggcttttgacaactaccttcaccattccaaatataaaccttagggtgtgtactgaactctttcaatataagatcagacacctgccaacaaatgatttagaaatttaagtactggcacctactaagaaaaaatggacaattcaaggtcctaccttatgtggtgttcttctggaaaatgaaaccctgacacttccacaggtcttcagaacattgtgtagtgagcttatcaacttcttggcaaggcctacatcgtaattacagtttcctggccattgaaaatatcacatgtgttaaatctatataaccatgaaagcagaaaaggctcagcatatgagttcaaagttcaaaaaaagtctcaaaaaactaaaatatgtgaaggaataacctttttttctgaacatcaagttgaaaattctgaacaagacaaaaaaaacttgaataaacaaaaaagcatatgaaatgcaagggtttgcatggatgagaacacagaaggtgtgagactgatttctttcttctgctcccaagcattcaatcaatatatgcaagctaaaatgtatataacagcaatatctcatgctacgtcaaaattttgaaagagggattagaagaaaggtttgtgagaaaactgcagcttctccattttagtttggaagctttagctccataacacaaactaaaagaaaataaacattttttagcttgacatgttcatgtaaatgtttgtatttgacaccttttgcattagcaatgctacaagtcaatagagaaagagatatcaaaattccttgttacaactaacagacacaagcagatccatttgacgctgccattgttctcatgtccaatgaacagtaagaactaacttatgtaaaattgcatatatcaggaagctcatatcacataggtaggctgcaggcaagcagacaggaagggagggagagaggatggatttacttgttggtcctccaatgttcactacaaccaatggctttggtgagttagcaagttcatcatgccaatcagaagcagcagtgcgtaatgcagcagaatctgcttggtgaagtgcgccaacagtaaggacctggctttccaattttcagggttcagaattgagacagttgctacgctatgaacacatacaagagattgttgcttgcagaaaagaaaacacatatcacatttggcccaggtggttctcgtgcagtaatccatctccagagaaggtgagggaattcccgttgtcctcttgtagtcaaagcatagtaatcatgacgaggagttaccaccaaatcaaacctatcaaggcgatacctgggatgttgtatctgaaatgcaacaaatacgatgtaaagctaatatccacatgacaaagtggataatgattcataacccaagttgaataacaagtaaccaaacaagtaagtgatgcattccttacagaattctacctgtatgacaaagacattatctggagccaaacaccttattgaacttgcatatgatatggtatctcgtccacaagcgacaactagtgccaggccttctctgaagaaacacaaaatttgaggaagcagtgcagggtaaatagtatgtcaagaaatttcgataacttagaaatcatagacaatgtttaggctgctctacaattgcatagcaatattcattggatagaagtccagagctatgttctaagaagatgcctatttcacatccaagaaaaacacttatttcccatgttcttactagaattatgtcatcaacattcaaggataccacatctacaatccatggtaatgatatcaacagaacatattcttaaaatctttcaggggcaacatgtgctcagaatgaaaatgttcagttctgttttattccagagctgccaagctaccaagcatataacagggattatggcgactaaactatgggcaagctatataaaagagatcatcatcacagaagttgtggaatggacttcaagcttaatatgaaatagtgcacaaacagcacagcaccaatataagcgatgggatcttacttctcaaaggtatcattgaccatggtaactatccttttggtatctgcttctaggacagaagataatccaagggactggccattacagacagtatattgagccatttttgccccttgaaatagtgttgcaaatttgttactagaaaacatctgtctgagtacttggtccactaacttatgcaaggagatcgggaggaagtgcagccacttgttgattcctcctgttggccttatagcacgctgcaagaccagaaacaagttcacaaagtaaagctaaggttccgtaagaactaaaaaactgccttacgaacagaggttagcggcatagttatctgaatttataaataaataatgtctaccctccatttgaacaggttatgaataaaaggatttatatggtttctaccacaacaatgtactacttgctagttgctgcaacctccacaaatgcagtgaatgcaaataacaaattacaggacaacaattaattggtagtctggtactgcatctagcaatcataaaagttgataagccatttcagagtaaacttgagattggagtttaaattgcacacgcccctcatctgcagcacatggcaaagcaaaaccactttagcatattgaattattgaagcaattcataaagataacaccaatacataccgaataggcgaatacatgccaacagaaattataggattgatttcccattctctgccactatcaaatgcagagttgtagacttgacccatggtaattaggcacagatcatggtaagtggtactaacaattaacaaacagccccaaatcctagaggcacatctcttactttacttactgggtaaaaagcaaatccaatgttgcatcagaaatataaaggacaatcactagttaatcattaagtcctacgcaaactgccacctgacatcagtaacacaggatccactaatgcagttgcggactaaacacaaacaatcaaattcgcagctccagtgaccaacgattttatgaccctgtcaccaaaagttggcgggaaaaatgatcaggggaggcagggtttacgtaaagcgtgaggcggtcggctaggccgagggcacggagaaggccgaggcactggttctcggcgcccgcgcagccgttcccgatgacgacggcgcgccgcacggagccgcgggcccctgtgccgcccgcgaagatntcnggngcgncngccggnccgcccccgcccccgcccagcggctccatcggccgcgtcgcccaaaatgggaggaggtggaggagaggaggcagctatggcgccgcgcttgcttgggttttgggaactctgcaggcgggaggcggacggatcagcgaggaggagcggggcgcgcagccatgtgaatcggcgcgagccagtcttgcgaaacaagtttgcttttgcattactttttttttctctctctctttttcccacctcctcgatcttctcactccactcgacgactctcgagcgttgcccggcgggagggcggagcggaggagacggggagtcgggggagcggaggcggccgccgccgccgtggggagtgaggtgggctcggtggtgggccgatcttgtgttagatttcctaaccaggccggcccattatgaggtgcaaagccactgatttgagccttggattcagttagctctgaatcgagagcttttggtgatgttaatttcacgcttcaattgcgcttgtggctaaatgagatgtgatcaaatgtcgaccgatgtttagacttgaagcactaggaaaatgattagttgaagaggagaggtcgatgcatcgccttctgacgtgactagcaggagccgagatggaaatcgagtcacatcgataggtagccatgcatctggcagttcttcagtactagtaggcattagctctgggcaaggttgcattatttatcctagaaagcagcttagcaacaaagaggtgtaatatgaaactatgaactgccattgcttcaggtagatatcgatagaattcttgtggtgagcggcgaaagaaaatgtgtgatgcagtgcagttagttctcattgaatggagcaaccagacagtaaattcatgcccagcagcagcccggcacagccccacagacagaatggcacgcagcaaggcgttgcaaattcaattggttcaattgggttttatccatttgatccttgaattggcacgctgaatagagtccagctattgactaaagcaccgcacccacaaatcagcaattgacaaggggaaaagaagggcgcaaaggaataaagcaaaatctagccagaaaagagcaacagaaccaactttccccaacggaggagcactgaaagtggatgaagtgattcacagtcgaaacctaaccaaattgcctgaaaactatatctgataaagacataaagcatcaggcctagcacccatatcctttcttttgctttactgttgaacgtcaacaagcaaaaacaaggattgctcaacagaattcatgactgtcgggtacaagataatcactgcacaacatattatttcagtataacgatcagtcagattcacatttgctcaaatatcattgtctgtcaataaactattatggattttgcaaaacaatagaaaatctgagatgcaatgcatgtactccatgatccgaggaacagaaaatctgaaattcaatgtactccatgtagtccatggtcggagggacttcgtagtagcttcattctactgtagcattatcaacagcagccataggccttaatctgccactaaaagagactagagtagaggacactaaaaacgctaaggtaagtaggactataactaatacacattaggcgttgaagaagacacaaggaaaacaacattaaatgatccaatcgagttgttagtatttatcccttttgttcaataagacaaagtggttgccatcatagcaccaaaattactaaaaactaaatataactaccactaccagtcaatgcttcattaaagaaatctaccagtcatggtgaacacccaaattctagtatgcctaccgaggatgttacaacattcaagcatagaggagtactaagataagttcagaaaacagattcaagcaccaacaaacaacagaaattcttacatggaacaacagaaacaataatgctttggaatgaaggatgaagttgaatggccggatgaacatgctgcactgctattcagatggcatcatcgaaagccacatataattatattggacatatgaatcgtattggtggggtatcatacattgaccaagagaaatatgcaactatccaggaaacagtggtaaaaaataatgaatgagtgaatcatgcatatcataatgcacatcagacgcaagccaaaaataaaatacacttgtgcatcagaaattgtataattgggatatgaagtcatgaagacatcaataaaaaagaacaaaattttctaagagataacaaccataggtctcagacaattatcaagatagatacacctaacaggttaacaaccttaaacaaaattgctcctcctgaattacagagagctcccaaacgcaggacaccagttctcattactgttgaaactcacagtaatatcacactcacatacacacgcacgcacacacctccaagggcaccaaaattgcaagcagttgcattaaaaaaaaaccaactcaatttgttgccttaccatctggttttacttctcgatctacaccaataacccactagaattataccctaaaatgtaaccgatctacgacactgagcatgcggacctgaacaaaaagccagagccacatcacctttgcggaattcagtcgaggaaaccggtttgccggagcacggcgtcgcgcacccgccgcaggtcacggcctttgagcgtgcgaccggcgccctcgagcatggagaacggggcggccgggccggccccgccggcggacgcgcgcgcgaccatctcgtgcgggggcagcatggcggcgtcgccgttccggaggaagtcgtcgtcgtcgagctcgtcccacttgaacatctcctgcctccggggcgggcggacgggcaccttcaccggagccgactggtggtacggcgccgctggcccggcgctcttcggcctcggggtcatcgggatggcccgggcggcagaggtcggggactgggttggcgacaacgagccgccgccgccggacgccgaggcggcggcggccgcgatggtcgccttgcgacggagcagcgtccccgcggaagccgcggcggcagcggccgcgccccctcctcccccaccgccacggcggagcaggagcctcttgtccccctcgtgcaacgcggcgaggagcccgacctgcccctgcggcacccggctcgggctcccgggcccctcccccggccgcgcgctcgagggcggcgcggcgggggaggacgagaacaggaagtcgtcctcatggagctcatcccctgccacgaacgacggctccgtcggggacgacgacggcgacgcgaacatcccgatgaaccgctcgctcgccggcgaccgtcgcggcctgtactcgtccatggtcagtcacaacggcggcgcatgcagccaggggccaggcgtagcctctcctccctcgtccgcgcagcaggagcgcgcgacgtggtgtgggggggaaggaggcgagatgaaagagaaggaggggc

SEQ ID NO: 38490 - DNA, 8081 bp, Oryza sativa
gggggggcggttgaatcggtcaggtggacgccccactggatactgttcattctgggtggggttggatcaggttttccgctgcgtgtgtgtatcgtgtaattcgaattcggcgtgctcgtgctggacctggacgtgaggggtcgggtcagttcggatgggtttgagcggcgaaggcgcggcagcgccggtgcgtacgagttgagccgagttcaactctggtggttgtttatagcatgttatccgtcccacaaaaaaccaatttagataaatataagatactaagagagtactccagactctagtacactagtacgagcggaggtataggataagtgattgctaaatttagagatatggataatgcatgtacaccagagccgatggatggaagatgcaagggaccgggttaattgccacagtgttaagataaggattatccagttagaatgtatctctgtgaatgccatgacttataattttaagtctagatcaagcataccatcacggtcatatttcaagtgtatatcatctagcccacacacataacaactactactcctacatgatatccgatttgatctaatacatgggggatgattggaagacaagatccgttgctttgatattggtagttttatttttcttttttatttttataaacttattctaaaatttagaaagtgtgatgttactgttggaccatattatcgcactatagcaagaatgacgtgataggagtgaccatgcagttggatagagttggtggagcggccctctagcctaatgataacccaatgatagaattaaagatatagataacaacatgagtcatgcaaccgaagactagccgttttggagtttatagatagatgagaacaatccaatgcaacttgctataaagttaggagtaatgtcataatggtatacgtccactcacaataattttttcgcataaaaataaaaggagaacaatgagataatcaacttaaaatggctttagagtaagggttccaaaatgctaaaataatcgctaggttatcagcctttatccaaacgaacatgtttagaaaacatactggccaagttctaaaacacaaactaaattttaatttttggtataatttaatcatttttacccctttttttggtaaccactcgattattgtagttttctagtgttgattgtattttgaaactgaacactgctatacgtattaaaattttcttacaaaactcttactaacaaatttttcaactgtttgatttaactagatgaaagtttaaaaaaaatctagatttacttatagcttgccacattagactttgtaaacattttgtaagaaaatttagtacgtatagacttttcctttgaaacctgctcctgtgtatcaactatcaaaccccaaattacaacctagagaattctaagatgctccatttgaagtggttaatcgtattgtgcatttcgtggtagcgtactagcatttgatttcaaaataggaatccaccctcaaacacattacagatctttgctcccttcgtcattcacattttggaatccaagcgtgttgtcaagcttcgttgttagtggctcatgacggctcttcgccggaatgcagcctcaaatcaagcaagagagcgggttgagcagggctagaccttattcgttagatctccaagtccatttggtgcctgcctcttgtttttttagtgcgatggcgttgttgtgagcgatcctggcgccagtgctcgatgatcatcaggagattaaagcaagggcatgttaatgtgatgaagtgatatttctgactttctgtggtggttaataattccccccattctgactccaagcgaagacacgtacccgaacagaaactgatcagactcggcttggatcaaagttccagtttttaacatactccaattaattttagaaagtgtgatatcgatgttgctgttggaccatattatctcactatagcaagaatgacgtgataggagtgatagaagtagccggttaccatgcagttggatagagttggtggagcggccctcaagcctaatgataacccagtgatagaatgagagatatagataacaacatgagtcatgcaactgaagactagccgttttggagtttatagatagatgatatgagaacaatccaatgcaacttgctataaagttagaagtagcatcataatggtatacgtccactcacattaattttttgcgtaaaaataaaatgagaacaacaagataatcaacttaaaatggttttagagtaagggttccaaaatgctaaataatcgctaggttatcaacctttatccaaacgaacatgtttagaaaccataccggcccatactggctaagttctaaaacacggtctgaaatttaaattttggtataatttattttttttacccgttttgttggtaaccactcgattattatagttttctagtgttgattaattgtattttgaaaccgagcactgttatatgtattaaaattttcttacaaaactcttactaacaaatttctctaccgtttgatttaactagatggaagttaaaaaaaaatctagatttacttatatcttgccacattagagtttgtaaatattttgtaagaaaatttagtatgtatagacttttcctttgaaacctactcttctgtatcaactatcaaaaaccccaaattacaacctagagaattataatatgctccatttggagtggttaattgtattgggaatttcgtggtagcgtactagcatttgacttcaaaataggaatccaccctcaaacacattacagatctttgctcccttcgtcaatcacatcttggaatccaagcgtgttgtcaagcttcgtcgtcgttagtggctcatgacagctcttcgtcggaatgcaacctcaaatcaagcaagagagtgggttgagcagggtgcgctagaccttattcgttagatctccaggtccatttggtgcctgcctcttgttttttttagtgcgatggcgttgttgtgagtgatcctggcgccggtgctcgatgatcatcaggagattaaagcaagggcatgttaatgtgacgaagtgagaggcctgttcagattgtaagcaaaataaaccttatgaagttttgacaagatagaaatattattaaaattttgataggattttttttatgtatttaccaaatttggcaacaaactaaatgtagacaatttttttagcaacttagcttaagaaaaaggtatggttaaaaatggtattaaaatgaacagacccgatacttctgactttgtgtggtgcttaataatttccccttttctgactccaagcgaagaaacgtacccgaacagaaactgatcaaactcagagtggcttggatcaaagttccagtttttaacatacactccaattaaacggatcaaactcaaaccaaacgtacgatcagcctagagataaaccggttgtgggacaatcatttcgactgggtggacatggcagattggcagtatggcactagctccgaggataacacattcatcagattcagaggaagcagaatctaatcctctcctccaagcctcgttcccttgtccggttgtcccccgcactcactccaccccccaccgccgcgcgctacgtcacgcttcgctgtctcgcgcggtccacccttttcccgacggcgacgtctcggtctctcagggccccggccggccgtcctctcctccgccgttggatcgggctccgacggcccccggcccccgcaccggcgccagcgccgcaagatgacggcgttttgcaggccgcatatgcaggcatgcagccgctgctgcgcagccacacgtggggtgttgttgttttagctgcggctgcggctgggcgcgacgaggttaatttgctgggtgtgcgtcctttttttgtactgacgtcttacctgacagcctccacgccctccattcgttgcgtaccgtagcgtagagacgtagtactagagtagcacagcagaaaaaaaaaaaacaaaacagcaacactcgctagtactacgtaggagtagtataacgtgcgctaaaaatgacacagtgaccttagtcgtaggcgtaaattaaacagcaccagtatagttacctattactacctccctacctcccttttatgttataaaactttctaacattgtctatattcatatagatgttaatgaatttagacacatacatatatctacattgattaattaacatatatatatatatatatatatgtatatatatgtatgtatacatatatgtgtgtgaatgtgagcaatactaaaaagttttataatatgaaacggaggaagtaccattcattacgtaggcttaaatttattttcttcagtggaagaaagaaaacgtgtattttccttagggaaatgtcaagaaatgttgctctgcctgtatatggtgagtgtacactatatgcattatttattctttatgattattcttgcacgtgatttttgtatgctcgaacgtactcaattcgtttcattaaaaaaactaatctagtatgggatgtgacacatcctactataaatctagatatatcattgtactaggatgtatcacattcaatactaattttgtttttttttaacagagcgagtatgtatttcaaatcaaatgtcagacgtgtgttattttgcaaggtactcctacgtgattggcaacagcgacatacgattattctgtccaagcatgatttgtcaggtactagtattaattatacaagctaagccatgcctttgttgagttgcatcatgacaggtttgccaggtgtgggatcagaaagctggatgacaaaaaggcctttctcggctctcgcattcgcgttgtattcatgggccggtagataagccgtgaaagaaattgcgctgaaagatgcagagatacgcctcgcaccatttcctagctacaaaaatacgttctcagtacactgtttgttgctttttcttaacacataatctttctttaggattcgtctatctggtcgttagcagacatcggatgaattaggggataagtttatggatttatattttgcttgtgttgacagactgtatttagcatatttatatatgcgccaaaaatcctaggaggaactaggtatttttgtctggtcggaaaggtactcgagctaaattagatattggtttagggtttaattctgttatgtgctggaaatgtacacaggaggtgtgtccgtgtgtgtgataaagttatggttgcaagtcaccgtgtccaaacataagatacggagtatatagtgatacacaattttattgttgtgtttacgttgtgttctttgtgcgtgtggtaaaagcactactcgttgatgcgtgagtgtggtgtgtgtacgcgtcttttaattaagctagaaaagagattagtgcctcctgcgtttctagagtatataagttaacccctacaaaaatcatacgaggtcctataaaattcgtgtcctttttcagtaagctggaccgaatctgcccaaataaacatctgcatacatatacaggataacaatgtcgctgcagacgtagcaactcaaattgatatcttgagcttgatacgtccgtgaacgacaatcaccgaacacagaatctcaatgattgcaagtaggtaatcgaagctagctaatgcaccatacacggtctggattaaattgtgtaagctttccccgctaatctctgtttattttaacctgtcccaatcgtgtggagtatgtgctccatgtgctacctagactaaagaacgttggttttggattgattggagggaccattttaatttttgagccccagattaatgcggagaccagttgcaaagctgcggctgagtgcaaccgactgtagagacatcggtatcaaatggtaataacacaatgtcagttgttcagttggcatccataccccgctgcccattttattgcaaaaggggtagcttttcaccaagctaagaaataacgtaaagtactccgcatgagtgcatcgaatgaaaataccatttggtgtcacctgtggcaaattatgagtggtgcattagagtattatacacgaaaagtgaaaagataatgcagctgcgacagtttggccgagtggtctaaggcgccagatttaggctctggtccgtaagggcgtgggttcaaatcccacagctgtcaaattttttgttttactttctcttgtttttaaaggtgttgatttttttattctcactttatctcccattattttattttatactttctcttattgtttgtcaacgagtgttttttttcgcacttttttttatctcccgttgtgatcacacatttacacaattttgagccttaatattgctacgaaaggaaccttttgttttgtatatactgccttgttgatacactagttacttataggattaagatgcaccccttgtaatagtagtattgtctatatcataaataaattataccgacagaccttaaacttgtaagtaagtttcacctatatccacgaatttgcaaattacgtattgagatccctaaacttgatttattcttatatcatcctagtttaaatcctcttctgacctagtcttgctcacgtgagtgacatgccacttggaagataacatggcaaaatttttcccttttccttcccctttttcccccttcccttcttcttttctcttcttcccctccaccgctggatgcactagtggcaacggcagacgagagaaagatggtgccgaccaccggaaaaagagccgccgacgacagagttggctcgacgatggagcagaggttcaaggtcagaggtgacaacggtcaccgtgagctccccactctctcccttctctccacctcgagctccacttgatggcgattaagagctcctcctctgtcatgctcatggtgttgtccgtgattgatggaaggaagggggaagaggggaggaaggaaaatgtgctgacgagtggacctttagcaacttcttttttttactataatgcccgtaagcaccatatcgaataaatcccatgttaacgtgccacaaaaagtgtcatgtataattcaaaaaaaggcaatccaaaccatcaatgatgataacctggttggttttatatattagttgtggtagcctccattttgaattttgtgattttgtggttgacagatgcgaacaagacttggccatagggaggcaaattagactactatttgctttcttagttttagttaaaagccccttcctcccaatatgcggcccgcatgggaaatcctcacactcggcccaatagaacggccattatggccagtgcagcccacccgagggtttatatgcgtgcacgcactcggccattcacacctcctgccggtctcctccgaaccctagcctgcttctcctcctcctccccgccgccgccgccgcgagcacagacgacgcagccatggtaatgcatcccatttctgatctacgcttctccggcgtattgcctattcgaaggtctcgtttgctcaccgggaatgcgtgccgccgccgccgctgtttgtgcttggtgcagtccgggaggaagaagacgcgagagcccaaggaggagaacgtgacgctcggccccacggtccgcgagggcgagtacgtcttcggcgtcgcgcacatcttcgcgtcgttcaacgacaccttcatcgtgagatcccgagacctttgtttctgtttttgcgcctaatttatgttaaggcgtggtgtgttgtgctcgttgctatggcggtctcatacttgggtttcgtccttgcagcacgtgacggatctgtccggcagggagacgctcgtccgcatcaccggtaatttccctacttgagaacaatgcttattattgttaaagtttagtgtatttttgggccaatcgcattgtgaagtttattaatctactactatcgaatgagtgaattggaatggtgctgttgttgcatctaacagcggtaatataatacattgtagtagtcaatagaaatgtgtggctgttatgtatcgcggctgctggg

SEQ ID NO: 38491 - DNA, 14854 bp, Oryza sativa
tgttggagtaagcctcaggaagccttatttatactaagtcctaattgcccaattcaatttcgcatggattgggggggtcagcatcccagctgacatcgggttcaccaaggatcttcagtgctctcacagttttcagcaaagttggctgcaacctccatgtagactgtctagccacatctgttctttaatctgtttggttgttgactttattattttatttgttagcatggcccttaagatcgcctcccttttgttctgtgggagcgtgtcgagtcatagccatgcaagattaacaatgatggacctgagagtttttctctggaacttcttctcttcccgcttgttcgtcaggtgtttccattgtggcattgggtttcctgtggtgtttggttagtatggagcctctgctttctgcattgctcctgctgagtccttcattcttgcaactctttgccacttaaaaatggaggtttctacatgttggaagggaacatgtcatattattttacaactgcttctctttttgtttgaagattttttgtgtattagctgtgcaattttccataccttttagttgctatgaatttataattatggagttatgaatttataattatggagttatctgaagtttctcactggatgcagctcactgcccatttgttttagggtgttaatattttttaatcttcgttgggttttggcatgagaattcattggtcacaagtttttttttatcttagaaccacttgttatatcttgctaggattcataatgtaattagtttctttcagtaattgaggacggtgcatcaatattgaaccagttgtatatataacgtaatcgcgtttatgtttatagatgcctataaaattgtgattttatgcatttttatgatccatggttgtcttgccattttgtatgctctgagatcagtaagatgttgatgttctatataattcatggttcatcagaccatttgaaatcttattcaaactacgtgcaaatgctttgatccagttttttttaaaaggaatatcttgtagatctctgctgttatagttacaaaattgtattttgcaggtggcatgaaggtgaaagctgaccgtgatgagtcatccccttatgctgccatgcttgcatcccaggatgttgcacagagatgcaaggtacaaaaatacctactgaaacattaattgtctgctgtcagttgatacttactgttttgttgccctgtacaggagcttggaattactgctctgcacattaagctccgtgctactggtggaaacaagacaaaaactcctggtcctggtgctcaatctgcgcttagagctcttgcacgttctggcatgaagattggacgcattggtaatcttatagtccccattaatttccttgcaccattggcaccttggtggttatctagcatttgttattattaattgtgtttgactatttttgtggaaatttatcctagagttgctaacggactgcgcattgtaatgcatgggtttttttggttatactactgtttataattcaatttcttatactattgtttgacatacatagtatctagaatagaatggctgtacatttaatttagccttgtaactagtatggttgatgctgaacctgtgctagctttttgttgttgaaaagatggctttgtttaccttttatctactcgttatgctcagtgcttagctactcagtgttaatcagcctcctaagttatttttacaattattgtcaggttgaacttacaaccatttccctcacgatttctgtgaagaattaatcttatttctgttcttaatttgtgaaacagaggatgttactccagtcccaactgacagtacccgcagaaagggtggcagaagaggaaggaggctgtaattccgtgtagtgcctgttatggggggaaagcaaagctatctatccttgtccttgcaacttgttctgtactctattatgatcttagcatcggatgtggatttataaattttgagctatgttatgttctttagaagatgaatgacctccccctataaagccgattatctaaattttggttgctgttatcacaactaatgtttatcagattgtgttttgtgttgctgttgccgtgatatgacctgctgtccgtgttcccgtcgttaagtctatttttgtatatcttgaatccgttcttagctcaatttggttcaatcactaatcactaagttgctttgcagtcaccttcagaatattatcttctaatctgttttcgtagtcgacctgcatattttgatcaggagaatcggctgaatggttttgtatcgcctcaatttgtacgccatgttggctgaggcacagggttgaacagcagaatctgaagaactgtactacctccattttacaatttaagttattctagtatttcccacatttatacttgatgatgttaacatcaatatgaatatgggaaatgcaagattcattaacatcaatatgaatgtgataaatgcaagaatgacttacattgtgaaacggaggaagtatcttttttggaagcttcttttttttttctttttgttgctacgcgtccaatacgggtgtgtgtttggttgcttgcatccttctaacctggcccatctttctcatccaggatgtgtttgtccagctcaagaggatacacgtgtggggcccatctctcatccaggatgtgtttgtccatctcaagaggatacacatgtgggtgtttggttgttcgtattggatcagcctggttagcaggagattttggatgtgtttgtccatctcaagaggatacacatgtgggtgtttggttgttcgtattggatcagcctggttagcaggagattttgtttggttggttgcacaggagatacagtatgatagagattttatttggttggatgcatgaaggctaagtttggttacctcctattttttgggtgagattaccctaatgcaatttatgaaataaatatctaaccgtttaatatataagaaaatttgttctatttgtatctgttgaatacgcaaataaggaaaagaatcggtgaatatgcaaataaggaaaatgaattggtgaattgatcctcacactattgctgaccaattaagtgaaggagaaaaatatcccctattgctgaccaattaagtgagaaaagaaacaaggaaaggagaaaagtatcccgtagatctcatcgccagccaactactcagtgtggtccgctctgtaattcccctccaccgccgcaccgctcagtgctcgcgtccctagccacgccaagatctgatcatccgatgctacgcaggttgctgcccctctcctcgaatcgacactcaccctaccagatccagtcatccggtgctccggcaagccggattaggaaggacagacgcaaggaagatggcgaggataggagaaatatgaagccggcgatgacaacaacgctgctcgagcgtccagatccggctaacacaaccaactactggatctggcggcggagtttggggccgacatgatgacgccaagcagtggtgagaggctccaccaggcaagcagctccctgaggtggtgatggcgatgacgatggagatgatggtgaacccagtggcctcgaggactaaatgtgagtaggaggtgagtgaatgcttcaacccccctgcctcggatcaggatcctctgcagtcaaagtcacgtgactttgacattgacatgtgggtccaataatctctaagtccacatgtaagtgacaaaggcattatgcattcaactgtaaagaatctcaatacccctacctcatgcatccgcgcggaccgcgcatccccgcctgcacccgcgcgtgcccgcatctgcacgcattcagccaggatggcgagcgaagcttaaatcgagcgtttcccttgggcctagctgggaagggagatttgcacgagtggaaccaggcctaggaggccgtgcgggataccaaacacgtgctccttgcaccagcgggtgcgagcaaacccatgtgcaggcaaccaaacacgtcctacgtgtatatgacaatacatactctcatgacagaccaccggatattgtcaaactctgaaattatagttgtatattacacgacgaaaggaagaaggaatggagggagatagccgttgcccatggcatcaccacgagcatgcggttccagcgaggcattgcacgcatcgtgccaaccctttgcggatttgcctccctttgaaccaggcagttgcaaagcagaagggcagcaccacgcacccacagcaccgatgaccaatcaccatcgccggccactacctcgccgtgctgaaagcctgaaacggctaccgaatcattcgaatcatcgcctccacatttgtttcaccaccacctacctatctacagtgtcacctttgagctggaagccacacgatctctttgcaaaccggcaagccgtccctcctttcacttccctgcgattctgcgaatgcccgctacttgaaacgatgcaaaggtggaaaaaattacgtagtacaaaccatacaatagtatgtgaaaatctaaaaactatgaaaaatgaatttctgactaaagttatatttgtgaacgtggataaatctcaagcgtccatttttacattctacggtagtttctagttacagcaagataaaaaataaacgcctgataaaattttactcgtgatgaggtgaacaaatatcatgtattcatttttatattttagggtagtttctagatttgcattgtaatacatgatttttctattgcataatttctcctaaatttgcgatgcatcgtcgcaccaatcgcactaggcgtctgcatatttcctcggccgacgactcatcattgcacttgcgcgatctccgtcgcccgccggagcctgctgcctgcagcgacgcaagtggccgtctgctcctgctgctgccgctgcgtagaccatgactcatcaacgaatcagctaccgagtggtacatttgcttgatccggtgtgtgtcccctcggcctgcaaccctccactgcccggggttcccacctctcccggccggcaatctgatcgaccaaaaatggtcaatggatagtgtgcactcaggctctcagcttgcatcaccgcgtgctagtggcctgtactgtggccacacacaggaccagactatggtgaacttgtctcactctcttgcatatacgctgaacacgagcagatcgatcgcatcagcctaccgaattatttctgcgggtgtgtatgtgcatgcactctagtgggcctcggatgtgatatggctctgtcagatgctatgatcgatctgtgccggtcatgagatgagatcggtcgagcatgcatgtgcagtttccgtcaattatacctcaagttgttgtatattgtactacagtggatggagaaaggaagttcagtgatgtccagctacgtactaacacacagattgtgtgttcatgcatgttgcttccaacattgtatacttgcttaatttttgcccagtatgcatgtatgtgccgaacaatgacaacaatactgcagctcctcccaagtctcggtatagtgatacagattagttgtgtaaaaactagcactgcatgtacacttaattaaaatcttgcacataaggcaaatgtaatgaatgaactgcacgtaaccggacacttgcacgacgatgtgtgtacttctttttttttgacagagtggtcagttagggacagccatatataacaggtgatgaaactagagtatatgcatggaccgagcttgtggaattaatatagatcgagcaagaccgtaaaggcctctatttttagataaataatatatcttggtcgtactcagtgttcatggaagacagatccacaacccaccattggactgtttattgcgatgttctctttttaaagttttgtggcctcgctagtaatccacttcgagagaagctgacttgtaggcaatactgattactccctccataaaaagaatgcatataagttttcttacatggtcttcaagacttcaacatggagctttgatcattaattaatttcacagtatattatgaataacatgtccattataaataactatataagccatatgaatgggactaaatgtatcagttaaaagttagaagaccttttcaaatatatttgtgcctatatttttggatggaaagaatatatagtatgatggctggttaccagttagtgttgattataaactactccatccatttcatattataaataagacgcttttgactttttctaagcttataaaaaatagtaccattcttaacacgaaacaaacactataaaaatgtattcaatatttatttagttaattgaactaatttggtgttatagggatcagttgctacatgacttttaaaacttgattagaccaatagaaaaaaaatcaaagcaacttataatattaaacagagaaaatactgaattaatatgtgcgtcccaatgtacttttttcaaaagaaaagtaatccactccgagattagttcagccctcacaaccacgaactgtatgttgccatttgtattgcacttcacgcgctggccattttttttaaaaaaaaccgttggctttcacaagatagatgtctgatcaaatgacatctttttttccttattgaaagaacgttatctaatctcatatcttaccttgccctgatcttttggtatggttgttaactttcagtcgcacaatagcccatatacctaactatgttgcagtcaggtgatctcatgttcaccttttgagaaaaagaactagagtcctttgatggaacttgccagtgatcgatgataaatttatctctgtgtgtattttcaaacagtctatatacccccttaatctttgaatgaaagtccttttaacaccacaaattttaaaaccgaacatcttaccctttaaaatttgaaatactgattatattacccctacattgatgtacacagtgatggtgcgtatttggatgtttaaatgaatggttttaaataactaacataacacatttacacattgtcaatccttggtccttaatttatgctctacagtaagatcatacgagtattatattagtatttatttgtaggtgagaaagaacaagtgggaaaataataagtagagattttgacacacacatgtccaatgtgtatgtcacatagtcaagcttgtccaatctatatgcaaattaaataaaaaaacacattgcaaaactattttagcagtgaatgaacgatcttgtaaagttgggggatttatatgttcggttcacagtgtttcctggtacataaactttttccatttccccccgcactaaccgtaatttcgttcgtcaactcaactggttccgctcatatgggggggggagcctatcaggatgattgtacacacatttgacaattatttttctttcgtaattgcaaatttctagaaactattaagtcgttatccagaaagaaattttgaaaatgcaattaggtttttgggacaaatccagtgattacacttacacataaaaaaaattcagatattctggtatatcagtggtctggtctatgcattgaaagatgatatcttaagacaaataaagcaaccggagtgcatctaacaccagtgcgcactcatgggttatactagcatcaatctttattagtcctaatggcatccatgcattcaaactgtccccttggtacatatgcatacgacacgtgtgactgaaaccattttacacaagggggcatgatttagcacataattaagggcaatcagttttttcttttccgctgaaactcaaaaatctagctagctactgaaggtagttctcatcatgcattgcatctatctctctcaatttcaaatattgtttaggctccattcatcatgaccggcttcttcatctcccacgcggtgagctgcgacaccttgatctccgccttcccgttattgaaaacgtaaaggcgcgcgttcttgccgatggccagcgacgggtacaccctcgacaggatgcacgcctttcctccagccccgaagctctcaacaaccgacctgtcgatctgcacaagagagacacaagatatcaaaacatattctacaatttatgaaccttttccagatgaatgttataaaacagtaacccgttcggacgaggtgatacctatgaggtacctatcagataggtatcagacgatacctcaaagatatcatcccattcaaatagtttattagccaattaatatttattaggtatcggacaatatttaagaggtataattttatccgaacgggataccgtcatgcaacattttccttttttcccgataatttggtcctattacgtaccaggctcctcagagatatcttcccgttggtgatgtccgtgtcaacgaaccctgcaaacgtcggctggtacatgttcgggttgcgcgatgacctgcacgcatacgcaccataccaaaaaatcagtaaacggagtcaaggcaatattttgtttattgtgtagtgcgatcaatcaccgataaagtgcaaaagccgcacgtacttggtggggtcggtgcacatgagcacgacgggcttgccggcgccgccgccgcgcgccgccggcctgaacaccctgaagaacacggcggtcttctcctccagccccgcggacgcgagcacccacaggccgaacggccccacgccgcccctcgcgtcggcgccccgcgcgctgcacagccgctgcgcgtcgtacgccatcgccgggtccagccgctccgccgcctccaggctccccacctcgaagctcacctccacgtcagcctgcaccccaccaaacagaatgcatgatcacttcatcagaccagggacaatagcacactataagccagctataaacacatttcgatcgaggagataaaagaggagagagaaaaacaacaagctatagatttacagcaaattatagtacggactttaagatgcatatgtgtatgacatgtggaaccatgtattaattatttagtatatgtttataggtaactattatatgaatttattattagattgactatagataatttagagccagtagttagctatactattaaacttgctatcagagatcacagctcctactcacgtacgtcaccaacaaagcacattaattgagctccttaactatctctctaattatgttgtttagtgtcttagtgatatgtgcactaatcacgctgcaacctggaagttgtacgtgacatgcgcggatgacgagagaatcagtgagatcagttaagtacgagcaaagtgtgcaggagatggtaaaaggggacgagaagaaagcgacacggcacacgtagtaggtggtgttcagtgggcactgcacactggacacaacttcaggcgtgccagataagataaagatcggtccaggacacagcaaaacaaacaggataacttattaataattactactgtcatgcacagaaccatggatgtgtgagcagttttattcgaatgcccttttggggtaaaaaaaatagttttacagaattacagatgcaaaaaggaatacctgtgcagtttgtagcccggtcacctcgacgtgttcccctggcttgaccaccctgtccttgagaatgaccggccacttccctctcagcctctcgacctcctcgattggccactgcaacagttgcttcccacttgggtccagccacactttcctcggaatcgcctaaaacatcacatcacaaacacacgattcaatcaaagattaccagcaaaattgagctgctagtgttgttccatttgacttttaagatatactctcttttttcaaaatacttgacaccattcgtcttattcaaaaaatttaagtaattatttgttcttttcatatcatttgattcattgttaaatatacttttatgtatacatatagttttatatatttcatatttttttaataagacgaacggtcaaacatgtgctaaaaagtcaatggtgttaaacattttagaacggagggagtatatggtgatattgactatctgaagatggcagcatgcatggtggacacgtaaatggcatgcacgtatgcagtcaggacgtgcggttaattacctggattccggcccagcccttggccacgtcgtcggcggcggtgtcggactcgttggcccatccccagaggatgcggcggcgcttcgccgggtcgtagaacgtcttggaggcgtagaagttgccgtagtcgtagcggatgtggtgctcgtcgccggcggggtcgtccggcacgtaccgctcggccttccggtcgtacgttccgacggtgtagtagtcgtaccggcgcaggtcgaggctgttcttgagcacgtacttgacgcgcgccgaggcggcggcgtcgacgacggcggacgaggtgtcgacgccctcgcggcggccgtccgcggtgaccgggtagaagtccgggcactcccacatccccgtgggcgccgagtgcagcggctgcgccgcgcgcgtccaccgccggaagtccctgctccggtacacgtacgccacgccgcgggactgccccgcgaggctgccgacgagcagccgccagtggccgtcggccccgcgccacgcggtggtcgggtcgcggaactgcgtcgcgttgatgccgccctcgggcacgatcaccgggttgtggccgggcttcacccactcgcgcagcagcgggtccgacccgttcctcggcagcgccacgttctgcacctggtagttgacgtcggggcggttgacgccggtgtacatgatcaccggcgtcccgtcggccatcatcgtcgccgaccccgaccagcagccgtacttgtcggccctgatgctgggctcgatggccggcttgagcgccacccagttgatgaggtcacgtgacactgagtgcgcccacacgatgttcccccacacggcgcccttggggttgtactggtagaacagatggtaccaccccttgtagtacatcggcgctgcatgcacccgttcagtttcaccaaatcaagaaatgatcttcagtcttagtagtacattgaaatcaattaccatttcagtttaatcgcgcgtgtacattgcatttttctctacactgctcacgattaattatagaactatagatgcttcatttcgtacgagaaaaaggtgaacttttggctaattccctttctgagaggaagttaagattttctgaactttgtggtcatcagccgtggtaggggctaggtaccccacggtcgacaagcaagcctgcatgtggagtcccagtgcgcctaccattttcgtgctaaaatgtgctttgaacctttaatcctaccatgaaaggcgtcactaactacagtcctctcccgtacaacgaaattgcaagttgcaaggcataaaagttctagtactactactactactactagtagacagagattcgtgacaggatatattataaagggtgggaaaacgacgtaccgttcggatctgcgggtttccaatgttgatgacgcagcagcaatcacagtgtagagcagagcacacccccaccaaataattgcacaagaaaattgccggttaggactaagccttgtcacaagaatcattagcaagaaaagtagaacaaggtagtacatctgttaacagttcgaagggactaagtgtgagcttcatgaaaaagagatggcaaactctcagtagtttactgtgagatgcttctgaagctacttctttcagcgtgaccgcgtgggtgctaacgttgactctactagctgacccgacaaaatggacataaaaactgatgccttagtgtactgtccgtaatttatgttgtgtgccaaacatttgatatgactatgatgtcaatattttcaactctgactataaattactcaagttgagccatttagttcaggtgatgttctacacaacaacgtcgtcaaaactgtactagttactctgcacgattctgcgtctcaattctcaagaacagagcactctgttccctttgctcatctatccagtatccacaaccacaagtggtgccctatgacctgcaaatcatacggcctgaccggcgttctggcatgaacaatggcaagttggcaacatttcagttagttcacattaccattgatccagttcttgggtggctggaagtgatacccagtccggagctcagagtcgacgatggacggcggcacgccgtccgctgtggtagcagccgcctgcagctcgaggtcgtcgtagacgacgtgcgacgctccggcgagctgctggagcagcagcagctggaccagccatgcccaagcgaccctactaccaagaactcccattgctctcacacttgggcacaagaagtgagagcgagaagaggagaggaggatgagcaggagcagaggagagggggtcctatttatactgcgaaggtgaagagatgcattatggaaaagacgctgttttttttcccctaagcgttgagatttcaaagattgctgagtcggacaaaagggcagaagaatggcaggcccgggcgggccgcattactgtgtggacgacctaacattatttgtgccctgggacgtccgtgacctgcatgtttctctcatgtttttgatatatatatatatatatatatatatatatatatatattgggatttgtcttcatattggctctgatttataagctggagctcaaacaagcctaaatccatatacttttttttcctaacatggtcaccgcatggagcacaaagccatctataacgtattgggaaacaaaaagcaaaagttgaatggagatcgttatcaatccgaaccaacccaaagatatcaattcgatttttcatgtataaaaacactgaagttagcttgtaaagaagagagcagcactgctccttctcgtggcttatatctctatctacaggccattacgaaaatgtcaatccgttctattgatctttcatgtctagaaaattacggcatcatcttttcgtttatacttatacttatcagctaaacttaaatttttaactttaaatttgaagctgattttgggtttttttcatcgaagtttatttttcactctttgattttagattgctaagaacacgtatataaaaattttattcacaaattacttttcgtttgcaaatatgccgtttagcttattccacgaataagccaaacgatgtggttgttaatctgtttgtttttaaatcagtgttcacaattcactatgaactattatattttctctcatataatagcatatatgttttctcaatatattgttcaaatatattaaattgacaatataattttaaattttgcaataactttacgaaactactaatgggtaatattcatattgtattttatatacgtgttagttattaattattttaatatcaatttttaattatttgtaaattatatatattcctatatgcactctagactcgtcttttaatatatattttttaattccgaattttctgtaaattgtatttctatatagactctatgctcttcttccaatattatttatttttatttctgaatttttattatttttaattgtatttctatgtggactctaaacttatctttcaatattctttaatttttaatttcgaatttcagttacttctaaattgcatttctatattgactttaaactcttcttcccatatttttcttaatctcgaattttagttatttgtaaattgtatttttatacggactctaaactctactttaattttattatgtttattccaaattttagttagttttaaattcctatatggactctatactctaattctaatattccatttttttaattccgaatttctatttttttttcttaattgtatttctatatagactctatactctatttctaatattccttattttttaattccgaatttcttttttttcttaattgtatttctatatagactctatactctatttctaatattccttatttttaattccgaatttctattatttcctaattgtatttctatatggactctatactctacttctaatattctttattttaaattctgaatatcagttatttcctaattgtatttttatatggactctagtctcctcttctaatattccttattttttaattccgaatttcaactatttctaaattgtatttctatatggactctagtctcctcttctaatattcatttttttaattccgaaattcagctttttctaaattgtatttctatatgaactctattttttctttttttctgattaatgtgagaatttctagaccataagagcgaacgtggaggctcctttttctattcctttaataatataatagatagatttgtctatagtgtacctctttttttaaaaaaaaattaagggacctatatactacctccgtcctataaaaaaccaacataataccagatgtgacacatcctagtactacgaatctggacatacatttttcaagattcatcgtactagaatatatcatatccggttatagattcgttttttatgagacggagagagtatcttacaagcgtatgttaaagattgtgtgtgttcaggggttgagtgttcatatatgtggtcgtgtcctatcgtacactaggaggctcacccagaggaggcttcggagtatggccgatcaagcataagcatcatataccctgtacaacataggctattaaatagccctctggaatcttgctatttatgattattaaacgtagattaccgataaaaccgattccataacccctaggctatttt

SEQ ID NO: 38492 - DNA, 10937 bp, Oryza sativa
caaaatagcctaggggttatggaatgggttttgtcagtaatctacgtttaatactcttaaatatcaagatttcggaggactatttaatagccctccgaatcttaaacagggccatagtctaggggacttgcctcagcaccggcacaaaaccctcatccagcctgatggtcgatcgcggctttcgacttgttacaacggacgtggactctagcaaccctagttccaccactacaagggaagtgtgtaagggtagcagaaattgtgggaacaagcggagttaaccacacgatggcagtggcaatcgaagctcatcaacttaggaccagcgtggtgatgatgagctcaagggagaacgccaaatccaataggaggaagaaggctatattggtacaactgtgtattttttaatgatgttttaacctttacaacctggtgttacatgtgcgagaagcagaatatttgaactgaaatttgtcttagttttatacctaagttcttttgttttagaaatctttttcgatgtttcggtcagtggaaccggtccaatgttttacgttgcatggaacaaagttgtttatttcttcttcttttttcccttcctaatgttgcactcacttcttcagatgtttcgtccaacgtccatctatatataaatataatgttggtttgttgcacgcttgtttctcatagtaactattttcaaatgtttcaaatattggtttttttgtttcacaatttacagtttgttctttcacgtataactgaaacattcaagcgcctgatgcctagtcttgtaatcaaaataagtaagtactatgcagggatgcagccacctgcagatcccaaatcggctccgagctgccgctgcggcggattcgcaccgcgcgagccaagttgcgcagcggcaacaccagttcaattgccaacacgcactagctagtggtcgatctgccgcacccctagccagatacggatcgtgcgcttgcatgcgtgcaggaacggcttgtcccttactgctgaccagctgccttgctactaacctccccgtaagggcacccgcaatggttatctataggctctctacaagagatccatgtcaacatattttcctacttggaacagattaaatgaagaaagagagtaaagctatctactaatctggagatagtctatagagaaaaacgaggcaatagatgagagagctatagatacctatgtagacatactattgaggtggtttactattaatctagtctattgctgagatgtatatattttatagagagcaacttactttaccattgtgggtgatctaatagtaatgacgttctatgtatcgggcgcagcttagatcgacaggtggtcttgtgtagcgtatatcctgaaaacaataaaattgacaatgtataagcagagcattagggcattgccgctttaattggtgatcctaaacggccaaaccgctccttttcaactctgtagagggagtgcttgcgatggtccagatgatcaagttcttggaagccagaagtatatgcatattctagctagcactaaacaactgcagcgccgttgcaccacacgttcgtcgcaaagttggattccaatacgccatgctatgccaagattctcttattacactatgggtaacgtagttccataaaaattgctagctaaaatattttatgtggtttaacgctagtcaataataaatggaagttggggatttgtcccatcaccttatttctcattttgatttatttttaccttacatttttattactattaaacttatggctgtatgtcttatgacagaagccggatatgtaatctatttccattatctaccaaaatacgccatgctatgccaatgaagcagtagtagtccgcgcgaggttactggttgtagccgaaatgattaggcgggcgtctaaagtgcgctgccagaagcactgccaatgagcgtgatggaactttcagcgtcaacttggcatggcttttacgtctgcacgccctcatttcgcacaagtcttgctccgcctttattcgatcctggctcgatgatggatcgacctcccaataatgcgcacgttctcaccacattctctctcgagagcagattgtggacaattaagtccactttgactcccttaaaagtgatccgaatttaatccatgaccctaaatcgtaaaaccgggtatgtcgactcccgaactattgaaaccggtgtaatttgactcccttggtggttttggagggcagttttggtgacgtggtggtgttgacctggtctatagggttgacgtggcgtttaggtggcatttgaattaaaaacacatatgtgggaccacatgtcatcatctctctctttattcttcctcccctcttcctcgcttctctctttctttctctttctctcccctttggccagccgcggggactggagcacggctggagcggcgggggctagagtggtggcggtcggcggaagctgaagcagcaacggcaggctggagctgacggcgggttctagagcggctacgggcagcttgatgaccggcaaggaggcgggagaggatagcagcgccgacgccgacgccgatgacatcgagcggggggacggcggtcgacggcacggcacctaagcgccctaaccccagtcctcacctccaccggcacggcgccctcaccggggaacgagctccctgctccctccgctgcctcctgccgtccgtaataacaagatccggcactctggcctctcagccgattgcaacaacatgatccgggcatccagcatatgcgacaagctgacgacacggccgacatcgagcctgtcaaactggttaggggcgagggccgccatcgagctacgccattcagcattgcaacgacgacgtcgtcaagtcattgctcgagctcgctgcgtggccgtcaactcccgcgccagccccatcatcgccaccaactcatcccccgttgcgtctccttcaactagtgctgctaaggccacaagcatcacaaaaatccagaaataaaattgattcatttagcaactaaccagagataaaattgattgttagcaggtcgttcaccatccactgaagaataggatgagtaggcagaggggagcaattaattttgtctcgcttgaacacgcccaagatggccaccctcccggggatacttgtgcttgcgtgttgcgtcaagcggcaccgacccggacatcatgtcggcgatgagctagcttaggtcgctggtgaagcagtcggcctgcagggcgagcgccatctgccgccgctcccaccgccaccgccgcttcagcttccgccgctctggcccccacccgccgccgctccagcccgtgctcccttggcggcccggccggccaaaggggagagagagaaacaaagagagaagggaggaagaagaacgggtcccacatgtcagtaggccccacattttttaatatatgaatgacaaacgggtcccacatatccatttttaattcaaatggcacttaagcgccacgtcaaccccatagactaggtcaacaccgccacgtcagcgccacgtcaccgaaaccaccctccaaaaccgccaagggagtcaaattgcaccggtttcgatagttcgggggtcaagatatccggttttgtggtttagggtcatggattagattcgggtcacttttaagggagccaaagtggacttattccctttgcaggctgagtggacatcaggacatgagatcgtctcgcaaacttgccatatgtatgtatagcatcaactgtgccgtcgagagataggaaattcaggggtggtggtgttacgagcacagatgaaagttcttggaaagccttaccttgtacggttgtacctacgaggaccgtgatgcctccatcgccgtgtacaaagagtactgctacacgtactaaaattttcttataaaacttttactaacaaatttctcaaccgtttgatttaactagatagaagttacaagaaatctagatttactcacagcttgacatatcagagtttgtaaatattttgtaagaaaaatttagtacgtatagatttttccgtgtacaaatacggacgttttttggccacttagcttgggccgatggcgactacatctccggagaagaacactgagttgggctgaatctaatccagaaatctagcccaaaagtatacatataggacaaggcccaagaaaaggctttttcggcgatagggatgattggagcaaaatgggactcgaggaactacaaacttgtcatcagtaagtcacaactgtttagccgtttaggccacgagaaaaatcagatgaaaaaaaaaaacagccacggaaccttttattcactcatgaccagcaatactttcttcacgcattgagtgcaacaattatgatacaaaacagaccatttctttccctaacaatgcatcaaaacactacactgcagcctccaaatttatcccaaaatctcagctaaagaagctagtatctactacctccgtcccaaaataagtgcagccatagatatgcgtactcagcgttttgaccatccgtctgtttgaaaaatttataaaaaatatttaaaaattagtcacacataaagtactattcatgttttatcatctaataacaataaaaatactaatcataatcttttttcaaataagacgaacggtcaaatgttggacatgaacagtgttaaaactggacttattttgggacggagagagtagctagctaaacgcccggctaggcggctactctaccagtactgctacaaccaccatgtctaggctgatgtgctgcttgctactgctgctactcctccgcgttcatcttcggggtcttcatctcccaggcgtccaggttggtgaccttgacgtccgactcgccgttgttgaagacgaagaggtgcgcgtcgtcgccgacggctttcctcgggtacaccctcgtcaggatgcacgtcttgccgcgcgccccgaagctctccaccacggagtgatcgatctgatgcacaaatatatatatagttcatcaaaagcagagtcgatcgatcagtgtttatgccaagagattaaatccactgttgctgaacacaaagatcgaggtcgatcgacgatcgtgcatgcgcaccaatgtccggagggcgatttgtttgttcttggcgatgtcgacgtcgacgaagccggcgaaggtcggcctgtagatcttcgactcgtacgatgacctgtttatttacgtgatcaatccattgggcgaacgatccatcagttatgttcagtgacgtcagcaaattaaggattgagatctgaacacgggaagcacggaacgcacctggtagggtcgttgcacatgaggacgacgtgcgaggagtcgttggccttgaacaccctgaagaagacggccgtcctctccttgaggtcgccggaggccagcgcccacagcccgaacggccccacgccgccgtcgacgtccgagccgagcttcttgcacagcgcctccgcgtccgtccgccacgccgggtcgaactcctccgccttgctcaggtccttgatcgcgaacgccatatccacatccgactgcacttgcagagatgatcgatgcgcgcacgcaacatccatgtcagtgtaccgggtagattgcaggtgtggctagtgtatgttgctatgtgcaccactgacctgcacggacttgaagccggtgacctcgaagtagttgcccttcttgatgaccttgtcagtgacattgacgtgcttggctcgcagcgccttgagctcctccaccggccactgcaccagctgcttcccgtccgccgacagccagagcttcctcggtatcgcctgagagagagccagcaaaagcatcgtcagtcatgaaaacggaggcaacgtacgtgtgcaggcaggcccacgcgatgctgacctggatgccggcccagccctttcggcggtcgtcgggtacggtgtcggactcgttggcccagccccagacgatgcggcggcgcttggccgggtcgtagaacgacttggatgcgtagaagtcgccgtagtcgtagcggaggccgtagtcgttgtcggggaaggcggcgtcggggacgtaccggtcggtggcgtggtcgtaccagccgacggtgtagtactcgtaccgcgtcaggtcgaggctcaccttgagcacgtacttgacctcctccgccacggcggcgtcgtgcagctcggcggtgtcgacgccgcggcggtagtggcggctcccgcccgccacagcgacggggaagaagtccgggcactcccacatcccggtgtgcgccgagtgcagcgggtggtgcgccttgacccacttcttgaagtcccggctccggtacagcacggcgagccccttcatgttcaccttgctgccgacgaggagccgccagtggccgtcgggcccgtaccaggcggtggtcgggtcgcggaacgcgctggcgttgatgccgccgtccgggttgatgatggggttgtagtcgggcttgtaccactcgcggaggtacgggtcggagaggttcaccgggtaggcgacgttctggacctgccgctcgtcggggtcgatgccggtgtacatgatcaccggcacgccgctggggagcacggtggcggagcccgaccagcagcccttctcgtcgaacgtcttggacgggtagatccccggctccagcgccgtccagtcgatcaggtccgtcgaaaccgagtgcgcccactcgatgttcccccacacggcgcccttggggttgtactggtagaacagatggtacaagcccttatagtacatcggacctgcaccgtgacacgtataccatgtcatccaatgcacattagtgtacgtaggagtacttcgtgccatacgcgaacaaattttcagctagtttttacggccgtgtgattagccgtttacgtaccgttcggatctggtcatcgtgtacggaggaggaaacagataggagagaataacacgaagttagtattatatcgatcaaagaggacaacgcaaatcgatcatcgtacgtaccgttgatccagtgcttgggtggttggaagtggtacccggtccggagcttcccgtcgacgtgcttcgcctccagcgactggagctccgggtagacgacgtgcgacgcgcgcaccaccaccactgccgccatctgcagcagagccacaaacaccagcgcggccctcgccctcgccgtcgccatttccactaacacactacttacctcgcttagtgagacccagttaggactcggatgatcaatgatatagtgaggtgaatggtactattttataggggcttctagcttgcctagcttcttctcatctcggcgcggcggctgcgtccgcgcgcgacgttctttccgttttccgtttgccacgaattcaggacagttttggcgtgccacgtagtcttatctctagtgcaagagcggcacgcgcgcgcgcgagagagatcggtcgatcagatcgcgcacgcttcgttctcccctatccgcccccgctgactcgctctcgatcgatcggcgccgcgcgatctcgccgtctcgtctctcgccatcgcagatatatatagctcgcgcccacccgcgtgcgggcgctctgctagccgccacgtgaaccgccgcgcgcgcgacgcccgtccgtccgtttgtccatggcgccaccaccaccgccaccaccgctgcactgctacaaagcccccgaggagcagcggctcgggccgcgccccgccacacaatcaaggcccccgccgcacctcctcccgtactccggcggcctcgacctcctcacggaggcacttggggccgagagcttcgatccggacgacgacgacgacgccaccgccgcctcccccgccatggaggacgtcggcgccgccgtcgccgcggtcgactttctggccccgccgtgcaagaggccgcaccacgtcctcctcagcagcagcagcgaaggcgtaggccacgacgacgacgacaaccagcacgccgtgatggtgctgaggaggacgaggagcgggagggcgttcccgccgccgatatcggtgatcggcaagggcgggcggccgtggctgagcctccgggcgcaccgggaggccggccggctcgtgctgcgggagatgcggctgccgtcgcaggagttgctgcagccgtgcaaggaggacggcaggttcaagctgctcatccacccggaggccggccgccgtagtggcggcgccggcgcggggccacgcgtaggatcaggaagggaaggacacggcgccctcgagtcttgatcagtagatcagacagaattttccttttctttggtctttagagcaccgtaaattcttcctctccttcctgcgataatgtgcatgatcttgccgttaatcaatacatgcattggcttgcagcttaatctccgatctgttcaaatgcgtctcgtgcctgcatgcttgttccgatctagtattccattgcatgagaattccagacacggctgcgcggagaactgttcagttttggtttctgcaagataacgcgcggaatcacaaggaagaaacagaacaaagcgaattttttttaacgaagttttattaatagagcagaaaaaaattacaatcctagaggatcgtaactagaaaaaaaattacaagattacaataccagaggatttaaaagattacaataccggaggatcgtaacctgaaaaaaaaatataagattacaaagcgaaaattttggttgaacacggaatcaactaacttgatcccctcacgggtgatctctctaacaaacagtataaatcacacgcacgtgagcttaagttgggcttttgaggtttgacaaaataaaactcacatggtgacatggacatgaagaaaggaactggtcacatatgttctaatatctggatccatttcagttgacaattcttcacaatttacaaatatctagacctcacactcttttaacacacagtgggaaacagaaaatgtgcattagctcacatgtgccaaagcttattgtttaaaactttatagtatagttttgtttcgaaaatgaaaattatatatagcatccaaacagccccttaatctgtaccattagacattcacttcttttttctcaccgtttcaacattaattaggagtatttcgaaaactgaaatcatttgagccgaaggctaacatggaggtagttagcagtaaccttgaagataacttctgggacccacctggcattgactgtgacagcaccgagccgttttactcggtagcctcttgttcccgcacaactcgcatcgcatgccacgcctctctgctcccgcacggcgccgcgctgcgagctctcgccacggccatggcgacaccgacaccgatgcctcacactcccatctcctcgcaaaccctaacgttagccccacacgtctcgcggcggagatgcggaggcagtgtccgcgcccggaccctagctctgcccgcaacgccggcgtcggcgtgctccttccgcctccgcgccacggcggcgcgcgactccccgctgccatcgctgttcgacgaggcgttccccttcgtcgccgtggagtggaagaccatagtgaaggggtgggcgtgcgcggccgcggccgtgtactgcctctcgcgcgcggtgcccgccgcggggcggctgccgcgagcgctcgcggcctgcgggggcggggcgcggaggcgttcaagggcgggttcgcgctcgcgggactcgccgctgcgcgctcggccgcggcgtacgtgcagcaggcgttgctctgggaggcggcgctccgggcggcggggcggctgcgggagcgcgcgttcgagggggtgcttgcgcgtgacctcgcgttcttcgagggcagtggaggactgtccgcgggagacatcgcgcaccggatcaccgacgaggcggacgacgtcgcggacgccgtgtactctgtcctcaatgtgaggttccttgagactaacattttcctttgctgcgagtgactcgtctgagttgagcgataaccgtttgtggaaatgcctgcatgaggttctagtatgttgacatgtttctagatctagatgagcatcaatctgatcaaatgtggattagctgtctgtgggaatgccttctcattagtcagcataattgttgattttgtcactgttcctttctacctccttaaaatgcctatacccatggagtaatggatcttgtttactagcttcagggtttaggtgtaattcaaggcatcctgcagaattgctgatgaagtgattacattgacaattggtaggcctccaaaaatggattctaattactcttttccttttgacacagactattgtgccaacaagcttgcagttgatagctatgggacatcaaatggtgacaatcaatcccctgctctcagtggttgccgcaacggtaacatctgaacagatctcacaccttatacagttatagtgccatccttttgtagttgcttcaatgtatactgtttaattctctctacattacatatgcaggtaattccatgtatgtggcttgtcattgcaagtcttggcagaagactccgccaaatatccaaagaggctcacattagtcttgccatgcttacagtctatctcaatgatgtatggtatttcattttctattattcagtgatgtctgtagtcctacagagtttgttttttaaatgaatttccttttaggtacttccatcgatgctcactgtgaaggcaaacaatggtgagggcaaggagatatcgagatttcaaaatttagttattgttgatctaaagaataatctaagtaagaagaagatgaaggctttcatacctcaggttgttcgaacaacttacatcggaggcctgttagtgctctgtgctgggtcaatagcagtttcaggcacct

SEQ ID NO: 38493 - DNA, 1659 bp, Oryza sativa
tctgtattccatgtcagtacaagttcaacattttccctggacctaatttctcacatccagaggaataatcgaagtgtcattgcaattaaatatgtaaaaacagatttttaagttatttctttccctgcgaatttgaagcatatttcaatgtattaatttagaaagaataaatactaaacttacatttttgttaagtaatgctgtatgttcttttaatcatgtgccaattctgttgggtttcgtgcaccatttttttatatggtaaaccatcttgatttagttcctattagaatttattctgtgcataggattttgggaaggcatacaatgaatataagcaaggagaaccagcattggatcgcatatttgatctaacaaggttcatccctgaggtacttattcttttgggtaggtcaatcacaaaatttctagttatctgagaaaaatattgcatttttcaaacactgctatcaaggaaatgattaaggcactgctattggttctgtatgccctaattcaaagtcactaattgcttcttgtgtgctgtaggtgagggataaagcaaccgctgttcatttaaaatatgtcaagggggacattaacttccatgatgttacgtttcaatatattgatggcatgccgccaatactagatggcgtgaatcttcatatcagatcaggagaaactattgcttttgttggaccttcaggtggagggaaaactactcttgccaaattactccttcgactttatcaaccacaaagcggtatcacactgaacaccggaatagaattttctaaattgtcctgctacatgttgctgccttttaccacaaattcaagtgttcaacagacagcactcctgttctcttggctatttaaattgtgtcattatcttctaagctgctgttggtttgcttgcatcttaggatatatacttctggacaactgtgatatccgggacattcaattacaatgcttgagaacacatattgcatttgtttcacaggatgcattaagtacttatgtgctattttccctctttgttgttgtatcctcaaatgatgttattctccaaacaggaaccatattttttacattttaatttgtcttacatttgctaaacagtagcatcctggtcagctacaactgagggtgaaaacgtaatatgttctatttcctttggttggtttctcttgatgcagtgcctaatcataagtttgaatttcaaccatggagctcttgaacttttctcctcttttgttacttccgtttacatatctcatccatggtgtttaaaagaacatctttgttaccattcacatatgcaactattgcacatatttcagatatatttatgttatgcatgctggagcaacaacagtttgcaatattaatgtattactgacttcattgtgtttttatagatgctgctctctggaacaattgctgaaaatattgcttatggagaccccatgggagctattgatatgagcaaggttgaaagcgctgctaagattgccaatgctgaggagttcattaagatgttgccaggaggatataattcatatgtagggcaaaaaggttctagccttagtggtgggcagaaacaaaggtatattgtatcacggattgtaacaaatgaaacattttactcagt

SEQ ID NO: 38494 - DNA, 312 bp, Oryza sativa
tcctcaatcaggtatctctcgaatgctgtagtatcatcgtgtgcaccatggataaagacaagcttgggggttatattcctttcttgcttcaatctatcaatcttggatctcaacagacctataaataccatctcagttttagtgcatgcatgatatagataaatatcactgatcattaatagtaacctatccattcttttgtttaaaaattaaaaaaaaaactaaagagagtaaataccatcctttaatggatgttctgtgtttccaacactaaatgagagtaatcatccatcatcctatacttcatcaaat

SEQ ID NO: 38495 - DNA, 1922 bp, Oryza sativa
ttcaagcattctatatataaacacccagtcctctttgtcataggccttctcaaaatctaccttaaaaatgatcccactttgctttttttgtgtgaagtattcaacacctcatgtagaatcacaatcccttccatgataaacctatttttgagaaaagcattctggttctttgaaatgatagaagccataaccctatccaatctattcatcaacacttttgtaatgattttgaaactaacattcagcaaacatattggtctaaatttttgtatttgagcagcgtctttagtaattatgacataatttagtctctcaatgtctagcacacctctatggaagtcattaaccagatccagtaaatcaccttttattaaatcccaaaatttaatataaaaatcaccaaggaaaccatcaggaccaggagccttattctgttttagctcaaaaactacctgtttcacttcttccagagtgaaacgttttattaacatttctgcatcttcttacctttgtgatcccctctaggtttaaaaacaagttattctgtttgggattaccaaagagctcattgtaaaagtgagtaatgtatgtcaaaagctcggcttgcccagtaatgataccttcctattgagataaagagtgaatcagaattttcctcttcctacattagctttggcatggtaatattaggtattacaatctccctccatgatttccctttctttgctcctctggaaccacttcgttttttcctccctaatagtgaatttcagctgcaattccaggctcttctatcttctctatctctacaactcaagccaacattttcagcttttaagtcaattgcatcaattttgttcaaaatttcagtttttctcctcctatattctccttaccaattcttattcaaaccttttaatttcctccttagatagctaagtctcttttgccatttttcaatgctattacctgaaaaggatttgttccaagcttcctgcaccaaagtccctagatcctctctcataaaccaactaaattcaaatctgagcatactcttttttttaactaattccctagtgtccaacaacatgggattgtgatcagagaaggctcttaccaaagattgaacagaggtgagagggtaaacaaattcccattcattgttgatgaacactctatccaatttttctaaagttgggttatcttggttattacaccaagtaaattgtcttcctcccatttgaacctccctcaaattgttctgcttaattattgcattaaagaggaaggtccacttattataacccccaacttttgtttctctcactttctttcctcagaatgttaaagtctccaccagccacaaagggtcccttagatttttggaactccttagccaattcagctaggaagacagccttatgctctggttgagcagccccatatattactaacagatcccatgtttttttgtctcaaatattctacaactttaacctgatatgaaaattctccatagtaacatttacaaatgataacttgtatatgtttacacccactagaatcccccctgacctgccacatgagagtagccattcccattttaatttttttttgtccacttaagctatgaagtaagccagcagagaaatcatgctttatagtttcaagaattcccacaaagtctacatttgaatccctaattaggtcctgcaaatgatctattttttcgggttccccatgcctctaatattccagaatatgccttttcataattcttttggtttctttttccttttcttaagtttaggagtgaccttgaaaatctcaaggtttccctttttttgtttcatttttctagctgaagattgtatttgcttgagcataaactcaatttcctcaaagtcatcaacctcctctcc

SEQ ID NO: 38496 - DNA, 138 bp, Oryza sativa
cctggtgtactagtatagtcaatacaacatctggatcagcaaaatcatacaggtcccagatattaccagttatgttgtactggatagtccgcactcttagccgcctttgcaaggtgaactttgatctgaacaatgtat

SEQ ID NO: 38497 - DNA, 18882 bp, Oryza sativa
cacaagaacatctaaaaaagacctcaaataactgaataaggggttgcacatccctcataatacttacagaatcagcaatcttgaactctgaagatgttctcaaacgcagcacacatccgaaagcataaggacggcttagcattttgtatctgcaaaatgaaggataaaactcaattgctgctttgtaatatataataatctacgcatataaacagtacattgtacttaggccattctgcgcatacatacaaatagttatagtatgtgacattcagggtactgcaaaaccatcatttaaatattcattaggctattaaggattagacaagtcagatatgatccagaacttgaacagagaggaatattaggatcaactgtcaggatacactgaacatcagaattctatcaatttaactgttctgcaaacagagagagaagaagagtacaagcatacataaatcaaaaccttgggctgtggaaaatttgaaggacctatgatcttgaagcaataaagttgaactgatgattacattgagatacacaactcagatgatgagcaaacttacatatcttgcggaagtgttgattcatctgtacttgaatacatgtacaatgagccaccgctctcaacactaagaactttcaaggaagaaagatctgtgtattcatttgtaattgcaaaaaggtccacacatacacctgcttgaacagcactagcagcctgtgatatgccaattaggatatattctagaatattcttgtaatttattgagcaaaaattacagagacttaccagatttgtgtagaaatttgtctgctcggaaatgaatgtatggtcggatcccagcattttagcagcattatggtccacgtcacttcttgtttctatttggccaggcccgtaattcggtggaccagacaaaaatgtgaatatccttgctgtttaaaatcaggacagaacattatagtagaaggcaaggtcaatcgccaccaaacatagtacagccttcaaaaagaagataagccacaaatgaaacaatagaatgatagcgtaatcaagatatcacataccaagttcaaacaaacttccgtactctgtacataggtagttgacaacagcatccattgctaacccaaaaccgcgggcatgatgcaacgcgtgatcctggacttctgaggcagttgctgttatttcccaggaagatgttggtttaattgtttcaagtgcttcagcaatgcgatctttgcacccgtcgacctgttaagacataactgacataagcatacgacagatatgaatattctaggaaggggcagaaagcacagtaaaagacaaaatcatagattaaaggaattgcgaataagggcaaaactacaatcaacagcatggtatacatacaggagccaaaaaggaacgaagcggcatgacatcttcaaggtcgacaagtaaggtaccatcagaatcaggagggatgaaagcattcttcacaatcggtatcggaccttgaacatcatataaacctatcttgctgctaaatgtcaaaagcccaaacaatgatcctggagggatagctgcatgggatcacaaggatcagtgcacacatagttgcacaggaagctcatgaactttatgatgtccacaatagattagtactagctcctaaaaacttgtggctggatctcaccttcaagagctgctaggagagcacttttgactagctccaagaactcctccgaagctaaaatacaatatgattaaacaaataagatctacagaaaatgagtcgggaagtctagaaagattgcagctgaaagaaatcaatgttattttcatgtaaatctcaatactctttcaatagatacagtgagtccaatttaacttatcacagcaataggattaagatggaatgatcaaatgaatttggatgccatccatcaaggtataatgcatatgcaaaaaccaactcgatcaactaaatggatccagaacttgacagaactgttcacagtaatcaacaaaatgttgcaacgctaatttccttttttttctacaattcaagcatgcttgcaaacacacatccacacgtgttacaaacaggaaccattgctcatgttgatcaattactagactaaatccatggcatgagcatagcaagttattatgttcagttcaaattcacgttcctatggcaccccaaaaaaaaaggggctcacatgctgactagtgagtagtgactattaagcaagcttcatgcattttatagccaaccacctctaaaacgtttcgagacgaaggaattttgagatcttacaggacaagtcgattgccgccacgtacactggcgtcgtcgtcgccgcctctccctcttcccctgccgagaggaaaaaaaacatcagctcctcatcatcacacggcaaccacattgcattacatgagaacatcgacaactatgatccataccagggaggaggaggtccacgaaggcggagcgcatctcgggcgggtcctggccgccgtcgcgggcgtaccgcgcggaggcgtcgggggtgaggtcgttgtcggcggagcagatggcgcaggaccacgaccagcggtggagcgggcagagggtgctaaagtaggcgtagcaggagtcgcagcgcgggaggaggtggccctcggcgccggtggcgggcgccgcgccgcgctcgtcggcggcggagaagggcgtcacggcgacgccccacgggatgcccgaggactcctggagtgccgcgtcggaggggaagcaggcgaggctcgcgcgcaccgccattgctgctgctgcggctgctgcggccccccgcgctgcagctttgggatgtggatctgtggttgttggccgcgaccgcgagagggatctgaggagaagaagaggagggaggaagaggaagccgtgcagcgcagcgtggagtaacagtttacggtgtgtaccgtgaggccattcacaatgcatctacatggcatttggcctcaactgtccagctaagcagattgtatacgtggagaagaaaagaatgtggggcccatatattcaccagctccgcgcgtcctcatttggcgcttttttaatcgcatttgcacatgagaaagcaggacacagagagagaagggggagaagctgacccaaaaaagtaaatttttgtggtggggcccacatgagaaacagtttggtggggtccacctaaagacacgcgcccacgccgcattgtggagagaggagcttcacgctgtttcttcgtacgtggctgtttaggctcctcagaaaaacacaacgcagtgctaatgccctgatggtccgtgtgactcgctcgtgtcgtgtcgggctgctctgctgctgcagcaaaacgatcaggagcatccaatgttaatcgtacggcggcgatgtggtacaagttgcaaggattagcacactgttgttgctgatatcattttgctactgggagtatttctgtatttttgtctatttacaaggttgtccaagcgtgttgtttgttgatgacttaggtgctgtttggtttccaggaacttattccaagtccatgtcacatcggatgtttggatactaatttggagtattaaacatacactaactacaaaacacattccatatccttggactaattcacgagacgaatcttttgagtctaattatgtcatgattttgacaatgtgatgctacaataaactttttataattatagattaattaggcttaaaaaattcgtctcgcggattagctctcatttatgaaattaattttttattagtctatgtttaatactccaaattagcgtccaaacatccgatgtgacatgggctaaaaagttttagccccatctaaacaccccctagtgtcaattttttgttgggaacattggacacacacaaaaacacattataaattacttcatctgtcacagaaaaaaccaatttttgaaaaatccggatatgtatttatccaaattcattcttacatgttgttttttaaaaacagatgaagtagttaaaactatataattgaagtgtttgtaaaatctagtttgtgagataagactcgggcttgacaagcctaactcggcaaaacgaaaacccgtgtgacttttcactcctagcgtcttggatggcttaggggctgtttggtttccagggacttattccaagtctctgtcacatcggatatttggacactaatttggagtattaaacatacactaattacaaaacctattccataagcttggactaattcgcgagacgaatcttttgagtctaattatgtcatgattttgacaatgtgatgctacagtaaacttttgataattatggattaattaggcttaaaaaatcgtctcgcggattagctctcatttatgaaattagtttttttattagtctatgtttaatactctaaattagcgttcaaacatctgatgtgacttgggctaaaaagttttagccccatctaaacacccccttaactgaaccaggagtttggcttgatttggacactacaatgttcagaagcatgaagatggacctgccactctaccggaagagcaaggaaagaagagaggatagtagaacattggccctgtttggaagattagctcagagctaattttaagagctaatgtttagtcatgaattggtaggctaaacattagcctaaggtagcatgtttggatccatgggctaattcaaggctaaaaggtagagagagagtagaaagagaggagagagaaggagagagagctgctttttgatggtccctacacaaaattagccccattagcatctcttgaaggggctaatgttttgagaggagctaattcacattagctcaaaattagcccacttgttttgatttctgagggctaatttgaggctaaaagttgagggctaaacattagcccatggaactaaacgcggccatagtagaagacagggtagacaaggaggtagttttctcttacacgtgaatctacaaacattttgcacactagagcaacttaaaccaaattaaactcacatgtcacatgtactctgaccactactctcctagatttgtacatacataacattatactccaccgatctagatctaattacttgttccttaatttcatttaagagatctgagaaaataattaggtttctacggagctgaaacatctccattaccaccgtagtggatttatactaggaaatggcgaaatgtttgcttcaaaattcactgaacaatgcgccattttgatttgaaatcaaaatataccctaccaaattgttagccattcgaataacactttggctaatgtttggtacgctaccaaaatataccaaataacatatatagcgtgcttagatttggaactaccaaaatatgcttagatcttagcattgctaacattttgacatgatatcaaagcaaacatgtcctatataacgaaatcttggcttatttagggggacatggcaaataaatagttcaaagatgggttgaatgggcaacaattggaaatagatgtatcaactataaaatcaattcttttccataaatgaccgtcagttatttcacttcaggtctcgtgattgccggattcgaagaatgcacacaatctgagcttttgttcgaatgcaaacaggcaatggaagggtgcaagcaatgcagttactgtcaaattctcggctaacaagcaaagccttaagcatcagcattctcaaattctcagctcctcaatgcgaaagaatgaaaagcgattaaattatcacaaagtggtaaagaaagaatagtaatcggtacagattacaattgttagccgttgccgagcacaacaagcagcacaaaccagaatccaacatcagccgggggtagacacgcgaatcgacccaacacgacacgaattgctccacaactttggacatcacacacgattcacagctatccatcgccggatccatcatgagcagatggggcagcggacgaggccgttctcgttgcactcgccgcactggaccgtctccttccgctcgccgtccacgcgcaccttgcggctgccgttgcagtcccggcacatgacgaaccgcacgccggcgcagccggcgcaccagacgcgcgcgcgcgggaggccctgcagcagcgccttcagcttgccctcctcctccagcttggtcacctccgccgcgccgccgacgtgccggccccggacgaacaccgccggcacgcgcacctcccgcccgcccagcagcagccgcagctcctcgcggtagcccgagtccatggacacgtcccgctcgatcaacttcacgtcgtgggcctcgatcgccgcgcgcaccgcgttgcactcctcgaacgtcctgcggatgccgcggagggtggtggtgtacaggacgaccgcgtcggcgccgccgggcgggcatttcccctcggccaccatcgccggtggcgccgccttcgggtgcttgggcttctccgacccgaccatccgcttgatgtgggcgccttcctccgacagctcgcgctcgatggacgccaggagctccgggtcgaacagcgggctcaggctccgccgcgacgacgacattccgccgccggtctccggcggcccgggcttccggacgatccgagcgctcaccggagagaatctcttggacatcctggacaatttcgagttgtcgattgaattgtacggccggaggaccctgtcgacgttgacgtcgccggtcttgttgatgttgctgctgttgttgttcccggagcagcgctgcagcgggctgttctccttcccgggcgtgttcctccgcttcgtcgccgacttcttgggcgacggcagggccattgcgatgacccttgccggcgaccaacgactcggctgcttggccggcttcttcgccggcgacgcatccgcggcgtcggcgtcctccagcccggccataatctcccaggcgttgataacctccaatccggagtccagcttacccgccggcgccggcttcttggcgctcgggaccacgagcggcggcggcctcgcgcgcttccactccctgcttatcggcttatcctcctgcggcggctgagcctgagtctcctgcaccttttcctggcacgccaccgccgccgccgctgctgccgccgctgccgcggcagccgcagccccgtgcttggggtggaggtcgagcaccccgtaggtggtggaggtgagggacaccacatggtcgacgcggccacgcacggtggcgcgcgcgccgcttccccctctcgcgtcgcccggcccgggcgggagcagcttcgaggagatgcaccccatctcgtcacggcgacggcgacagcgacggcgagcaaccaaccacctctctctcgaaacggcggcgcttttcactctctcgctttctcgagccttgaccagagtgggcaacgtctatggcttgaccggctcggggagtagtggggcgttttgtggtgcgttttgaacgccgtgtgagtgactgtgcgcgcaacggtcaccaaggagaggccgagaccgagagggcggtgcgtgactgcgtgccgtggtgacgctggagatttgggcttttgtttttaattttctcgtgcgctgcgcggcgatgttggtagcaattccaacggtcgaatccggcagatggttggtgcccgtggcagcgcagaagccaggaggaggaggaaggcccgcaagtcgaaaaaaggtggcgcggcccgtgtcagagttgccccgctggatcgtacggaggcaaagtgttgggccagtttctttttctcagttatgggcttttttagtctcgcgtgcgagcccataaagtttgcaactttttagtttttcagatgtttatatgcctttttgatctttcagattagtgctttagtttttttaattggatttgctttagttggatacctgattggaaatttggaagagaccatctcaagagaatttggttgatgcattgcaatggttctacagtgtagaaagtccagtgagtgattaatctagtctaacatcgacgacaacacaaggtacaaggagcagcttgctcaataaagaaaagtgtcacacatgcacaagcagaagaagataaagatgacttttttcagagttaacaactggatattagcacgggagatgctgttccaagtactaagaacggatggttgtttgcctcggggaccgtgatccgtcgatataccagattcaggccgccgagactggtccctgcccagccactgccatggtctccggccaccgccgtgaagcaaggcgcttcatctctcccagcccaaccgccaccggccgcggcggcgaaagagcggcgaccgtcggtgacgaagtcgccgttgcgttccactcgttcgtctccagctcaccttcgagcggattgctggaagaacgacataggtgacgcagcgtggcagccacgctcgcccagcacccgccgttcctctcctcgtcctccacgggaggcgcaggcgccgccgccgccgtcgccggcgacctctccgaccgcacggccccaaagcacgaaaccttcggggacccgggatccgtctccaccgcctcgctcgcgaagaccctggcccccgccgccgcgggtgcccggcgccatccgcggccaaggcatggggacagccgcttcttctgcgcgaccatctttcccgccggcagaccgcagatcacgacggccgccttgccggtcaccggcagcctcctcgactcagccgacgacggccgtggcccgcccttcttccccttcccggacgcagcggccgccttgggattagagctgcccttggtggagccatccctctccagcaccgcgccgccggccaactccgcccagatggcgccgtcccctatccgcacgcagcgcgactccgctggggcgtcggagcagccggggagcgcgatggtctcgcacgccaccctcgaccccgcctcgccgccgccgcagaagagggactccagattgatttgcggcatccttgccagctactagcactgactgactggtgggtgagcgattgatagtttctggagagtcagagcaagtggatttaaggggagcgccaaacaaaagacgtggagattttgaaaagggggaggcccgtgcggtgtggaacggcagcgagtaccgttggtgggttgagtggttgggtgaggcgcggcttgccggggagttttggaggtgctttctcgttgtttttagtttgcacgcagccatcggtaacatcggcagaccggctactagcagtgtgtcgaatgcccaaacgcgcggcagtatctagttcatactaagtttggttgaaattggtatgatgtgatagaaaaaaattatgtgtgtatgaaaggtttgatgcgatggaaagttgaaagtttgaaaaaaaaaaactttggaactaaacaggccatatgaagtagaagaattttgaacgaggaagtgcatatgggggctaaaagattgtcttgcttattttttatgcttactaaaaaatacccgtgcgttgcaacggtttaatgctattttaatcttattatatacggtttaactaggatgaaattcactgtaggaattcgcttggatttttttttagaaaatcatgagctgcaattaggagtccgatttttatctcaagttagcatgcaagcttttttaaataaatttcttatacgactttttttgtatttccaaagcaatcgaatttaaaatccaactcatacacggatatttatttccaagagcgaacggacttaaaaatcgactcaaatacggatgacttactaaaatatcggtaaaaacatcttcaatttataatagtagagaatagatataagtcaaagattaaaatttaaaactcaattttaaatttaattattttcatcatagtttaatttgcaacatttgattttaagtcgttcaggacacgtacataaaatttttactcgtaaatatttttttatttacttcataagcatatgaataaataaaataattgtgatgtttgagtttgaattggtacttagtactaataatataaatatttaaattttaataatatattggatacgtcacctatacttcaaactaaataggattagataaaaaacgattatgactttttaatattaattttttaaattcgaaagtaaaattagtaaaaaaataaagacataatggaacatcttactatatcttccgttgttttcatgttatattaacattttacaaattttgaattaataagtatatctaattgtatttatgtcggagttttaatttagcatgtttcataattcaataaatatagagttgcgaactgtttagactttggttctaaaattccgaatcaataaactattagtttgtggtagtatttgacatggactcctatttcatccaaacttcttaagtcaaatgtgaagttacacggtgttttccaaggacatgttttatttaatacaaattcacaacatgatctacaattacaataatatattttagttaattagtataatatttgttgttttttaagtagatttagaaaattttttgtgagttgggtccatagctcagtggtagagcatttgactgcagatcaagaggtctccggttcgaacccggatgggcccttattaactaagttttctaatttttctatttttaaaacatatttccgttccaatctggccaaatccatctcttatttttccaatcatcccatttctttcctctcgttaatgtaacaatcgcaatcccaatctggacgtcgttaatcttcctcatcccaactggccaaatttgctcgccatctcgttccggcccaactgatgggcctctcgtctggcccggacgaagtctccgcggccgcgagcccccgtccggccgaggttgcacacaggacgggggcctgtaggcgagtcggcgtgtgctgaagctccccatcaatcgcgcggttcgtgcgcgcactactacgctagcgccccgcaccaacggcaagagcacacgtttgttgagaactcagtagttcttcattagtaggtaattaaagagggtgacaaaagaccggtctcttagtacagaaatcaaagccagttcaagactgctagcaaaaccggggcaaactatggccggtaaccaaaataagaaagcaaacctagacgctataaacacacgacttcagaaacaaactactactgctggacagaacacaacacaagggaccccaaaacacgcagcgatctccatcggccggaatggatcgatggcgctgccagcgcgtcgtcgtacgtcgtcgtcgtcagcctacggggagctcctcctcttcttcttcccccagaacctgtggtagagctgcacggtgcggccgttcatctgctgcgtcggcctgctgttccggcggtagccttcgtccaggggagccatcagatcggcggcctgctgcggtgtcatctctctcggctgcaacattttagtaagcattcgtgctcacaaagttcagacttggcagaatgcgatgcgagccatgttgctgtcatgatgcagctgagatggaaaattttaggagatgaagctagtgcgtgtgtagtatacgtaccatggcagggatgttccagatcacgttctcggcgcacggtggcgtggtcagtgacccaacgtatctgtagtatatgtgcacgtgctgcctcatcgtcagcaagctcacagatccggcagggaccgggctgcctttctctgccttgcagccctccgcgttgagcgcagccagcttatcctgaatctatcatccatgaagggcaaaacaccacatatcaggaacagaggaagacatgctgctataaattattgcctttgaacggtagaatcgtagtgtgcaccgtgcagccacgtcatatgaatcgggtgatctacctgttcgaagaacgggtctggcctgccaaatcggtagagaaaggccagaacggtgatgttgccattttcgttggtgtgaaccatgtggagctccagtgggaacctgccagagaaaaaagttacaacgaattgtgatcactgatcagcacagaaaaggatgatccattccatatttccagccgtcgtctgcatttcgtctctgttatgtgcaggcaggcgcaaacctgaagccgttgatggtgtgctcggaaggagagtgccagtgcatctgcttcagcgtgtacttcaccccgttaatgctcagaacccctgctgcctcttcgtaccgcagctgaaggaaacaaaaacgactaactatcagaagactgcacaatcagaggagggacagagtagtgttcagtgcaagaggtttggttcagaacaaaccgcgacgttgaagatgttgtcgacaagagtagcatttgcagcggtataatttctatggagtggctccatattcagttcatgaaccaggttgttggtgtcgatgtcaattggggactgctgctttccgttcgagcaacgcgtgaagtcggcactcaaattcccccagaagtcagggccgatagaaccagtgtacccaaacttcacgccacctgcttccaatcaagaattcacatatctcacatcaacgataacgttagaaaatgataatattgcgaaacttgattgtgaaattgtccaaattgacagcagaaacggaagcaaggaattctgaatgctctcatgaaggcatggaaacgactgtaacagtagataaatacacaagcagagtagacagggttcagacaaatactcaatgcagggtagaagaatgtaccgctgtcacatgcaagggacgggagaaagagagtgcacagcagcagaacaaagatcgcatttccatgagaagctgccatcttttcctgcaatgcaataaagcctgcaaacggagaagaaaccacagggcaagaacagagagtagtttggagtcaagccacttgtagaatgagcaaatatataggcattgagcttaatcgcattgtcgcaaactggcaatgtcatggaccaaccacaatccatcttacctctactttgctatatgcagatcagcttcaaccctttggagtttggtccctggaaccaaagtggccgtgctccgactagtagatgttcctgcgaaaaggacaggcaaaagatgtcgattctctgcagccatcacaagatcgatcatatataaagtgtgcaatcatgctggggcaatagtgatctgacctctttgctcgacggctgcaggaatcttcgaaggccagaagatttccaagagcaagaacgctgctgctggtgaaggtgctaacttgggcggtttatccaccagagttcagaagacaccacgtatatatagacacagttttgcccctcttttgcagccgttctttcccacttctccctcttttttctgcagtgacatgacatgcaatttttgcgaggaaatggaggtagtgcttgtcgtggcaacaggagcacgtacgcccattaaccacacgtcctgcaagctcgaatgttgcatgcaatgcacgggagaggaggagatggacaaagcgaacggaaaaaaagattaaaatcctggccacgtctaggcgcacgactacacgagcgagcacacgacgacgcacaaagctcggggtgaggtgttcgtgttgcccttgcatttcgagaagtggtggagaggagagaggctgagtggcttcaccgaacagtcgtccaactgtccaaccgaaagcgtcaaagcggtcatggcctttcaactatacagatatcggatcaagcaacaaaaaccatcatcttgcgttgcttaattgagagtggaagaagacggttgagaagacatgttcagctttgtcaactcgtgcaacgccctaaatcttctatctatcttctattatatactaaaagtccattaaacttcctagaaaccctcctaagccgccacataggacccctagaaacgctcctacgccgccatgtggcgatctaataaattatagaaattctaagaaaatattagccatcgattttcatttaatatatggtaggcccattattttcaaccattagatctattgtaaaacataccaattaaaattatctccaaaacccaatattgccaatctttatgtgcatgtgcacataagtacggacgtttagtaggtattccaaaaaaaaaaggtacgtacatatattccaaggtaaaaaagtacgtacatatgtacataagcaggccgggctaacgacatctttttattttcttttttttcactcggataaaaaaccaaactgcccatattaactatgctctacttacgttgtaaaaatataggcacatatatgtcatcgaaacaccaatgagaagaaaaaattaattaaagtatatattatgtaatagttaaattagacttgcattttttaaaataaaaacaattctaattgtgactagcaattctcaaaagttacctactccttataaaaaataatgatatgtcaaactgatatcattaaatttatcatgaatgtgttttctctattcgtataatatttaaatatcaaagattgtatatattcttttcacaccatactgatctactttatcttctacttatgcttcatttgatctagctggatggctgagcttattcaggatacatgaaacgacacatatcattagtgcaagattaattaaatattgaatataataaatccaaaatagatttatttaatttttaaacttttatataaaatatattttaattatacacaagttgcttttaaatatatacgatgtaggttatggttgtcaatttaattatagtgcataaaatggttcagatggatttagatattattatcaaaagatatgtcttttgtaataattcctatatcaatgggtagataactgggaaaacaaggagcaaccaatctgataagtactctagaacttattgcttatttactaaaatgtttaatgtgtagtatataatatactttatgaataaaaaaatatcctaatatataatcatatgccaccacttatccataagtatataaattttatcaactaatcgtcaagtcatattgcttacgaggtattcattcatagtgcacctaataattagctaccatccaacgagcacttatgtcatgaagcaccatatataacggactatgctaagtggagaactatcaacaaatgataggtaaagtaaagcatgccaccaagccacagcaaataataatcgattacaagtatattgtcagtataagcaatagaattctacacttctacaagaacccttaatatatcacgtaatagatctcataaattagaaaaaaagtataaggaaaaatataaaaaagaaaatatctggtcatcaatttacacttcaactggtagatccattatttttaaccattatattggatatattcgagctaaaaaccaactaatctctccctatgtacgtacctatacaagagatgtcaaaaaggaaaaaaaaagaagaatgtatatatgatctgctccgtctggttgtttttttgtttctttctttgcagcactaaagttttcctcaaattatgcatatatatagtgaaactctttacgatgttatcgaaaaagtcatgccaccgtggcatcgcttcatgccatcccacaaaacttttttaaaatatttttttaactaatgatctaaaacgaaatcatagacactcatataaatatgtgcacaaccatcctacgaatatgcgcagtactattcacaaaaaaaaacaaaaatatacatacgtacaataaaaaatgtcgcatggaaacctattatatccttatataagtatgtcattctcatctaaatagtgttgacaaaattagcacaaataattttgacaatatgaattattccttcgaatattacccatgaatatacgtaggtgacttagatgtatagtaaaagaaaaaaatctaaacccatattaacctgtatgtttacgaaagatggtgatatgcgactttatgtatagccatgacaaagtgaaatttgtttgaatataatagattttatcaattagtatatcaaagtttataatttatttcacataataaatatttcttattttatattataaggtaatctatggttcttaaaataaatacggtaacatatggtttattttagtattctttctataaacaaaaaaataaattgcccgcgcatctgcgcgggcttcctttctagttacactaaacatgaatccagtatcaactctctttttttgaggtaagataatgagtcaaaatctagtactacatccagtagccaactggtttgtctggttatgagtatttctgaatttactgtagtccaaacgacaagcatgaaatcctatatcacttttggcagcactaggatagcaagattcatctctacgaatggctgacctgcaaaatggcaaaggacacatcatcactgagcagtctcagctggaggaatatatcccactatgtggggactgcacactgtagggctgcaccgaaaggaaaggaccacaaaattttcaggctccagagccccatagcacattctggatggcttcaaggatgaagaaaatagtatatgtgccttgaagagcttgacattgataaatgctagccatgtctcattgcctaccacttctttctttttttttttcgtcatcttttcttttgaagacttcattgcctaccacttcagcaggcaaaaaaagttgaccctgtcaatatcaagttatcaacaggctagagaatattagaacaggacaagacttaaagagcatatggcaggccaaatatataatcttttgataagagccacttccagctattaaaaacatggggattaccagttttaacttggtatattagccgccccataatcggtaagtggaggaggataaggcccatggcgctttctggtacctgcaaagcatgaagcggtcactattaagccgtccacaggtattattcagcgtgcaggcaaaatgcatggagcacactgtagaatgtggagatgcaacgacgacagcggaatgtgaatagcagagcatgtcaacagctacttgtcacgataaagattgaaaaaaatctgaaaattcattaaactttctatgaatgctcttaaaccaccacgtgacactcctacaaacacttttaagttgtcatatgataatgtctaatctcaccattgattttcacttaaattggtggacccaatattttagaccattaaattagtgtattgtttttgttaaaaaaagtgataccttcctcctgtattctgtgggttggaaaaagaaaaaaaaatgtaaatactttgtacgtatgtaccaactgaaaaaatgaagcttacctactattcaccggaagaaaaaaaaagtaggtaaagaatcgtacgtacagacttatgataaaaacgataaagtaaaaaaaagacgcacttagtagaaaaaaataatggtattttaaattaggtttttctactattttttataaatatattactctacaaatttacgcgaatgcgtcaacctccccggtgtgatcaaggtggaagacgagggacgggagtgggagtggggaatagggcatccaggcaacttcgcgctcctagatccgatggaggcagcgacgacggtccagctcaggattgggggtgggccaagtgatgagtggggtaggggcatgagaaggggggagcgcctcggcgatggtgacaacggtggcgaaggagttttcccatttgagttgatctctagattgtagacgaaagcgcgagcgaggagaggagggagggagggaagtagggagggagggagggctacgtgaggtgctaggggacggcgacgcctcggtcggctggaggctgcctcggcatggtgggcaagaggagcgccggcacaaggcagcacaccgagcgctgcttggcagcgaaatcttcagtggctgggccacttacatgttggcctcacatatttttttgctgactaggataccacgtcagcaaaccgcacatgacatgtcatgggacttactttacatggttttgaatacttgagggtagatatttctggtattggtgattagggatgttatacagattcaagtactcgacgtaaagttgagggatagtaagtggacttattccaacaaagttgaaacacggcctgcaaaagcccattaagaatctagcctgcgagccaaccgagaaaattcgcggggatgttcggctgtttcggtttcggcctgcgtaattgcgtgggggtgttgcccagtgcgcgaggagagaagcccacgccacgccacacctccctcgctctgctctgccctgacctttcattggcctgcctgatccgctcgtagagtggggtcatgctcacacacctcacaactcacaagtcgaatacgtgtctacgcgcgtgattcacctgccactgcccgtggtatgacgattgacgacggtggaagaggacatgatctatatctatactaatatttatatattaatataaaaagtacgagttcatccagcaatcctctaatccttctgatccactgtcgcgtaggacccatctgtcatccaaagaaaccgcaccacgcacggagaaaaaaaaagagacggtgcgaaaaaaaataacgcgcacgctcggcggacctaacccatcgccgcgccgcgccatccccacgctgcgccgcccgctggaactaacccacggcgccgccatcccccacgcacagcaagaaatcgctaatctccgcccccacgccactgctccgcctgccgcgccgcccgccccacgccccacgctgcaccgcccgccggacctgatcccgcctcacc

SEQ ID NO: 38498 - DNA, 2486 bp, Oryza sativa
cgccaccgccatcctccctagccgccgccgccaccgggggcggttcccaactccgcctcccccaccacgcctcccacatcgcgtcacccctaccgccccgcatctaccggccgacggttcctccgcgtcgccgccggctcctcccgcggcaccccacccccatcccggcgcttctgtccgtggagatcggcggggtagccggctcgcaaggtggagcatcgatgtgacgtgatgcagcatttggggagtctttggtagaggtggagcggtggagattccgacgccgccgaagccccacccagtgcacatcggcgtcgcgactcccgccgacgccccgccatcttccgaccggcgccgccgcccgcatcactgccgacgcctcgccatcgcgcggccgccacgccaaccgcgacgcccgcctcgccgatctcctccgcggtcgctgccgccatctccaccggccaccgctgtcctcggtacgcactgctaagtcctaacccacccatgcctctgccttgccgccgacaccaataacccctgcgtccgctgtgcttcacgttgactggtcatggaaccagtgcagcccactccactggctggagctgcttccctcaggctgccggaggtagctcgctgtgccaggttatcagtcatctcaagcaatgtgctcattaggctattgtttgattcacgtacagaatctgttgcagtagtttagacgatcttgcactatacattcctgtatttacaaaatctgttgcagtgtttgattatacattcggcatcatattttgcattatattgttattttcaactcctgtatttacagagtgttgacatgttatttgtatttagatcccagccaatgtgaattctagagctctgttctaaatgttggtaaactctaatgaattctagagctctgttccaaatctttgagtccatactttagtccatgctctgcaccttagcaaaaatgaaaatgttatctgcagctagcccaaggaatccacctgcatccagattatgtttcttcaactatttgttatatggttccctccagtcattcttttgtacagcagcgtgctcactatttgtttgctaaaatgttgaccatgcatttgttgaaatactcaataaaaatttgttcgaccactgccaccatggtcactattaggggctccacaccgatatcttcagcaagattgggtaaaatgtcttgctgctgatgtcagtaacattttttttcttcatgtgagttgctaattgttcctcataaggtccttgcaggttcaagaaatacaggattcatgtgatgagaaaaaggaaaatagggttcaactgaactctgaatctaaagaaaaacgaaacatacggcaaaaaaatatggcaaaggccaacataaaggtaatttgtatggagttaggtgtcgtttctacatgacaatactttattgttggaatttcctgttaccttgctatggtatgatatttggcttgaattgatgctaattttaactgtacttgctaaaattgctatggtttgatgggtaacaccgaagcaggaattccatgtctttcagatctactgtgctgcatcttgaaaaacactattgctagcatgtaggaacaactcatgaggactagcagtaggtatatcagtaacagcttatctatatccctatactatattatcatcactatcattggtgtgtttagttccaaagtttttttccaaacttccaacttttcccatcacatcaacatgtcatacacacacaaactttcaatcacatcgttccaattttcaaccaaacttccaacttcggcgtgaactaaacacagcccatatctatattcagaattatttgaagatgagacgatgactagcagtaagactgctcctattcatgtcaaactctgtccatcaagattgctagatatctctattggatgctgttagtaactcctattagatgtgtttttttttggctgttagtaactcctattagatgttaccattggactaaaatatcataagtatatctgtactcatatatgaaaatctcatctagaattgctctttttttactatatttacagctatataattttgtacgaaatcatacaacaactgctctaagtaattagttagatagcaaatgctcttcgtaattgtacagaatcatgtgatgtcatcttacccaatcctggatttctgtcttagctaagatgggtgctttgctttacataagacagacgtgcatgcatatctggatttaagccgtatacttctgccttaggattttgtaggatgtgggctttcatgaagaaggtttgcagctcagctaagttgacgcgggggcagtaagcttctgcaaacctgggctctattttgcacagggagaacacaatagcagaggctaccatgagaagatctgataaatttccatttgagaggctcggttattgatgtttcctaaggat

SEQ ID NO: 38499 - DNA, 1015 bp, Oryza sativa
  unsure (1)..(1015): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccattagtgaaaatttcttgttttagagaattagctcgtatagaaaattataatgacttggttgtcattgaaactgaagttcttttaaaatttactttacgtcagccggagagcaaggccagaaaaaaacggtacaagtctaattctacctcttttttcatataaaactttcactgaatattttaatctagcaagaaagtatgaatttgcagattaacattggttatgaactggcgcatcaagcatgggacttcaaaatacaacaaggaagttgcagggcaaaaattccttcaaatataccgcggcagtatgatcctatacagaaccttgattctgtgttaatttttgatttgatggataattcaaatgggcttcactgcttggagattatgacaaactgcctgcataagaacatattgcatgctccaattgttcagaagaaggaggatgttgactgcatttctgtatggcatgagccttacacaggcaatcttcttgcatatttggaatctactttgttaggggccaaacatatggttggggaaaaggttgtgctcccaacacctgtgctacagaatcttataaggtgtgtctttgttgccagctttacgtaatgcattaagatatataaagtcatgtaatagtattgttgttttagtcaagtttttgatggattgaagatgctgaggctctgtgggaaataccatggaaactttacacttgagaagacatactattacaagaagaatggaaatgaaatcattgtgaaacttgctaattttgaagttaaaggtaatgcaacctatcgaccgttgagatacaagatcaccatttagggtagaaacaagtagagatatgtaagcacattatttagatgacgttttcaatataattaatgtttcaatttcagatcggggcgcagg

SEQ ID NO: 38500 - DNA, 1303 bp, Oryza sativa
atgcttgagtacctgtctatagtttatctactaaacttttgctttgatttgaatcatggctgcttttggttagtcaatgctcttttatctgaggaatcaattgatgattgtgtaatttggatggtcttgagtgttcctaattttggctaagcagttcatattcagcaatagcatcttgctgtaaaaccaagaacaatgtaaatgatcattgtttcgtactttaggtagctaactgcatgccaaggaaagcaggttcctcacaaggatatctccgaacttaattcctaagtttgtgaatagtagattttagtcgtttattttaaaggaggttggtcaatctagtttagagcgtggaatgtttcaatgtcaatggtttttgtttatttccttcaataccgctcatggatcaagaaggcttatcttaccgactttagtgacttaacaatgttttctgcagtggttgtttacctgctgtaaatattgctgatagcttaagtataggatagagacctagatttcatgattgaattgtaagaaatctgtgcttgaattaagtgatgccaatgtgttggaatggccctggcttgaattaatatgggccatgagaaggaacttgcagctcttcagtgtagctttcatacgcttcaagtttgtttccaagtatattgtgagtttgattgtgacaaaacaattggtattctaaaaccaatagcctctaggtgaaagcgaaatacttgatagttgaagtgaaacactgatgacataaatagcttaacaatatatttttttatgcgtgcattcgtaatgagagcactctctagcaattaagagtttaatgactatctaaaaagctatattcatgaatggtggtgctagactaatgatatattgtttattttatagcggggatttatgcaatattgagaagaagattggaggccatcctttcttttgggtttttgatgataggaagttccttttgacttgctcgattcctttggccatgaacaaacgcgcatttcgacaaaagattgagggcaatgaagatttgattgctcttccttgggacaaagaggactatgatggattaattaatttgatgatgaagtacagggcagatcatatgattaaaaagtttgatattaacagcagagttgactatgtgctgtgtgtaagtggaatgtatgctcatgaaaaggagctgaaggtattacatgttttaagcaaataaattaacttactttaattaccttctggttacatgcttgcagtaaataaaatgaacttactgttgtaaattata

SEQ ID NO: 38501 - DNA, 13958 bp, Oryza sativa
atgttcttaaaaaattcattatcagagcattgctcgattagtttgtttagcgggcatgggaactttgtttcacctatactttgtttctttcaaaagataaatatgatgggatcatttgcagctttgttgtttgcttgatatttgttgtgtaaaataacgtctgttgttgaagaaacgtcttgtttgtcttattctcaatggctcgagtgtcctgaggttatgggcatgcacattattttattttagtaacatatctcttcaacacagatataaccctgggagctgtgcgagaggtaggcatgaagtctggaacaatgggaaacagtggcttttggttcctacttgtctttgatagagctagcaggaggcgaagagaaacatagttaagttattgataatttagtatttgcaaaagagggagatgcaccactaaagatcttataaagattggtactgttatatttggtgctttcaatattttcttggtaatctatagtacaatgtccgtgcgttgcaacgaatgaattggcaattgcaattgtatttaagcagaaaaatgttaagagtaaaggtaatgtgcgacagagtgacattaagatgcgttcattcacatggttttacacaacactattagcatttcatctgaatatctctgtattattagaaaccgatccatcccaaacgaaaccaattgtataaacacacacacaaagttgctaatatatgaccatccaataacttggcaatgccaaaaaatgttagcaaatttgacttaatttgttttttttttcaacctgtagaaattgaattttaatttgcatgtttgtgaagtgatatgtcatatattaatttatcttgtttatttttttcaattttttataacaatttgcaaacaacgatgaaatgttagtttttttttttgagagcgatgaaatgttagtttatattataatccactcctaggaagaaaagatgcatgttcactgactgtagggctatcataatttttatttatttattggttgaagtgtcacgttttaattaaaaaaaatcaggtatagtactgctgtgggatctcgtcgtacgctggcaataaatacttttacttattcatcatgtgacatatctaagagcaggtacaatagcagactataagccagttataaacatattttaaagagataaaggaagagagagaagagcagcgggctacagatttgtagccagctgcagcacggactccaagacgtaatgtaagtatgacagatgggaccagatattaatagtatagtaagcaaatattgtatgaattggctattacgttggctatagatgatttggagctagtagtgggctatactattaaacttgctgtaatgatgcaaaatatagtttaacaaatgcttttattaatcattcatcatgtgacatatctaaggattcattcataatcaacggaatgaggtcgatccgacggctccgatcgatatcaaatcgcacacctccctcctccccaccagtatcgtgcaaaacacgtccccatccaactcgcggcgcagatcgcgcactctctccctctcgatcagatcgcgcgaagcattatccgagggctatctgccttgaaggccgggaggatttggagggttggcaatgggagcagtatagatatatgggaggatccttggatccctgctggagtcacccgaagaccgataactcctcgaagaggcactgtgctgaacaaggtagctgatcttattgacccagctacgggctggtgggataaaccactagtggaggagattttttgggagtctgatgccaggaacattctggccatcccggtgagattagacacaaatgattttgtagcctggcattttgatacaagaggaatgtactcggtcaaatctgcgtaccatgtcctggaagatcaaagggagagatcggcgaagaagcaagagggcggttcatcctctggagcggtgaaccagcggaatttcgagtgggataaaatctggagtttgcaatgcattcctaaagtcaaacagtttatctggcggcttgcccataacagcctccccctgaaactcaacatcaaaaggagagtaccagacgctgaaactctatgcccggtctgcaaaaggtttgatgagaatggtggacactgcttcctgcaatgcaagcccatgaaactctgctggagaattttatgccttgaagatatccgtttaagcttgactcagcttgtttctgctagagatgtggttcagaccattttgaagctggagaatgatcgaagaatggaggtcttctttcttttgtgggtttggtggtatgcacgcaacaaggtgaactcgggggaggacgtaatcagagtggaagaagtggtccacaaggtgaaacagctgatctgtgatcatgcctctctgcgcaaaggaaaacatcccaaggtgaatgtgcaaagaaataagtgggttccccctgtagatggtaatctgaagctcaactttgatggagccttccgagctgtaaacaagtctggtggttatgatttcctggttcgtgaccaccgtggatgtgctgttcttgcgggtgccggctgcctggaacatgtacatgatgcttttgcagctgaagctgaagctggtttagcaggcctaaaatctgctatttcgcatggtattaactctgtccaggtggaaactgattcaccatcctagtgagagcctttcactctcatgagtacgctctctctccttgcagttctatcgtaagggagatcaaggatctcgtccatttaaatttttctagtgttgtgtttaattatgccccgtgatcatgtaatgtggctgcgcataagttagctcaaatgggtgtgtgctgggaattgggtcaagcaagtgtgtgggctgacctgtccctgacattgtacaaactattgtggatcgtggtatcactgatcctagtatttaataaagcgcgccggtttaactcaaaaaaaaaaagatcgcgctcgctcctcctctctcagatcgcgcctcgcgctccgccgctgcatctccgacgattgtcgcctcaaccggcatcacccgccgccgccgatccggtttcccgccctcctccaggtcgcgcacctcgcgctcgacctccgccgcgccacctctccgacgaggcgacgactgcctagtgcctaccgccgccgcgtcaaccggcatcgccgatccggtctccctccgctgtccctccgccgctgaagtctcctcagactccgcctcgccgatcccctcctccgctgcatgcctgcatgtcgcttgaccatcccgcggggcctactcgcccgcgagctcctccccgctgccatcggacctgcgcggactcccacgaccaccacggtgtgagatgacgccgctggcggcgattgtgttggccggtttctaggagctctttgattcagtccgccgctctccatcttttcccgtcccaggggcagcactgcagtattcctcgacgagcaggttctgcttcgagcgtagagcttccggtgggggttcaggggtggattagcatgtgccttcatgagtcgggatgtcagacggtaggaatggagcaggaggagaggagaacctgctgatccagtggagagatagcaatctcatcgggaacagcgtgctgagcaggtatacctagcatggacctcgattcctacaaggggcttcaagtttcgagcaataggcaattctgattggatcggtcttctgctttccttttggtgcaggctttgatcagaaccagcaatgccacagaggagaagacccaagtgagtacgtttggtcagtttcttgtttgtctttattttcctcaccaactgcgcaactgtaaatcttaatgctcttaattatttgatcccactcttaagtgtttttcatcggaaacttttgattagtgacacataagggagcttaaggatgaagtgaagctactcaagaacctctcacattccaaaatgctgtgagtacatactagataactacatatggtttgtttttcaattcgatgatggtgtttgatttatctggtatgctttgaacaatgatatattggaacagtatgggaggagaactcactaaatattctggtggagtttatgctaggaagatcaatacaatcattccttgggagggttgggccattccatgaggctgtaagtgctaactgttatatatgagcgtcctcttttgatgtgtttacaactaaagaggttttttaactgaatgtatttgtttatcaggtcatcaggaaatacgctaaacatattttgcatggtcaggagtatgtacaccgcaatggaatcgtacacatggataaaaaggcaagcagagtatttgaattttgttgaccctgaacgattttgttgcatgggctagaaagtttatatgtgagattactgtttttttaacttttcagggagcattctactgataaaaaggaaatgcaagacaagtgactgcagtgcttgcaagatgaatcatcatcataattgggtagttgctattcgggttgttgaactgctagacgaaatcaattgtagttgtagtgccatggtagtaatcagcaatcaaactccttgccatgattaatcaggtatgtcattttttgctagagaataatgctaaacaacattaccttatttactaattatctgctagatgtctacggttgaaattttctcttgagcatgattctaaaaagttagttgagttgttcagttacaattgatgatttagcactgtctggaactattttttggtaccaacttatgtgctttacgtgaatagtattggtctttcaaggttgatatggtagtgcattactgttgtgaaacgagaagcttatatatcctgtgcatcttcagtgatttctgagtatttaatcctagaagattgcatatttgcattacattagtttccaaatttctaaagtattaaattatcctgttgatgctggttgcctgagtaaggagattgatgcagattgttaagttcataatatattagagatcgtatatggctgcatatgaaattatgtatttgtgttcaaatgccaatgtcaggtaaaatctgaatgcatatatttttttctatataccttagtttagtagctcagatggtaagatttaaaaaaacctaacaactgtcagcaccgctacttgtaatagatttctttcatgctgtatggtggatttgattttgtaattttaaccattaaaggaacctccttttactgtgggtgggacggacctgtcagcggggtgctgttggtgatgacggggtgctctgaattgatggagctatgcggattaatttagctttaccactgttaagttgcttgcagttctggttctgaacagctttgtgtctactctctcctacagaccacagtttgatagcaccaccattactatatatgttgagactgtgagcatgcacagctctgaagccttttgtagttttgtatgacaaggatcaggagttcaggatgcaagtccaccatatggattgaatttggtggccatgtattttctgtgtcctgcaaaggacgttgctgttttttttacggctgctatgttgctaccttttcagagaaggtattgcaatctatattcgcaagtctttatcagttcacaggtatgttcttatcctatcgtccgacaaatattgttctttcatctttcatattcatgatgaaacatcttttaattgagccacagtgagattgatgtaaactatcagcatacaattaaatgtagtgcatggagtttcagaccaacatattctaacaaggaatactttaattgaaggttcatgttagacctcatagctctctctcatctgtgctattctaaaatgaaaggaaacgatgtggtttatgttctttcttgttagacttcatagctctttctcatttgggctatgatggaattgcaaaattgtggatgcaaagttgattaattgggttattcaaacttcaatctttttttttttgccattggtaaatggcatgcatcatgcccaccaattaattattagttgagctattgatttttactgtaagtacagaaaaggatggccaatttacatacatttttctcaaataataattaagaattgttcggtgttgtgcaaatagactcaaaataataattggaattgtgttcatttgtgccatgtggtgctattgcatctcttatttctctaccatgagtgaatagatgatatggctcttgttgattggaaatagaggatgaattttgctttgaagatctgttctttatgaacacctaaaattctgtaaacagtgcttgtggtgcatcattctaaaatgaaaggaaacgatcgtttcgaagatggtgactgtagtgctaatattactcctagatctatggaatttatgttcattatgtgttccattagcggatttattggtagtcctaattgctcgtttatttcaccaacttgatgtggtaatatgttctattatcatcgagagatggatttaatattgcacttgagtctccagtagagaaaacgaatggtgagtatgagcagaaatattatttctgcacatgactttgaagtccatgccacttccatttacatgactgtatcagtttctgtaacttgcaagaatcaaactggagaaggaaaaacaggagaaagatggagcaactgcaaatttgtgcagtactacgactatatatggatttgctgtgtttttttttttgtgatgtatgttgtaattgatattgtgaaatatttgttgactgtttgtataagaaatcaataatacatgtgcatgtattaattgtgttttagcgtttcagatcgcagcgtgatgagttgttaacaaccatcttgtttattctgaaattgaaaggaaaaatatgaagtagtagagaaaaaaaatgtacgtctcattttcttcttaatcagtttttgctatcgttaattaattatataataaggaaaaatatgtagaaactaagaataaaatatcgtcgtagcgttagcactcgtatctcatatttataagttaaagagaccagctatacgcgatattacaattcaaggacataattttaatggggaaattggttccataccatctaaagttaataaaacgagggacctacaatgggatccgatccgatataaggagtcaaattgaacttttttttttatcctttttccgccgaggcgaaccatcccgatttgcgatccgatttctcctttcaatcgagggttgcccgccacgtagcagtgcggtctctctcccttatcgcttcgcccttccttttccgctctctttcaccgtccccgccgcgtccatcgtgagaagacctaaccctagtcatccaccaactcgatcggagaggagatcggagaggagaggaggtgcggtgatcccgacttcactcggtccaggccttaaatccaaggcaatcgagagaagagatccgcggatgaaggaataaggaaaccgatctcgatttggttcgtcatggacttggagtgggttgcggaaaggggaggggaggggggcctcctcgtttaagaggaagaggaagaggaggacgaggacgaggagtaagttacttgctgccgccgagtcaaggccgagccgaagacggcgaggaggttttgtttggagcttttccgtggcgggaggggagggattcccgacgcaaccgtcaaaaatcttccacccaacactctccaaaggatccaacgggctcgagtggagagattctgcaggacgagcaccgcatagaggagaaggcggagatggcttctagtggagagaagctgcagaagcaccggccagaggagatagctcttagaacgggctcgagtggtcagacaacgcagaagctccgagagaaggcagccactgagaatcaccgtccaaaggagattggcccaagtggagagaagccgccgcataagctcctccgggcaaaggggaaggcgggcacgagctcaattggagtaacgctacagaagcaccgggcagagaaggcggactcaagtcgagggataccgcacaagctccaggcaccggccggcacaagctctattggagtaatgccacagaagtaccaggcaaagcagcagatgggtacctctcggcttggacgccatccaccatgtatccaagtccaaggaggagtaagcaacagagaggcacaagcggccactaccaaccggcagaagcacaccaaaagtaacaattcattatcgacgagggccactacaaagctcagatcagcaacaaacaccccatgtcaaaagcccaccactgccccttcctccaatggcaacactgctcctcccaaggatcgtaaagaacctgctacaaacgctgagaataatgctgttcctgtcgcagagaacaatgatttgcaagaagcggatgaggcaatcaaaaggctgaatgaattgggcttgggagagaatatcagctctgaggagttccttacatacattgaccagctgaatgaacaacctaaaatcgatacttccattgaactggacgatgcacaggtcactaccctctattttcagcatgcgcgctatcgcgtcagatactataaggtcggttcaatttccatcactgctgctaaataaatactaattaatcatcacccaacacatgcatgttttgtactatgtttcctatgtgaatattagatcaacaatcattgctttaatgtttatgtctgtctaatttcagcacttgtcacaacaacctaatactgagttggtagaggattcttaccacatgaaacttgttggggaagatgaactctccgatgagtttattcgcgagatggaattttttatgcgtttcgaggaagatggcacatttgattggtatttctaccctgattactgctggcttgctgctctgaacgactaccaacgtctagtaccgataaactgtgtacgtattacattatattaatgcatgaatagtccttcaattcttcagttgtgtcttggtgttctattttgtcagttgtttttgcaccatcacacataacaagtgtacagatcgtaaatctgatgaccacttagttagaatttgaaatcatcatatatacaaaatgaagatgtctggttggaaaatctacatggcattcaaaaggttaaaaagatgtgtttatttgtttaataatccagcttttatactgctttactattagttttgtggatgctttcatgctatatctactgaattatcgctgcgtaagacaagcatttgctttgttgttttatcagcctctacaagaaactggtcatttttttctaattcaaaaccagagccaacccaattcatgttatttctgtttcttgatactctaggtgctcggtaccttttttctttcttcttccctttatggaacagtttctggcatttctgtaaagagtgctactctgtaattctcctttaaaagaacaaagtgaacaaatctgcatccctttctgtatgaatactagctagtaacttttttgctgcttatttacttgtatattttttagcttgaagctcttagttattgaagtcatcgaattgtttcttcaaaactctaaatcgcgagtttcctcttaccctccttttcaacataggttggtgaggagtacgcttattgggacgactaccgcggctattttaatagctatcatactgaattgcaatatctcgacttctgcaaggcattgtcgaaggaacttaaggtgtgtatcataaaattgaacaaaccaataacattttgtacagcgctttgcattcttctgggattaaaaacgctttttatcttgagacagtggatggaagactatgtcctgaataaactgccatcttctaaggtaaacaagctcaccatacaaaaatgattgaatgagcagtgttatatgttgtagtactataataactctgctgtacagtggggaagaatatgcagcagaggagcctaccaagcaattaagattgccacccgcttttccaagatcactgctgctttggcctataatgcctactatgtacgatccctcacacacactaattatttttaatagaaaaaaggtggtttgtatttagtaacaattccattcctttcaggattgtttacagcacatgcgcttttatgttgcttattgcaaggacatggatagcttgtactttgagatttggcagcgggtcaacatgcaaaaagttagtacttaacattgttatccaggttcctgcctatgtttatgttgtgtatgtttgtttagtaatgcatgcctttttctcaacaatgttcagaagagtttcagagattctttggaggaagtctacaacctcaacaagttcccttcacggcaagataaaatgaaggatgcattggagaataactgttcccacatggaaactgtggtaggttatttttcatggatgatctgagaatttaatgtggtttccaaatttttaattgtgctttaattttattatctattgtcatatcttttcagtttcatgtttgcacggcaagtgttaccagtgaagtaagtactgtatttgtctaatattagttgaatacgtggaatgtgatcttaatgttgatcatgtctgtgtgccttagattgcggaggataaagctctggagctgattgcaaaggcagttgaaagtcgggtactgtacttgtatggaattccattttgttagatggcacctatttctatggaacttcatcatacatgttttggcttatagcatactgaattgaaaaattcctctgcattcaaaaaagaaaaattgtacggaacttcatcatacatgctttggcttatagcatactgaattgaaattcctctacattcaaaaaggaaaatttgtgtggaagttcattgtacatgctttggcttatagaatactgaattgaaattcctctacatttagaaaagaaaaagaataatgaagtgaaatttattttcttctttttttttcagatgaacaaagcaaaattctacgagcagtatatcgaaaagaagatagatattgcccaagctattggattgatttccacggtattgtcttattgctgttgacaattgcacatgagccatgttttctcactgtgaataaccaaattagcttccttcaactaactgtcatttaaaatttacatttgcaggatgggactgaagcaacatgatgtgcttaacttatagtgtttttttttgggagggcttagcttacctttctttttatatcagtatcagtagatgtcgatgccccgccagcgcctgcagaaataaagatcccgaaccaatgtttttttagctgttatgattaattcggtttccaggctccggcccgatcgaaagcattgtaattgataatgttatgtgcgatacatttagcgtacgttgcaatcgtgcctcggagtgattcgacttgctgattcggaagatgaagtttttttttttgcatgaaattgggctatccaattagcttgttgtttgctttgtggtcgacatggatgaatgtgattgtatatagaggctcacaaccgtgtctttgtgctaactgccctagctagattatgcaagttgatatcagcaatttgctgctttataggacactgagaacaaaatacatctacaggagagttttttttttctttgaagtttggtcaagttttttcagttcttttttttctattaatcctgataagttgagacttcctttgaaattgaggaattgcatataagatctctgtaagaactgaactagctctgtgagaagtgttataaaattcttcgttccaaatgagtgctgggctccatatatatatcataaaatttgatgatttgacactttatatgttgccaatttgattgtatttacactcgtgaggatgacatgtgggattatgcgagtctatcacaatggctcaaatagtcagatttttcaatttttatgtttggctcctgataagtcagttgaggcttccttctaaatgaaaggaatttataattctttgtaagaattgaactaattttgaggaagatgttgtaaaaggaggccatagtttcgcttattaatggaataagcgaaacggtatatttataaacgaaaaataatttataaacaaaacttttatatacatgttcttagcaatctaaaagcaaaggctcgaaaataaattacgatgaaaaacccttacaatcaactctttttcaaaattcaaaattagcttataagcataagccaaattgttttgtttcaaatgagcgctgggctctaaaatctgcggtgtggtcagttgagctcatcatctcctccatcctgaggcggcggcgcaacgacgacgacgacgacgatggcgctgctccgcgcgcaccacctcctcctgatgaggccgcgcgccgccttctcctctcgccctccccctctctcatcctccccgtgccgccgcgcccttcccaccaccgccatcgcctcgcgcctcctctgctcccaccacgcctcgtcgccgcccgaagatgcctccgcctccgcctcgccctctatcgtcgccgacctgctcgactacctcaacgagtcatggacgcagttccacgccaccggtgagcgcccccaccacgctttgccgcttcgcatgcatggatgccctcaacctgttcggtcctattcctcaccgggaaggacgcgagtggctgctttgtctctggcatttctgcatgtcctggactgctcgagtgcattgacctttgtgtttaggcatcggtacagcccccccccccccccccccccacatgtgctgtgtttgcttatgctttcagcggaggcgaagaggcagctgcttgatgcgggcttcacgctgctcagtgagaacgacgactgggacctgcagcctggtggccgctacttcttcacgcgcaacatgtcctgcttgattgcctttgcagtaggggaaaagtaagtcagcgacattggcttctgattatttaacttatcactaagaatctgcaacgaatgtggtgttcaaataccatttgaaagtcaatgcctttgatttaggtacttaaacttgctcaaaaggaacctctagtgtaaaacatggccaaagtatttaactgattgagatatttaagctagtggaagaggcaatcaatactatgaaaaattcctatgtatgtacggcagtcagcagggtacacactccagtaccttctcaaaaatgtttttgcctcttcacttcgttgcattcctttcaatttttgaagatatttaaaatctctccttgatatccatggcatcacactgataaatgatatatgcgtaagtgccaaaagtttcaaagaaaaaaaattatgataccgctctttctactccctagttgtaaatggatatttgaagtaaaattattttttggacgcaggtacaaattgggaaatgggttcaatataattgcggctcacaccgatagcccatgtctcaagctgaaaccaaggtctgcctcctttaaatctgggcatcaaatggtaaatgtacagacatacggaggtgggctgtggcatacatggtttgacagggacctgactttggctgggagagttatcctcaaggatgctgatggctcatttaagcatgagcttgtcaaagtgagcagaccattgatacgtgtaccaacgctggctatacatcttgaccggttatttctcattccttcttttactgatctattttctgagaactaggtggaatctatctggtagtatgttctgtattgctaagcaaatattgctagatgttctctctttcagtactgcatcatcatgtaaccctgtcaagttatagcagcttagtcttctttgaactactatttatatctatctcagtgtttgga

SEQ ID NO: 38502 - DNA, 6149 bp, Oryza sativa
attttatattctgagcacttgctctatcatttaatcagaggtgtactttcaaagtactacagatggcttcaagttgaacttatagcatttgattttctcgctctgctccacaggttctttcagatgaaattggttgcaaatcaggtgaaataattggcatagagttgaatgtgtgtgatacccaacctagctgccttggagggggaaataatgagttcatttattctggtagactcgataatctcgcttcgtgttattgtgctcttagatctctcatggactcctccaagatgccagaagaattgtcaaatgagaaggctataagaatgattgctttatttgataatgaagaggtatgctatatctaatgaagtctcacctgattgctaaaagtatcatgattgataaaagcacatcaatgcgtgctcaagatttccattcccgtttggagtctgttttgatttgtaggcttagagtggctttagatgagaagtagtgctgctaacttatttactgcttgtcttcacttaaattatctctggtcactagtatttgataaaactgatttttttggtagaactatctacacggtattgtttcggtttatttcttgtacttggtcccttcttgttcatattataacctcgactctattcaggtgggttcgaattcgatgcaaggggcgggtgcaccaaccatgttccatgctatgagacggattgtcgattccctgatgcatcaatctatgggagagggtgctttggaacgtgcaataaattcctctttccttggtaatatttatgtatctgggagatcatcaccggcctatagtcctagactaaatagtgcacaaatttaattcttgtttcactttcagtttcggcagacatggctcatgccctgcacccaaattatccagacaagcatgaagagcaccacagaccagagctacagaaaggactagttatcaagcacaatgctaaccaacgttatgctactagtgctgtgacagcttttctgttcaaagaaatagcaagacttcataatcttcctgttcaggtattcaatattttacattttaaccctcaataccatctttttttattgcaaattcccattatgtttgaacaaataagtgtgcttcaagatggataagaatcaaatcatcgtctatctctatcattatcatctattgctagttatattatttctgataggaaatgttaaattcaagaaaaacaaaatcagcatgtgtcatctagaagtctttacttttgtaaagctgatttgtctttagaatacatgaatgagtttgaggaattgcactgatgtatatagcttataggaatttgttgtaaggaatgatatgggctgtggttcaactattggccccatacttgcttctggtgttggcatacggactgttgactgtggtattcctcagctctcaatgcacaggtatgcacagttggctttatccctttttttgacaaattgacccttttcaaaaacttatttcgaaactaacccctgacaaaaacttcaaccaaaaataggtcgtttgctcagcgccaagcgcattggcgctgaggttgggcgtgtcagcgccaacggtcgtggcgctgacatcgtgtcaccgtggcggccgggccgatcccccagctgacgtggcagctatctcagcgccgaccgctttggcgctgagatggccaatctcagcgccatccgcttcggcgctgaggtgggacttagccttttcggccgagtcccgacctagcaggccgtctgtctggctggcgggggggggggggtacctcagcgccagaagaaatggcgccgagactaggcacatcagcaccacgtaccctggcgctgagatgggacttagcaagcttggccatggcttagcccagcaagccttctggatggcttgcgggctgggacgtcagcgccagccataatggcgctggccctgggcacatcagcgccagggcacctggcgctgaggttggacttagccggctcggccatggcccagcccagcaagccttctggatggcttgcgggctgggacgtcagcgccagccataatggcgctggccctgggcacatcagcgccagggcgctgaggttggacttagccggctcagccatggcccagcccagcaagccttctggatggcttgcgggctgggatgtcagcactagccataatggcgctggccctgggcacctggacttacccggctcggccatggcccagcccagcaaaccttctggatggcttgtgggctgggatgtcagcgccagccataatggcgctagccctgggcacctcagcaccaaggcacctggcgctgaggttggacttagacggctcggccatggcccagcccagcaagccttctggatggttgggctgggagctcagcgccaaggcatttggcgcgggcctggagtatgtcagcgccattttgcttggcgctgaggttccagacctgctgtaataagcagcacagctctctgcccagtcctgcttaacacaaccacacatccaggcaataatttattcacatcacaggcagtattcaatcccgacgaaatccccttcgatttgagtggatttgggggagatttggtgaggggagaagagagggcgacgaaccctagcgcgcggggtggggaagaatggaggagaggctggctgggggcggcctcggccggcctctaagtaccaaaactcagcgccaggcccattggcgctgagattggccatcttagcactgtcggcgctgaggtagctgccacgtcagctaggggatcggcccggccgccacggtggcacgaggtcagcgccacgcccgttggcgttgacacgcccaacctcagcgccaatgcgcttggcgctgagcgaacggcctatttttggttgaagcttttggcaggggttaatttcgaaataagtttttgaaaagggtcaatttgtcaaaaaaacggtggctttatgaccatcctttttcgtatttctgaattagcagtaactgcatgtagacagtacttccaatcgttttgcaattcatattgagcaagttgactcctagctatatagggaataagaggtcagtttttttcttacatgtatcatccttgtcaaaataggtatttaattaaattgataacataggtaagaaaaatgtatgcttagatttcacttataccttccccatcgttgttctggccgtgggtgacgcattactgaacgtttaactgctattgtattggtttgcagcgtgcgagaaatgtgtggcaaagaagacgtagatacaacatacaagcacttcaaagctttcttcgagatgttctctgatattgaccggaaactcaacgtagactaacttttagatcttatcagttcctcatgttcagtatttgaatttttttttcctggatcagaataatgaccgtatatcagagtatcagttttttcttgtcccaacatcccaatctaattctacgcatgaccaagaggggtgaaatcattttacatgtaaatatggtgacacatcgccaagctcacttttgagaagatggccttacacatatcatactcagttactcaggcctgaatggcaagttgagattgtaatgcttatattgaaattccatccaaccacagccggatcaacaaatgaaataaatggccatccaaaattgtttcgccaagatcacatcggtaaattccaacattctacaggtgttccagaatctcgccacaaaataacgtgcatacgttctcctacatacagagtgcaactgacctttcattatatatgaagaaattgacggtgcaaccagattggatatttgagtgttgcattacaaagttgatgccaacacaattttcatcacccagtgacccttcgccaaaaatgtcgcaacaaaatctaacccaccggagctcagcttagctcaccttagtgtagtttatggcgtttcttgccccatgtatatgggaatcttgggatgcaccgccgctgcatccctagttgagaaatacatcagcagaatgcaaaatacaatatgcctcctctgctcaggaacgacacctcaagctacatggcgatcaatttctatcctttcttttaccggttaaggagccaccattatgttctgctcgcctctgctcacatccatgagatgcctcggtgggagatacatcctggacaaccccgtttgctgcaggagcttcatggggatgtttgcagtgccctgtcctatcaatacaaagccaaatcctagctctgtcatcaccagatttctcctccataggcacatgccaagatcccatctccgattcctacgatgaagattacatcagaaacaacagatagcaagctctaaagatgcctgtagcccagttacttacctgaatctccgaagaatatggaggtggcatcataagcaccgcctttcctttactaaaggtgtacttgacctaaacaattggaatgagaaacaaaatcaacaattaagcaggaatggtaatatccaatacgtgaagcagtatcactatgttacaacaggataaaggacccagcatctgtttacatggttttaagtttaacctggcactcaaccttttctaaatcagggttctgtggtaataaattatgcagaaagaatggccagtatgttaaataaaaagaagtgcagagcacacctgatgccgttgcttccacttggggaaaaaagatgaccccaagagctcaaatatgtgatctctcatttcatcattagtcacaagcaaacaattcaacctaatcgccgcatacagccaatacctgaaaaagtgcatatcgtactgttagtaacatcgatgaaatgaaacacaagtgcatcaaaccggagactgatgggtgaaatatccaacctattacctaattgcacatattaatcaatgaatgcacaaatacaatataaggtaccccaaaaaaaaatgcaagtgcacccaagactagagactgaagagcattaccagtcatcatttgacccaattggtgaagtgtacaatgccccgttcgctctccaggtttcaatcaggtgtctattagatgcattttccataagcttggcaatgcgtttattatgtaatacgacaagtggccatttaccattatatctatcccgtagctctgttacaacagcgtccagctgctctatattaaggatgacagataggaaaagcattagtaccacattacttcactgataacattgataggtcaaagtacattgaaagatggagttcagacctgagtcaaactaaagccaccctctgcaaaattttgttgataaagtgcaatatttgcaccatcaactatagcttcatatgctccatgttcttccaaccactcctataaagtcatagcactcaaacttgtaaggaagaaaaaacatgtgttccaaatttataaatggattatcacctagaggcagtgttctaaaagtcggctctaggcgccgcctaggcactgggtagcagccacaattaggcattagatgctgcattaggcggctgaactaacttgggtggtgctttattgctattttagggttacatagtataatttgtatgcaatatgccagctaatttcttggatttcttgtatgcgaactgcctaggcgctagaggcacgcgaagaaaaaataagtatctgaatcatattctgacttgcatcgagaaacacatgcatgaggtatcttacgttcttaggaaggtaaattcaatgcttaactcataagggaagttccaaataatgatttatctaaacatagaacaagttacctgggcaaggaactactgagcagacattgctcaaatacacagcagcatttaaatctctaaaaggggtgaaacccaatatagataaatcagctgagcactattaggttaggccacaatgaagcatcaaatggttttttgaacaaagcagggagacagaccgatgggcttacatctctgactacaatttttctatgttgttatgatcactgagcccacaaggccatgttagattgaatagaccaagcaaaacgagtgatcttcctatcacacttaatagtaaatcaattgcagtcagtaaaatcaa

SEQ ID NO: 38503 - DNA, 21959 bp, Oryza sativa
ccgccttaccgctccgaaaccaaccctccagcacctccgcagtctcctcgccgacacaatccacggtgcggctcagcttgtgcatatactcatacaccttgtctgcgtcccctgccttggcgctgacatcaaggagcgcggcgatctcgggctcctcgggggcaacagcagaggcctccatgtgggcatcgacggcgtaggccttcccggcctcccccgcgcggcggaacgcggcgagcacggggctgtacgagcggaggcgcggggcgacgccgtacttgtccctcatggtggccacgaggtcgaaggcctcgtcagcggccgcggggttggaggcatcggaggcggtgacgcgggcgagcgaggtgatggtggcctcggagggggaggccccggagccgagcatgtgggagaagacgcggcgggcggcggcggcggcgttggggagcgagtcggcgtcggcggtggcgaggaggtggaagagctggttgtactggtgggcgaggaggcgcggggcgtcggggccggagagggcggagtcgaaggcggccatggcggcggcggcgtcgccacggcgggtgcagtcggtgagggtgcgggagaggtccgagttggggcccttggagccacggcgcgggcggcggcgcgccggggaggaggcgccggcggcggtggccatgggtggggccgtgtgggtggtggtggggtggagtagtggaggaggaagaagaaccctaattagcgaggtgggtttggaggtggttagcggccataggcccataggccgcgttagcccatgcctcatcgtcacctcacctctagctccttcgccgcgcgacagcgggagaagggaaagcttcgcgaagacgcggaagccgtcgattcgagagatgggagccgtggatgtaaggatcgacggtccgtaccaagatgaacgaaaatcggagtcctttccatctataagcaaaatatggaaatacaaaaactctatatcacaatcttcttttactagatttttggaatttatattgtcgatgttttcttttagttgatttgtatggactccaaccatggggaggcaacactatgagtcgactagctcgttatcactttggttaaagttcgttatttgtaaggagtagaatgatggattagtgttttccaagctttcaaatggtgcggttttttttaaaaaaacttgtatgcacataaatttcttgaaatatagtttcaaatacattttcaacttgcgagagttaatttgttcgtttgtacatctcaataattatcacaaaccatttactctccattcatttcatatcataagtcgctttcacttttttttttcaaatttttccaagtttgatcaaatttgtagaaaaatataacgatatttctaactcaaaacaaacatattatcaaaatatattcaatgttatatttaatgaaactaatttggttttacatatgttactaatttttatataaatttagctaagtctaagtagtttgactagaaaaaaataaaagtaacttataatatgaaactaggagagtacctatttaggctttagccattcaatacaaaaggacaaagaacggatggattacatttgacacaatttcttttgttttcattgtttggcgctagagaatcgaacacaacagaaaatagtgaacatatgctccagtataattgtgtgttatttcatctttaacataaaattgcataaaatttgtgtgctctcagatatcaaataacatatcacgttggtgatctgtatatgtgtagcccctgaacttaaaaacaaattaacttattccggtgtttagctctattgctgtttaagaaattaatagatcagagctcccagcgatgaaggtcgttgaagcaagcttagttggccctgccagtgaccatggagatgccggcgcggcggccgaacctggcgacggcgcagtcggtggagaagatgtcagagacgacgtagctgggcgcgccgcccatgaccggcatgctggcgctgacgctgagcttgttgacgtagtcggagcggtaggtctggccgagcacgccatggacatcgtcggagaggtcgtagaacttgaagccgatgtcgaggtgagcgaggctgtcctcctcggtgacgccatagttgtggatgcgggagtcctgctcggtgatgggcaccacgttggccatgatgtcgaacacgccggcgagctgcaccctcacgccgttggtggcggcggtcctggtgacggtgaggcctggaacggcggcggactcccagcgcgcgccgagctcggctgggacgtcgacgggcgcgccgtcgaaggcgagctcgaggcggtcgacgtcgctgttccacttggcggtcttaagggcgcccatgtagaggcggtggtcggcgaagcggatgccgagggcctggatccaggtgaagtcacggctcatggtggggttgcgcttgccgatgaagtgggcgttgatgtgcaggtcggcgtcggagacgatgcagaagtcgtggtccttcttgccgtggaagtagaagttgttgccgtcgccgccggtgaaccgcgggtcgccgcacgacacgccggggtagaagtcgcacactttgaaaaaatcaaataatttcacacagagaatcacacacgatgtcacgatcgatcagtagttcaaatgaattgcaactagctagtgatgcttactgcagaaggtcttgcagccgggacacatgacgatgcactggttggggcagcgcttgtcgcacttggccatgcagacggccttgttgccattggagtcggtgcaggagagctgctggtccctcttgccgaacctgccggggttgatgacgtggtagttgcttggcagcctcggcgacgacggcgcctgcgcggcggcgcacaccaccaccaacagggcagccgccgcagcaaccaccgcggcgccccgtgccatcgatcgctacctcgttggctagctaagcttcagaaatcgatcgatcaaacgaggaggtagctaggatgagatgaggaggacatggggaggcgccaatttataggcagcggagcggagcgcgggcgcgatggattggggttggatctgaagccggtgcggcgcgcgcgtggtggtgaagcgatgcatatgcatgcgttgggtaagggttgcctagcttggcgacgcacgcattatgcacatgtccatgcatggggagtggattttcataactcgaggggaaggataaccctcaactaactaaatagttatgaaaaaaaattaaaaagatatattaacatgtaatatatcactccacaaacatgcaagtttaaattcaatttctacacctcgcaacgaaaaaaacaaattaaactacaactagttaacgcatattcacagtcaaatttgtttttttcattgcgaggtgtagaagtagaatttgaatttgcatatttgtaaagtgatatatcacatattaatacatattctcaaattcttttattttttttcataaccatttgagtgacatgcaaataacgagggaatattccctcaagggatgaaaatgatgaaaatagttttcctacatgcatgcaccaatgcaaaaaaaaaaaaagattatttcttttgttttgctgtacacacgtacaagggcacagtacggtgcatggtgtgcgttgagtggcatctatctcgatcggttagaggctgcgatgcacgtaaagcggctagctactagcagcatcgcttcaaatgcttgcatctgcatgcgtggtaacctatattattgttctgcacatcacaacacgttacaagcatgcagctgccacctgatgatcgatcgatcgaggacctccctgcgatgctactcgatcgatcatacacccttctctgctgttgtgcaccacacgctacaccgaatcaaacgtacgtactccctcctttcttaaatatttaacgccgttgatttttttaaatatatttaaccgttcgtcttattcaaaaacttttgtgaaatatgtaaaactatatgtatacataaaagtatatttaataatgaatcgaaaagaaataataattacttaaattttttgaacgaacggtcaaatatttttaaaaaagtcaacggtgtcaaatatttttgagatggagggagtatcacattaaaaaaatcaattattgattcactgtagcagcaccgcgaacgcatggggtatccggccatccaacggcagagcatgctcgttgaccgtcggatcgatcggcactcggcaaatacatggatcagatcgatttataccatgtcctgcaacaaggagactttgcacaaacttcgatctaatattggtcgacgacgtacgactaaatcctctcatcagcatcagaccccttctctctaataatcttcacatagcccaatttgttttatctactctcgtcaatccatactttgcaaatgagcactactacaaaactcttacaaacaaagctatcaaccaattgaatttattttcgagaatcaaccattcaaattaattagatactccatccttttcacttataagtcattttgatattttaagtcaaacttcatgaaagtttaaccaagtttgtatgaaaacatatataataacacaaattagtttcattacatataacattgaacatattttgataattttttttttgaaaatattgctatattttttctataaatctagtcagatataaaataagtttgacttagaaaaaaatcaaacaacttataatatgaaatggagatggtagtagttaataggaatctagattcaatcacaacataccacattagtgttactaaaagttttatatgcatagactttcctttgtgcatcctatattatcattggaattctcaaaattaaaaataatacttatatacttaattcactggttaatattactttttcgagttataatggaatagattaaaatagaccaagtgtatcacagtttgttggttggtctagttaactaaacataattcatgctatatatcgaatatatcatacataactacgtgggtcggtcaattggggaaatgagttaagccaggcttaaacaaggtcaaacttactagcataacgtctacttcggcacctatttttttagatataggatttaaaactcggtatttacatcaataaggatatacacaacaggtaaaaaaaatcactgaataggcaattagtttgaaaaaaaaggagaagcagtagcaagagcaacgccttcccttggcggtttggtggtttgtaggagtagcatgttaggagatatgaagagtaggcttaacggtaatgtgagcatgcttagtgctttcggcaaaacagctctatggcctgtccacgtcagcaaaatcagggaagcagaaccaattactgtgtgattttatctggtattgcattggtagatgagggtgttcaataaccattttttaagtttttttataatggattaaaccggcctctacatccaaatggatgtacacagccaagccttttttaagttaagggattttttaagttaaggcatggttgatcatccttagtgagtctcgctcctcatggtgaaccctacgacatagatcggtgtgcatgggttgatggctaagttatatgtagggtgcaaatataattttctatttcatacataagtaaatagaacaatatatgtatggcaaaaatataatgatccatgataattaacatattcaatcatcgtcactatattcattcaatatttagtttgacgaaataattattgaacaataacaatgatggttgtacacccatcatttgtgggaggggtgaagagattatatcatccttgtgtcaatttgatcatctttggtgatcgatcttcctgttaaaattattcccggctctcatgatagcttggccaaacatcagaatgcagacggcacacgcaccctttgtcgaaggcaacactctttaactggccctggcggtgaccatggagatgctggcgcggcggccgaacctggcgacggcgcagtcggtggagaagatgtcggaggcgacgtagctcggcgcgccgtccatgaccggcatgctggcgctgacgctgagcttgttgacgtagtcggagcggtaggtctggccgagcacgccgtggacgtcgtcggagaggtcgtagaacttgaagccgatgtcgaggtgagcgaggctgtcctcctcggtgacgccatagttgtggatgcgggagtcctgctcggtgatgggcaccacgttggccatgatgtcgaacacgccggcgagctgcaccctcacgccgttggtggcggcggtcctggtgacggtgaggcctggaacggcggccgggactttccccaggccgccgcccgccccggaggcttccgggccttggggggggaacgtcgacgggcgcgccgtcgaaggcgagctcgaggcggtcgacgtcgctgttccacttggcggtcttaagggcaccgatgtagaggcggtggtcggcgaagcggatgccgagggcctggatccaggtgaagtcacggctcatggtggggttgcgcttgccgatgaagtgggcgttgatgtgcaggtcggcgtcggagacgatgcagaagtcgtggtccttcttgccgtggaagtagaagttgttgccgtcgccgccggtgaagcgagggtcgccgcacgacacgcccgggtagaagtcgcacacttgaacattgaacattgtcagagaatgagagaattacattgctgatcaaccgattcatcagtagaccatgaaatggattatgtacatagctagtgaagtggtgatgcttactgcagaaggtcttgcagctggggcacatgacgatgcatgcactggttggggcagcgcttgtcgcacttggccatgcatcctttcttcttcccctgggtgtcgtcgcacgacagctgctggtctctcttcccccccatgtgacccgggttgatcatgtggtagttgggcggcagtttcggcgacggcggctgcgcctggaccgccgcgacggcgcacacggccaccaagacggcgagcgcaccgacgagctgccgatccatggcgattcaatggatggagatgtgcttcaacctctgtgactctgtgttgctagctgttgttgttgttgtgacttgtgaggattcaggacaagagaagatgttcatttatagggatcgcgagtgcagtggggtagtggatcgatgagtggccgccggtgatgtgtcgtcggcttcggctctctccggctggccggcggcgcggccgtggcggtgaagccaccagcatgacatctgagaatccaacactttgcgttcaccctgaactatgcatgatcttgctagcgtacgaatcgaaaacgtcgtcctaggatcgaggtcaacagtaataatataaagaaattaagctagctggttcttgtatggcttcatgcttaatttgcttcctttcttccaacaatggacatggttttaccgttttttttccttctagctagttccttaaaatctactgcaattagttgattcagctagtagcaaacataataaaggaagtaagcttggcttatggacctgaaagctgtttacctttttttccatcctaatcaagcccctggtcaactccattttgatctacacttaattcttatcttcagatattatgttcctaaatattactggctcaatgcacggacctctgttcttcagtaaagccaaattacccaacatgcatgctcgatcacacacacacacacgttgttgttatcgtttcatatagaacagtatagtggttaactaattgtaaattgtgatgagatttctcatcagtaaaccagccaagcaagaacggatggtacacaagtttttgtaacagagtttgctgattgtaaatttggtggcgtggcatgctagaaaagctggacaaagtactccacatgcaagctgaagttagctagcaaatattcagacgcacgcaatgcgtcatgcgttctcctgaagacctgaagctagatacggcagctgctgggagctttctgatttgccacgacgacgtatcgaacggccagccgccttcgccgcgacgccgcctggccggtcgccatggcactgcaccacgaggcgctctcgctcgcttcaccaccacgcgcgccggctcgccggcagtcttccctgccgagcaccatgcttgcatgctacctcatggatggatcatctccattgccagtccagtgaaatgccggcctagctataaatacgcgcctagctctcatagccatcttcctcaccaccgatcgatccagagtagccaacttaaccaaatttactgtacgttgaccaccagctagctagcttagctagcgacgatggcccgggcatacatggctgtcgccgtggccctcttcttggtggtcgtgtgcgccgccgtctccgaggccgcgaagccgccggcgtcgcatcccaggctgccgcccaactaccacatgatcaacccggggagctcgggcttgggcaagagggaccaggagctgtcgtgcgccgacaccaagggcaagaagaaaggatgcatggccaagtgcgacaagcgctgccccaaccaatgcatcgtcatgtgccccagctgcaagaccttctgcagtaagcatcactagctatgtacataatccatttgcatgttgtactgatcaatcggttgatcaagtaatgtaatgtaattctctctgacaatgttcaatgttccagtgtgcgacttctaccccggcgtgtcgtgcggcgacccgcggttcaccggcggcgacggcaacaacttctacttccacggcaagaaggaccacgacttctgcatcgtctccgacgccgacctccacatcaacgcccacttcatcggcaagcgcaaccccaccatgagccgcgacttcacctggatccaggccctcggcatccgcttcgccgaccaccgcctctacatgggcgccctcaagaccgccaagtggagcagcgacgtcgaccgcctcgagctcgccttcgacggcgcgcccgtcgacgttccagctcagctcgacgcgcgatgggagtccgccgccgttccaggcctcaccgtcaccaggaccgccgccaccaacgccgtcagggtgcagctcgccggcgtgttcgacatcatggccaacgtggtgcccatcaccgagcatgactcgcgcatccacaactatggcgtcaccgaggaggacagcctcgctcacctcgacctcggcttcaagttctacgacctctccgacgacgtccatggcgtgctcggccagacctaccgctccgactacgtcaacaagctcagcgtcagcgccagcatgccggtcatgggcggcgcaccaagctacgtcgcctccgacatcttctccgccgactgcgccgtcgccaggttcggccaccgcgccggcatcaccatggtcactgccagggccagttaaatttgcttgtatgcttcaagcttgatcgttgacagctcttatcgtgtacccaatcaagcattaatagagctagacactggaataagtttattttcaggttgagggaaacataccagtcatcaatcaatataggactcaaatcatttgatattcgcaccgtctcgtgccggtttgttaatgttaaaaaataatttgatatttgtgatcacataaaaatcctgcaatttaaatttcatatgtataaaaataaccgatacatggaatatactcctttacctttcttttttttcttttctctagaaaaaagttgaaatcgaataaaaaagtgacacaagaaaaaaatgcttaggcttaattcttttaagataatgtataatattgttaaaacagattatttgctccatgcttcggaaaatacattttcttaaaagaacacatggaaaaagaaaaaaaagaaaaggtttagccaccgtggctgatgagttcgtgaccgatcccaaatccagtctccaccgcgcgttccaactaccggaatcgaatccatctctctggtctctagttagagtttttaagggtgcccgcgaacccccgatgtgaatcgattgaggaggggatctccatgcatccatcgaaacacttgcctccttagtcctcacctagcactgccgcctcccctgaccagcgtgttgtccccagaaaaccatcctcaccaccccttgcccctccattacctcccaacccagaaaatcgtaatccccgtgtctttggcatagttgcgacactgtcaccaaccgctgggaagtcatcgttgctgatgagttaccacctcctccctttctccctgtcctcctcatttggagcttgaggacgactcggccatagagctggtgactggacactagcaattcccaatcaaatattatataatccatattttaatttgaacacgagacatccatatgaaaacatatgattcgatttcgctagaaatctgtcgtgtgattttttccccggtgatttcacggatttgctgaccgcacgatggtggaggctgcatgcgtggtcagccggtcgggatgatcttgttcgcactgtgctcgtccctttgggcatgatgagtggagacgatcgccggacgggacgaccttctctgcacttgaatcttgtgcgtaaatctgaaccaagccaaagctaggatcccacactagattacaccaccatgcggccatgcctaacaaatctaccatcgctagaaacctgttctattcatttttttttatatatttgccgataaatttttttctagaaatttgacagatgtaattacaatacaatcatagtgtaattacactgcaacttgtatataattacactaactaaaattatatttgtaaattcagttgatatgatatgtaagtgcactgtaattttgataaaactaaagtgtaagtaaatatgtatttgttattttctttaaaatataaaattacagtcctatagaattaaaattacatttgtaaattcagttgatatgatatgtaagtgcactgtaatttttataaaaataaagtgtaagtaaatatgtatttgttattttctttaaaatataaaattacagtcctatatatagaactaaaattacatttgtaaattcagttgatatgacatgtaattatttaaaatataaaattatagtcctatataactaaaattacacatgtaaatttagttgatatgatatgtaagtgcactataattttgataaaaatattgaataagcaaatttgtattagttattttattttgtagtccgttggatataaatctaagtgtaaaaaaaatctgggtgatttcttgttaaaaatcacccgacaaatgtgtaggcaatccccatatgatttatttgaatagtgggaatggtggatcacggcccgtccacatttcaaaaaatgtagttagtattttttttatagaaaaagttcaatatggctcccttaagataagtcagatttgattcatttccctcaacttcataagccataataccggatatatcgacccctccaactattaataccaacacaaacgacttagatccagtttaaatattttggctcttagagtcattttgtatccgttttaacaattggagtcattttgtatccgttttaacaattggagtcattttggctcttagagtcattttgtatccgttttaacggttgagaggtatgaatcaaatcatacttatatttgaaggagccagattagaccttttcttagttttctcacacatagaaatgtcggaatggacgtgcagcccagtccagtaggccgcaaacaaaacagggagtgcatgcttaaacccaacttggattctcacgtatattgtcatttagtatgtactccttccctctcaaagtattaagggttttcttttgttagacttagttgagacacatttttatagtataatacgtatagcacccttgtcaccgccactgtacgtaggtcaacgatgaaatctagctatctaaggacgtctcccctgcccaggatagatgcatattgcgtagagctgaatccatgcaggcattgcatgggccggtaacatgcactttaattaatctggggacttcgttgctagcgagtatatatgtagcatacgcggtcttcaaaaaaggcaaagtatgtagcacgtagcttgtaaactcgaccaccacgacgaccatagctctacctagcttcaactctactaccaattagtagtagcaaacgtaccatagatgcatatgtactgtcactttgtcttcccctacgccacttcccactgaagccacttcaccctcaattaagcccaggccggcgtcttctttccatcttcccataagaaccctaccccccatgtacatttgatcctcaactccgatccatcgatcgatcagcaactaagtagctagcagccaaacaatcatcctagctaggctgattgatccaagctagcttcgtcgtacgtgcagcgcatcagcctagctagctagcaatggcggctctggtgcaggtggtggcggtggcgcttgcgctgtggtgctgcggcgccgccgtcgtggcgtccgccgcggcgtcgagcccgccgctggtgtcgccgaaggcgaagcccggcgtgcggccgaagctcccgcccaagacgaagctgaccaccatcaccttcagcccccaccacaagcgcgactaccaggtcacctgcaccaacaccggccgccgtccctgcgtcgtctcctgcccttccaactgccccaacaagtgcctcgtcgcctgcgcctactgcctcaccttctgcagtacgcacgcacatatatatatttcgattattcatccttcgtttccaattggattaatattgatatatgtatgaactctgtcatgtcagtgtgcgatctgttccccggcacgtcgtgcggcgacccacggttcaccggcgccgacggcaacaccttctacttccacggcaagaaggagcaggacttctgcatcgtctccgacgccgacctgcacatcaacgcccacttcatcggcaaccacaacccggccatgaagcgtgacttcacctggatccagtccctcggcatcagcttcggcgaccaccgcctctacatcggcgcgcgccgggccgccgagtgggacgacgacgaggaccacgtccagatcaccttcgacggcgagcccgtcaacgtcgacgccgccaagggcgcccactgggtctccgccgccctgccgtccctctccgtctcccgcaccgacaccgtcaacgccgtcgccgtcgagctcgacggcgtcttcgccatcaccgccaacgccgtccccatcaccgacgacgactcccggatccaccactacggcaagaccgccaaggacaccctcgtccacctcgacctcggctacaagttccacgccctctccggcgacgtcgacggcgtgctcggccagacttaccgccccacctacgccaacaggctcaacatcaccgccaagatgcccatcatgggcggcgccgacaagtaccgctcctcgggcctcttctcgccggactgcgccgtctccaggttccaccgccgccgcaccgccggagaccatgtcgccctcggttttgcctcgtaaatcgccgatcactcgtctactccaaccaagtgagatacgatcgatcgactatgaaataaatcgacactgatcagtacgtacgtatatacatactcgtgcaccacgtcaaagcaagaaataatattctcattatgtggatggtgcattgattaattccaaaattttattgactattattatggagctctttcgattgaacatggagtaataaggattcttgatttgttttgatgaaaatgtgtcacattcataactttgttccattattttttaattagtctatcgatcagattaatatattacctaattaacctgtgttaaacttcaaatcgcggggtgtactatatgtaccatttctgcgtcaacgctattacgaccaaattaagttaagtaaactaggaaaaatattgcgtgaatgcttagtactacgaaaaaacaccggccttgacttgtttttgaagggggaaaaagtacaccgaaggtccctcaacttgtcatcagaatacaaaaacgtcctcgaaccgcaaaaccagatatcgcgagtcttttaactatataaaaccggtcacaataggtccctcggtggttttattcccggttttgtcctacgttgctactgagtcagcgtgggaccccacgtgggccccgtatgtcaggatgccacgtcatctcccccttctctcccttcctctctcagtcatctctgccgcaggagaggagaggcgcggcgccgctacagcggctgcagcggggaagcacggcggctccgaggcctacggtggaggccaacgagcgagcgagcgagcaagacacggcggaggcgcggggaggccggcgagctccaccgcgtggaaagggaggagtcggggtggccgcggtcgtcggcgaggagctcgcaggtagggggcccagaggaggccgtggctcggcggctgccgccctcgcccatctcctccccccggcggaagacgccgcagttccgctccgccggccgctgcgccctcgcctgccgccctgcgcctccgctttgctccgccctccaccacgcactcgccaaccgccgcgcgctcgcacgccgcctccgccctccgccacacactcgcccaccgccactctgctccgctggccgccgcgcgcttgcacgccgcctccgccgaccgccgctcagccccacttgccgccgccagtcgatttcgagcgtgcacggcgtgctcgtcgctcagcgcgccgtaggccttgttcgccagcgttcacggcgagcttggaccgcccggcctcgccgccccacgcgccggccacgtcgcgcaggtaccacttgaggttgtgccacaccagctcgttcccgtggtacagcggcgccgtcgggtacctcagtacctggggacgacgtcgcgtgtgttgtgaacgcggaggaggcgggggccaaggccacgtgcgccgtcgaagcgactcttgaagtcgtgcccgccgacgcgcgggttggcgaacacgaacgcggtgaccgggcagcccgtcgccgccagcgccgccaccgcggcgcggggtgccctgttgtatccattcgcgacgatgtcaaacgcgttcagcgtcgcgagtgcggcgccaaggctgtgtcccgtcaccctgatgctcagctcctcgccctggtacatgctcaccaccctcgccacctcgctcaacacctgcatggcgacatccatgtcaatcagtaacaatgtggcaggtgaccgtgccgcgctactccggccattacctgatctcgagcattgtccttgttgtggctggactcagagtcactggaggtgtacatggacagccatcctcggtgcaccatggcgtcggaggctttgtcccggaggaggtccttgggtggcgccattgacgaactccatgtccttgatccattgtagcgactgcaccgtgccgcgccacgcgacgaagatgttacggcgcccgagcgcggccttcccttcgtcggtggccaccgcgacgtacccgatccagttgctctccctgcacctgcggaagcgcgagacggactgcaggatgaacggctccggcacggcgacgcacgacctcgcatacaggaggatcccgtctcggcgtcgaagccgaacggcccgccctcgagctccccgaaccccgcgaagaaggcgcgcagccgctccgctctcgcgcccggtgcgacgttggtcacgtacacccgcctccccgctgccgatgccgccgatgccgcgacgccagaggatgggttcgcgccagcggtggcgaactgggcggagacggcgcgcggccggcgacgacgacgatgccgccgcggcccacctcgcggagcgcgcggcgggcagcggtgcgggaccgcgccccaccgacctcctcccctcccgtcggctagcctgcccagagaagtgggagagaaaagggaaagaggaaggtgagaagtgagagagagaagggagagaagagggaaagagaaatgtgttgacgtggcatcctaatatgtggggcccacgtgggtcctatgctgactcagcaaccacgtaggataaaaccgggatcaaaaccgctgagggacctattgtgatcggttttgtatagttaaaggacccgcgatatctggtttagcggtttgatgacgttttttatcccgatgacaagttgagggacctttggcgaaaacgcttacaatcggtcgttcgataccaccgaaaaaatcggacgctccacgtgtttctctgtttctcacacaacgagtccacgacttttcctcctccccctcgctataacttttcctcctccccctcgctgtaaccgcccctgctttccccattctcgctccatccctctctctcgccacgcgctgccgtcgtcggccgtcgagacgccgccgccgcaagccttttgtgcctccttgttcttctcctctttaactcctcatgtactcttcctcctctcccattaacatctcccccaacgtgggtgttcctcgagctagatctagccatccttgacctcaagtatcagatccggggcaaggccaccatggggatagggagagaggcacggatatggcttcagctcaggagcttcttgtagccaccaactccgtcgtcgtgccctacctatgtgatagaggaggtgaaaaagtagttgccggcgctgacaaaggtaaagctggtgtgcctaactagttgggcaagaatgttgcacaccctattcttttgatgttgcacacaatgtttacttgatgttgcaattagtcttttttggatgttgcacaaattggtataatgatttcttgatgttacaatattctgttttgtgtgttgcaacaagtgttcttggatgttgcaatattctggttttgtgcgttgcaacaagtgttcttggatgttgcatgtgattgaaacatcttttgataaatcaatgaaacattcttgatcgagttatggaacacgctggaacaattcttgttgaaacatttttttcatcggattatgaaacatctgaaacatttttttatgtgtgatggaacacgtccgatgtttcatcatccatcggacgtccgatttgtagcgctccccggacctttggtgtactttttccttttgaaggggtggacttttcgtactcgtggatgggcctaccaaaatgaggcccaagatggagtttgagatgggcccgtttctgtctccaattccagcccgtctcttatctctctcgtgtcttcttcacaaaagaaaacgacaaaaaaaaagtcattccaacacaagcccacctaagcgagcacgatgcacggcggcgcgtccttcgccgccgccggcgaagacgccggcgacgcggttctcctggagatcaccgacgcgtccttcatcgccggggaagctgacccctcgcctccacctcccgtctccgtcgacgacctcgccggcctagaccccctgccgtacccgaccatctgggttcgcgccgaccgcaccaggcaagccctcgccgcgccctcttctccggattcaccggccaatgagctgcttgtattctaatcccgcgtcgcgtgattctggccaggctaatcgagagctcctcctacttccgcgccctcctcggcggcagcttcaggtcagtaatctagtcgccccgacgcgatcgagctctcaatctctcaaacctatcaacagcaaatcctaagtaattgtctgacattttcccgcggctcctgtgggcagtgaatctgggagagcgcatgtgcagatcagctgcaacctcgaggcggccgtgcaagtcctcatctatctgtttgagccttctgggagtttgacgattacgcaccacacctttctaccgctaatggaggtattcagtcttgggttagctttttaatggctttggtgcagaagttgttgaccggcatttgtgtacatatgaaatcacagctgctaatcaacacaattactagtaattggtcagttagctcaatttgagtaaacataccatgttttggaaattttgtgttatgtgaaatgtgagcaaaaatgccatgtatttgtgtctccatgaactgttgcttaactgggttcgagctcgaaggttcagattgtggtcattatgcacctttataatttgaggctagtgctattaagttttggtgtatggtcagtgatgctcactggtggtattatgaacttaatatttgcagggtggcttgtttctggctgctgagaatcttctaacagaatgtgaaaggtggttccgcaccatgagctctcaaagttcctcgctattggccccattagatttcttaattgacacctggtactttgctcaagagcatggtgagccatattttgttgccgctttgttctaatggttcttatacttttgcataacgaaatctattcaaagatctaattcttgttgacatttgtatgattgcagggattaattatgttcaagatatatgcccaggatatttagctcagaattttgtaggtacaatatactaagttgcaatgctgccatacctttctgcatactatcaatttgtttcctaacaatatcttccttcagtttgaaaagtttatgtgtgactgattctacaagcagttagttttgttccactcatggtcctttcggagattctagaacattaaggacccgcagtcaccatatttgactcacataaaccatgtttgtagcctacaattgacattaatatttcacattttcagataggaaaattctagaaactgtagaggctggatgaattttcatgtgctctatttatggttgatgaaccggtgcatgttggcatttatgaatgatgattactgcttgaattgaagaaaagggtttgtctagattcagaggaaaagctcactgattttttactttttatggagaaaataaagatattctctttgttagcagcgtcatgtcgtttatagccttatagtgttttagaccatattttttccccttcttgtaataattaaatagactatgcctttcttattcagacactgctttaaccaagaaagcttatgatattctataaaaaagaaaaaaaaagttatgatgttaaaatgatgataggccaacttaccagttgaatatatatgcagtggggctacctttatttggcatgaaatgtattcatgtataattaccactgggtgaatcccatacaggtgcaggttatctccaggaggtcgtttgttaaacttccctatgatttgttatattctacaatcgagtgcccctttctgaccgtggataggtttgttttaatttttcagcgcttttccataatcaaatcgctgtgctttcatctcgatgctaaaatttgatctactgaccttgtccagtgaaaaacaattatgcgaagcaatcctatgctggattactgaaaatatgctatgctgtgaagaactacctcccaactcagtagatcaccagctgtaccttcttaataaagtacacctctctgtgacccatctatacaatgttacatgacttataccatcatatatgtgttgcctccttggtttgttcattgactacatttatgtatgttttctaccacttcactgaatattttggccacacagatttaagtctatctttctgtttaaacctgttctgcaggtgaggatatgcctcttacctttagaatttgcagcaggtatgattccttgatcatgagtttttaattgataataacattatgttatgcggttctcttgtttgatcttttgctatgtcaagacataatccatgctttttgattcatttttgtaggaacaaagagaaactgggctgagttcggaagcaaagtagagagtaggattcttaatctgctcaaggatagtttgcgaacagtattggatgcaattgctgatgacaacttggagagttaccgtgttcgaattacagaatattctaaggtttttatttttgccacctctgttgtaataatgttgttttgatatatttgaattgtctagaattcttttctttttggtgtttcttaaaaatataatacttttttagtgactacataaattggtcgcaaccacttcatgtataccttgtttgaatgactacatattgcttttattttatcaattgttgtaaaaataggtaaattatgctttactttgtatataaaaaatcttcttataaaacctacaaaatattataggctcaataactctttttacatgcttcgtgtgaagatatccttctgttatgacaaagtgctatcctgcattatcaaaagagattctggtcctttcattgtctattgcagatcatgcacttcgttgcacttctcactgatgaagattttgttttgcagaaaatagtgctttctggttgtccacaaataactactgaaatcttgtacatatcagtgctcccccctactaatgtgggtgcctcattgaataaaaggttagaaagttcatgggcccaagttgattaccgaaatatcatcctttacaatgagctggaggaggctgttaaaagctcatcatttggaaatgtgcacatggtggatctctcaaaatgtccaaatgcacattttagcactgcaattgactggttgaagttggcatttccagaattgaggatattcagagcttccttttgtttgacatttcagttcgaagacttgttatatctgctactgacttgtccatggattaatgaaattgatttgtctattgatacgagcattatagcacaaatgcattcagttatctcttccagatttgaaggacggggcgcagtgaagccaaagctcacaagatattatgcacaggatccgctatgtgataccacaatgaactcatatatctcaaatatatcaaaattgatattggaaggcagaaatgatattactggttggaaatatgttctgttcctactattgatttctttatagttatggatttggttataagaaatcttgtaaccatgtatgtgccttttctttttgcgtgtgtgtatgcagatgtggacctgttgaagatatccattctgaagaactctctttgttatataaacattaaaaattgcaccctattgacagatgatggtatttctaaattattactcaagtgtacgaagattcattcaatggttctttcttatacttcttttggaaatcagtcgattcaaactctatgcaattccaatcctctggacagcatggatgagtgtaggcatgtaatggcatttagaatgcaagaattgcacctggatgggtgcaaaggtaaacatggcttttgtttcatgtcaaaactttctccacaactaagcagatcataacttcctaggacagcagaagtggcattcttatttctatgttctattaactttacgctccattagcctagcatgggggaatctgggtaatataaatttatctacgtgcactgtgcaggtattggttatgccgctatgtctcagctaatgagtaatgtgaatataacaaacttcctatgtttaagggagacaacacttaccgatggcgctctctgcaactttgttggctcttcacttgagtttcttgatatttccgagaccgtggtatggttttctgtttcaaattatatgcatatggtcacctttttatatatcagaatatcagatgattttcctattctttgaaccaaagtacttgtgatgctaagcaaatattcttcagttttgaactttataagaatcaaacactgcaattgactagttgaagaaatgcttagactgagacttggggtgcaggaa

SEQ ID NO: 38504 - DNA, 1764 bp, Oryza sativa
atggtctgttttgatatatatagtcttaaaagttttgtcgcctcaaaattacaggtttccatggtatcattagcaccagttataagaagaaattctaacttgagatgtctgaaagcagctggatgccgtaacttgctatttgaacatggtgaagtagaagcgatgagtggtggtaatatatacggagattttctacaagaaataaccagtacttgctgcttagaggatgttgaaatgggatgggcattttgccctattcgagttacaacccttattccttcttttagtaaagtaagaaagatgactattggacttggcacaacattaccagagaatatattgtgtgctcttcctgatatttgtccattcctagagtctttggttcttaggtttcaggtgtgtctctggctcttctccctactatttgttcaataataaaactaattgtgcctttaattcttttaataaccggatgatgtacataccagatgatctctgacaaagttgtaagaaatctgttgaaatcctcaacgaagcttcgggtgctttgcctgtactcttgtcttggcaatttaacttcatttagcttccaaatcaaggcaccattgctaagaatcttaaggcttgagtggattactccatggatgacaaatgatgacttggcagttcttatacagaactataacttagttgaactttcactgtctggttgcaaactccttgactccagtaagttctactttcggattcagtatgtggaccactcgtgatgctgttgggttgagtttttttttgtgatcaacagactctcaagagttaatctcgtctgggtggccaaacttgacttgtttacaccttgaggtatattataactacaattttttacatggggcatttgattaaaaattatctttatctttgcagtttttatttaagccaaaatttcaaggtttcagtgctgttatatctgtagccaccctcttaaataagtaacttctaacagaactaaaggatataatgtattcatgtccatactttatgcatcagcatgtatgtactgtataatcgtagttatttcactagtagatgtttatatttcttgatatcatcacgaatatacctttttgtacattgattaggcattcaatgtattgaaaactccaatctacagctgaaattgttaacatcctccaaaccccatctcttatgtataggcttgttgatttacaggaatgtggtcagataacacttgacggggtttcttcaattttaaactgtaaagctttggaagatctgttacttcggcacacggtgagcatagaaatgccgtagccatgtagttgagataattgatagtatgatctaaaaactcataaacctaaatattttgtatgctattgtgtttgtgtaactgtaaatcctacaaataaagcatttttagaactataaattaaattaaaggatgtgtagcaacttgttgctctttacacaaaggttgttaggtttatgacttgtgctgctataggaataatcctttcaccatgatgtttcaccattattaatatgcatgctattgcaatttaaacttgcagcaaatcctgcttcatgcttcatagtcatcatgctttttttttctttattagaatgatgtgcagtgacaacggcatttcctgccatagtgttggcaagtcaccttcataggttatccaacacaaatcgttattcacctcgagtttattttgacaggaccatcaattgattgct

SEQ ID NO: 38505 - DNA, 6415 bp, Oryza sativa
attcaggatggtgtaagcagtaagcacagtgctttgaggtttcccctgcaaacggttaacccttgtgcatagctcagttacttgaatgaacgtttaaatgacaagaaacaagaatgaacactgccactaaatgattcaatgtgcaactatttctgctaacaagctttcgttgaagatgtttaaactgtatactggttaagtggtttatgaggcttggtcgttacagggcaaaggtattggaagaaccatcataactgatgccataacagaggtacctatcttatctattaattggttttgctgcccttgcaacattatataggtcacataggtgcaactcattttgctgtttatttcagttaccactactaagaaagctagctctggatctttgtgatgcttctgaagaaggctacgatagcccaaatgtgagtatattccaaagattttgccgagttgggcgggttaataataataataactgaataaagatgctaatatctttgcaattgttttgaagaacccggaggggaagatgatgaggaccataacgatgagcagatgcaagtcggtgaggtcttgtttcgagctccacagggaaggatcctcaaactcaaaaccagtgcacaaggagacgattgtgttggaatggagcagcagacagctaagaaccaccatagtgaaagaaaaaatacgttggagtacgccgattttcttgtaaatttgatatttcactcccctagtcccctattaccaatttttttttttaaaaaaagaaaaaacgcaaccttaccagcccaaaggcccaaagcccacaacagagaggagagtgggcgacggggggctagggcggcggcggcgcggcgaccagcgacgggcggcgcgcacctgaccggaatggcccacctcgcggcctctgccgccccgcttccaagcgctgaccccgacgccggcgaggagtcctcccactctccgccgccgccggagaaggggctgaggaaggtggtggtggtgatgggcgcgactggcgccggcaagtcgcggctggccgtcgacctcgcgagccacttcgccggcgtcgaggtggtcagcgccgactccatgcaagtctacggtgggctcgatgtcctcaccaacaaggtccccctccacgagcagaaaggtctcctcccgggattccccagttcttcttttgaccaaacctgcttcagatcgagcttaacagcgctatctttgccgtgttaccaggcgttcctcaccatctcctgagcgtgattgatccctctgtggagttcacttgccgcgatttccgcgaccatgctgtgccggtgagcctatgatgttgctgctacgacttttagtgctcctagtgtgccatgtttactgattagttgatgtttcttagtgctctgctcaccaattatataaggtatattggtttactgattaattgctgtttctgagtggtcacagattatagaaggtatattggatcgtggcggcctccctgttattgttggtggtacaaacttctacatccaggttgatacttaagcgcatgaggattcctgtatattaggctatttttcttctgaattagactatatctgatttttgtccttttaacacttattgtaggctcttgttagcccattcctctttgatgatatggcacaggatattgagggtcttactttaaatgaccacctagatgagataggtgaatgatgaaagcttagcacatgtttcttgttgttagcatgttttgatcaatggttgtgtccaattagtgtttgacttgttaaacactgcttaacacatgccaagcagggcttgataatgatgatgaagccggtctgtatgaacatttgaagaagattgatcctgttgctgcacaaaggatacacccgaacaaccatcgaaaagtaagggtgttgcacagttgtgcccttaacctgttaggtttctttggtagcaattggattttccttgtggtgttgccccatttgccttatccggttatcctgttctgcatgcttttttgttgtgttgaccagataaaacgctaccttgagttgtatgaatccacaggtgccctacctagtgatcttttccaagggcaagccacagaggtgagaaaaaaatgattccttttaattaatttctttattctgacttgttgctgactctatagtccatgtgaaatgtgcaaggactttatgcatattatcatgcgcacaacacattttttgccgtacgagttggacctcatgcgaactctaaatgtcctaatgaggtcatttgttgtcaggacagaagtggggtcgacctagtaactccagatttgactgttgtttcttgtggttagatgctgatcttcatgttctggatcgttatgtcaatgaaagggtcgactgcatgattgatgatggcctgctagatgaagtgtgtaacatatatgatcgagaggccacttatacccaagggctgcggcaggccattggtgttcgtgaatttgatgagtttttcagattttattttgcaaggaaggaaaccggtgagataaagatggattcctgtacaactatggcaggtctccatgatgataacctgaagggcttattggatgaagcagtctcacaactaaaagcaaacactcgcagacttgttcgacgtcaagtaatctcgacacttttttaagtaaataattgaaaattgcattttgtgtgttttatattcttgcctttcttcagagacgaaggctgcatcggttgaataaatattttgagtggaacttgcgtcatattgatgcaacagaagctttctatggtaatgatatgtgcatttcatgttttagttcaaagccaaaagatttcatgtcttacgaaatctaatgtgtttgcttaacatgtcatgcatatttctaggtgccactgctgactcatggaacatgaaagttgtgaaaccttgcgtggatattgttagagatttcttgtctgatgatacaattttggcaagcagagatggttctagtgtaactggaagccctaggatgtcttcaagagagttgtggactcaatatgtttgtgaggtaattgggaggcttttcttattcttaccaaaaagaatgttgataactgtatcgtcatttgtgcgttttgccacattttttgttagtgggacagcaatcaatctgatgaaactttcttgcctttcctgctcctattttacaggcctgtgataaccgggtacttcggggaacgcatgagtgggagcaacacaagcaaggccgatgccaccgtaaaagagtacaacgtttgaaacagaaggctagtacagtgatatcattataggcaattagcactgtttgcactctcggtgttcatgaacctttcttcattctctgcaactgtccccatgcatcctgtttgtcaaattggctgaagactacaccattcagaaggtagcaagcagcagatatatttgttaatagtaccttgctagattcttgtgccagttccaaacatccaatgcagagaatacaaactctacagattggtcagcacaagcacgtccgattgagcagcatctacactgatgaccagttggagtttctccaatctgctgatcatttctagactagttttcccattaaggacaccataaattgggtaggcggtccagcttgttagcaaagtggtgatagtgattagcaattaagcatgacattgacccatcgaatatttgcatatcttggtcttccagattgcatgatttttccttcatatgtgactggaaacagtggggccatgctaggttacataaattcctgggcgtgatacactgcgaatagtagctatcatgtttactactgtcgtgttgagactactgtacagtagctcgtatgtatttctcgtatgtttgtgcataagtgaggggtcgatgagagtgacttactagacttttctcatcctaaattcctaataactagaaaagatgaccgaaattgggaaggcgacttgtgcctcttttggaatgatcgaaatatagaggaactttcatgttgacctgattcttacgaaaatcatgtaaaactcgtgttcgttgtcaaaaggcccaacttcatctcagatgagcataagtataccatattaatgcttcaaaatggttaatgctagctcgtttttactgcacaactaatgctcgatgtccaaatatacttgggttattattatttttttgaaggatttttcatgtgagtctcgccgaggtccactaaccggtacacaggcgccgacctctggcacattattttacacgagaaatttaaggtaggcatgaaatcatcagtcgcacggatgcaaacgtgacgacatcatcagaaacaatatactgctgcgccgatttaaactacacttaaattaaaaattctattagtggtacgagagtagtactactcctgtatgtagaatagatgtgcacgggcgcacgtgtttcatccctctaattctgaatccccacgtgacgatcgagcttaaagccgaacgggcggggcggggggataaagcgggtcccccagccgctgtctccagttcacacccacaacccgaagtcgatcgctcgtgttcgtgtccgcctcgacggcgaactcgacgggtcccgacccgcaaacccaacacccacacctacttatacccacctccactaatccctcctctcatcgcaccaccacgccactgagctcaagctaagctaagtgctaacctaggtgttcgaccatggacaccgaggacacgtcgtcggcttcgtcctcgtcggtgtcgccgccgtcgtcgccgggcggcgggcaccaccaccggctgccgccgaagcggcgggcggggcggaagaaattccgggagacgcggcacccggtgtaccgcggcgtgcgcgcgcgggcgggggggagcaggtgggtgtgcgaggtgcgcgagccgcaggcgcaggcgcgcatctggctcggcacctacccgacgccggagatggcggcgcgcgcgcacgacgtcgcggccatcgccctccgcggcgagcgcggcgccgagctcaacttcccggactccccctccacgctcccgcgcgcgcgcacggcgtcgcccgaggacatccgcctcgccgccgcgcaggccgccgagctgtaccgccgcccgccgccgccgctggcattgccggaggatccgcaggaaggcacgagcggcggcggcgccaccgccacctcggggcgtccggctgccgtgttcgtggacgaggacgccatcttcgacatgccggggctgatcgacgacatggcgagggggatgatgctgacgccgccggcgattgggagatctctcgacgactgggccgccatcgacgacgacgatgaccattaccacatggactacaagctatggatggactgacatgtatacacacatatcgttcgagtatatatgcttacagatatagataatactccatcagttcctactaaatacggagtatatatttttagataaaggatttatataaaacccggcttctacatcccgaagaatgtacacagccaatcctactaaatatatataagcacctcttgtttgtttagaaaaaatgagattaagggaaaatattctctttttgctgtctcacgatcaaattttgaattttgatgaattactggatcatcctaagcatattaatatattagctaaaaaatacttgcatccctgtgcattgaaattggtgtcacacgagtaataaacacaaaaccatccattttggttttacatttgttttatttgaataaaatgtttgtcgaaatgtttatattgttacaaaattaaaatcctaaaaatactttgacagtagatggatagcaaaggtatccacacatacacacataaagttcagacaagcgtcagccttagctagctagggaaaagagtaaaaaagggcaacaaaatattttctcaatagacaaacgtgtgaatcaattaatttgcagatatttggctaataactttttgaatatcttgagtggacatcctctaattatcattatataccctaaataccatataattagtttcaaatcaaaattttctccaaacatgtggcactttttatataacgtacatatatataatatctatgatcaaggggtgaactcataaatttgttgcacccgtgacatatatagtactgtacatgtacacggatcgtgcttaagagacatatatgcatgatgtcatcttctatcgagaaacaatctaacacacagtaggtcgttttgccaaaaatcttttggccaatctaacctcaaagtaacacggtcaatctgcaccttagagcaagtttaatagtatagccaaatgttaactccaaatcatctataact

SEQ ID NO: 38506 - DNA, 1724 bp, Oryza sativa
acccttactgtagtcctctttcttttctctcctcttttcttctcaatatggttatagcggcttatagcctgctattgtaattgtacttgctcttacaatccccacaaattcttaagtctctaaactcaaagttacacacataaagctgagccaagaggaccggcacgcaactcgggcagccgcctaagctcactggtgggccacaatactatagattgatcatactatatattattttcttcaaaggagaaataaataatagtacgatcgatatgactactaagtaaatcggtcgtactattagtttctgatatgcatgaatatgattacttaaggaagaacttttaaccttacatttactttttaggcttagagacatagacatacattatcttaattatggatcgacactttgtaaccactagattaatgtgcatatttatctaaaaaatatgttatatacaaaatatgcatataactttgtaaatattttaaagttttaatatggtgcgggggccggcctcctctattgttttcagttttcaggtaaagaaacatgtttttgccatgggttcttcaaagttttcaggtccatcactggcactgcttgcacaccaggagaaaaaagagttaactagctagcatatatatatatatatatatatatatatatatatatatatatatatatatatatatatatatatatatatatttatatatatatatatatatatcagtagtaatttctcgagagattaatttgtgtgtttactaatgcacataaaatttgagagatgtttcctcaaaaacatgcagatcgatgaaattatatctgacaattgattaatttgacaacaagatcgagataacaagattgattaatttaactaaatacgggtcgatcgactgctaattgattaaactgagtagagctagctagttttgttggcatatgcgatatgatgaagtagctcgatcgatctccggcgccgcacaaattaactaccaacctgaactttatagtaaatgacctaatgacaacgacggcaagaacgcacatattatacatgtatcgcataaataataataaacaacacgtgttgaggatttacaaaagggtagcacacggtgaacactatatttacatatatatatattaatcatgtatgaaacgtacgtctgtgagacctacttgctcttttcattcctacctttaatttcttacttctcacgacgctaattaaacatcatatatagagtttatctcctaacgcagtcaaatacacacacacacacgtgtttgtgactgtgtgtgtgatatttaactacacatgtagatgtagtcacataaaacacatcaattttttttttgctgtgtacatatattttgaatgtagaggtcgggttattttaatccattttataaaaaataaacacatcattttggtcttcttatagtatgttataagtcaaattttaaattttaaacatcgatctgctttcagatatatatatttggattggaggcatgaaaaaccatatgcataaatttgtctcgagaattatcttggtaataacataattgttttcaaatataattttgtatgccctcattacaaaatataattattctagttatgtgtatatactagtggtgagaatcgtatcttgaagaccatgcaaatgtctgaaaataacatactttcgtagggctgcaggaa

SEQ ID NO: 38507 - DNA, 2975 bp, Oryza sativa
caaaattaatgagtactatccttttgaaaaaaaaacatatgaatatgtctggccaaatatttcattactgttatccttggacccgttaaaaaaatccataaaccttaaccctatagtaaaaaaaaattcatggtttacccttcggcatttaatttcattaggtatagtctttgatcaaaattcatgagtattaacctttgcaaacaaacgcaaggatatttttctttagctcaaaatttcaatgagtattagtcttaaggactgttgtgtacaaaatcgtgaatattaacctcacaaaaaaaaaactattcatgatttttagccatctacctatagttagtgatttatagctttcggccaattttttttttaaaaaaagtgtggttatgtttctctggtccaaaatttcatgagtactcgccttaggcgtattaggccaaaaaaaaagacttgaatattaacctttagctgaaagaagatatccaaatcaacatgatagggtaaagtaaagctcataatgatttgctttttcaaaattttatttacaattattagccaccacttcatttttatttttcagtttttttcttcaaaaaatttcaaatgattttttttcttcaaaaaattcaaatgatttgcagtttacaagagtaatgcttgtagtaatttgatttttcgaaatttccttcaacaatattcaaagatttccagtttatacacaagtaatgctcgtaatgttctatagttttttaagtactgcccgtaatgttctataaagatttggacgaaaacaccaaaggttttcctcgacatatcgtgggctggaccagtcgctcttggttgcaccacaaatataagtaggccggccctgaattgtttccaagtaggcaaaacatgcaatgttatgctttatcagtgaacacaacggaaggcaatcaaacttgcagttggatcatggatggtagtattaaaagaggtcttttacttttactacaagcctttcacttaaagatattgcaagttctaacatgacagcaaggaaaaggaagtcacttgcgcatgatgggcaaatacagaatccaaacacaaggcaacaatgacggggaagaaaaactctaatcagatggacatagattagagaggtgcaccatcatcgcacaacatctttatcttcttaggatttaaagcagagactaaagctttctggagcaaactaagaagacccgtccggggatcggccatcaggcgaatcatctctttccttgctttctttccacttaacccaggcccatctcaacacaataaacgctccaagagcataaacctacagaagtagcaaggcaaatcgtcttttcagaaatatgtgaagtatgttgagatagcacaatgagtgaacacaagagcatatatattgcagcacaattcaaaatgaaaaacggatgctgaaccacatatggttctctgaagtctgaatgaatatgttgatttctctgaaatttggagtcattgattagcagatactaacagtaatattttctgcattaactaaaaaagtgtgagtatcttgttagcaagaataatagggtcccgaattcaagacaggctcgtttccttgattgcatcatctgaacaagataactgtacccaccttgctgaatctcagctcctgattttagtaaatccaacatcaagtggtgattaacttgcagaatattcgcatgcacattttgctcccacggacacaggattgaggtgtttggcaatattctatttgatttttcggaatcgtgcatagcaaccacaattcactacatgggactttgaggtagacagtcatttggtctataactggatacacacaatttgggtaaagcacacgataaattacagtttcgatggagacaattggaaggagaaacagtactaaattcttagaaagtttgaaagacaaaacaacaggtgctaattctcagagtaggtgtgaaatttaaaatacccaattgggaacattctacacagcagcctggtgtggtaatccacttgtaattatgcatagtactgggaatgagtatattgccttcaagtttgtgcattctatcctggactaccaacttaccaagtgctcgcggattagatcacaggaaatgagccattgaaagttaaaaggttgcttatctaagacaattgttttggactaccaagcttcgcggataagatcacaggaaatgtgcttattaagacatatggtgttgcaaagggtgcatctaatctaacaagagtattactgcacatttcaaaagacaatagcaaacaaaataatggtgaatatacatggtgtgtgtaaagccatctgaaaatccccttcatgttgtgtgtaatttatctgttgtatattccaaacaaaacaaatattcgagtcgcagtttcaggcgatatgacaggttgaaacgcgggaagaaattggcatagatccacaaggcatagaggttttggtgggtttaatcgcgcagacagagagatggtcggagcgggattgggattagttggggctgtacctgccagaggttgcggggggccatctcctcgtcggcgacgggcggagggggcacgtcctcctcctccagcttgatgggcggcggctgcctggccttgggctggtcggcgctggggtagaatcgcacggtggacggcggctggcggcgggcctccgcgtcctccttattattgccggcggcctgctccggcgagctcccggcgttgcccatcgccttccgattctcgctctcctcgccgcggcggcgcctctcctctcctctcgcctcgtctctcctcgctaagagactcactcgactagcttgtaattggtgttggtgatgatgataagatggattacttgggagtaacatatgctcttttcttttgtattttctgtacactttattaccttttcttttatttgctacattcttttttag

SEQ ID NO: 38508 - DNA, 2058 bp, Oryza sativa
tcggttttaaagcgaaaaatttaggaaacatccaagctaatttctgacctcattcgaaggcctgggggcgatgtcacgcccaattgtacctttttcatttggattttcatgattatttttcgtattaaagccctgatagtaaaacgtacacactactggttagtgtttgagtgaagaggaaaataaatgattgagaagatacgtaaaataaggttagccattagcatataattaatcgagtatcaactattttaaattttaaaatggattaatattatttttaaagtaacatttctatatatttttttaaaaaaacacatcatttagtaatttggaaaatatgcgcacaaaaaataaaaggtttgctccctcaatctccctgaacaaacgcagatacatcttaagtggaaaacaaaaggagatcggatgtattctggcttccagctatcaagaaacaaagagcttaacatactaatgatggacctgccctttcatgcagttttttttttcacagtacgcaatcagtatgagtttgagaacaatgcacagtactttctcaagaaattttgaactaatccaaattatcagttcatgacaatgggaacccacctggatactgtgatagcacgagaaaagctcaggcacacggcatgcgcatggaacaaacaagttaccacaaattagtcggtcatatgaatcacaactaccaagtagtgaaatttgcagattttgcttctaacagcctactactagttgctgtactaaactcaaagaacttaactcacaaccattatagcttccagcccataatttccttgaacaatcatctatactgaacaagaacatctctcaccgacgaagcaataagaaagaatgacacaggatgagcaaccaaaggtacaaatgaatacatcgactctgccacagatatggtggataaccccttgccggcttacacaggaggaaacctaaaagttggtagggatctaggagtgactagatgcacaaaaaggattacttgagtatacgtattccacttccaaacgattatagccactgacagtgctctacaagagccaacatcaccatctatggattggagcgtgttgtctaactcgacgctgaagcctgtgacatttgccttttgatagcttctttgtaagtcttgtgctggtaggtcaatgttgtctccagcaaatccttgagaggggtcttcggattccaacctagaacagttgaatcaatatttggttattatgaaccactggttacccaactagtacaacatagacataacaggttattgaagacagtaaataccaagctgcttgttgattatggtcatgtcaggaatcctcttatcactatcatcatatccttcaccatagaactgcttcgaactcacgtcaatcataggttcatccagtggtggctctcctgagacatttgcatagacctgtacaggacaaccatgtaagacttagggcatgagtaacagaaacgctcaaagaaacattgccacgctaatgatgtacctctgtcatcatttcagccaattgcctaacagtgacttcattgttaggattcccgacattgaagatttgaccattggcacgagcaggattttccttttgacataaagtacacatttcagttcaactaacaaggtaaatctagcataagagcaaaggaagtaaagataaacagagaaaacatacaatcatcaagtgaacagcttcaatggcatccttaatgtaaacaaaagttctctgggactggccaccatcaacaagtttcaggggctcccgacgcaggagattctgcaaattcattggcgacatacatcttatgagaaaaacgaccataacgaaatggaggtatattattctcagaaagggactggttgacatacgttactgaaacatgccaaaacccgaggaacaccctcactaggaccatcaacaccaggaataaagtccattcttggtccaatccaattgaaaggtctcacaattgtgaactcaaggccattttctgctccttcagctggttaaagct

SEQ ID NO: 38509 - DNA, 3213 bp, Oryza sativa
  unsure (1)..(3213): unsure at all n locations
gactaacttatcacattggaaatacaattagaaaagacatttccttaagatgccatgtattcttgattactatatccacttgcaaagcaatgtgcagtagtagcacataaacatagttatgcctgaagaaataagtatcatcaaactagaggaggaacaagtcattccataacacaacatggcactggacaatctacacagatgaaggatagagcaacatgagaaatactgacactccaagagatgctgtcaactctgctatcctaagaaagtcaaaacattcaataatcctgaaacagaaccaccatcacaagaccatatatccgagtgtcaaccaacaaccagacaaggtccaataagaaaatccattcccaaccaacaccaaatctaacccaaccttactgtcaaggccgtacaacagcaagtacaggataatggcagctgaacaactgaatctagcagacctgcaccagatccattccacccccaatctaatcagtaccaatcagtttgcttttcagtcaaccaaccaaaaaagaaaatgtcacacagacttgtacaattggcacaagcacattattatccagaagaaacgtcaaaatagagtgatatggtggatgaccttgcggagagggtggtcggtggggaggaagctgccgatggtcttgccgtagacctcgcacgtggagaagtggatgagacgcttgttgttctcagagcagtacttgacctgtgcacatcacacacgtccatcaacaattctgcactagtggtagaaaagaagaagaagaacgctggagtggagaagaggagggattaccacagggagcgcgtcgatgaagttgctgtagatggtgtcgagggggcgcgtgttgtagtcggccggcgtgcagatcgccgccaggttgatcgtctacgcagatccggaatcaaggcgtgttatcagaaatgaaatgagattgaaattgagagcaggagggagagagagggagagaccagatcggccatcttgatgaggccctcgagcctggagtcgttcttgatgttgaggcggtggaaggagatgcggccatggaggtggggaggggcggggtcnacgaggtggcggatcttgtcgcagtagacgtcgacggcgtagacgacgtgggcggtctcggccatgagcttctcgcagaggtgggagccgatgaagccgccggcgccgatcatgcagatggtgaggggcgcgatggggttgccgtccagatccaccctcccggcggcggaggcggcgggcggcgacgacgacgacgacatcctcccttggtccgcggatccggaatgcgcgtggaagatggattggattcgattattgcggaggaagggaggcgctggatttggnggttacgaggcgaggcgatgtcggtggcggtggttttctttttctctcctatttaagagcgcccacactctctcttctcctcttgtctctctcgagtctcgactttgaagaaggaagggaaaggattgaggggatggacaagaggtggcccactcctcccatcgagatccggtggttggtgggcctgcatgggcctctcttcctttttcaccatttccttcttttcttttttttccctaactcatttacgcctattcattttggatgaattttaaaggattttaatttcttttaggattaattcctacgaaagctatttgattattaggaatgtagatataggaaaaccaaagaaaaaatttctcctacaagatgtagagggaaaacatatattttgttcccgtccactctaaccttttgggaaaatcctatggattcaagtttgcatgtattcctatttctccattttttaatatnnttctaattggtatntaaaaanatttttcttttcaaaaaaacccggaaaaatttagacactaatgaattttttccctttaaattcttacctctactgcttaaaagcggagcattcgtctgttccaaaccaaatatacatcaaattcattcatttgttataccaataaattcaatgtttgtttctacacgcgaacatatattgctagttatattactattcatacacgcataaattagcatcatgtgtgttgttttaacgtacgcgggaagcggtaaatctcgaccacactgtatgtataatatttatggatattatttgcgtactgttgtatatagtactatagtgtgatgccgttgtctgttacctcaacccaaatgtcacagcagcactttggtctctgtcacgttggcaacctacttaacctagtaggggatgtagatgtgatcccttttaaaataacgaatcataaaaggtagtccaaattcattataccttctaggagggtcaaatttctttctaagttaattttttttacacagagggagtgctttcttcatcatcaccacacacatatacatacgtgtagtgtactggtcagtaccattatgtaattaaaaataactcttctttttcagtaactcccttttcgtttaccttccagtctttaagttgttggtggtgtaatattgttatcgtcactcatatatctcatcataaatcactactacaaaaatagttttcgctggtagttaaattgggttttcgttgaccagcgaaaatcgagtttcgcaaacggatatgctaagataaccaagcggcaagctaaagagaactgccagtgaaaacaattttagaataaaaaaaattcaaaatcggtgccatcggcccccataaccccaaacaatgccagccggtcggaatacgatagggtattgtacgatccgttgtaaaaaaaaaaaaagtatgtttgcaaatatagtttgaaacatcaaatatatggctagtcggcaattttgctgatcctatgaccgacgaaccgacgcaacggaaaaaaaaacaatgaaagctttccgtttcaaaataaatcaatctagcacatgatgtcacgcatactaatactatgaatcaaaatctggacaacaactctagcatcgagagtcactaactttaactactttctccgtttcaggttataagactttctagcattgcccatattcatatatatgttaatgattctaaatatatatatatatatatatatttatatatatatatatatatatatatatatgtatgtgtgtgtctagattcattaacatttatatgaatatggataatgctagaaatgtct

SEQ ID NO: 38510 - DNA, 18305 bp, Oryza sativa
tttgtcttacgtattttctattgagaaaatttgaaccgtgccacacaaattttgcaaaatttgtgatatgccactccgacccacatgtcattgactcatgtgggtcctacatgtctttgagatacgggtggcatatctaaaattttgcaaaattagggtggcatggttccaacaaacccttttctatttgtcgcacaaggaacacacactatttagacatgcctacaaatctagaacaaattgaatgaaatacagatcacaccggcaaccatgcagtagaaaatataagcttttcccagtactgcagtaatataaaataaaatatttttccctttcaatcggacaaattgctacaaccaccgttcttggatttgttgattacatgtagaataagttttcacatgatgtgagaatcagaaagtttgacaagatgcatactgtacaaccaagtttgctggttagacccaaagcaaaccgttacatcgactccggcaaactatcatgctcatgttcctataattttctcaaatttgttcaatcttccgtcactgctcaaatttgttcaatctgagaacactgaaaagatgcatgtaactgaacatgtagagcacggacgggggcagataccggggatagggtatcgaagtggtcgcctacgacaggcggtgattactggcgacgatctacttcattgtagcagacatgagtcctatttatagtactcatagcttacttagaaaatgattagagacacataaaaagtagaatttgccgcacatatacctctgatgaactcaatgtagcagctctgagtcctctttgttcatattcgaggaaggaatcaacaagtactgcaatgttaaacaacccgacagatcaaatgccaaagtaagaatgcacggattcttaatacaggcaatatctgataaaagcctaaaatgcgagtcatgttatgtacactctgtcatcaatttaaataataaaactatccttctcataggtatatgttctcgattattacgtaatttgactatacattaacagattaatcttgcagtggtgagcatatgttacatacatgtaaggaccttgttttgttatgttcaagactcacgttgcttctgatatcggtcaatacttggagtatgtagcaacatgaggaatttatacaaaagatttattacttaatactcactatttgtaatacaatttcatattgcatgaaaattggtgtagataaatcaagaagtacaaaacgcatggtttccaattctttacaagcataagaaaattaataagcaaaccaataaatatgttgcacatccccactgttaatgaaaccatatttctgaaaaaaaaaagacagtttaagctatgcaatgcctcatgcgtgtagaaatcagaggctgagttaaatcaacatgtaatctacaaaattgttctcatggtcgtttttacatactggaaactggatccatccctcccctcaacagcatttaatcgaacacctaccagcctaccgggcacaatacaatacatgcgtagagaagtcatgatcattggttgatcatccaagaagtcacaatcaataagaaacaacgatagcagaccatattcctagggcattatgacttcccttactccacatcaaagattccatttttttcataaacctgggcttcaactgaagatttgatatttagctgttaccgaatgaccaaacatgtaaccccaaaaaacctagttgctccagatagttcatatttatcttttcaattgtttttacagctcacattattgttgtttggtactacctctatttcaggttataaaactttctagcattgctcatattcatatagatgttaataaatctaggtgcatatatatatctagattcattaacatatatataaatacagacaatgttagaaagtcttataatgtgaaatagaggaagtactttggtttccaagtcccaagtgcaaaggtccccagattcataaaataaatatttgtttgtagtggcagcttcctaggagggctaggaatacaaaattgccagcttcgatttcctattttttgtgattaacagtgaacacaattcattcctcatgtgttgctatcacaagttcacaaaatttgttgcactgaaaatgcaaatcatgttgtgttaagaatatgctcaatgttgctctacagagagacttcgccattacctggctagcggcgtgggggcgaggaggcgcgacgcggaccagacggcaggtaatcgacgacgacttgatggcggtgtgaccgagaccggcggccaccaacggatcctgtggcgacgcgcgaggtggggcggcacggcgcgacggttggcgggggctcggtcaccgcgacgacaaacccgcggtgggcgatcggtggcaagcgcgatggccggtggctacgcggtggaggagccaccgggattcacctaggagctgccgggattggggaagtgggagggggagggagcagggcgcggatctacagtgtagtggcccgtgtcaggcgacaccgatgacttttggcaaaacctataacggaattgtttatccgtatattataacaccatgatttaagcatataagcatgctatgacaccaatagatatgttatgacaccaacgaattgattttctggatccgtcagagggagggctggggatgacgacccgcgggatccggcgcgagatgctccatggcgaccagggcgaggaggcaaggcgtcacagcgtcaatctgacgagggcaaaaggacgaggcggcagcttcaacggcgactggttgacgcggcatggttagggttacggagggagcgcataaatgaggggagtagggaaggcgcaagctgtgcggaagggagaggggaggtggaggcgatcgtgagcgttggattttacagagatgatctgaaccgttgagtgatgaatataagagtgtttgagtgaaagatgagtaaaacaagttggtgaattattattaaaaatatggtagatagatgtgaaattttttgtatttgcttttttttttgcaaaatataattatctgttatatgttatatataatatttttctgtgttgttatttttaatgtaacatatttcgtatcctatacaaaatatttttttgctactatcttttgcataagcaatttctcactcatataccacacaaaaataacttttctttacaaaaataaaaacacaaacaaaacttgaaacttaaatagaaattcccattctgtgtaaagaggctacataaaaaaatcatatattttttaaaatttataatggaataaatcaattgttaaggtattttgggtttttttaaaaaaattcctagcccaataacatattataaaacaattaatagctctttccgatatatattataaaaagggacaatgtcaatagcatcatttaactgggatatacttaatgggtacaaattaattctgaaatgcatgacatcaacatagtcaaattagttgcctcaaatttttagcccgtatttgatctgtttatccaaaaactataatcaatcaaaatacatatattaaccttgccattttcattcttcttcattttttcttcccgtattttctatttgttttgtgatttctcattgggacaggacgactttaattccatctccctttttcttaggtagaattgtttttctctagtttgtgttggagaatttatccatttcagctcattccagtcggttatagaaggcgctgcgttgcacaccttttttttttggtctttttctcgtttaagttggaatagtttaatgaaaaaggctagatacgtgtcaacaccgtaatgggctgccatcccaaccaatcagctggcagtatttttttccagcttggagataaagtgattagaccaaccgacatctaaagcacatactcatctaaaatcctctatctgatcttttctattagttgcagttgacattcaaagttttacatagcactgtaaagcacgcgagtttatgtagcttgaattgaaaacagttaacgattttttcaacttcatctttgctttgttaggtgtgtgcaaaactttcgtacatctcaactctagccttatatggatgttcgcatggagctctcaattttgtttgctgatctacttggcagatgcttgagtacaatattcagttattgatttgtggttcggtccttatttgtacagtaacctttttttttatcatgatttgtgttaacaacgcttcaaatcgccgcaccggccgcgcggcgtggcgccgcacaatcccttatagtagcgacgacgaaacacattaggatgcaaacaaaatagcttgtttggttgcctgaccacaagaggagtggcaatagtgattatatgtgatttccagcaaaaggccaagtgagagaaagattgaaatataatcatgtcagcgatagatgtaccacaaatagcagaaactaggaaggtagcccgcgcgtatgcgcgggcacttatttaatgttgcttaaatttttgttacaaatgtttacatgtagatgatatttttaaaatagatcttgattatattttaaacatgttttcgttaatatctagtttggacatattacttgaaaccgtacaaccttaaatttatgagaacatgtgtcacgataatggaatatttgagttgtttcatatctatttgtactatatgtgattttttaacctagataaagggttttttaaatactaccacgataatctccagagcaccatattattggttatattttgataaatatctataattttgagtttggtttttttaacgcttattattcataatcacatgagacatatttactaattaatttggagaatgaatctattttcccaaacttatttacaataactaatttattaaagtatactttatagtcatgccaatagggttactttatagtcatgccaatagggtatatgacatccgtccatcaaatttgcctgatgtgttggaattcctcatctataaaaaatatatcatgagtaatttattatgcatgttacttgattgttcatttgttgtcaaaactatttgacaaagagaaaacatatatatgaccataaatctcatgattgattaagtggttgtattctatcaagataattggcttgaaatatttttcatatttttttacatctgtgtaacattcatgttgcccacttatcagatactaatgaaataattctaaagattcaaaaaaaattgaaaaccttaatctcaaacgaattaaaattaaattagatctacttaaaaatacacaactaaattgtgttgttttcatttattttacatatgtagaattaaattagcattgtatagtcttcaagtgatatttgacacctgaaatatgataagatttttttttaaaataggaaaaagtacaaattatccacataagcccgaaaaccggacatctttcaccctcaactattaataggacgaactagaaaatgagcgtgcccgttggcacgctagctagtttatagcatgtgtatattttcttttagaaataataggtttaaaatgattatttaaagtttttttttcaaattttatgtttgtaaaagtaagttagaatagtaaaattatcctaatttgtggtcttatcatgccgaacagaatatttacgttaagaaattattaaagatcatatatattagtgaaaaatgtgtttttattaatattcaacacgattgttataaacttgcaagtcatatagtttgtataattagtccgaaatacatatctaaaataaatgtgtcttcggttacctgtttctttatactggttttatttagaggatggggcatcgacatggtaaagatacttatcttgttttcatatatccagttattctaatgcagctcagctggttaggttccgtgcctatacgggttcaggtcaatagacttagaacgagttctttgcattttaccactatttgttgtttcaatgataggcaacctaccgatctttatcaatccaaatatatgtctgacggcctagtcttaaaaggtgctcgtgtgtatatcatctaaattgtgtttcacaaacaaaaaatatagcaaaattattgtcgttacttacccatgttccaaaataaatggattcctttgtggtggaaccaacccacccgggttcaaatcctagatttgacacgggtgttcgtatttatggctaattattctttcagtggtaggcgacgtacccgtcgacagcgaagcgcctgtggtgacttcgtcaatctcaagatatgccggcccagtcttctggaggtgctcataagggtagggtatgcgtgtgtgcattcatagggtgagtgtgcgcacgttgtgagcgcctacgtttgtactgtgtttctaaaaaaaaaatggattcctagcatccagaaaaagtataaggtgaggattaaaaaagaaaaaaaatgttctgaattaataggaaaatagtgctgaacttgtcggttaacagagaatacatcggttcatctaatttcactttttattctttccattctatagaattttaggtattttcctcgtttgaagtaaacattctagattgtatttatctggaggctttcgattgtcctaacacaatccttgctgctgctatatttttttccatttaatttcactattttttctaattttctagaaacacatgatgctaacatgaagtgactttccctcattcgagtaattgtggttgattgcataatcctattatttttattttttctcattttctttttattactattattttgttctatactggctctgtacacttcagtccttcacgctgtttttcttcccttttcttttgaacgaacgtacttagcgccgcgtgaagaggccatgcaccagtattgcggactgtggtacatattgcggaaaaggccgtggggcgccagggccagggccaggcccagggtcgcacagcctagctagatgcaaaacccaccccgcatacgcacgcaggcaaacgtttacgtttttttttccgatctctttcgatgcgaatacttcacccatcacacgtggcagcttttcagtgagctctaaccaaatttgtagggtgccacgcggcccaatgaaaaacaagagcctagacctagaaatcggtattagagattggcctcagataagtattcatgtaagtcgcatgcaaaggggaaaattatcttgcattgcaaatttatgcaaagagcatgtttggttgccagaccacaaggcattaatctgggaatgagtgcataaaaaaaaggaacaaacagcaaggaaaataaaagaacaagattagataaatctgttcataagcatcacaaataagcagcattaaccatcactcgccaccttttctagccaaatagcaagaaaaattagatcaagtattgacaaatctgttcataagcatcacaaatcagtaacaatattcatcattgaccacatttccgagcctaatagcaaggaaaaaaaaagaaaaaaactgtagaaaatcctgttcatatgcatcagaaatcagcaacattaatcctcattggccacctttccagacagcaggattctgttcatatgccatcagaaatcagcatcattaatccaaatttgccatcatgcatcacaaatcagcgagcatcatgcaacaatcaagtattgttgttcactacaaaagacatgtggtgccactaccaccttaacaagcagctaaccaatatcctacaaaaaacatacggtgtccactaccaccttaaccagcaaatatcatacaaaagccacatcgtgtccactaccaacttaaccaatagttaaccaatattacataaacagatgaaaaaaaaaagtgaaactaagcctcttctgtggtgatcagtccaatagcttgggcaatgtttatcttctttttgatgtagtcatcatagaaccgcggtttatccctctacaaataaaatgaatctcaatcagtaaaaagctaaacagtttttaaaaagcaagcatgcatgcatagacaacttcatatagtacactaccagcttcttaactgcgtctgcaattagccccagaacttgatcctctgcaacctgacaggtaagtgggatgttagacaaaacaacatctaccagtataaatatataatggattgcacttgcatgtcagatatataacacaatacttacttcctctgtaatgcaagccgtacaagtatgaaactggaaagggaaaaaagaaggtgagatgaatgacaagataatgagaataccacattataattttgcagatcatcagtgaacaacacaactaaattacctccgcttcccattgagagcagtcattgatctccagtacatatttcattttttgttgtcgtactggaaacctgttcagttcatagacttccttcattgcatctctgaaactcatctggacatatatagttaaagagaaaacacgggcattactaagcaaatacaacatttataaacatacaaaataaactattatatatttacattatataaattttagttgtgcagctggggtatagtgttaatattgtgctgaccttttgcttggtaacccgctgccaaatctcaaaatatacatcatctagctccttaaaaaaacaaacatcatagttcatgctagatacaaattcctgaattgtataaataattcaactattagatatatacaagaccactaaaatcaaattaactagtgtgcaacttaagtatcatacatggaagccaagataagctaacctggcagtaatcttggggaatccagtagctatcttaactgcttggtaaagtcctctgttgcttactcttccccactacatatagaattattatggtgatacaatacatgaagatgcaaaattattctatacaataatacttgccttaagagatggccgctcaagtaacacataatcttccatccactgtttcataatacaaggaagctattagtcagtagtcaatgctttaaaagcgttacaaaattttaacacttgattaacttgatataaatatgatgcaacaagcatatataccttaagtttctttgataattcaccataatatttcacatactgtttttcaacatcatatgtattaaaatacatatgatatttatcccaattggcatacatgcaaccctaaaaaaagaaaaggggaaaatcacatggttgagaaaataatatttacaaagatatatataacagtactcatgcatcaagaacatatatatgatcacatacatcatttttaatgactagacgttgatagtcaacaagtgcagcaagcttgcaatactcagggtggaagtaccaaacaaatatgtaatcaaagcacttaagaacctcccagaggacctcatcatcaacagaatcaagtgtgccatcattttcaaagcatataaggacctcctccagctgcttagacatgtcaaaagggtattgatttatcatttcatcatggtccagcttactcctagttccagacacttgctgtaacgactgtaacaggaggtcaatcatatatatcagtattgtatcttatctcctaacaactgtaacaataagatcactcatgagataatgttagatgcaaatgcaaacaggaggtcaatcatatatatcagtattgtatcttatctccctgaaatgtttgaggttaagcacattttagagaaaataaaggttgcagcattttttaaatttcattgagtaaattgcagtttgggtcatgtatttttacccttgttgcagcttggacagggtcttagtcatgattttcaatttggactacacaaccttgccatttgtttcactctgatcttatccaacagactctatccttatccctagggccttgacccctcggcccactacccatgacagcaccaccccctcatcgtctccaagtcaggcagcccatcaccgttgtccctctctttgctgctattatcatctctcccaacctgttcttgttatgctatcaacgaacaggaggaggtaaaagtacgacacttcccaaactccagtcaccctatccaatctggagggaggagcagatcatcacaggttcagcagcgctaccggtgctcaagctgagatggagtgcatggtggtagagctgaagttgctgctgcttgagcttgggtgtgggagcagtacgacagcgcttggaataggcaatgtttcttgagctcgagtatgtaggttgctttcaccagggagctcaatcccaaacacaatttttttttgacgggtcagccgaaaatggaccaaccgaaattgtattaagaggagaagaaattcagtactgttaaaaaacggcactagactgtcaaaaaggggcaaacgcaacaagccgtcaaacgacagtgtgccattgccccaaaaaaggaaaaaaaaccaggagctgcaaggaaataatcgctctgcttgaacactcctgcttctctccaaaccaggacctcttctcttactgctctgtagagctgtgcggcggtgcagttttgtgctaaaaaaatatcatattgctctctttccacaccagccagcacacaagcatggagaagatgaagacttcagtatgctaatgaccaaattaaactaatcgtatcacctcacttggcatgctaattttagctatcaatacaagagagggcatggtagtgctcaagctcacgtatagtggcttcagctcaacgaagaagagaagagagcggagattgaggaaaaaccggtccaatctgaaacttgtataaaattgtctagtccaaagtgaaaatattactttgcccctagtccaatgtgtaactctggtaataagaggtagcccaatgtgcaattcactcaatttcatttgtaggatgtgtcaccgaggaagcacggatactcaatccactctataagctagtgatcattgattgatatatggatagagtgtgaatgaatgaaactaaccttgtaatacttcacacgatacagttcatggagttcattttgagcatcgagctgattgaaatccaattgagtagaagtatcaacaggagagtcttgttcttgaggcagctggcgcaagtaaccacggaacttgtcagtgctaatatcttctcccaaacccaattcattcagctcctgagtgagaaggttggcttcctccacatttttctccatggtagcatcattgcattcggttgcgattgcaactggaacgctgtaatcttgttcggtatcatcatcctggtctgcaggactgttgagggccttagaaaaacggaagctttttttcctcctaggtggaacccatgtcttcttcttcttggcctgcttgttgtgtggcgccgccttctcttgggaaggaccagagaggccagaaagccccgggacacacgaatccattacatcatcatcatcgtcatcaagttcacctagcaccgcgaaacgacgaccttttggagtggtcgagtcaataccagcggatacgtcgacgatgtcgttgatggttgacacggccaaacggcgcagatttggagtcgtcttcttctctgaggcgccgatggccggcatgttcttcccgctcgggggcggcggcccgcggctggacccgcggtgcttgggcggcatctctccaaacccaaactagatcgatctggaacccagggagcgggagcgggagcgggagaggcggcggcggcggaggaggaggggaggggaggtggggcgaagaagacgattggtttgggagctcaaatcgccaagggtgcccaggtcgggatcgggtcgggttgggttcgtttgggaataagcgagattttttttagatcccttaaccccaaaaccagaaatacgtgcccctcaactcttacaaaccgttcacgggaggttcctcggcagtatttttgcccggttttgctgacgtggcatcctagtcagcaaaaataattttaaaaaatacgtggggtccacatgtcagctgcacactcttttcttcttctcctcttttctcttctctcttctcttcttcagtgacttcagtgagggagaccggcggcgggcggagcccgctcgaggccgagcagcagccgccgctgccgccgccctccgtgtccgggcctggcggggaggggacggggagagccacaacaccgccgccgtcgcgtcgtgtccggacctggcggggaggggacggggagccacgacaacaaatcgggtgaagctaaatgaccaatggtctaccattcgagcgattaactgacggcaattacagcgaagcgctcgatcggatcggagtccggtcagtacccgccggcgccgctgctccatccgccgcggccggcggcgcccatctgtttgctgccgatcgccaccgaaggcagctggttggcgttggtcaaatactgccggacggggtcatccgtcggcggcccggcgagcgccaccggcggcggcagcggccgtgatgacgtactgctgcatgaccagcacggacgccatcttggagaactcggaggagacgaggaggtcgccgatggggccgagctccggcgactccatccactcggcgagccccgacgtcagcggcgagctcgcctcgccggggtggcggccgacggtgtacagctcgtgcgcgttgtcgagctggctgcggatggcggcgagcgtctcctcgctgttggccaccacctgctcgacgtagaggatggcatcgctgccgaggttgcgcgaccggaactcgttgaggtactcctcgtccatctgccgctcgctcttggcgacctcggggacgacgttgatggcgcgggagtgggcggcgggcatcggcggctgcggcggcgagaccgccggcgccgtgtaccccggcgggatgaagcggacgatggtgaggcacacgcccgggttctcgaccatccgccacgcgtacgcgagcccctcccggtcgtcgggcccgccgaagaagaggagcgcgacgtagtgcacggcggccatcctcgccgcggcggcgctgaggccgcggtcgacgaggatgccgacggagcatggcgccgacgcgaggatgctctcgttgaagccccggagcgacgcattgatgggctccatgccgcgtccaccgtctgctgcttgtggaacgggagcacgatgagcgagacgtgcttgtcctccgccaggacgcacacgtcctcgtgcatcgtctggtaaggcgacaccgccgtcagcgccgctcgcccggtcccaagcccctctgctcctccgagccgctcgcccgccgctccgccgcctcgctccgccgctgccgctcccctctgcggcaaatataaagacgaaagaggaggagagaaaaagggatgctgagtaggatctgacctcatatttttgtcacttacatgtgggtcccacgtactttttttaattttttttgctgactagtatgccacgtcagcaaaaccgggcaaaaatactgccgagggacctcccgtgaacggtttgtgagagttgaggggcacacatttctggttttggggtttagggacctcaaaaaatctcgctatcaaattaagggacctctggtgaacttattccgttcgtttgctctctctcccatatagctggccaaatgggccgtgctctgtcgggcccgcccaagcacgatgctacagtaaccgacacggcacagcacgggcccgtgagcttatgggccgtgctcgggcgtgccgtgcctgggccgacgcctaagcccgtgggccagcacggcccgacgcgtggcccggcacagcacgagaggccgaagccatcgggccgcatgccgcagcctgtagcgccgtccccagccaccaaccgcagcgcagcccgagattagttaaaactcgctccttttttacagcatgcaagcgtgcatggttagtttgtgtggcatgcacaggaaccgaataggcagtgcatgcgtgcatccaccccaactaacatgcatcataattgcttcttgaattaattctcccttagtattgctgcataaatgacctcggcgacgtcaaaaacatgcatgcactgatgcacccaaccaacatgcattccttttcttttcgcatatttttttggtcaaaatctcccgttcttatgcacgcttgcgtcgccgccgtgcgcccgtgccgcatcgggcgagccgcggctccaatctttcgcctccacgcgtcgcgcgccaggcgggcggtagacgacggcgcgactttcgacctcccgcgtgccttcgggccggcgccggcccacgtgccactaatgggcccgtgccggcacggcacggcacgacgtccccttgggccgtgcttgggccggagggacggcacgtgggctggcacggcacggcccgctatggaaccgtgcctaatgggccgtgcttttggtgggcccgtaccgcgctgggccgggccgcccattcggcctactatacttgggaccttctagtgctgtacggtattccagttgtaattaaaaaaaaagtatatccgaggtctttatcttgtcaccaaattatacaaaatcatctctcaacgaaaaaaatcagacatatcggactcttcaatttacagaactggttttttggttgaggaatgattttgtattttggtgacaagaggggtctcatatgtcctttttgctattccagttctagcatcccctatatgagtactatacagcccatgcattgcttttattttctttctttttttatataatacaagaaaaaaaatatccgcacagaggagaaaaaggttgatgagagagtgtgtgatcaataaaagccgagtgaggtaacaacgtggaatgtgagacgtcaataaaagttgagcgaggcagcaagcagacttgatgcgtgagttgaacaatataccaagaaaaagaaaaaagaaaagaaaacgaatgacatgcagacgaccaaggtaaaaagcatgcaagtgattattgaaaaaaatatatgaattttcgaagtacataatacctccgagttatgtaataaccatttacttcgttataaattgatttataatagtgtcatatattaaaaaggggaaaagtataattaaaactagggagagtatatttctatatataagaatatatagagatatggaagagatagatatatacagatatatattcttataagaatatataagaatatctcaagttggaagatgaaactatcgctaaacattaccatatatcaaatatttattttgctatatttttgtatcattttcctcttactctacgtatagcaccatggtccatgtttttttttccaacttattaatatgtgccttttctcatatcacattagattttattttactttttccctctttgacgtcctggccttgaatttttttattttagatttttttaataaataattttaataatatacctcctaggaacttattttaaaaaataaatctttttgccacgccacttaagctggtgcggccaaactaagcagccacaccaccgctcttggcgttggcaaggtcaaacaggcactgacgtggtgggggtgaggttggtgggggtgaggttgggcttgccatgccatcccatctagcatagttgggggaaatataccctagccgtcgccgccgccgctttctttctccttcctctatcgtgttcttgcgctctctctctctctctctgcgcgaagtaaccgacgccccctcctcaaatccattcaaaatccagtgttcttgcttcgatgtgaagcccttttgagtgggaacccaacccgtaaggtatatatctttttttggtttcttttctcttgtttttgcatgtatttgtaatgtctaggattgtatgtaatgttgttggaatatgtggtaatgaggttcatgggatggatcggaatagatcggggtgtattatggagtagttctcatttctgttagtgatatttaagtggaaaatacctttttagttcgaatgatatggttaaaagtggggttagacatgggagagcacggacacattttttttaggtttttgtgatcatgtagggatgataaggtcatgcatccagtgatttttttggtgtataagttgtcggcttctgccttcgtatcgttctataatgagtatttgatttgcatgtgaatattgtgcatgtagatggatcgtgtggtccgtgtatattctggtggaaccgttagtgcaaatggaaaatttgatgagatgaaagtaggtgttttagtgtttgcgagcagtcctacgtgggcacaattatgtgatcgggttcgttctaaaatggaacatgtcgtacctacgaacgtgatgagaatggaagggcagtatgttgcaaggtttggatcaggggaacattttgtgatgatgccaatgtcatgtgagttggagtgatcgacgtatgttacatatgtttcaagttcacaagttcgttctatggatgtggtggttacaacttgtgcaaatcgaagtacagtagatctagtatccttagattgtggtcattccttggaaacagagcatgaactgatagtggagcatgagggcaagttttatagtaggggtagttgtcacatctaattttatccatgtaagataagaggtgatatatacaatacaccacatctacaccacctctatcattttaacccaaattatttttttatttgtttgtccaatcccctctttctttcatctcatttttctttgggtttgtgtggaggttgcccttgcatgaggggtggctcaccttctctttcctcaattattacttccacctcatcatccaatcctacatggcatttttaggggcaacacattaagagcaagtttaatagtatagccaattactagctccaaatcatctatagccaatataatagctaattcatacaatagttgcttactatactattaatatctggtcatacctgttatacacacattacatcttggagactgtgctgcagctggctacagatctgtagcccgctgctcttctctcttccttttctctttaaaatatgtttatagctggcttatagcctgctattgtacctgctcgcatcatagtacttgtcctgaggagactttgacacaggatcccccattagcggagatagctggacctggtaacgagggtgtaatactgttggtagaacctagtagtgtctcaaacaacaatgacactataatttgtgctggcacggtttatatgcaaaattttgaattgcatgggcacaaagtgattatcgagttttatactggagatgaggtttatttcaaaatgaaaacaaatatatcgattttttttcatctatagcaaagtacgggatttcaggtacacgttgacaaattttacataaggagctagcctgggagtttttagtttttaaaaatgaccgtattgtgtcaaaatagtttggtactccctccatctttttttatatgacaaccgtatacaaatcaaaacgtgtattaatattgggtctatctaaaaatctgtcacaagtttttgagaaaatactttcaaatataacattagtgtaactacattgtgattgtagcgtaactatattgtataactatataaaatttgtatataagttgcttgcaactaatagaacattttcatagctcagttggtagcatgcgtgtggagcataaaatttatagttcagttcttagtaggtgggacagatggttgacgccgagatggttgaaaaaaactagttaattaaatgttcattctaaaatacttaagaactgaactttataggcagcaatgcttgatgcagcaacaaacgacactccgatcttggtttgagtatgtcattcaggagtataaagttcctgcatttcaatggagcataacattttaagaagcacttttttttgctggccggccgaaacgaccaattttattaagattggaagaatttttaagaagcaattgtctttgaattcaggtctctgaatgaatttccatgaaattgcattgtaggtgagacaacgaagtttggcatgaaccggaggatggggtatgcccacatgggcgacggccttgtttggatcctccgggctattaaatagctatccggattcttgttatttagaagtattaaacgtagattactgacaaaatcaattccataacccctaggctattttgtgagacgaatctaacaaggtatattaatct

SEQ ID NO: 38511 - DNA, 2082 bp, Oryza sativa
atgggtctgtaactccaataggagctagcttcaactggagtaggagtttggagctgggagttggagtttggagccgtaccaaacggggccgaagatgcgttggcctgcaaggctgcagcggagaggcgcgcgagacagttcttgatggattggatcgataacaggggtcgtcgctggcgcgcagtgaggacgatgctgacgctccaaaaagatctgtcgtcgcccagtgccccttgttccatggccgctcaccccctcttcctccactgcttctcgccgcaccatccgccgccaccaccgtcgcctcgctccatggtcgccttgctccacattcgcccaccccgccctcctccaacgccggcacatggtgtggatgaaaaatgcggggagtatggcgcctgctcggagtgaagagggtggcgggctaggaggctggcggcaagcgagcggttgccccccgctgctctgcccgccgctgagctctcctatcgccgctcagcccgccaccggcctcccccgctgaagaagagcagagagaagggaaggagaaaaaaaaaaggtgcaattgacatgtgggctccatgtagttttttaattttattttttttctaattaggttgccacgtccgtgaaaccacccgtatatactgtcataggatcttgagtgtatggtttacgtgagtttagaggtatattttctaatgttgtggttaaaaatgttgtggttaaagtatcttaaaaaaaatctctgttgagggaccttcggtgaactttattccatcacaatatcacacgcgcagctgcaggcagatgaataagaaaagcgaagcagaaacataaaagagagtttgtatgactagcaaaactgcaaaagtgtcaatgtgttgtaatgaaaaaaataaattacgaaataaatcaaatccttcgataattgagatccacacaaataaagcgttgatatcctaattgatatttgcaaacaatactctaaattgaaatttagaaaccatatatgtcaaaacgacatccagagtatgatgtatgtgcaaaatgacatttgcaaattaatattatgtagcaagtttttcattaaactaccattgatattataacaaatgaatttgttaataaacacggtcatgtacttttgtttttttaatgaaaaactacagctaactaactcatgaatgaagagcaagcccgcaatttattttgacgattttttttataaagaacagcatctatgcaaaaataaagaaaacgataggtggtatcgacagaatatgctttgctttcttcaatgaaaaaattgggacggccatgtacaggccattgaggcaaatttgagacgggcctaaggggttgtttggatggtgactatactttaccacaactttggcaagctattttgaccaatttagcctagtgtttgcttgattgccacatctttatcatgccatactttttaattttgtgaccccacttgtcatagatacatatctttgccaacatttgcctaacttgtggccaagaatttcttagccacataaattgtggcatgccacaccttagctatagaactttggtaaactgaagcaagcatccaaacagcccctaaggcagacaacattgaggcgggcggcgatgggactctgacgcatactactccgacactgtactaaaattttgaacctaaaatagactagccaagatgtccatgcgttacaacgggggtatgtaaggaggacagttcattggttccactgcatgattgagtgtgtttaagttgttttttatcctatagtttttctttattataaagagatattttggaaatatttcctgagacactggtaggtaggaccagcatatcagcgagagggggagcgccaggtcagctatcaccgtgaattgtgttaattgagttcgctctctgatcagcttaatctttgtcaatggcgatgccaacgccatgacaattcttttcgttgatgtacgtggagggctgaggcgtcgaagcatatcaaggaaaggctcatgaataatacattaaggtcagtgaggttggtgaacaaaatgcta

SEQ ID NO: 38512 - DNA, 1241 bp, Oryza sativa
tgcttatatacctgatgagtacccgaccatgcatgtggattaatatattatatgcttataccatgtctgattactagtttaatcgtccacccctatatcatgcctctgcaatggatatgctctgctcatgttcttatgccacctcctcctgccaaaattagcttgagcatattcatctactagcggtcattgtccaattcaagcttttatttatgggttccccttaccgttttcggcgtggttaccggacccccgcggtaaccgccaaaaaccacacaaatttcagtttcaaaaatttgaattcaaaacaaccgtgataccgcagttttgggcgcagtttggggcggttactgcggtatttgcgcggtaaccgtgagatgtttggccgaaagaagaacaaaatgaaaaaaatgcaaaaaaaaaatgaaggaaccctgcgccgctgtgcctcaagcagggagagagagagcgcgcgcgatagagagagatgagagtactatgagatattttctctacatatgggccttaatgggccacatgaccagtgaagcttaggcccatttcattatttctttttcctatttcctaattgacttttggtattaccctcgaatttgaatttatcttactctttttcaagaaatttcttcaccataatacactacaaatcaagcactacatccatggattttttttattttttcgatttttttaaaatttttgaatttgctcaaaatttggtaatccataccgccggtaaagggctactgaaccccattggtaagcccagtaaccggttaccggcggttttgcaaacctgattactactgctttcgcaatactggcaagatactagtagtgctattactttattacacattcaagtgatgttcaggcaatttcaacctattctgtggatggcttcaagtttatttttaacagccttgcctacctgacctgagtagtactatatactgacagatttttacagttaactgtcttcttaggcttataagcaatgtcattcgaggtacacaagtctgtgttttatgcaaaggatagcactcgtggggaatgctttgttattgatcagagaaaacttcatctggatcttgacgggaacccaaccaagctgcatgaagccacctatataatgggtccaagcaccataaagtgcttggtgaagaatggcactgcagagaaaccattaatgcttaaagattatgctattctcaagaaca

SEQ ID NO: 38513 - DNA, 21511 bp, Oryza sativa
ccatatcagcagtcgcccttcaacaacattccgccaaatcattatgtaagttgattaccatctttttttttgtttggcacttaatcccattctgtttactgccactgcatgtacctgagatatgttacactgaatttattgccattaacatggacaagatagttactctagtcatttgatgttaactattaatttgaaccattgttgtagtggaatcagcaaggctctggattgtcttctacaacacaacatttaccctagcgagattcgaattgaagatgtatatgttcgagtgaagggtggaattaccacagttaaactgcttgtttatgaaggtgtgtgcctcagccttcttgtacatgtgaattttctatgcagtgaatcttacttgttaactttccgttaaactttttttataaaaaccattttggttttttgggcctaatttgttcataacatgtatgcagctcaattggcaacatcaagaaatactactgctagtaatcagaatgcacagaggatcaaactgtggaaagatgtaaaaggggttgcagacaaatgtgtagaacttgctgggcttaaaaagcagatccatcctgactgtgataggtttttgaaatatattggtgctgggaatgtcaagtggttagaggattacccggatgaatggaatgatgacaaaaaggcctgttacttgaaggcacttgtggcgtctgattctaaatatgtcagatccaagctgcaactcattggttttacatggcctgactacagtgacttcctcaacaacttgataactgatcaagtgaccagattggacataaagtacaacattttggatccttatgactacctgcgattgtgcagaaacctggtcaaacattggctctctctgccctctaatctacgggtaagttcaaatagacaaataaaaccatctacaatactggaatgattatgaatggatgcgagcatgtaccttataacacttcaaatgcaggagaagaatgatgattacgctttcttccttcgaaagatggagaagtggacaccgaggatttggtgtaacctgtatgaggccattgggtggcctccgaagtaaggtattccctcttctcatgatatatcgtctccttttacacgggtagtaaggggcgggtaaaaagacttgttgtcttctcggggtggacgatgcgtagacccggattagttgaggctacaacaaaaccataattcttttatccattttctctttcttattagccatacctgtgatagtggtttgtatgtaactcccttttctcagtttggttctgtatatttctgagttgcagcagcaacaggttttgatcgtgtcagtgccaaatgaaagaaatatcaaggttttcggagtagcagcagcttttgacagtgtgagggacagatttcgatcaaggttttctgagttgcagcaatttaagaaaacgcaatgctgatggagacacagtggacaccactattacttttctttttgttcggcagttttatactgttgaacacgaacagtatttaagtagttttaaacacaatactgttggagtagttttgtttgccgtgggcaaccgactgttgcaattagcagtgaactctatctaagaagtgcgattggatgaactctctttagccatatgtatttcccgagaaaattgtatatctaccattgcataaggttggattcgctggaaaaacatcaattaaatgggtttcattagaatatcactcaaaactaaaatattttcgtcaaaataccattccaacgaatccaatcttatgctatgctagatgtgtaattttcttgttgggcagcatatcatctagttgcattccattgttcatggcgatatctaaagtagtgaaaaatcaaagagtggaagatctaattaagctcccagatcttcatgaggcttgtataattccaagagaagctagacaccagagaagcgaaaataaacgaatcaaaataggaaaaaacacacacacagaaacacaacggcggcgcgttggctgaagccttcctgaggcggaccgccccatacggcagggtggtgcggttggccgagctagccgacggcgccgaagacgacgccgccgccgccgccgcactgtgtgtggctgtgccgcgccatatatctgagtcgaggtaacagttgacgaaggcataaataaagctgtgaggacctgttcagatcatagatgtccaaatgggcctcctggcccgacacggcctaggtcagtcgggccggcatggctcgacctacacgccgggccgggtcatacctacccacagcctaggcacagcccaaaaaaactcgggccggacgaaggcgtgacaatatatatttgcttctttatagaataagtttatttgacctcccttatctatttgggttgtgtcttataaagctgaaatatggctattctatctccctcctctctttttggacagggccttataaggctgaagtaagtctattttggttccctcaaatatttttcaaatatgagggatagagagggaggtcaggaggaagaatggaggaaagaggactaacatggggccctcattattattattttttttgatctcggggcccttatttttttttgtgtgtgaatgacaaatgggtcccactcatatttttttaattctaatacacataagtgccacatcaactccacgtggaacgaagaccgagtcaacaccgtcatgtatgtgccatgtcagtgaaatcgtcctccaaaaccgctgagggagtcaaattgcaccaatttaaatagttgggaggttgaaatatccgatattgtgattcaaggatacgaatcaaattcgatcactacttaagggagtcatagtgaacttgttcctaagcggattaagagcgtagcgccgccgcctcctactgtcgacgctcaccgtcatcgccccataagtggcctgggcggcggccagctctctgtccatttcatggaggccggagggagaacagggggcagcatcacgagaaaaatctagggggttttcggctagctacacaaggtggtggactatacaatataatctagatttgaagcttcacccttttatttggtattaggtcgctccttaatattcgcgtatgtttttggggggcagcatcacctgcagggcgcggccagttcatcgcgatagtaatggacttatttaattgaaaaatcattactcattggccattgaaaatcagcccattaaagacagtacttttgcattcccattagtctctattaagattaggcaacaaacgaagttaagcttggatttaaaatttggtgagaatgtattttatatctacacctatctaccttacaacgcagagttgccaaaggcatttgtgccacggtctcctaaatactattaaatgtgcccgacacagaattttgtacaccaccatcgtaaagctatcggcttttatataactcaaacacaaaagagagaagacccaacaacctggtccaaagaacatgcaacaaaagaacaaatttcgcactcaatgcagcttatggacaaatatcgatcactccgcacctcctccacaccccaggtcatagcttgctctggaactgcaaaaggaacatcgatttatttcattattatttttgtaaagaacactagggcctgaagttaattttcaaaagtaaatatcgttctggtttcgcccattatgcccaacagacactatcaattccgtcaaggatataatgccaggtaacaacatgcatccccaccagacctttcgacagataaaggtaattccaatcacatggcaagcaaacttggcagctataccctcaccctcctctaaatgcacttgctctaaacaaactagtactcctaatatttcaattccatggagatcagaaaaatacagaaaacaagcaacattgatatagtgattagaaaccagtcatgtcagtagttcggtacaaacggcagttagcttgcaacaactaagggaaacagacctcccccaccccccccccccccaccccaagcaaagcacagacacacatgtgcattctgtagataaaagtgccttacctgagatggtcatagcaagggagttagatatacatacttatattttagagccactaatatgaactaggaaatgaataaatgaagcaatttacttgataattttccaagaaaaaatgtttgtgttaatagctctctgctgtttcctgtcaaaaaaatcaggaaatttcttcaccccatgatagtattaaaaggcatccagtgagaaacaactgacaaagaagtatgaaaatatgaatgaagttaattgtatattacctttctttctaaaatttgtgagcttcacgactggagtagaacattcaaggaaacaatatgtgttctctagagaaaagttcccatgataatacccgttgagaaacagctgttccatcccgtcaaatattcctctgaaacaacattacaaaatcattcacggaagcactactctcaaaattttaacttcactcaacttagtgccaacaaaacagacctcaaaaccatctggagatggggtgacggaagtaagagagttgcaccaacgggggcatgaaaccgagctgttgacaggagcaattgcacatattctgataacacacgagtgtaacgctccatccaggccacattaaaggagctgtcaccaatgataacttccttaataattccaggatgtaatatgttctcatggttacacgatctcattacatttaagcaatgaacatcttctccaatgcccaaattcatgataagctctgcacaatgtcccacattatggggatatcttgctggcagtcttgaaggcatcttcaacctgccagatgcttgttgatgctttagactcagtattgcagaagtcagctcgtacttaatatctatctgcaaattgcaaaattttgtggggtgaagaggttcagcataaaaaggtatcaacattttaaaataggattgcaaatgcacccaagatgtctagcaaccggctgtttctatgtttgaccatgataggtgtttcatttcatgcctttgaacactggcaagtgtgtgaaggccacagactattcagatttcagatacagaggtttgacttaactaaccatgcagaccattgaaatccacagaaaattgactggttccaataaatgaataaggcgacatatacataatagaatatttgtaccttgttccccttatccttagcttctgattgatctgaagtaaaaataaaataaaatgctgaattagagataagattaattgattcagtcttaattatgcacatcctatttctctaagactatctaagagttaaaaaaggattatcttaacttattaccccatggctcagtacaactgtataagtagcaaaagtacaaataaaataccattttgaagagttcttaatggttcacccatgatggttattctggaagctggcgtagcaatcttctgtggtatagaaatctggaaaaaaatgccattccaacataacacatttatttatgaagcaatttgtatgaatatcatagcttggacacatacatactataaagctagaaaagaaacaaaccataaacacctgatatcctgggttaatatcatggaattataatatgctactacaagatttccctgcttgtacttcaatgtgtacatctatcaaatgttatgcagttttttttttttgaataaatcaaatgttatgcagttgctatgtcaattcctagcagcggcataattgagaagccaaattgaaacaagaagtgcaaaccataactagtatttttgagaagtgaatgattaaattttatattgcacagatgtcccagattaacatgttgggttatattcaaattctatggaagtatctagggtctgcaatatgagtctgagttggttacaaaagctgttttcgcacgtgcatactatctcattaagacagattgctcgtgtggatgaatgggtcggtgactagtacaagctaatgcactacaaaagggtaaaaagcatccaaggtcatacgaagtgaccattaaatgtatatgcactacaaacattaattctaaccagcacaggatagaggtggtctcattatagatcctggtttaggatctatagactataatcacccattgagtcaccacatggtttttttttctgcaggtcagcaatgggatctctcaatcagctgacaacaaaaactattttctttaagaagttgcaacaaaacgttttattctatgtgaagaggtacaggcagtcttgacgataatgtgagtaaacggagttggatacaaaacatgaaatttataaaggaatactgactggtatcttaatgacaacctgattgcaaagtatcccaactagtacaaggggccaggaaaaaggaagaactcgaatgcaaaccaaatgaaaaggagtttctgcaagttaagagaagtgtatggcaaaaacatctttactttttataatagtagagaagagataaaccgacacaaggcacacaagatcatcaggagaacaagacaacggcgtaacagcattgggatccaagcgaaatgacaagatttagaccacacggcacgtgaatgtttcacgatttctccgcgtggagagaaaccgatcgatacgcccgagatttctccaccagatctcatcctcatgagtacaaatcgaatctacattgacattgttgcacaaagccccaaggaaagaagaacaaaaaaggccacctgttggcatgtcacgtgtgctaggaacgcatctatactatacaagtacaaagcacaaggtagttggatctggaagagaagatcatagtcatagtgtctcaccggtgtaagccgcagggcagggcggatggagatgctggccggcggctggtcaggtcttcaaggcggaggcggaggccgccgccgccgccggcggatttttccttttcttttcccctccacctcctctgcagcagaagaggggaaatgcgaggaggccccgtccctggtcggattgagatctggttcagccgttcattcttacgatcaatggtccagatcaatttctacactgttcacacctagggatggcaattatgccaatttgcccgtttacccgtgggtaaaaaccctattagggttgggttgggtttgttctccattttatacccatgggttttttattgggtcaaaacctatgcccgatgggtaaatgggtatgggtatgggtaatcactacccatgcccgcttgcctatttacccgtgaaatctaacttacatgtaggctaggagcaaaatccactagaatacataagccgcgttctttgttttctacggtttccttttatttcccttattatttctctcccccttcctctatcgccgctagaggagagacaccacaccgagacggagaatatttgatgttaaaagtttgtagacttttttccactgcttttgttgtggcgggtaaacgggcacgcccgcgggcacaaggcgtccgtgggcgatgggcatgggcaacaatccttgcccgtcatgtagtaacaggcatacccatgggcacaaataatctcatgggcacgggtatgggtagaaattacctgtgcccgtcgcgcccgattgccatccctattcacacctgtcgtgtagtacttttgctacaatttggatttagatccaatgtagcagctacaacgtcttaactagacgaataaccgccgcgttgctgcgaaaaattaagttagatagtatgtataaataagatgaaatatgaatattaaaactaaaacaaattgatattatgaattttgagtcctaaaaatgattgagattacttagtgttaaaagagaagaaaaaaatgacaatttcaaccatagaactatcatccaatggataaataattggggtgatgtggcttaatgagagaagagagacatagtattaactacacttagtggggatgaactatataagtatataggataagggcatgtttaggaaattaagagtctgtttagggagcttaagggtctgtttggtacagctccagctccacctctcctggagctagagctcagccaaacaatttcagctccaccaaaactgggagtggagctctctcacaaaatgaactagagttgtggagctgggtttaggcagttccacaactttactccagacccaactcctagagctaaatttaggagttggagctgtaccaaataagctctaagattatgagaagcagctggttgatagccagcttctgggaatctggaaaagctgggtttctcatcttctggtttctagtttattttctgtattctacaactacaacttttggcttgccagaatctggaccaaaagctggactgtctagggagcttctgattctaggagaagctgcagcagttagaagctccctaaacaggccctagatcccctggcaaaatttacatccatgtcacatacacgtttgaacacatgcacggagtattaaatataggctaaaaaaataactaatagcatagattgcgactaatttgcgagacgaatcttttaagcctaattgctacatgatttgacaatgtggtactacagtaaacatgtgctaataacggattaattaggcttaataaattcgtctcgcggtttactgatggattttgtaattagtttttttattagtctacatgtaatacttcaaatgtgtgccgacatacacgatgtaacactgtaaaactttactcccctgcatctaaacacagcctaagttacagtccatactactactgcagcttccagtccacggacccttttcacattcaaaattaaggatccgccccttctcttactcctctgtctaaaaaaaaataatctcaatcctaagtttaaacatacatacatacatacatacatttatgtacatatatatagtatatgtatgtatatatatatacacatatacatatacatacatacatacacatatatatagatatggatactcatactctatgtagcaccaattaatttacctacctatatatatatagaactactatatggtaccttaagtgctacgtagctatatggcactccacagatcatcttttcgaccctcacccgaacgtagtaaatttttaactcgcggctcccaccagcatctccgcaccccaccgtatcctctctcacaggttcaaataggacgccactaacagatgcagcgcgccaggaagcttcgtagagcgactcacggtagtccccgcgtccggtttatctgttcaccttcgctccctcaccggtcatctcggtcaaaatattactcatcgagcgttgtttccgtttctattgctttttttaccctgttcgctctagcacgagagattcatctttctaatctacacgtggcaccatgggctaaattaactcccagcaaaattatgcttcagtaaaattttcactccctatatattaggtgctcaataaatttctccaaagtcagtaaaatttttactcccgtatacagtttggttgtgggttacactgacatggtttgggagttaaaagtttactattagtttttgaaattataatatttgatgatcaaattcagttttttttttacaatacccgtctcccacaaacaagtcattttttgggtgagttagcttttgcatacttgttaacagagatgattgtttgcattttttttgtaatttgttgttataaaaaaatgcatcccaatacgtataagtttttacatattcattagaaaccttgtttttttacatgggatgcagcttaataagcttaaaaacatggggagactatgtaaaaaattaacttggtatccttactgagtaataaattaacttggtatgacaacaaaatttttactccatatacatccacacaatctataagtataagttaatttttcgttcgcgcttgctccggacatcgacggcgacgcgttgtggaggtggccgccacggaggtcatgccatgcgcgtgggcgcggagcagcggccggatccgctgccgccttgcctaccgctcgtagtcgcccgtcacagccgcgcccgccgtcaccagtgcaggatccacactggatccgctgccacgccgcctgcatttgtgcaggatatgccccaccgcagccggatccgcgcgcgtggggcgaggagcggcgaccggatgtgccggcgtgctgcctcctcgcctcccgcctgcaatcgcccatcaccgccgtgcccgcagccatgctgtgccggatccgctgacgccgcgcacgccgccactcggcggtggaggcggaactgccgcgtctctcccgcccatagtcgcccgtcaccaccgcgcccgcagccgtaccgtgccgcgtcattatgtgaggcaaaaaattacacatctataatgtgaggaaaaaaattacacatctataaaaaggacgaagattcattttacagcttaaaaaaggcacgcagcagtatccatcaggattcactgaaggtggacgacgaccacaaacggcgtgcaaaaattacacaacaaaatcaggggcaacgcgcggatgtgctcgccgactaccgcgcacggctgcgtcggcggaaggtgacgccgacgaccaggacaggcttcctctatgcccctgattctgttgatgccgtcctcgcccgtcgcaacacaggagaggagtcagatccagcagtgcgccgtctctgtccacgagctgccacctaggctcactcccttggagcaaaccacgtcgctggtgtagggagaggttgtcgccccggtggccgatgatgctgccgactgcccccagatccggaaaaaaaggatggagattggagagtgaatgggaacaggttggattagggtgccaatagggttatatattcagtatattggtaggtaaaaaatttactatcatggatgtgggatgacgctgccttggcaggactacgtggtggtttgcgatagtgataaaattactctggatagtgagaacaaaatataataagaaaaagtatttttatgacataaacaaacaaataaaattataaaatctgtggcacgtaatagtgagcggatggttatgctaacttgaattaaaacataactagtaagctaacaccatgtagagtaaaaaaagatgtcgtctgacacgtattgaaaaaaaaaactctagttgaactaaaaatgttaaatagagttaaataattactccatatgaatagttaacaaattactattgaaaactgtcagcacatatagttggcaatcaggcggacgtgcagtagtcaaaaattaactattaggtcaacgtgggtgggttcaggatgggggtggggtgtgcgcacagttagtgggtctgatcattgtgtcaggtgttgtttaataggtagcaccttaaggtgtcatatatatatatatatatatatatatatatatatatataactactatatcgtccgagcctccatcgatctgctccggtcgtttccctcactaccgagaaacaagccatcagattcaaattgggtgacataaggtaggcatgtcacaatgcgatataggatagatctcggctctacaaaacaaatccaacggccaagattcattcatgtcatcacgggttaaaatttaactccattaaaattttaactcctgaaagtttactcccagtaaaattttaactcctgagtaaatctgcgagttaaagtttaactcgtgatgtcgtggatgaatctcagccattggatttgttttggaggaccgagattcaccctgtgtcacctggtgacatgcccaccctatgtcacccaatctgaatcccaattcccaagtcatcatagatcggcgcccacggcaggcgatcttgcatactttgtctgattgtaaaatggtgtaaatgccatgtaattttttttgtcgaactgatgcaatgcaacactatgcatgtgtattatacacgtccaattgaagacaattggacgtgttgttttttttacttttttttttctttttagaaggcgatttttacggcttttttttatcgttatttaaggacttttttgccatctgtttttggaatcggagttgcttttttgctttttaaattcttttttacggatggatcttttttttgttttttcgctgttttgtaagtcggatggattttttttggccctttttattttaggaaactattggcgttcagtttttttttttcagaaggtgattttttggcctttttatttttttagacgttttattttcgctattttttgggagtcggacttcttttccgcttttttttccggatggctttttttgtcggagacggttgaatcgggatgtgactattataaagttgtgaattttttaagtagttaaggtttttttttacgggctatgacacgggtgatcgctgttaaggaacagggacgatgcaacttaattggaacactaagcggattaggatgacgtaccaaacggaccaacaaaaacatcttcaatttttataatagtagagataggacagctctattctacacctcccccttagtataactattggaaaaagtacaccgaaggtccctcaacttgacatcgagttacaaaatcgtcccccaactgcaaaaccagatacaaagcctcccttaactaacaaaatcgtttacattagatccttcggtggttttgaccccggttttatctgacgtggcgactgagtcagcgtgggacccatgtgagcctcatatgtcagaatgccaggtcatctatctccccctcttctctccctcatttctctctctctctcacttctctccaatttgatggcgacgtggcagcggtgatggcggcgacgggcgacgcggcggcggtggggggaggagcggctcgcgggctcccacgccggccgccacccacgagacccacaaggcggcggcgcgcggccggcggcagatgcacccgccgcacgggcctgccggaggaccgggcgagcgggggcggagcgggcgacggcgcggggagcggccggctagcggagcaaacgggcggcgggcagccgcgctgcgggagaggaagatggcgccgacggggagagcgaggacgccgctgccgtcgtcgtctttggccacagatctcgcgccaccggtgggagtgtatgagcgtggggcagctatacctggccaaatgggccgtgccaagccgggccggcccgagcacagcagtactgtagccggccaaggcccggcacggcacgccagcctgtgggccgtgccagcatggcccgttatcccgtgccgtgtttgggccgacgcctcagcccgtaggccagcacggcacgacacgtttactttagcgtgccggcatggcacggcccaggcatggcacggcccaccggttcatttatttttcctacgattttctaatttttcccatatatttctcatattttttatttttttccacattttatcctatttgtaccatatattttatgatatatttcctaaattttcctcacatttatcctatatttataatgttttcctttatattatgttttttctgccttttttttcttttttcccctcaaatttcaatttttataggccacatgtactagtgggccggctaccagcccacggtccgctacagtagccgtgccggcccggcacgacccagcacctccttgggccgtgcttgggccgaggccttggcacgtgggccagcacggcacggcccgctacaggagccgtgcctaacgggccgtgccctagtgggccgtgccgtcagtgtgccatgccgtgctgggccggaccgcccgtttggcctgctataggggcagcggcgggcggagcgggcacgacgccaaagacaacttcttcccgcggcggcgccgccccagcttcttcccgcactcgcccgccgccgacaccacttcgtcgccgatgagaacggcgtgacgaacgccagggagctgaagaggtatcagtgactcgcactccttcagctgtgctgcctcgtcgacgacaaggagatcgaacgggcttgcttctggcaggtagtgcagacgggatgagctcgaagcttgtgcagactgcagagtatgcttttggtgttccggactaggaaatcttctaccgaacgcttgtcgaaaatgttcggaagttcaaagtgatcagataggtgttttagcttctgaagacactgagctctagcatccttcatctctgtactcacactatcttgcacatatgtcacgaaattctgatgccttgatgccttccagtgcagagcagaaatcagcacgagttttgtcgaaacatgatttcggcaataataaaagggggtagcgcacgagacctaaaagtggatggatgcggagacaaaagatttagagaggttcaggccctctcaatgagaggtaataccctactcctgtttggggatttgaatccgccgagcgtgtattgatctgacgatctagttgtgtcatcatgccccctagagggcctcctgcccaccttatatagggtggggggcaggattacaagatagaaaccttaaccaatacggtatcggtttcctaaatctactttacaatattatcaaaccaggactttaggccgttccgtaatatataaggaaacgtaatacccgagtcatgatctattacatattccatagatataagttatcccctatgactagtcggataaccatgccgtatgggtatggggtacccataatatccacagtagcccctgagaccttcgcagtcgaaaagataatcttctctcgaaccagaatactccaaagccgagtgcttcaatcatctttgtcatggtctcccgagtacttttaccaaatctgaagactgtggagggctggaaaataaagtcaggtgcaccgactagatgcacctaatagatgtagcccctgacaatgtggttaattgaacaaaccaagcatatagtcaaggaataaataattcaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagaaaaatagctataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctaaaaaaatgaccacaatatataatcagcctaagccataatattggtcaataaaaatgcacacttacgtggcaaaaagcaatgatattgtatccaatcaattgcttaaaaacccaaacagcaccatgactatataaaaaagtcagcgggccagctatataaagctttactgtttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaaaatatgccttcgacaccctttaaaggatgacgcatgtaacatgctcctgagtaataaatcttctgggtaatatagaccaagtgtagctcatatgaatagcttctgatctgaatgattatcccttatgggatactccaaaataaatataataattgaatcccgactggcgcaagtattcggttgatagcccttacggggaataataattggtccagtctttgagcatagaaaatagactcatgactatgaatccatgtggaatgtatccggaacaagtccaaattggagatataatcctcacgcttgagttgatgagcccctgagcatatagcttgtccttctgtcatagtcaaaattgtctattggcaatagctgacgcagtcggtatggagatgaaatgaccaacatgaagacgaaattgctcatcagaagtaacggaagatgtcagtggtagtaaaaacagtgacaccaatcaaaggtaatgaagttgcataaccatggaggcgaagaaaccagtcggcaacagtcaggtcagctagcagtgaagatgtaggcgcccaacaacaacgaaagaacagtcggtgatgacaaaagcaaaccgacgatgaagacgtagacgcgcatcaacagtgatggcgaaatccaccaatcatgaagatgaagaaaataatcggcggcgacaaacgcatccaacggtaatgatgattaacggcaacagagatagccgactatgatgacgaagtttcccatcaacggcagcagagttggctatgttgatgaggcttgacaagatgttgatgaagatgacgatgtcggtgatccagtcaatagcgatgtagcagccgatgataacgatgagatcctctatcggcagttgcgtagtaggccaaccgtgaagacaaataattggaggagagttgatgttgttgcccaactcgtctaaaccgaaatatttgaagttgttgaagtagaatgtctgttccgaagcaaagatgaagataatgactcctggagttgactcattggctgattaattgatttcttcagcttgacataaaatttgtcaaattttgagccttatatttgtgtagcccccgactctttggttagttgggaaacaactgaacatagagtcgagaattatagcttcttgtcgtcgagtagtcattgcttgattgaagatatgtgttgaaggtgtccaagtagaaatcctgaatattggagaatcacttgttgtagtaaaatatcatggcattgcatgccgagatgtcgaggttcacaaagacgtcgtggttggtgaagtagtaaaacttgcgaagtaacagcaatagagtttgccagtgccgaagataataaagatgaagtcgccccaccatgatgacaaagttgcatcgccgtgatgaagtgaacacgagtcggcggcaacagaagcaaactggtagcgaagacgcgcggttgtgaagataaaagcactagtcggcggcggcataaccagtcggcaacggaagacgatgatgtccatcagtagtggtagctgtataaaccagacgtagaggtgagggcactagtcagcagcagacgagacgaccggcggtgaagaagataaggccaatcaacactggcagaatcatgcagccatggaagtgaagaaaccagtcggcagccatggcaaacgtaggcagcttgtgttgaagacactgatgcctattagtagtgacagcgatgtagccagccgtgaagaaggtagcatcagttggcgttataacaggccagccgtgcaggcggtgacaccagtcagcggcggatgcggcggccggtcggtgaagacgtagacgcccaacaacggcagcataataagtctgccgtgcaggcggaagcaccaatcggtagcggcgaaggcaagccggtcggtgaagacgtaggcgcccaacaacggcggcataataggccagccgtgcaggcgaggacaccagtcggcggcgacgaaggcaagccggtcggtgaagacgtaggcgcccaacaacggcggcataataggccagctgtgcaggcggaagcaccaatcggcagcggcgaaggcaagccggtcggtgaagacgtagacgcccaacaacggcggcataaaggccagccgtgcaggcgaggacaccagtcggcggcgacgaaggcgagccggtcggtgatgttctgactgatccattcctggagcgtaagagataagcttaaagccatgaatcccttttatgcatatctggatctggatcctgcagaacaaacatataggatgagtagtatctgatatataaatataatactcgagaaaaaaatcaagtattttaaaatatttataaatatgtatttctcctcttgtcaattttgatttccccgagcagatgactctgtacgtttaaacactctgtccgactagtcataaccatcaagcaccgggagtcggcctaggcacttcccaaacatgcatatgagtgacatgagttcgtcattaatggaacaaagtttcacggatcagaatttactactcgggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgacaggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagcggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacggcaacgaaggtgagccaacggtgaggatgtagacatccaacaacggcggcataataggccagccgtgtaggcggaggcaccactcggcggcgacggaggcaggccggcggtgaagtcgtagacgcccaacagcggcggcataataggctagctgtgtaggcggaggcaccactcggcggcgacggaggcaagccggcggtgaaaatgtagacgcccatcaacagcggcataatagaccagctgtgaaggcgaaggcaccggtcggcggcggacgaggcggccggtcggtgaagacgtagacgcccatcaacagcggcataataggccagctgtgaaggcgaaagcaccagtcggcggcagacgtggcggccggtcggtgaagatgacgatgacgcccatcagcggcggcggagtccaccgaccgtataggcaaaaacaccagtcggcgacgtcgaaagcgggccaatggtgaagacgtggacacccatcaatattggcgatggaataggtcagccacgaaggctagggcactaattaacgatgacggagacgaccggcaatgaaagtagaagatcatcttcggcaaaggaagatggcaagcagccggcgctgcacatcggtcagattgagcccagctttagttgtgtcctcgttggatatgtgaatacatgcgaacaagcaaatcagtttgattagaaaacaagaacaaatatgcgtgcatgctactgtatatgctcttgtatatcaattaaatagaatattcttgttggttgaccgttgtcaagcttgcatgcgagatgcatatgtgtaggcgcctggatcgtcgacagctccgtgcggctgaatcgtcggcaacggattcctactcagccgttgtactgtagacgtccgatcacaccaactccatacgtcgagcgaagcgtacgtgctagcgccacctcgcacgcagctcgcggcgcacaaccgatcgaaccgtgcggtgacagcaaacggcgtgacctgaaggagaccgttcggccgcgcatgtgccgctccagaaaaagtcgcgcgtggctaccaatcggatcggcaacgacgacgatactgcaagcaaaagcaatatcatagcagatcaatctgcatttagaaattaatctaacagagcaacagattggaacgagaaacctggcgtctctttgtagatcgatttgataagaagatgattccaatggcaacagattccactggcagatgaaaagaaaatactgaagttgaacttgattttttctcctgttctgtgtatggatcatgttgctatatatccggctccggcgacttcataaatatggaaggtggaagggcagcagcggctccaccgcggcagacttgaagccctgaaggtcaatttgatcttggcaaaatcagtctcgccgaattaatcagtcgacgtacacgccggcagccgggttgcggagtcgttggaagattaaacccggtagtgttggaaaattggctgctggtcttgccgatcaaatagagaattcggcggcaacagtgattaggtccatcgccaagattaattcttccatgtacttaacaggcatacgccttaaccactcggccaaagcgtcccggagtaggctcacgagcagtcggctacacagcgacgccaccaatccatgagccggtgatattggagattaaatcgttgaatctcgccgagattgatctttgtgactccaacaacatcggagattggttccatcacactcgtcgatgaggacctcgacgtgtcccctacctggcgcgccaactgtcgaaacatgatttcggcaataataaaagggggtagcgcacgagacctaaaagtggatggatgcggagacaaaggatttagacaggttcaggccctctcaatgagaggtaatacactactcctatttggggatttgaatccgccgagcgtgtattgatctgacgatctagttgtgtcatcatgccccctagagggcctcctgcccaccttatatagggtggggggcaggattacaagatagaaaccttaaccaatacggtatcggtttcctaaatctactttacaatattatcaaaccaggactttaggccgttccgtaatatataaggaaacgtaatacccgagtcatgatctattacatattccatagatataagttatcccctatgactagtcggataaccatgccgtatgggtatgtggtacccataatatccacaagtttcttcgatcagcggcacggtgaatgatcccatgtactctttcagcgaggagaaagttgtgggtattttcttaacctgcatcaaggcaagatcatccgcgagataatactcagattacagcgagagaacgagctggataatgcgatgtacactaccattatagtggaagagattgtgtgcaaactgcagttcatgggataaataggtactcccatgacactaattctttgccgactccgacgaccccgcccagctcgctgacctcgattccgcccactccgacctctgctttgccctcgcctccaggttcctcccctgtccggctatccgtctccctcccccttcccttcctcccctgatgccctaacccaccctccctttctccctcaggatcgagaag

SEQ ID NO: 38514 - DNA, 4265 bp, Oryza sativa
cagcccaactaccaaaagcccatcccaccctccctcccgatcacgcccggccctgcttctccagatcgtgcgcagcgccggcggccggccccgcctcccctcccgatcgcgcgccccaccagcgccgtggccggctccgcctccctccctcccacctgatcgctccttttttttcttcttctcttttctagaatcttctcttttctagaaaaaattaaaaataaattaatgaattcaagattagaacccatgatcttatggttcataacaaactctcctaaccaatttaccctatgacactatgtgatattattatttgttttctatgtatatctgttcaaattttgtgaacacaaatccattatgttactgtataaatcataccttattattattatgattcggtagtaacattatcgtagaagtacagtaacatgatatgttactgcgaaatttataggtcgttactgtgaaattactgcacttttacagttacatcatgacgaaattgcagtaaaagagaacatatgttagtacctatactactgtgaaagaaccatctggtcgggatataacttcggctgaaaaaacacaacgttgtccctcaaattatcgcacgagcaggatggccgctgcttcagctatccccgctggaacggatctgagacttgggaggatatgaacaggagagatgggaaaaggggatgaagggagaagaagggaaatttggtaatgaagggagaagaagggaaatttggtaaaaaaaattaaaaaataagatgaaagggtaagtaataccatgtatcaaataaacatgaaattgtaatggcacgtatttaatatgtgaatagtaatagtatattttaaaccatgaaagttgcaatggcatggttctaattaacccaattaaatatgccttattttttaatggtaggagtactactaatcatcttttaattaataatatttttatagattctagaaatataggagattaatgtgtccagccgtccaggatacttgttccaatttccggttcaaccataatatattgtatttatctgaagattttaaaaattatttgtgtttctttcttatttttccttcctagctccttttctacttggcccaagcgcgcgtcatttgggctgtacagcgcagcttgggcgtccactttttctagcctaacaacaagagagagaaaatgttaagtgtcgacaaatcttttcataagcatcacaaatcagcaacattatttatcactggccaacatttccaagcctaacagcaagaaaaaaaaggagaaaaaactgtagaaaattatgttcatatgcatcagaaatcggcaacattgatcatcattggccacctttcccggcctaatagcaggattctgttcatatgccatattgccatcacaaatcagcatcattaatccaaatttgccgtcatgcatcacaaatcagcgagtataatgcaacaatcaagtattgttgttcacttttgagtcatatggtatccgctaccatcttaaccagcacatatcctacaaaagccatatggcatccactaccaccttattaagtaatagttaactaataatccatccgtttcagattacaagatgttaaaaactgcttcaaatttaactaagtttgtagaaaaaataataacatttttaacccaagataaatttattataaaaattcaattattgatttaatgaaactaatttggtattataaatattactatatttttctataaacttaattaaacttaaagtagtttgactttgactaaagtcaaaatgtcttataacctgaaacggagggagtattacataaactgatgaaaaaaaagtggaactaagactccactgtggtgataagtccaatagctcgggcaatttctatcttttttctgatgtagtcatcataaaaccgcggtttatccctctacaaataaaagaaatctcaattagtaaactactccctacgtcccaaaataagtgtagttttacactattcacgtttaacgtttgattgttcgtcttatttgaaatttttttatgattagtatttttattgctattagatgataaaacatgaatagtactttatgtgtgactaaatatttttaaatatttcacaaattttttaaataagacggatggttaaacgttgggcacggatatccacggctgcacttattttgagacggaggtagtactaaactttttttaaaaaagtaagcatgcatgcatagagaacttcatatagtacagtaccagcttcttaactgcctctgcaatcagcccgagaacttcatcctctgcaacctgacaagtgggatgttagacataacaacatctaccagtataaatatataatggattgcacttgcatgtcagatacataagactacttacttcctccgtaatgcaagccgtgcaagtatgaaactggaaaggggaaaaaacgatgaaatgaataagcataaaacaaggcaattagataccacattataaatttgcaggtcatcaatgaacaacacaactaaattacctccgcttcccattgagagcagtcattgatctccagtacatatttcattttttgttgccgtaccggaaacctgttcagttcgtagacttccttcattgcatctctgaaactcatctggacatacatagttaaagagaaaacacgggcatcactgagcaaatacaacatttataaacatacgaaataaaccattatatatttacattacataaattttagttgtgcagctggggtatagtgttgatattgtactgaccttttgcttggtgacccgctgccaaatctcaaaatacacaccatctagctccttaaaaaaacaaacatcatagttcatgctagataccaattcctgaattgcatgagtaattcaactgttagatatatacaaaaccaccaaaatcaaattaaatagtgtgcaacttaagtatcatacatggaagccaagataagctaacttggcagtaatcttggggaatccggtggctatcttaactgcttggtagagtcctctgttgcttacttttccccactacatacagagttatcatggtgatacaatacatgcagatacaaaatttgtttatacaaataatacttgccttaagagatggccgctcaagtaacacataatcttccatccactgtttcataataaaaggaggctattagtacggtagtcaatgttttaaaaacgttacaaagttttaacacttgattaacttaatctatatatgatgcatagttgcatgtataccttaagtttctttgataattcaacatagtatttcgcatactgtttttcaacatcatatgtattaaaatacatatgatatctatcccaattggcatacatgcaaccctacaaaaagaaaaggggggaaaaatcacatgattgagaaaataatatttacaaagatatgtaatatatagcaatactcgtgcgcacacatacataatttttaatgactagacgttgatagtcaacaagtgcagcaagcttgcagtactcagggtggaagtaccaaacaaatgtgtaatcaaagcacttgagaacctcccagaggacctcgtcatcaacagaatcaagtgtgccatcattttcaaagcacataaggacctcctccaactgcttagacatgtcaaaagggtattgctctatcattgtatcatgatccagcttactcccagtcctaggcacttgttgtaacaactgcaacagtaagggcctgtttggcacagctccagctccagctccacccctcctggagctggagctcagccaaacagtttcagctccaccaaaactgggagtggagttgggtggagctctctcacaaaatgtactagagttgtggagctgggtttaggcagctccacaactccactccagactcaactcctggagttatatttaggagttggagctgtaccaaacaggccctaagatcacttacgagattatattgaatattgcaaattcaaacaggaggttaatcatatataacaacacctatatatacgaataaaagtatatgcaacatatataaaatgtacagaatatactagaatgcatggcttatatatgatgattaattaattaatatatagatagagcatggatgaaactaaccttgtagtacttcacacgatacagttcatggagttcatttgaagcatcgagctgatcgaaattcaatt

SEQ ID NO: 38515 - DNA, 1536 bp, Oryza sativa
ctttccaaagtgtatgaactttattgtatcaagatgtgcttacaaagtgcctccaaaaatactcccctttttctcttcttcttcatcttcttcttctccctcctcctataattccttgtttttgggtgaaccctagtgtatttatacctaaataaaaaaaactcccaatcacggagtaggagcagaactcttattctctccaaagccctcgtattccataccgatgacaatgtccaaattaaactctctccccccaaagcgaagtcctatccacatcccggacaggactctgcctgcgatcgatcgatcgagctgccgcatgggccagcttcggcaggcctgctgcgctcctgcccgactgggccctaggctctgggccgacaccacgtcctcgcgcaaggcccagctgagccgccgcatacagccgagccgactgcctcgctgcttgctactgatccgatccttgctgccacatgcacaccaccatacacatgtacagacatactctagcatatacacatgtactttagcattatgtactctatttcttttactcttcaatttttctcacgtacaccggtgtttgtatgcacaatttataaattccctatgcatagtctcggttgacaagattgatcctaataaggtcatattcttttctccaacattggatgaagattaagatttttgtggcacgcttttcaaactcctaaacggtgcgtttcatacaaaaattttatatatgaaagttgctctaaaatatcatattaatctattttttttaagtttataataattaaaactcaatcaatcatatattaatactacctcgttttacgtaaaagaaaattaattttcatcttcagaagaaaagaacaccacctaaatcgcctacacataatccatcgaagaaaacaaatgttctgtgagactgtgacctaatcacacgcacagctatatatatatatatatatatatatatatatatatatatatatatatatatatatattcaaaccgaatacaaacattccaaaaccataattacgaaaatgatttcacatatggttctccttgttggtctttaattagattcgtcatgttccatgaattaatttcctcctcctcttgagccggcgccgactttgcagtttgcacggcggttggaggacggctttcctgtgcggcatcttgcgagcgagcgggttcctcatcggcgcggtggcgggattttgattggtcgtctgcgcagtgcaccgcccggcatgcatgcgtgcttgtagtagtgttcctcctttctctccggcgggcggcggccaaccggtacgtacagtacataattattgacaaggaattacaatggtatactccatttacgaaagttattttaaactacgacacggtctccaaaacacaactttaacttcttgtttctataaaaatatttattgaaaagtgatataaaaatatttattgaaaagtgacatatgtatacgtttatgaaagtactccctccatcccaaaatgtttgacgcc

SEQ ID NO: 38516 - DNA, 1475 bp, Oryza sativa
ataagataagcggccacccatgtttaaaaaagtcaatggcgtcaaacattttgggatggagggagtatttttcaagataaatctattcatataatttttacattttcaaactcaacaacttgagagttattcttgatttatattcccaaggtttaacttaatcattctaaacgattttctttacgagtgagtacggagggagtatatagcaagtgtcagatatatatatatatgatgaatccaattaagcacttgtattggtaatacaaccgtaagaaacgagaagagacgtattttacggaaagactaaattcgcgtgcgttggcgcgccgcgttttaggcccacgcccgcatatgcgtttctggcccaccagctacagtcgattccaattccgtccgaccgccagccatctgccaagtgcgtgcggttactacaggattagaaaagatcattttataattaagtagttactaaactaagataacctttctttttatattggcgggagttttttttctctttctctactattataaaaattcacgatatttttgtcgatattttggtacgtcatccgtgtatgagtgggtttttaagttcgtctgcttttggaaatacatatctatatttgagtcggtttttaagttcgtttatttttggaaatatataaggagtcgtataagaaatctctttaaaaagactcgcatgctaacttgatatgatcggactcctaactgcaactcattgttttctagaaatatatatatccaagcgaactcccatagtgaattttatcttaactaaaccatataacaataataagattaaaataaacttcatccgttgcaacgcacgggcatttttgctagtttactaaaaaattgaaaatctatacatattttttcttaactttcaaataaaatctaaaacttcctaagaaattaaaattcattaaaaatgtaaaacttccaacttgagatttgaaaactttcaagtcaaatttgaaaactttcaactcgaaatttaaaaacttccaagtcaaatttgaaaacattcaactcgaaatttgaaaactttcaagtcaaatttgaaactttcaatctgaattttaaaactttcaatttgaatattggaaacttccaacccaaaatcaaagacttccaactcaaaaattaaaaacttccaactcataattcaaaaactttcaaccaaaatttaaaaactttcaacccaaaaattaaaacttttaatttgaatttttgaaatttcaacttgaatttcaaaactttcaatccgaatcttaaaacaaatgcacctaaatttttgaaaaatttcaactcaattatttatttatttattatttcattataaaggactacttaacgctaattgttactccttgttagcgctaacatttgctctacggcactaggctgtgcggttgccagcctgccacgcgtgtatgggccgaaaa

SEQ ID NO: 38517 - DNA, 726 bp, Oryza sativa
ctcaaaatctcttatattatgggacggagggagtataaatttaaccatttatcttatttatttatttttataaatatcatttattttattgttactcgttttatcatcaaataaactataatcttaatttatacttttacatatttatactaaatttttaaataagacaaatgattgaactttattcagaataaaagtcaaatgacattatatatgttaggacgaatcacacgcacaaacattgctttagcccttgattgatttaagattcgattcgagggcacgtatcagttgttggtcgccctatgctcgatcggctactcgcagtctcgctctcgctctcatcaccatcaggcgtgccgcgttcatagcgactggaacaggcacgacaagacgagccggggaaaggggcttggtttctcaagtggcaaggaagcggcatataccaaactctgttaggaaactataagcgaacaaacgataaaaaacaatagatcaatcatagaagacacgagatttaacgtagaaaaccctttcaaagtagaagagaaaaaaaccacggacgccagccagcaaaatatcttcactatatctggggtgaagttgcaacgccgcacggcggtttacaagaggtatatatatggtaaaaccctaaaagggatgtcgatctcttaattaattgagaggttcctgcccttcctttctttacgctgcaatgacgcaagg

SEQ ID NO: 38518 - DNA, 739 bp, Oryza sativa
agtcagccgtgcaggcggaaacaccagtcggcggcggcgaaggcaagccggtcggtgaagacgtagacgcccaacaacggcggcataaaggctagccgtgcaggcggaaacaccagtcggcggcggcgaaggcaagccagtcggtgaagacgtagacgcccaacaacggcggcataaatgccagccgtgcaggcggaaacaccagtcggcggcagacgaggcggccggtcggtgaagacgtagatgcccaacaacggcggcataaaggccagccgtgcaggcggaaacaccagtcggcggcggcgaaggcaagccggtcggtgaagacgtagacgcccaacaacggcggcataataggccagccgtgcaggcgaggacaccagtcggcggcgacgaaggcaagccggtcggtgaagacgtaggcgcccaacaacggcggcataataggccagctgtgcaggcggaagcaccaatcggcagcggcgaaggcaagccggtcggtgaagacgtagacgcccaacaacggcggcataaaggccagccgtgcaggcgaggacaccagtcggcggcgacgaaggcgagccggtcggtgatgttctgactgatccattcctggagcgtaagagataagcttaaagccatgaatcccttttatgcatatctggatctggatcctgcagaacaaacatataggatgagtagtatctgatatataaatataatactcgagggggggcag

SEQ ID NO: 38519 - DNA, 741 bp, Oryza sativa
cggtgaagacgtaggcgcccaacatcggcggcataataggccagccgtgcaggcgaggacaccagtcggcggcagcaaaggcaagccggtcggtgaagacgtaggcgcccaacaacggcggcataataggccagccgtgcaggcgaggacaccagtcggcggcggcgaaggcgagccggtcggtgaagacgtaggcgcccaacaacggcggcataataggccagccgtgcaggcgaggacaccagtcggcggcgacgaaggcgagccggtcggtgaagacgtaggcgcccaacaacggcggcataataggccagccgtgcaggcgaggacaccagtcggcggcggcgaaggcgagccggtcggtgaagacgtaggcgcccaacaacggcggcataataggccagccgtgcaggcgaggacaccagtcggcggcgacgaaggcgagccggtcggtgaagacgtagacgcccaacaacggcggcataataagtcagccgtgcaggcggaaataccagtcggcggcggtcgaggcggccggtcggtgaagatgtagacgcccaacaatggcggcataataagtcagccgtgcaggcggaaacaccagtcggcggcggcgaaggcaagccggtcggtgaagacgtagacgcccaacaacggcggcataaaggctagccgtgcaggcggaaacaccagtcggcggcggcgaaggcaagccagtcggtgaagacgtagggctgcagg

SEQ ID NO: 38520 - DNA, 6735 bp, Oryza sativa
  unsure (1)..(6735): unsure at all n locations
tttcaccaaggtctgagcaattcttttagaacgaatgaatatttacttaaccagaatagtagtgtggcaacctcacgtttgcagtttgtttgttaactgttcaacctgttctgttagtctgagaaatcaaagaaggctggacaccctccttcaactactgttgttgttgaattcctgagaactacgtacatgggaagcctagaggtccttctactggaagaagatatgaatttcaatgcccgtgctacatcattcaccgttcgtgttctctttctattctttctgacgttcccactataaagacatgtttgattttgaaaaatccatatcttcacacaagtatcgatgttcctctgcaggaggtcaagggaaaaggctttcttctagtttccactgacatagcaagcagagggtttgacctcccacaaaccagccacatatacaactttgaccttcccaagacggctattgactatctgcatcgtgctggaagaactgggagagaaccattctccaagttagcttgcagcgtgacaaccctcataacagaggatgagcactttgtattacagagatttcagaatgaactcaagttccattgtgaagagctacctgtagaatccatgttcgcatttaacttgtgacgtccctcactggatgtaaatagccatttctcttgatttcatcccccggttggaggtttttcttttttctgtttaatctagatgaagaggtttgaacaagtgtcctggttattttccctctggagagtggagaaagatgttgaacgtatttatattaaagcataaagttgttatgtatccttaatccttattcactggattgtagcttttttaatggaaattcccattagttgcaacagggttatacccctgaactcttcaatatccaaccagcattgactcgaaaataacagtatcaggcgatgaacaaggtaatctgaacatcctgttcaaagatttagaattcaaatgttaggtctgccttcggcgagagcatgattaggtacagagcacactcatgtcacacatcacactcttcattatcaacagaggagagaaatcggtccatcactcaacagagaagagagaaatcgatccatgagtgatgcggatggcagacagaaactatgaacatgatactctagtactcctaccatggaaactgttcagattcatgatacgagccaggaaaacagatgcaagattatatttcaggtgcgccaggtctgcagcatcaagagaagcaggatgggctcttccgcaaattactcttctttagtctccagcaatttggaatcgcaggccacgatcttcaccttgtttattgtctctgtaatctcttcgttcttgaaaattgcatctgttaggatgaaagtccacacattgtcgcagaacctgtaggtgtgcagatggccctgtgcagagaaaagggaaagccatcactggaaatgcaggcggtctgaactatacatgtgaatactttcaaaaggactcatggcaggaaagcacagtcaatgtgctaaacataagaaatctaattaagatatatgtaacacatcgacggtcttgagtgaagctatatattggcatatactcatcacttcgaatgtgtaacctcaatgcacaataaatcatacagaacttgaattatttcccataaagtacaacacaattgcaaaagataatcatgttacttcaaaagctttgcagaagtagccatcttcgacatacatgacacacaataaaagaacaaaattaatcaatattatattccagttatttgtaggtttgtccaaacaggaaccatgattgaaaatgttgtgcaccgctacttgaccttgatatttagaaattaacatcagaacataatcaatcaatattccagttattttcatggaaatttggattgtcccaaaagtgcttaacttattggtcacagtcattctcacagaaagtctatcgaattggtgagtagcctatgaagcaagcaggaattgccttcccacaaaagaatacacggtagatctaaaagaagactcctatgccacaaacttaatgacatgccaacatgacatagtaataatgttatctatagactgcactctcagtactcatttgcattgcataacttggatgtgtgcaaacaccatagaatgaattgatgattaacaagataagtcaacagttagaaagtttactaattcataactaaataacaacaatacggcattctcatcgattcctttttttaaaaaaaaatctacagctattaatgaaacctacagtacaaaaagagaatcaatagaaagagcataccttgacagtaaccttgctcttcacctgatgctccaaagcgctagtcatggactgaaacaacaagaacatccatatatgaaaaacaagtaatccacatccggcagcagtaatgaaggagaggtagggggttaagaaaccttgtcaaactgcacgaggacttggatggcgagctcggggctgagcgccccactggagaccatgtcgtccagcgtgtcggtgaggcacataccgatggtggacctccggtacagctcgaaggtggccatcgatgatcgaatatcgatcccctccctcctgcagataggcagcccagatacataaaaagtttaagatcggcatgcaaaggctgcggaaacgaactaatcaaaatcctccgggtctgtttgccggccagccgccgcaaatcaaaatctagaaaattcatcgatgtgatcgttcgtgcatatacacaagtatcgcatccctccctccctctatttggtttggttgggtgcggtgcggccaatcgaatcgagggcacaaaatttccctaaaaattagatcccgatcccaacaaaaaatcgcatgatcgaatcgaaccaagcaccagccgcatacctgatctgagactgagagcgagagcggagaggaggattgaggggaggagcaaagcgcagccgcagagaggaattcgaaatctggggcttatataccgatggaggccaggggaagggaggaggggatttggggattatataggcaggggaggcagcagcaaggatcgactatgtcggtgccaaatgccgattttgcccctccctctcccgttgacctggtcaatgcatactgctttatttccttttcttttttttttcatttcatttcattattattccttttccttttttcctttgattattattattattattattattattattattattattattattattattattattattattattattattattattccacgtcatcatttaccttttcatcatatattattgttctcgcttggtttagttacatatagtcgcttggtttagttatacatagagaacgtatttggctctcttttgtgttaatagagcgtttcagctttcaacctccagaaatatatgccacgttgtattggtttttcttactaagccaggatgggtgaaggtgatgaagagcacgatgaattaaagctcactagtaattgacccgtgctaacgctacggtaatatttagtaatgcaaattaaactattaaagtttatcattcttaaaaaaaagaatgacagagccaattactatattgttaattacatagcgatgtgagtaaaataacatcgtgacttttctatcttttgatttgaaacaatgcaagcctattgtacaacttcacaatcaggcatagacatagaagtctatagcatctaatatttgatatatatgtggttttcaatagattttcagtctccaaacttttccctttataaagtgatcacctggcctaagagaattgagagtccaagagaccttgcatcttctttccctcagtagaacatacatacagagcaaagacataagttgagtctgcaggtggctttgttgctcacccagtcaccaaggtcttcccaccgatcagaaagtactataaacttattggatctgggaaacaaatttacatgtgcatttcagccaattaaatgatccaagtacttaagtagaccaaaaatgcaacatgcttcagcttggtgtcatctacctcaaaagctaatggcggtgaaagtttacaaaataaatttccagttcacatatagtaccaaatgatctggaacgaattcacttttntggggcaggcaccgggggcccaacgccccttcaaaatttggatttcccaaaatgatattaccgctgatgttcggaatttcagattttcagactttcaaaccaaagttaagactttcataattaacttttatcaatgaatattccaaagtttagactttcagaatcttaaccatggtaacttataacttaaactgtcttatcatgtgcttccatgtatgcctatttacattctgaaattttaacatagctatatacatattctgaaatataccatgtgttgaatgcctgaatctgaaacaacaacattagttttctgcaagtattcattaaaaaaatatgcagcaatcttgtataatgtaccaaactacccaagcaagacaagcaagatgatgttgattttaggttctgaattaaggtaatgtaataagaaaaagaatatatttctaaaatttaatgattttcctcatcaatttgactatatcacaaatatactccatacattaattttcaaagcataggcataaagcttcaaaatgcaagccatagataaacacttaaagtgcccaaagcacaaatttattccatcacatgtcaaaatagagatcattatattttctctaaatagaaaatatggggtaaataaatgaataaagttcagaagtgaaacaacccttgccaaagcccgccaaacaactatgcattccaacattgtgtacattattgagctcagaactaacatatgaatttcagtcgatataacacatgaatctgtcatgtactgcaaactgaaatgctaattttgtaactccaatccaatatgaagaatcgatgtttgttggtgacaagaacgaagtggtatttaggcgcaaatataaacaacttaaccgggagataagcaacaacccaagcgtagaacctatcaggaatatccttaacctttagctacatctaccttccagcacatctgaaaaagttgctcccatgttgtacgctggtggatagcagagggcttcgtgcaagggagaggtggaaacaaaatgcaggaattgagaaacactgtatgaagacagtgacctgatgttggcaagccagcacacttgatgactgatagcttactttatggagtaaaatggacaatttccttaaaaagaagaactgatgaagaaccactacttttactgcatcagttgttaaccaatagtattaaatttaaaagtagcaaattatcatgagttgctcatataatgctgaatgttacctgaccaatatcggcacagtagaagtaggaaggcctcgcggaatcaaagctgcatctccacgggtttctaagacccaatgcccaaacttctagttctaagtcactgtcatcagtgtatgggttgtcttttggaatggagtagttaccccacaagttggttagcaatttcactctgtcctgtaaagggaaaaaagggaacaaattatcaaatagagtacatgttgatgctccatatattgctaattgtttgtcttatgtgagaggagatttatcacaaataaatatgtgaagtcatttgcaaaaatttcagttcgtatgtttgaagttcatcagaaacatatttatctacccaccccggtatctacttacacaaatataagtagtgaatccagataactgggttgttgctatatgggaaaaaattgcagcagtagcagtacctatctcatgacggtggaaaaaagacactcaaatcaatttgattacctgtatcaccatcctgttttgcaactcgtagcaaaatggagtacagtaataaaatcctattaccagttgcaatagtacaatggaacttagttgattcccataatttgtagtatacacatgatgacataaagggatggatggggtctagttgtacaagaagggctctgcaacactattttatctccattaccaaattctctgtaacactattctacgtgcattaccaaaatcagaactcaaaaaaagcaggaattcattcagttcgtaacctggtcaaattcttgtgagcaaaaatttaccttgggcacagaggagatcggcaaaggtggccgtcggtgacgatgcggacgggagagatcgacgctagcggagcagatcggtgagcggccgtcggtggcaatgcggacgggagagatcggcttgggcggaggcgcggaggagatcgacgacgttggtgacgccggccgacggaggagggatggccgttgttggcgtggcggcgtcgcgatggcggatggcgctggatagggcgatggcggcggcgtgagagtgcggcgtcggcggcgtgcgagagagaggaggatgcgtgtgaggagcgtgattgggaggatgcgcgtgaggaaaggggagaggaggacgcgcgtgcggaggggagggtccgcgacgattttgaggcgttggatcaaatgattctggaccgtcagatttgatgaacggggtttgtaggagtgtagttggtgaattatagggtagatgcaaccacacaattagtgataataataataatcataaccatcccagatcgcaaaacggt

SEQ ID NO: 38521 - DNA, 3233 bp, Oryza sativa
acaggagtgctcagatcaaactgtgtagcggttcttgagacctttgtccatcttttttgcatcgtcctacaaccaaaaagggcacgaataagaaacagttattcatccaggcatataatgtaacaaagctaaggactactcacatgaacaatgaacccaatcgagtccttgtaatccagaaattctttccactgcttcccaatgcttatctgatgaagaaagagaaacaattatgttcagcttatctgacctacctaggcgaatcaaatataataatgatgtgatgaggaaccaaaaaacttgccacaagatgcatatattgcagcagtcatacaaaacgctaaaatggcaagaaaatactacaagagataacgcggacaatatagcacgaaaggaacaccaagatagaacagaacttaacgtttcaatataaaccttggttaaaatagctgcacaatgtatatagcatgatcttggccaaaataatgaaaatccccctatgacaaacttcacctggaagtttaagcaagtgcacccaaatgttgcaatcttttcaggaatatatctcttcagctatgcattgtgtatatgcagattgagagcattccacatgtacagagcaacatttggacaggctcaagacataaatagctccagataaccagatcatgccattattaatacatagtggtatttgacagcaatgacatgtaaaagtttgaatttaatgatgttgaaaactatgtggttattatctgcaggtaacaaataaattagcagcacatatcttagaaatagtacctgagcagcttcattggcagcatttttagtccagatagctattctttcctgcttgccacgcacactaacaactgctccacaaatttcatccccataatcgaattgttcgccaatcattgccaataactaagcacaggataaggtaaagaattagggagatatttgtataaaggataactgtgcaaataagtgattcaaataatgcttacagtatgcaaccacattgtgtcggactttcctctgccacagctgaaggtccatttacctccattagcacagataggatcttcccattttggctcgattttattcttaaagcaatggaagtcagctcccacaaccaacttgcttgggtgatggatattgttataaaggctgaaataccacattcaaccttattagactaaaggaatacatgaaaagatagaaggaaaaaaaatactgaagcaaattgccaaaaaataataatatttaagcgagctgttagcagaaagaaagaagccctgaagcacatgcattgatataatttgcgacaaatgacacatgttataaactgtcgagagaactcaggacgacacatgtgtcaacatacgtggactatctcagatctctgaacatgtatcaactcaggatgctcaaattactcataaaaaaatagagccacagagaattaacattctttttataaatgtcagatacataaaattcaaaatcaccaaacagaacaaaacaccatcagccaatcaccttccaagttctaatactacatggaaagtaaaagatgacaaatattcggccagaaaaaaaaaaagaaggatcatacgcattttagaaggatctgattcatgtcctttcatgatgacaatggaaaaagatatgtttatattaaatataatatctgacttagacaaaataacctagaactgaaaatagaagaacgccaataaataactggcttatgatgcagccagaaagatgtcaaaaggcacaacagcacaatgatacagcaagatcaacaaatatttctgacatgaaacatgaagggtgccaaaagcataattatgacagcaggactgtaaacaaatgcttaagtgtgaacaagcagaacacttggacacaatttgcaacacatatgcatgaagagaaaccaaagaacacccaactctgcacctcaaatgtaatgcactacaatgtaggataacacataatattgatttccccaaccatgccaagaaatcacaatcggcgtaccgacatttcaacaaacaaactctgcacaccgatttaaccacagttaggcttattaaaataaaggcataacaaatcatgtggcctgcactaagaattcaattctacagttgaccatggaataagtatttgagtttggtacttctcacttgagacgttttcttccagggtatcaatcactcaagacaaattttcctcaagacatgttgttcatctaagaacattatgatgatagcatatacagattatcaccctatactaagtaaagtttccatcaaaatagataaacaaagaaaagcatccatccacagcatgaaacataaactgatcgatgaagatgtgaaatattattctgcttaaagaaaaacactataattcacgaaaagagtgtactcctcctcaaaacaattctgcctaatctgcaaccaagtcaaaaaaaaaaaaaactagatccacattagatctcagtcctacacatgaagcctatgacatggacaaagtaaagtgggcatgagtggcaagcctaacgcatgtaatcgaatcgggttaaacagctagatggggaatctacaatactgattcatgaaggcaagggatggagaggttgtggaggggaaaagaagaggagggggggtgggaaacctccagaagtcctcgacggtggagaaggtgtggatggggcggatggagcttccccaggttgcctgcttggactttccctgcgggttgtcgaaccagaaggtccaggcgtgctcgagcgggtgcggcgcggcggggttggcctgcggcggcgcgtggccggagtcgtcgtcggcgatctccccctcctccctctcgtcagcgtcgtcggccctgccgcggccggacgacggcggccttccggcggacggcggcctcgtctcgtgctcctccgccatggatgcgggcggcggtgagggtttctgtgttgcgccttaattagctaggtcgaggtcggtgctcttcccctctcgcttctccgtctctatatctccctctccactcgtgtagtatagaagaagaacttgtattgtaccggatgcgttgggcttatcaggcccatgggcccaaataaggactatttaggaattttttttatttataattttttttattaaaagttttacaaaaataattttccattttgaaaattaacgggctgcagg

SEQ ID NO: 38522 - DNA, 4707 bp, Oryza sativa
aaatgggtggtgagggggggcatggaattttgcaggcggcccccttgctgccctccgttagggcgattttgcactgtgcggggggccgcctgcaaatgggcggcgagggggcatggaattttgcaggcggcccccttgccgccctgggggagggcgattttgtactgtgctctatattttttttgtatataaatatcaatagttatcaaatctttttatattgaaaactatacaagattaaaatctccaagactggtaaaatacaattttattattttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagttggaaagaagatatgaagaggttgccttcagattgtcaattatatagcgtcgttttcagtgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatatgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagactagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggtgagggatcgacgctccgtgggacgaagagctggcgaacgcgcccgaagaggtggcgaacgcccctgcggagctcgcggaagcgccggtcgtgcctacgaacgcgctcgaatgcagacgaggtcctgcgatgaggaaacgtgcagttaaaacatggtgacacattcgtgcaaaagctgaaacaaaaatgaactaatatctgggctgaactgtaccgtgcgaaaccggtgctgtaggtcgcactgctccgaagctaggggcgctcgaagacaaacgaggtcctgctccgacggtaggcgcgcgaggccgtgggtgtaccggaccagctggaggtacgacgtccacggcgctgcgacaggagaagacgcgcatgaccgcacgcatcttctcctgcatccggtcgaaggtcgccctctgctcaacgtcagtcaagtgcaaacctctgttcaacctcacctggactgcggtgatatcggcactgatatcccgtgccgcatcagcctatgcaagatggaaataaaaaattcagtagttgtcctatattatgcaagataaatgacataattgttggaagtaatacaaattggacgtaccgccacgaagtagtctcggtcacggtgcgtgggatacgcgtccgtgacagcggcaacgtgcggctctggggcgtctggagtgaaggtcacacgcgaacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattgtatggctcgatgatgtaattaccataaaaatttagaaatgaacaatccgaactcacgagtggtcggcaggggggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgataggaattagacatgttatgtgaaggaaaaaaaagaagaggactgataaacttataacgcagcgaagttgcactaaccccacgtcgacaccagtaagtccccatcgtgggaccgtcctctggccactgcgcgctgcgaccaaccccgtagggtgcgctgtccaccactggtcgccctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacctacccgaacaaccacaacaggtacgcctcaagggagcgtcggaccgagtaatcatcagcgtcagggtgcagaaggtccgcctacagttaagaatgaaatgttagtacaaaacactcatccggtcgcaaataagcatgtatgataataacaacttatttactacaagtgaactggagcaaccaagccttgctaagcccgactgtagagtacggaggaagggtggtggtcggtcctaggtgtggaaggcgcatcacctgctcgaagcgcgcagtgatatcctccttccacccaaaaacaccgtcgacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtgcaaaacaaagcaaagttgagttcaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaagattgaattgaaattacacgatagaagtatttagtccgaacactcattacatcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactacaggtacatccaccatccgccttcaagatacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtaggcttgg

SEQ ID NO: 38523 - DNA, 1660 bp, Oryza sativa
tgtgcactctctctaggacccagtaccagctttcagtgttctcgctctctacaaatgcgaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcttcaaccgatgtaaatgtatgtaggtcatagtaagtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttctttcatgcacctcacttcatacacataatttgttgacttgaccaccctaaactctctctgcaatgaaactgcccaatgcttcaccgcctccttcatctcatccttatgagcataccttgcaccctcaattacctcgttctccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaaca

SEQ ID NO: 38524 - DNA, 6916 bp, Oryza sativa
  unsure (1)..(6916): unsure at all n locations
gggcggccgcattcataactagtggatcccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaactgatgaaacatcaacatatccctacaaatcgaagtaagaaaaaatatgtaacatcaaaagaatttatacataaatattttgatataatacaaagaaacatgtaaaacatatatgggatgaaacatggaaaaaatgacaaaaaaatatgccaatccaaatctaggtccttcttactctccgatggctggatctaagattccttcgatgaactcgtgcctatgacgacccagtgctccttaccttcgatgatcttgccttcctcattgtcggagtccacagcaacggccatctccttcattgctggttcgccacgatggggtcatcccctcctcctctccactggtgacctcctagatgtcttcttactctgcccgccacaacagtcgttctccccgtcactatcgccaccaggcggccatggaaacaacaataccatcatcaccgcaaccttttcatgtatgtggtgtgaggtttagagagagaagagagagaataaggggatagagacctagaaagagagaaataaggacatataagtgagtggtgcgggtattcgattttttaaccaggatcggatgcccaacccagtgtttttaagaaagtgttccaattttaagaactagtgagcgtgcacgtgcaaggcacgtccatacatacatactctctcaggaattcatcttggctctagctgttgggcgcgtggctccagcgacaagttggaggcaatagcaacggtgattcacgacccatggcgcagctcaccctctgccgttgatcatgatccatcctgttcataaataatcgcacaggttactaatgcaatgaacaaagatatctaaaggaacaatatattcttgcagtgtgtgctatagtccttccataatttgtccagctcatatggcccaaagcaaagtatttgttcaaaatatatgtagttctgtgaaatttactttgaataaaattatgtctgactaccttcaaatgttttgcatgcctcttgttcaagcaaaattgggtgacgtaataagaaagtaggtctcaagcaccatagatgcttgcctgcaaaatagcaattgacataatattggaatatttcctgtgcgaaatttgttatctacggccagtagcccttatgtgaagaaatatcagattgatcttaaatataagaaaagaaaaatattgattttcagttgcttatccagtgtgtagcagcatggcagttactgaggatgacaatatgcattggttggcaggaaactacaaatgcattgcaagcaaccaacacaagtgctcaattcatagcaaatactgcccatacattgaaatgttaagaaaaacagagtggtctgttaaaccggcctgcatttgtaataaaatcattaatgaacagctaaagtttggactatcatagtacatgttgaacagtatgaaattcatatttgacaccacacatttatataggctcctagaacacaattcatataccgaataaatcaatcaaaatagattatacatgcaaaagaaattgcaattggcactaaatttagctgggtggcataattttcacagtactatattcactaattccaagcattcatatttgtacaggaccatctataattttgttttgaacatgtaacagcttcgtggattgcaaaaaacagaaaatgtgcagcacaaaaccacaaaaagttcaatgattaggagtaaatgagaaaaccaatcttaaaacgtgaatataattacacggaatgaagttgtgtatattgaaaatgcaaggaaaacgctgattaacttgatcattacctttatgtcttgttctaactccatcactaacagcatccccttcactgatcaaaacagtggatgagcacttccaagacccatagaagacctgctccaacagagaagaatataagcacaatagagctatgtgtttttccttcaattcagtgagtccaggtttcatcagtcaaaaaaaattaatgcaatgcatcacgtaaattgctacctacaacagtgtctcgaatcaaagctttggcactgcacagtaggcagcatgcatttttatcaggaaggctgaaattaagggaaataaacagctccaagcctccaaccaatctgaaaatgcatcatttagcataagtagtgatctatggccatttcatggtttgtcaacatgatttcttttgggcagcatcataggaggcataactctctttgttctaaataaacatgatgtctattttaatgtatatatccagaaattttaggaacaaacatgttacctttcagtatcacggttcctgaataggtttgggtagcaccaaagccagcataatttgtgatatctcttatgggcacccttcctatttaggaaaaagaatgaaacattaatagcatgcccaaacaatagttactaatgaagtaaatagcagtggcacctgaataggcttggtagcaccaaagccagcataatttgtgatatctcttatgggcacccttcctatttaggaaaaaggatgaaacattaatagcatgcccaaacaatagttactaattaagtaaatagcagtggcaaagaaagcagaatcattacatagcagtgatccctacctgtgacgattgtagagggagtgcagcatacctctctgtcacgctttctcctatccttggcagcagttaagtttgtaacatcgaccatggcaggtcgtcctctaatgtgtggcaggaaagagtcaaatcaaaccattttgtatcaataacatgttgtggctctgttaaaaaaaacatgtgaaagcctttttacgattaaacagataaaaaactttttaaatagagaagctaaataaatataggcacattaatctggaactgtaaaaattgaaaatgagagataggcactgaattactgcatgttagtagagaagaaaatgtccaggcacttgtgatgtccctgcaatgctgcaacagaaaaaaaaatgttcagagaacaaattgtccagctaatgataaatccctgcaatagttgaacaggcataaaatttcagatagttacccagcagaaaattaaaaatcaaatcaagtatgctcaagcatcaagttctgttttagtttgtaagtagatgagaaaatgtccaggtacttgtgatggtccctgcaatgctgcaacagacaaaaatgttcagatgaaaatgtctagctaattatgataaatccctgcaatagttgaacaggcaaaaaagttcagataggtacgcaggagcaaattacaaatcaaatcaagtatgctcatgcatcaaagttctgttttactttgcaagtcatatccacatgagaatggtagctgttgtaggtatatgtgtgcggatgactgcaggtcaatgggaacagtaacctgagaaagaattagatcgcaaacttttttgtttacagaaagagcaaattattcctcgggcttgctaggccgaaccatgatacagttatttacacaacctacactattaccttcagcagttgacattgcacgacacaaatgtaaatggaacatataaaggactggcagagatgcttctaattacacttagaatcagaatatgtgtagtctaacaccaaaatttgaaggttactcatgtccaatccttttgctcagtgctcaaggaactgtaccagttgtttgctctcttccttttaaggtcagtgctctttgaatctgttactatacgaagcgaaggtataagctgcgatgccagcaagtataaatacttgaagccatataacagagtaggtagggtaatatctcaattcatttctcaaattggatatttcctataataaaaataggaaattcgactaaaacagacttatctcagaagtaagacacatacatggtcagcagggagagccactgtgttggttgcaatagatccacttggagttgagaaagctcaagagtggtttatacagagacccctactacaactgcagcactttagagatatgtcaattgatcccaaagtcagacctacaggagatagaaaagcagacgaatcaattccatttaatttcagttcatcctatgtgtaaagatacttcttaattttcaaatagatttcagtaaaaaaaatgactgtctatactaccaaatgcaggggaatattttgttttaccgaggattggaatcagctcttcacaacttcgccgcccttttcaacccttcaatccaattttcatcaaatcagtcaaaattatgaatccaaccaaataaaaaaattgaatactatatattgaccgaaagcacctaacctaacctattgtgcattcaaatatagaggcaaagtaaaaggatatacatttcattagagaatctgataatctatcaataccaacataaacattcagaataacatttatgtttatacctctaatttactcgcacatcccgacatcaggcatgatccgcctctgccccacctctcacctggaaggaaggtctatggcaatcagggtggagagcagctgaaaacggcagccatcgtgaggaagacagacgaattgatccgtggcatttaacatctaaaataatacagattgcatcaacggggaattttacccctttccctctacctcttgcgcctaattagcttcattagtactacatgattcggtgctaaccaccacagagcaagttgcgcatcagcctgcttgtctggaggctccaaatctgtcatacactggaatatatataaatagaaatttaaaaacataaaaaatgttccaccttatgtagcaaaagaacaaaagtgaatcacttggtaacaaaatcaattgtctactgcttcttcaggctccatttctcggagagaccactcaaaactcaacatgatgttttcggttatctggcgtttaaagattaatagtatgattatgtgaaccatgttaacgaattatgtttgagtgaatggatgcaaattaacagacaaattaacagagagagaaccacacctgagaggagaggtcggtgccggtgatgatggcggcggcggccacgacgccgttagtcagcatgggagaaggtgcaagcaacctgaggccacgacggctgtgcgcggcgaaggagaatcggcgacgacgactgaacggcggcggcgcggaggagatcctgaggcagcggggagaggggaggtgggcgatgcgagggagaggggagtgcggcgaggggaggtgggcgacgcgagggagaggggagaggggagtgcggcgggtgaggcgggcggcggaggtacgacgtggggagggcggcgcggcgcgacgtggggatggcggaggttagcggcgcgcttttttttctatttttcttggtgcgtggttactttcttagggatgacaggtgggtcccacgcaacaacggatctgaaaggggattgcaggattaagaatgaactcgtactttatatatatatatacacacacgttaagctacttgttttatgtggggataaaatccagaatcaagagctaaaagaaattaaactgatcctaataaatggagcagaagagaaattaattctttccgtaaaatggacaacctctataatactagtactcacacctgtctgtagccatcaacgcggactcccctgacagagtggccccacccaggcgcgtacctccctagtaaaaacgccgcgccggaacccgtgagaaaataccggcgaaactcgaagaccaattaaattcgaccgttgccgttcccccgtttaaaaatcacttgcccaccgcgatcccttccatcgcctccccatccatccgaattccagtcaaaccaacaaaccaatcgaagacatcacgcgaggagagaaaaaactagccgttgcgctactcctccgccatggacgcgacggcgccgctgctcagccccgcctccgacgaccgcttctgggaccgcctccgcacccgcgtcgacaccatcctcgaggaccgccgcctcgtcgctccccccgccgccacggtgagccgcttttgctgtcccccgtttgtttgttggtttttcttcttgcgtggggagttggatcttgatgtggcgcgatctttgcagtgcggggtggaatccgagcgggggaagcggctcagggaggactcgctgatgctggtgcgtggcctcgactccgtcgccgcctcgctggcgcagctctccgacaccctcaccgccgcgcagaaggttcgggatccacgccgccggcgtcgcttgcttctt

SEQ ID NO: 38525 - DNA, 2494 bp, Oryza sativa
tgctcaggaagtgaatgcgctcgccacgtgctcttcccaggcgagggaatgcgagagaggtgatgaggaggaggagccgaaagccaagcggcgctgcagcttggctgagacggtgagcttcgacggcgagactccggtcgccggagcagattcaggtgaaggttcagagaaagaagaattagctgcggatgcgaaactgcgtcaggagaacggcggcattcaggccacttcggaggtcgccaagagcaccaatctgaagcgtgccagaaatgtcagttgggagattaacagctcctccacatgatctttttccggttggtttgggttatttcagaaagctgatttggatcaattttgtgcgaactgtctatgcagctggcggtctcgatggccggaagagcggctgctctggcgagggagctgaagaacatcaaatcggagctgcacttcatgcaggagagatgcggtttgcttgaggaggagaacaagaggctcagagaggggtatgacaatggagttccccctgaagaagatgacctggtaattatggcttcgtgctggcctcagttcttgatttgtcagaccacttgggtttcacatccaacaatttcaacagcctgaaaaaatttcagcatcttggatcacataacttctcttgatttctgtttaatgagatttgttagtctgtcacactacttgggcagcccccagcatttcgcagtcaagattgagcaagacaggctgaaaaattcagcatcttggttgacattatttctgttgatttttgtttaatgatactttatttgttagtatgttaacaatttccggacaaaattttcaggtgaggctgcaattggaggctctgctcgcggaaaaatctcgactggcgcaggagaacgccaacctgtccagggaaaaccagagcctgattcagctggtggagtatcatcagctgacctcccaggacctcgctgaatcttacgaggacgtaatggaggggatgcggctggacttctcgtcgccgctaggcaagatcgacagcgatgaagaaggcgagcgtgagaaccgaagagttgctgtcactccatctgataagttggaagccttggagtcatctgatgagtagataaatctgaggagaataagctgggtcttctccagtggtggatttactgatcagtaacagtatgatcttctatttctgctgttgtatgatgcttcaatttggccactctcggtggcaatatttatgtgatcaattccacttcgtaatgtgacaataacaaatgtggttctgaatcttaattctaaataaaattttagtctttggaaagcagatccctctaacttaactgcacatgcagttgattcattggcatgtggatcccgctttgctatgtctcacatgtcagtggctcaatttaaatgtagttaagccagaggatccctttcttatgaaaattcatcaacaatgtgaatgccacaaaagcaggcatgagtaatttacagatttatgaacttgacatctccaagacactctgatattctatctcctgcctgactttggtgctagtttttcattgtttataattatttattcatttcttgtttgtaattatatacacttcctaagacaaaactatcttaactcagaaatttgttcaactataagagaatgttcatgaaaataagccaaaaaaaaaaagaaaaaaggggtcaaatttcatcccaaaatacccctgaaaattttcatttaacaggctttacaattcctgcagtaaattcattttctgcccattattctgctttaaagaaaagagcttcatcggagtaatctggaacttcaaataagttagaacaacaaccttttcatttctacacataaatcagaaccatcaaaattgggcgttaatagtatacactttatgacaatgcgatgagtattgataacgaaaacacaaaggctgaaaagggaacttgtacagtgagccatcaacaattggcatcacaaattaattgctttcgacacaatattgttgatccagacaaaggagataattttataaggaaagatagtataattgacaaggaaaaaacgaagaccgaaaacggaactcgtacagtgtgagccatcaaaaatcggcatcacaaattaattgcttttgacacaatattgtcgacacaaaggacggtatttacaggacgtgtatacagtactgttctctatgttgtattctctagtcagcttctagtgcatctacagtaatcgtgataactaatttacattcaggtcatcccgaaacaaattagaagaggatcagagcggccaaattgaccaaaagaaacctgaagactaaactatcataccacattactgggttggaattactaaggggtctcaactgtgtaacgcttgctgggttcccaccctttgtttcctcgggggagtaattctcaggtgctgaaggggagaaacctgaagaattccgtgaat

SEQ ID NO: 38526 - DNA, 114 bp, Oryza sativa
acaggctaggagctgatatctggtcattaattacatctctgacaaattgtactcgattattagaactgtcgatggatggaaataacctgaacggtagcctgccaaaatcaattg

SEQ ID NO: 38527 - DNA, 129 bp, Oryza sativa
cgcggcggtgccgatggcggggtgcggcggcgaccctagcggctgctagaggcggccggagcggtggagatggtggcggcgggtgggtgcacggtgcttgggcgatagggagctcgggagcggacggcg

SEQ ID NO: 38528 - DNA, 5816 bp, Oryza sativa
aatgctttagaaaaccaaatagttgacctgttaattctttgatttgtatatatgagttctggaatcacatatccaaagtaacatgttctttgatcccgccatataggagctgcatcaatcgaagttagattgcttaagattggtcatgggtgtggttttttgaaactctaggaccataacactagaggttatctgccactgccacatgccaaaatccctatggtttcgagcaacttgaaatttactctagtaaaaaaaagaaattgctcactgttgtgggttaacatctagtggtgtctcctcttgatctgagctgccttgatctccaaagctaattctcccaataccatcacggctaaagcacattgcgaaggaattagatgtcagacctttttgtgctagaatgctaggaattgatatcatatctatcccaagtccaaatagaccgtttggagcagcagcatccagaaatgatcctgtctgaacctgtccacatctgataaatgtagagaagattttatcaaaatgctgaacacagtctccttcacccattatatgaaatgtaaaaattacccaaatagtatttgcgccttgagaatttgaggaatggcatcctctgttgacaagtagagcacatcctctactagaaaaccagaagaagatgtgtctgcagaaacataaaccatcttgtatggacactgtgatgttgtagagcattcctttctcagctcacaaaattggctgttgcaaggaactgcttggcttgttgacgacatactagggatgtaaaaggaagcctgaaacccaggggcagccagtgagtaactgagcaatatagttacccaaatcttatcttgagagagaacatacatgtagcaaaagtgccacttggaagaaaaataaattgtaatttttcagagtaccaacacaatcaatatgacaatagaaaatattactttgctatagaagttttaagtgtgagaaataaaaaaacaagcaggcaaaacttttgtccaaaaaggagatagactaaggtatgtatgagaagttgagaacagaaacaaaggaaataaaaacaaaaaaaaatcatagaaaaagacaatcaggtacactcaagctacatatatgcacaacaattatatcaagtggtacagttatggttggataaggctcaagcacttgagtctcggcctctactagcttccggcagagctccttccaacacggtaggaagtcttcagatcataagaagaaagtgagactagcaactttgttacatctagccaaggatgacaatgtcatactatatagagccactccctaaaagctcaatctaatatttccaaataggcaactgataagaatgattgccctaatttctaaatttcaaagtacaatcataaaaataacttggtagccaaccaagcttattctcatgacttaattatgccaggcagcaacgaagcttcatggctgctgtctggctggaggattacgaaccagccctactatagaggtattaaatccatcagaggaaggcctgaagtagaatggtttgaggtgaaagaatgcaccggtttggtgatggaaggatgtagaaaactggtccaggataagactttaggccctatacagtgtttattcataacatcaaggacagactatcagtatttatactcattggctacaacaaacacactagagtaacatccaaataatgagcatattatcattgtgtttatttgttacatgacagaatagtggcccatgcacaccagctatagtaacccaccacaagttacagcaaataacatcaaggacccttgaatgatatggtttaagagatataatgtataccttcaaatttttcctgatgtaatattaaagcatttctactcttggaagctaaaacaactaaacaagtattcatttactggaaaatttgaaatcgtgaaagtacacacacaacacaggcttttaatctagaaggcaacagctgcaacaaatgtacaggtactgacatatgttgcacaaatgtacaagttcgatggcattctcacaaaccaacatgtttcatgccttgcgttccacttagtctgatttctgtcttgctaagttgactcacccttgcaggattaaagagaggccttgtgattaagtattctgtacccacttgctgcatcagcccttgcatcgtagtcatcacaaacatgtacaatgagacacatatatctcattgtagatgccccattcaagggccagttgatgggggtgatacagaaatcaagctaataccgcacaaaacatgtaggtgtgtgagaatatccactgaacttgtattttgtgaaacatgtgtaaaaatgcttgcaatttgtgcaattcactcaaaagaatagaaaaagaaatgaaggtctatggcattgtagttatagcggacatatttggcaaccttcatgcccgctatatactctgcaaacttgactcttgatgctaccgaaaggatagaaaaaatggtttacagcctaaaacaataaatgtcatgtttccttggtaaatctctatattactgtttatgtgaaaagcatagcagtaaggtgaccacatttaggatctatgagaacggccaacaaggctttaaatgggtcattgtttagaacagtgggaagaagaaaataaaacagcagcaagaaacaacattgaagattgaactgaagtcaacaagatttcagaacggctgatctatgcagtcaatgttgttttatgcgttattgagacctgtcgattcataagattagatgatcactcagatattgtacttcaatttacaattttacaggacaatacataccatttaaacacctaattaggacttcattatgaaaggttacacaatttcccacaacattcgacactagttatagattatgaccaagcccatgcgtttttgacaaataaatcaagagcaaactaaaggccagaaagatcagatattttcatccaactgaacggcataatgccagacatcttagcgaatcgacatctcattcaatttttactaagctgtgtaattagtagcaaccatcttctggcaccataagtccattcccacatgcagcatatcaccaaatcataccgtatatcagcaaaaatcctaaaaagcattgcacagtttaaaagccactgaagcaacatgaaaattcttgcagcatggatcgttgtatagctctgaattatgcaccaacacctaaatgaacaaaggatctatcgaattgtcaagagaatagtgctcttaccgatccagaagcggccgaagccggcggcgtacacccatcacactggcacggcagccagaagaggtcactcccggtgtccagcgccaccatgaacgtctggcccggcgtgccgaccgtcacaagcgcatagtgcaagcttttacatatccacaaaaatgcgactcttcactaaaactctcaagcaccaaaccactacgaagagggagtgagagacggggagaggccttacaatccgaggttgctgaccttgagggtggcgtttccctcagaaaacgtgagcggcgggggcttgtctcctcctcctccaccgtcgccgccggctgctgagagcgcgcggcggcggtcgtgcccgttcagggccgcaacgtaatcggcgctgccgtgctccggccagcctccggggagcacgtgcccgcgcgcctccgcccaccgctgcaccggagaagagaaccggtggtggaattccagcgaaggcgccctcaggcgaccacctccgccgccgccgcccgcgacgccgccaacgacgagaagcaagagcaaggagtggaggagaagctggaaggatgacatcggggtagtggccgcatgtgatccggggccgaatcggggagaggaggcgtcgcgtccgcggcggcgggtggtcggcggcgtgcgctaccggccggaggaggcggcggaggattttgcggttttgtgggcgctgtgtcgatgaaatggttttgctttttaattttgagtattttttttctttcggctttggtttagtacgggaagctagttattgggtgtagcactgcactgttgggctttcgctttttactcgtgggttgttaaagactagttgggactttggtctgtccagtttccatctttaatctgctgctttttttctctcctttcgttaaagtggcacgatgtgcatgtgatatctgaaattggacggagaaatgagaattactgttttttttttctttcggttctgggaatcaattccaatcgctatcagtcataatgaccacaatataacattttgataccttggaaacaaataaagtacggtctagtaagcagaatattgctccgatgttcattctaaataattttgcggcttcatcttttcgcttatacttatgctcatcagctaaaatttaaattttcaaccttaaatttaaagttgattttgtgattttttttatcaaagtttatttttcagtccctgcttttagatagctaagaacacatattttattaacaaattatttttcatttgcaaatataccatttggtttaatccatgaataagccaaaataatagggcggtccatattattgtgaaaccactgcaaagttgtgatgaagataaagattttctaaaagttgcatgccgaaagttgaagactacggttatgcaactttgtagtagcgtgcaccacgcaaggcacctctgatcaagcgtcctctaagctccagcgtgtgccgagtgccgacgatcaccacctgtattaggccattcccaacccaatgactaggatagtgtccatagcattaaataagctgtcacctaggatgaaaaattatgtggcaagtgaataaatgaggaaagagaaggaaacatgtcttgcatgagacatggtttctacacaacatataagacatcatgtgatataagtagcattaaatttaagtatggaatagtagtatttgcattgaaagagtaatatctagtactagtttcttgatgatgtggagcttatggaaactatgtctagtgtcttggattgggaatggcctgatctccaccacgccgctagggtgtcacgccctgaaaatcgcctaatttaataattcatcttttaaatcatttttagaaattattttaaaagcctatgagttaaactagaataatctaggaaaaatttcaacgtaaaattccattaaatactttgcttgtttatctattttctatatttttctgagaattatttgagcaagaaaagtatttttaataaatgaaacatcatggcacgaattattttaattgaaaaattctttaaatcctcctctaagttgttgggccgtttccggcccaactctcctctcagccgcgcgtggccgagcggcccagccggctgtcacgccctgaagttcccctcccttgctctaaattcataaaataaatcgtccgaagaaattgtttaatttaacctagagatgaatccctagttaataaatgcaaataataatcggaattggcatgtggaatttttcttgagttctacatgtcaaaatatgctaacaggatttttagtggaattttcagagccttggaaataattttaaccaattaaaataagcaaagtgcaatattaaatccctgggaaaatcctttttcctttttatctttcctttttcccctctttttcctcctttgggccgccggcccatctctcccgccccctcccgaagtccaggtcgcctccccctcactccctcgggcgctgacaggtggggcccacctgtcag

SEQ ID NO: 38529 - DNA, 13234 bp, Oryza sativa
cccctcggtgagaatcggtctccctctcttcctctctctccctttgctgcgccgcccgccgtgtagcgccgccgctagggtcgctcgcgccgccgcttcggccgccgccgcggtctttgcgccgtccgccgccgcctcccgtcgccggttgccgtcgctggcaaccgtgcgcgcgcgccgccgccctcgccataaccggccggccggcttgaagccgagccgagccaccagccgcgcccctcccgccttgtgccactgcccggtgggccccgcctgccagtacccctccctctccccttgtgccgctgaccagtggggcccgcatgtcggcgccgccccaccccttgctgacgtcagccctgggatgaattattgcgcaataaattgattaagggtttttctttattagtaaaaacacagataatcttctaaaaatcataactaattcatccgagctccgattaaatccattcaagtctcagtaaattcataaaaatgtgtagaatccattaaaaatggttttgttctctgtttcagtagtcttatagcatgttttgcttgtgtgctttgtttgtcgcgtagatttcggccgtttcgtcgattcgtggtttctcgaagacgttgctgtgggtccatcagtgcgagagcaaggcaagtcatacattgcaattgatcatattgtacctaatttacaaatgtcccgcatttctattaaatattgcattgttttacaatatcatgtgggatgggtcctattactcagctatatgttgtttcccttatgccattgataacttgggtattaaaatgactagaggttggtttaggagatgcttagccatgcttagttcaactagtacacaaaaggggccacattaaagcatagactttgattattggcaatagctttggattagtgccaccgcaatggtgttggttaattaaaatacactacatggtgggctgtgggtgcatggttttgctagacgtgcccatggcgattaaggaccggttcgcgggatgccctggaagaatttatcgtacttaccacaagccagcgtgggcaacggctgggcttgtagtgtagcttttctctagccgacgtacccaggcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagagggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcaccctagttagcttttggaactggttagttcaggtggtggtttgggcctgttgcaacgtggtgtaacgttggacagtgattggttaatatggattaattactataactgttttactgctttcaactactgcttgaaatgccggctttatgcaaaagaacctttagcatcccttggatatatcttgcatcatacctcctcttccggtgtgacttgctgagtacagtgggtagtactcagtcttgctctcttttccccctcaccagagttgaagttcttcccagttggagatgtcttgaagaggttggtttcgtcgctgccgtcaagggttgcctgtggaatggagtcgcccgctgcaggagtcaagtcttcaggcttagctcgctttaccttttccgctgcatttgtaatcttttatatttttgtaagacgtggatctgtatgtcaacaattgtcgtttgtgtaccctggctggtcctggacaggggtttaatacacattcagcttagaaattctggttcgtgaatttctgggcgtgacaccggcccaagccgccgccccgcccccccacctctctagccgccgacatgtggggtccacatgtcggggcctttccctacctccagccggccggccgagccgagtccgagcgccgctgcctttccgccaaattcgcctcacccggtcgcccccgagtccgattgcttgagggtaaatcatctcctccttatcctctccctttcccctaaagtctcggaggccaattttgctcggataaaccaaatcgagttcgttttgagtttatccatccaaactaactttagatttttccggcttcgattcctctcggttggagtccgatctctctaatccgagcctataaatagcatcccctaatcgtcctcttccgtttgccccaagtcccgagctccctcgttgcccgtagcgccgccgccgctttgccctagccgccgccgccgccggcgaccgtccagccgcgccgcgccgctgcggtagccgtcgccgttgccgtccgtcgccgccgtcgggtgcgcacggaggtgaggaacctcggccgcccctttgccgccatcgccagccgccggagagctgccgccgccgccgacccgagccgagtagccgtcggagctcgtcgccggtcgccgttcgtcatcgtccgtcgtgttttcttgtaccggtgagttcgcgtcgtcgttccctacgtctagatgtccttagattgcccggccgacccctctagagccggtggtcgcgtcgcccgcgccatggccggtgatgatgacgtcatcatgacgtcataaatccctttttcttagtttctttattagatgaaaatcgattaaacttcggaaattcataactaaatcatcgtaactcggattcgagtggttcaagtcgctaaatttttctaaaatcaagatctacatgttaaaaatatccacatgtactgtttatgcttgttttttactgttttgttgattttgttcttttgctttagtttccgacgttccggaggagagcgttttcgttgaggaaggttcggaagcgtttgcggaagctcaaggcaagtcacacagatcccaaagaaccttttgagcatgttgaacccgtttaaagctaatgttttatttcaacttatgcattattttcgaatgtcatcgggtggtgagcctttcccaattaattatggccaaagatgactttattttcctatgggttataatttgattagcttggaccttatatattggattggttcagctaaatgctatatatatatatatatatataattgcttagccctgcttagaaacattagctcattaatgggatgaattatattacattgttaattatggttatatttaatggtagctcacgatggttaatcgtgtatgataattaattgataattaaaacctgattaaaggtgggttgtgagcatatggtttcgatggttgtgctcatgacaattaaggaccggttcgcgagctactattgtgaaacatttaccgtgccaaccacaagccagcgtgggcaacggctttactttttgtatagcatgattcattacggagtgccagactgtgaagcgacgagaagtccgtgggggtcgctggggagtccattgcctctggttttgagggggagattatgatctaggaacggagcactgtggtgagttatgttgtgtaaagggtattgtcacagttcctttccgaggtaccgtggtggtattgaggcgcatggtgacatgttgtggagctgtgtcttgtgggtacagtggtacatctctgatcagagtaaaactattcgaatagccgtgcccgcggttatgggtgagtttaacaatgtttttcgtgattagtctcacaccactcattaatgataatattgtgttaattaatttgactcctggtttggaatggtatattccaggtatggaggtttgatttgtacaaccgggggttgattgtgcagatgaggttgggcctatgcaacacaggtgtgttgtatagtgtttatttaatactgattaattattcaattgttttattattctctaaaatgtttattgtttatgcaaatgagctttactatgccatcctttgttatcctgtgcacttgcatatttgctgtgtggcttgttgagtatgtcatatgctcattcttgcaatattcattcatcagaggaggggtatttcagtgaaggtgatgatctggaggactaggctttgtccgggttaagttgcttttggagtggagtcgctatagctgttccgtattcgttttattttcgctacgtagaattttattctttgagaggaactatccacctctgtaataatttactattttgcgaatattaattagctgtttaagagtactctattatcaattcgttattgtgtgcctcggctgattcctggacgaggatttaacacacatgtaagcgtttggaattttggatagaaattccgggcgtgacatggggccacgtgctgatgtggcaaaggcgtgtgatccaatacgacaatacatatatggagacttcaataagcatcatgaacctgctagtatacgctatgcaatcgcatatgcagatgagctaactttacaaaatgagataagttatcgattccatctattctaatttttaagtaatagcgagattaacaagctagatcatgtctctaattgtttttaatttggaaaaagtacgaattaccccctgaacaattgcggtcgaccgaattaccccctgaaccacaaaaccggacattcttcaccccgaactttgcaaaccggacaaataacccctggctcaatccgcggtggttttaatcctacgtggcagtccagtcagcaatttttctaattaaaaaatggtgggccccacctgttagttctcacccctctctgtctcttttccattcactttctctctctctcttctcatcttctcagatgaacgacggcggaggcagctggcgacggaggggagccgaggactccgacagctacggcggtcccagctaggggtgtcggagccgaggatagcgacgcgcctctgccttcgctgcgggccgaacgagccaagcgaccttcgcctctgccaccggcgcccgaccgagatccgcctcgtcggcgctcgtgcgacctctggctctaacgctgctgccagcgcccgagcgagcccgacctccgccgccgctgccagcgccctagcgagttctgcctgcccccaccctcacccgtcgccatccgtgaggtggtgttcgtcggagatgcggcggccgttcacgacgctggagggggagagtcgcgggaggacctccaccgccggtcgcggagaagaaggaagaaggagggtcgcgagggagctcaagacgtggtgggttcgtcgattgaccgcggaaacgaaggcgatgcggtcaaggatgagcggcacaccagtggttgcgagcctcctcgcggcggacgtggaggcagggaagatggtcgaagagccttcgtgtcctcctcctcctccgtctccggtgcacgtgacaacagcacggcgacgacacacaccaccatgttgaggatgacgaatcacgccgcggttgatcccagcatcacccatgccggcagcggccaccaccaccaccatcgcggagtgggcggtggctggcgccagtggagggcacgacggatgttggcacggctcctcgtgtgcaactggtgctccctccgccggcgccagaacatagctctggtcgtcgtcctccacgaactcgcccgctgccacattgctatcctctccccctggatgggcctcgctgccggcactatctgctctgctcaccacgagaggcagagaaggggagagagaaaaaaagcagcagtggcaagtggggcccaccgattttatttgtttttgctgactgtatcgccacatgtgtgccacgtaagcttgaaactgctccagatcaagctagggggggtaattagtctggttttaaaagtttggggtgtcaaatatctggtattgcagtttaggggggtaattcgtactttttccttttaatttcacacacgattagatgtattagtccagcatgttagcatgctcttcttgtgtttgttgttggcacgaagaccggcattatgccatcccagaacaatggttataggtgattactactagagaattgatctttttggtcggccgaaaaccataataaccgcggttctaaaatgaactgggactaaagatcatcgttagccccggttgaaatgctcataaccattttatgataccaaccaggactaaagatcatttttagtcccagttgaaaaagtgtccgccctcctaatctttttattcctggttggaaacaccaaccggattttcagtcccagttgaaaaagtgtccgccctcctaatatttttattcccggttggaaacaccaactgggactaaaaatcgacgcatatatagtatataattccttgcactaatcctctagcaaccacctcttcccttatcctcctcctctctttttcttatcctctccctttcctctctctattcttttcctctcaagcaagcacagcagagtgtgagcgagcgagtagggcggacttgcggtgatagagggaggcgcagcgggcagcggcgggtggccagcacaaggaggtaggaggcggcagcggcattgccggattgtttttgttctttctctttttttttttgagaatttatgattcattgcatggatctgagatatataatctgtgatgtatttgatttgtgtgtgatgtataatgtatttgcgatgttttttttttagaatctgtgatgtaatttttttagaacttgtgatgtatttagagatgatccttttgttctgtgatgatcgatttggggatttcacgatttggggatgtagtgaaggatttcacaatttgagaattatttggggatgtagtgaaatcaatattcaaagttgaaaacaatgaaaattcaaaaaccaactggacctagcttggctccatctttagtcccatttggtaacaccaaccgggacttaaaatggatttttaatcccggttattttaaccatctttagtcccagaattcgtagtcctagttgtataaccggtactacagggggttacaaaccggggttaaaaaccctttctccagcagtggattgtgtcgcatatagtgcctccgcctgaatggagacacgttgtcgacactgccctgaacggcgacatcactacctcggtacttacgagacgccactcaaagaatgatcgacatatacctggcctaaagcggttgcagactccgaacgaatcagctcgcacaccctccaccgcacgatatggtcaacgctagcatgaccatgacttgccaagcacatcattttcctaaagtcgatgttgatgagatcgagaacatgacgcctgtatgcgccagagactccttgctgccgcctccacacattggcacctcgatgatgccacacacattgtttacgtgacccactggatttccattgttggtctgccatctgaaacgccaaacgatgggtccttcgtgatcacccgctcttgcaatcgacagctgcagcctggagtgacgacgtggagctcacgccagcctaccctcgctgttggtacgcccgacatgcctcctacgcaactgcacgcggccgggacgcaggtcaaagccgccgtgagcacccgccgccgacccgtatggcaatccgagtttctttggcacgtagcatggagctacaaactgccggacaccgatcatggactgatgccaacgaatgccaatatcggtgttgcccgatgtcgcaccgccactccacctttgacctcaacaccttgtctttgttgtccgtctccgctggtaggttgcttacatgcttgccattggttctatccttcgcctctaccaaaaaaacggaattggagcggatcttgctctccatttgtggaacaagaccgtaatggctcatcgagcgagcacataagatgggccaactggtttttcaatctggtaagtataaggaggtgggctacgaatcttaatttgtcctcacattggcaaatggcatgaagatctacctcagtgccggggtacaggaacgtaccttggaagttggccacgaattggtggcaatggtcctcctatgagtacagagagccctcaggtaggtttgtcttccaggatcaagcctgggccttgaggatgatggggaaatagtttgccatcatattatcatcgcctttgtctgcctggatcgcaatggtgtagatctggaggaactccactaggttgacaaagacatcatatttctctgttaagctcggtaggaacttggcataccactgcacttgatagaggcccaaagagagagcatgacacccagaaccataagggcgacctcccaagggcacctcagcgagccctcgatattcctccttaggacaattcgtgcctgaggacgactagacctcctcgcgtcgtacattgttctcacgcctctcgcgctggtcctcgaggttgacaggggcatccttgtgcagccacagttcgttggggcaagcacaaatatacccatgctcgttccactctcggggcaaaccgcctcgtacaatgccctgatgaggggccggacgagccgcatgcgatcgcgatgagctcagggcagcgtgagacatggacccaaagcgagaagcgaggcctgcggccactgcctggaggtgggtagcacccatcaagtcggtaatcttcttgagccaacagcgctcgggagcaccactgtcagcttgacgttggggaaggcaaagcaacgcttctgtcatgaatagcgcagccttggtgtagtagagtcgaagttgagacaacgccacatcgtaagacagcgcgccttctctcgtcaaatggtcgaggccgccgcagaactagctcctaaacccccttggtgatagagggagtagaggttgcacgctttgcccgcctgtggtgaagatccgcccatcaagtgcaagcagtgcacctcgatggagattgtggagggtgcgatgtggtgtgaatggggtcgataaactcctccgctggcagttctgccactgcatgggagttgaagtcatctcgatggtgacccgccaagcgcgggaacacaaactcataaatgtgcacccctacctagatcgccagctgtcggcgtaggaaacccctatagcaggaaggcaaggtatccccactttgaagtttggccaaggtgttcaggccacttggaagtgtaataccctactccggtgtccttactatatgagatcaagtgtacaaagtggttttacagttgttctaagtattagatcatgaacacttcttcgatgtatgtggctagagcctaactcagtccagagcatgtgaactcaaacttttccaacccttttctcagtggcattggtcttccgtttaggtgctaaggaaataccacagcgcctatgcacgcacacaatggttggggcgagctaattggagttggtaaactggtcttgtcgatgtccttccaaacttgttagctggatgtgacaggctcaccaattggctaacatgtggatcagggtagacgaagtccttgttctagctatcaacggggccaccagtcggtctctaaagccaataaagagggggcccttgggtgtcagcagagtacgtgccacatcacccaccatttctctagggtgacatgggcaaacaaggggtgacatgaacagccacatcccccacatcgtccgtgacctgtccctagtaatcatatcacgccgcatttaacgtggattgaaagggtaaagcaacatacaggcctaagtaaaatagcctgaataaagcagattcgcccgttaagacctcatggcataacgtctatctcgaacccctagcccaaaaggagcaatagtcatagtctcgagcctgagctagctcagtcccgagctaacattgacgtcaagtcatcttcctcggcttcgaggtagcattcgcgactatttactattcttgctttaactatcatgggccccacagtgcaccaagaacctgataaagaggggaccatcattcccactttaccgacagtagccccctaccgcatcattgtgccatgttctgcctaagggaaacgaagaagactaagggggaattttggtgaaacaaattttgataatgcttggaaggggtatgtagtggcacgtctcaaattcctgtaaaatcataatggcatggttccaatttgaatgagggaatgtaatcttaacacatagttttatgcaaccagccctgtttcttaaacaaatattcttttaagggacaatttgaaccatgccacataaattgttttaaagcagaaattataactttaggctatactaggaactatctccatagagatatgaaagcatagcctaaaatttcagttacagcttctaggataagaacacatacatttgtattttatccgatcatcttagctatgattacggtattgaattgatgccttatctatacacaccttaaattgattccaaaattgtgctggcaccaatgctataaaaacccatgtgttgccaagtaagcatcttcatcaaacatcaatattacccaccagtcatctagtatttgatgtttgtaaggaaaaagatgaagaccaatcaccttgcactgattgcaatttccctcctggtgctatgtttaggtatttgagtacttctcagacataaggaagcaaacttccgtgcttacattgtctttacgatatctatttaatttgttatgtaagagaatttcatacctccaacacatactaaacccgtatattttccatctacatgtccagacatatcagggaaggtttcagctactgaagagtgtcatgctgcaccaatcacagaagtaccaaaaccttgcgttgatgcaacctgcaaagcgatatgctcagataagtaccaaagcaaaggcgagtgcttcagtactgatgggctttgttactgcaacttttgtgcgaatagccctccacttccacaaattgggctgaattgaagtactgagtctcgttaacacaaaatggtgtgatgtgcagctcattccaagtgcttaatcaataattacagaagatttgtaatttgtcttatcagcggaactgtttgaggcatatataagggtgataattggttgcagttcattttcttcgatttcattgggaccagaaatgcacctatgtgttctgactattgccagatgaataaactacaatatctaaattgtatgattcagaaaattcttactactgcttctaaaaaaacacatgcatcactattctaggtcaataaaaaacatacacattggaattttaagacactgccgtcgttggcttgtcaacgtataagccatcgccaagcttaattttagtgttgattttgagttttgcatcatagttaattcagtattggtttttaaatagctaaggacacatataaaaagttttactcgtaatttttttgtcgttcataagccattatggcttataatcagcttatgccaaactaagtatggcacacattggggaggtatgtatggacatatataatgaccaagttgcggaagaacaacttcactcaacaagatctaaaacttagaatatatgattttatatattgctatgaagttagtttgataatcgatttatgacagacctccatctcaagaacatgtcccgagctgagtataggtatttcttaacgacattaataaaaataataatcctagcaatggcgctggaaatggtcctggtatatggtttactgaagcaatccgcaagcgcacagaaatagcattctagcatttcacctgggagtattccaaggtttcgtatttatttaatcccaagagaagattgtaagagagaactatgctaataatttatacatgccacttgtataatcaaagtctgtgcagggttaagatatttatatcggtagcgtgacacgaagcacatcactcatgtatctcatttaatcattcctaaactaagtggaagaagaaatagaaaaacaatcaattcctataattctaatatacactaaactttagtctacatctgctagtatacaaccatatagccaataccccctaacagttccatcctggtgcatcgagatattgggaaaattgatctctcggtttgaaaaaccgggaggagatcatgcttcgaatgcagatcattgcttagattgttttaagggaacattcactaagaaaattaagaaatgggctaataggagcatgtgtccattagaataatccacacggatatatgtggaccattcccagtaacatctgttgatggatatgactcgttcattaccttcacagatgatttctcccgttatggatatgttttccccattaaagatatatctgaatcactcgataagtttaaaatattcaaagccgatgttgaaaatcagcataatgcaaaaattaaggtagtgagatcagatcgaggaggagaatattatgggagagatactccttatgggcaatgtcctggtccatttgtccaataccttcagatacatggaataattgcccaatattccatgcctggagaacaaaaaaaaatggagtggctgagcgtcgcaaccgtacacttatggatatggtacggagtatgcttagtcattctactttgtctatgaatattgttggtatttgatacggttacagataaaatccgcaagcgcacggatataccgatgtagcacttcccctatggagtattccaagggtatcgaatccaagggaacgtgtgtgatcagagcttcctccagttcatccaaggacaccaagcaaatgataggccaggatagagaggatttactagtcagaaacaatgcctaggaaaagcttaattttaatcctaacgcaatacttcaggcactggcatcccgttgttcccagatgtcgctctactacgtacccggacagggaggacttaagtgatctcgagggctgtcaccacctctacacccacctcaaacgtactatgggatatgcagcaattactggataataattatctaaacaccacctctaagcaactaatatctactttagtgtttataactcaccaaagtaatcacggatgcctccggttggggttcattagactgcgtcatgaaggaagtgttttccagaatgcgatcc

SEQ ID NO: 38530 - DNA, 21242 bp, Oryza sativa
  unsure (1)..(21242): unsure at all n locations
cacaatcttggccacctaaatttttccaacaaccagttatcaggccaaattccttcttcactcatacagtgtgctgttctattgtcccttaacttggaaaacaacaacctaagtgggagtataccagagtcattaagccaactgccggcaattcaacaaattgatctctcggaaaacaatttatccggtgttgttcccaccggaggtatctttggaaaaccaaattctgtaaacctgaaaggaaataaagggttgtgtgcacttacatccatatttgcattgccgatttgccccacctcacctgctaaaaggaagaagaacaatacacgatggctactgatagtgattctcattccaaccgttactgttgctttattctcaattctatgcataatgttcactcttagaaaggaaagtacaacccaacaatcttcaaactacaaagaaacaatgaagagggtatcatatggggacattcttaaagccaccaattggttctccccagtcaataaaatcagctcaagtcacacaggatcagtctacatcggacgattcgagtttgatacagacctagttgccatcaaggtatttcatcttgatgagcaaggtgcacataacagcttctttagagagtgtgaagtactaaaatgcactcgccatcgcaacctggtcaaagcaataaccttgtgctcaacggtggattttgacaataatgaattcaaagctctaatatatgagttcatggcaaatggcaacctggaaatgtttgtacacccaaagctgtaccaaggcagcccaaagagggtgctaacgttaggtcaaaggataagcatagcggcagatattgcttctgctctagattatctccacaaccaattggtacctcctctgatccactgtgacttgaaaccgagtaatattcttttggattatgacatgacctcacgcattggtgattttgggtcagctaagtttctatcatcaaattttactaagccagaaggatttgttggttttggaggaaccattggatatatcccacctggtcagtttttccattccaacaactggttatttgttcagctttacatctatctttttgttgtttttagcatactttcattaatattgtcttacagaatatgggatgggatgcaaaatctcaactgctggtgatgtgtacagttttggggtgcttctacttgaaatgttcacagcgaagcggccaactgacacacaattcggcagcgacctcagccttcataagtatgtggactctgctttcccaaacacaattggtgaggttttagatccccatatgccccgagatgaaaaggtggtacatgatctgtggatgcaaagtttcatcctaccgatgattgaaattggccttctgtgttccaaggaatcaccaaatgataggccaggaatgagggaagtttgtgccaaaattgcatccatcaaacaggaatttgacaaaaccatgtgatacagcgatttgggaaaaatgggagatgcattctatgtacgctcatcaatgttccaaaaaactgtgcactgatcaatgatgtagcttcctgggcatccgcagaaaagcataagccctcattgtacagagaagccaaaaacacttctctaccagcttcttcctggatacctaattctaaaaacatgctaaaccaatgtaaataaagcatagcttttattagactaatagctcctcagaacattgttttttcttgaatatgcaagagagttgcatatcattgcattaatagaagaagaaaggcgtccaaaacacgcctcagaacatagctactttatggttaattgaaaagtgatgaaaacgaacggctgttgtatacgcttaattgagaagaaatccatattcagttgaatatttgagtggtatatacctctcgaatattagttttgctatgggctaattaatgaagagaaatttcttgatatgccttaccacttactttgcttgcccccttgtggaagtgaccttaccttcaatgcctcatctttctttctccttcctcactctgcacgacacctccacattcatggaaaaccatcagttctggcacaggcacaggttgccatcaatgagacatggcgagcacattaccggtcagaggagcgatggcgggaggagcccaaggccatggcgacgacgacgacctggggacagtgttgtcgggggcaagtgggcaacaacctggggcgagggagagatcagatattcagattggccatggcgacgaactcctgggtgctccaggatgctccatcggcgagaaatcgacctggactgcagcgtgcagcaaatggcggctacggcggcgcggttttggccggatccagggaagacgacgtctccgacgagctcttaacttcctttttcacacagacctcagcactgaaacgaacaagactaggagagagatctccgcgggcggatccggcagcggcggcgatgcttttgagaggaggaggtcacccgcggcggtagctcgcggaaggaggttgcgccggcagcagcggcggcgccccacgcggaggtgcacggatccgacggcagcgctcgcgggaggaggtcgcgggcgatggcggcggcgcttgcgggcggactccgacggtaggtggggcgacgcttgccggcgaaactccggcatccggcaacgtcagctcagagcatccccagcagatacggtaaccaatcctccatcccggttttagcgtatagaggccaaaaaacgccctccagcggatacgctaacccacacgccaattttggcggatacgccatagtaggagagagaagcggtaaaaatagcgtatctctctcctcacgccatttcgcccgagcgcctctggatcgagatcccgcccccatccggacatcgtcaaccacctcccctccggcgcgagctcaccgctggcgtgccaccccctccatcaccgtcgtccccagagttccccgtgcccgtattttgccatttttcaacgatttgtggagcgggacttaccagatctggggcgctgtcgccgtgcgcccgccgccttcctcctccgtctccctgcacgtggccgccgcccggcgccccttgcccgtgagccgccgccgcccctcgcttgccgccgtcgccccttgcccgtgagccgccgccggccctagccagccgccgccacccctccgcatctcgcgccaacgccgcccctgagcagccagcggccggcgcccctcaccagccgccgccgccccttgccagccgccgccgcccctcagcttgccgccgtcgcccagcgccgccctgagcatcccgccgccgccgccgcccctcaccatctcccccgtccctctgcctgcggctgtttgaagagaagagctcagagcagagaaagcagataatgagaagatctcatttttgtatacacaatgtaattgatttatacaccacacacttgaatagagaaatataaatatagtatgttgatttttgtgaatttatgtttattgagcagatatatacaataggaattgagtacaaactagatttatattgctatattgcttgcttttatgttcgttttatttaataaaatgtaaggttagttgtaagatattaataaaatataggatgatggtatatggatgatgtagtatggataatctgttggagttggaagggatatggatgaggaatcttttttggatgatactccatatggacatttggaggaccaaatatagatgagctgccggggatgctctcagggccgtcccgtcaaattcgggggccctgttcaaagtttaaggggccatgtgcaaagtttaagtttaaggataaaaacttaattgataaaatactataaaataatttatactccgtaatatattttatagtaatctagaatggtctaaaataataatccaaaattagggattaccggattagaaattatcagaaagaattaggtcaggggcgcagcaggcattaggcggcacgaccgcacgagagaaagaggtgaggcgtcgtttactcctctcgtttgttgcaattggcgattggcgaggtccacagtgggaggcgattaaagattgcgaaccggcgcaactatgcgaaccggcaaaggcgtaatcgaagccgaaacgataagaaaaataacagattctcgagactagttagactacctaattacttattgagttgtatatccagtgttgaagttttgggcctaggggcccctgaaaattgggggtccctgtgcgggtgcgctggccgcacgcccctagggacgcccctgcgtcagcttcgtgtcctctccttcgacggtggccagcaacagtgtgtattgaagagagagagtagcgatgaaaatgtagcggatacagacgacggatattcgcccatagcatatttgttgttatattttctgtcagatattaaaacaaatatgaatagtacggaaacaaatacgaattatcttgaatgcgaataaggatcgaatatgatcggacatgaataaatttttttctcagaacacgaaaatcacctcaactttttatagaaacaaatatcatcatatatataattagcttgttttatatggaatatagtataatttataaaaacatataaatgttcaaataatattaaaatctaaaaagatatatgaaaggtcgtagagttataaaaaaaatggagtgtgtctcatggtctcagcgaatatccgaatatccgtattattatccacatacccatcagaaactctgataccatattcgtattccgggataaaatatcagtatccgtatccaaactatccaagaattatccgctcccaaagatatccatattcgtttttttagagcggacgaaaactatcgcttcgttttcatccctaaaagagagatgaagaatatgtttttttaaaaaaaaaattgaccagtcctcaagtagggagaaaaataccattataccatcgtcataacggggttgcgctataataccattctacaattgggttcgcccgatcgaataccaccttaaaatggaaccaaccctctgtgataccattccacatcgttttcatctaaatcaaaagaatttagtactaccgctggaatctttttcatcatctaaattagtcttagttggctcggaggctagggtgtccggttcccgtcgcgccaatctgggcaccaccctcctctcgcaccgtcgggctgtgccaccctccccttgcaccgccgcgccacacctgggcactcgcctcgcgccgaccaggtcaccgccctcccctctcactatcgcacaacgccgcagccctcccctcgcgccgacccggccgccgcccttcccttgcaccacctggccatggccgtcctctcgcgctgacccggctgctgcccatttcccaagtgcagacaacgaggaggagaccagccacgtcgccttcccttcacgccgccatggcgtgctacggcccttccgtcgcgctgtctaggtcgtcgccctcccctcgcgccaccgagccgcagccgtcctctcgcgccgacccggtcactgcccgttcccctcgtggtagaagacgaggaggagagcagccatgctactacccctctccacatgccggtccgttgccgccctggtactctagctcgctggctagcttcttcgatggtgccacctctcacttcacgctagttgaggtgaagttttgtcatcaaagttgggagaaaatggacaaaattattttgatttactagaaaggaagaaaatggcatttcatcagcgaactcctccatgttaagagtggtattcggatgaatcccaattgtaacatggtattcgagcgaagccccgttttgacgatggtataatggccattttctcttacgtaggagtataccactagcttaacctcaagacctttataagaaccaccacttatatttcggaagaatcttcccatcaggcgtctgatgcctgccaaaaaaaattgtcagtcaaatgttcaagttgacaaacgaatgaaacatcaagttatatatgataaaacaaaaaaaccggcaactgaaatatttaaaaattttgtgaaacatggtgaagatacacattgaaacatgttgtgatcgcatatgaaacaacaagtgttaacaaattgaaatgtatgtttttctttcaacatatcttgttataaagatttaattataacgaatacaacgatgttatcggattatagattggataagtaatttaggagaaaaatcattttgaagctcaataaaatgtatgcatgcatggatgaatgaggtggagagagagagagcagtaacaagtagtttcgggaattttcgaaacacgttgaagacatacattgaaatatatcactatcacatataaagcattgagatttaacggtttgaaacccatgtttttcttttaacataataaaatcaaatgatattttgttgtaaagatttaattgtaacgaatataatgatgtgatcggataaatattttaatagaaaaaatatttaaaaagaggaagaaggaagcagaagaaataactagctgcctactttggatgcatgcgacagggcgtccgatccatcggtagcctgatttacaacattctcgcaatatttctacatattagtgagcatgcccctactagcaaccagtggcaaacctacatataccttcctggatcacaagaccccggatatattactcggacaaacacttgttcaaatttattactataagttgttatattctcggaacaaggaagcaatttttttaatttgtttaatcactgctaacaacaacatatgcttcgttggttagcagagggaccttactatggccctgtattgatgggattaaaagttttgatactaattataaatattaaacgtagactattaataaaacccatccataatcttggactaattcacgagacgaatcttttgagcctaattaatccatgattagcctatgtgatgctacagtaaatattctctaattatggattaattaggcttaaaaaaattgtctcgcgaattagctttcatttatgtaattagtttttgtaagtaatctatatttaatactctaaattagtgtctaaatatatggactaaagttaagtcactggatccaaacaccacctatgacagggtgaggtcatgagatcgattctccatctatgtttacacgcctaaggccctgtttagttcgtgaaaagaaattttttttgtcacatcgaaggtttgatcggatgtcggaaggagttttcagacacgaatgaaaaaactaatttcataactcgcatggaaaccgcaagacaaatcttttgagcctaattaagctgttattaggacatgtgggttactgtagcacttatggctaatcatggactaattaggcttaaaaatttgtctcgcaattttccatgcaaactgtgcaattaatttttgtttttatctatatttaatgttccatgcacatgtgtaaagattcgatgtgatgtttttgggaaaaaaattaggaactaaacctggccttaatgtttaccggtcctaatgcaaattgaacacataggcgtacgtgccaagccattgactaattatagcaagtttaatagtatagccaagtattagcttcaaatcatttatagtcaatttatacaatagttacctataaacatattctacataattaatgtttggtcccacctgtcatacacacatacatcttggaatctatgctacagctggctacaaatttatagtccgttgctcttatctcttttcttttatctccttaaaatatgtttatagttgacttatagggcttgtttgggaagcagttggtggtagctagcttctgagaatctggaaaagttgggttttctagcttttggcttctaggtcattttttggattctgcagctacattttctcagaatctgtactaaaagctacactatttgggaagcttctgatcctgagaaaagctgcagcagctagaagctcccctaaataagctcattgtctactattgtagctgctcttagtcgattgctttgctctcctagcacttcctcacttctagttgtataaaaatttgatgtcaccagtatatgctaatttttgcctattgtatttgctcttatgcccacctaggtaggtcttaagaaccgttgttctcctagcctacggcgcgccatcatcatcatacattgccgtgggttgtttgtgcagtagccactcctatgaacgctccaaaaattagaatcactggcacgctttaattatgctacgttcgtttgatcttaattatatacatgtctaaatcatacacgtataaaatgattttggtcgtttaagtatttaatgtcatgattaacactgccggagaaacccacgtcactcccggttcgcaacctcctttagtcccaggttgcaaaccgaaagggagaatccggtactaaaaatggcgatatttagtcccggttggtaaagatggctgagccacatgatctcaaatgtctttagtcccggtttctatcactaattggaactaaagaggtgatctttagtccctgttggtgttaccaaccaagactaagttcctgatgaggacatcaacaccatcgatacatccacgtccccccatatacagcatgatggtcctattacccgcgctcgtgcacgtcaactaaattatcaggtgagttctttcttgagttcatattcctcgtctttatacctcggagacgcgtgcactcgtgttttactcaggaacgatggagaggatccaaagggaagaggattcgcgcggggtggattcggactgcagggcagcgccaacttctaacggccgccacgacttcatgcgaactccgatttgggcgtgcaagtacttcatggaaagcttatcaagtctactttcaaatggatccagccacatgtccatatctgttctggagcggccgcaattgtcattttactcccgactattttttgtccatggtgctgcgtcacctcttttggcccaatgggctgtgtatccatgttgggcccattaggggcgcgtcctagggttggagcacgaccctatggtcgttcttcccctctttttatacctctagtcgccgccaagaacaggcgggttttgatgatagagatagcttcttgctaccggctcgcagcgcgcgtgttggctaaaccgcccgtctgcctgtaattggaaccccaccatattgtgtttgatagtgaaactttcatctttatctagcaatctcagtgcttgtcctacttgttcttgcttgttcttcgattgcttgcaggacgagtgccctcgtggctaggttgacgcgcaccacaagttcgcggctaccattggagacggtgtatcggttgctaaggtgcagcgtctttagacagttgtagtcgggccgtgaatgtcgacttcatctaatcgagttatcccttacctctcatcgaaagatcgggccacaaaccctagcgggttcgcatcagttccccagccccctgataggggtttgacatgccctgtcaaggggcgaaccgagactaaagatcacttagtcccgtttgagttataaaccaggactaaaaaaacctctttagtcccggttctttatggaaccgggactattgtgcttttcgtccgacccaataaagatcagttctccagtagtgttactaaaaagagtgaagtatccctaaactagtgcgagtgtgtcatgtaggtacctgaactcttaaaatgtttttttttcaaacttgtcgtgatcgatatcatataggtccaaacgaactcaaacccactctatgcgctgacgtggcatgccacggtgacgcctacatgttagtcgggcccacgttttatatcacatagaaaaaaataaaattagaaaaatatgttttcttctctctactttagaattattttttttaattttatattttttcctctctacctaagagggaaaaaatatgttttagttttttttatatatgactaacatgtgggttccactgacaccatggcatgccacgtcagcccatatagcgggttagaaataacgtctaagattagttcataaacccaaagatgcaatttttaaagtttagagatctagataacacacccttacaagtttagagactactaatgtattttactcaagaacaaattaaatctatgtgcgtttgcttatgctttaaacgcatacgagaatcagaattttgaccacgagttatagcatttttcttctagaaactagtatgcctcttgcgggagttgcttattaactgtttgacactactaagatcaaactcatcttttatcctcaaaccacgaatacaacggatgtattaagaaccggtacttattatcggttctaaaagctcgagaccaaaaaaatatctttagtcctagttagtgttaccaaccgctattaaaaatacatccttagttcctgttggtaacaccaaccaagactgaagatcgaggatctttagtccttggtggtgttaccaaccggtgttaaagatacacttttagtaatgcttggtaataccaactggtgctaaagatacttaccaaccagtactaaaaatgcctctagagttagttaaaaagaaaacatatctattcaaatcacatgtgtgtagtaggtgggatggtaacacgcatgagggttgaggtgagagatcttgagttcaaatcccacatattttatgacttagtatatatctttagtaccgattccttcaaccgaatcaagaaattcagtctcagtttcttcgtctcggttgctacaaccggattaaataggagtttagtaaagatcatatctctactagtgtgatgaacccacgaacaatatagaaagaaacatattttagcaacatctcctcctagtataacgatggtccagattaggttagcttttttttttttaaggacggagggagtactattttttttattgcttccttccattcactgggaaagcctagaaacaggctggggttacaccgttctgcgtggaactatagatgcccaaatgggccgtccggcccgacatggcccaggcacaaccaggcctgagccgaggtcgggctgggcctacccaggggctgcatccatggcccaggcatgacaacccatcgtgcttctccatacaataagtatatttttccttcctcatctctctagacattgccttataaggctaggttatgtctattttgggtcccgtaattattttttctttgaccgtgtcgtgccggctaaccgtgccaagacatcggcccaactatcaggccaggccggataggtctaacacccggcacaggtataagaccagtagtgccacgccgtgcttgggcctggccaaatggctgtgccatgggccaggtcgtcgggcctcgggcctcatggcaatcgaacctcgtcgctatttcgatgccgttgtcacaatgtcctggttagtcagtctgttggcttctttggaaggttctgaatgacaaacaaaccgtgttgtcgttcctccaaatttgtaccgttttccctcttcttaacaaaaaattgggtgttctaaaaaaaaattgggcggcaaatttgttcgccggcggccggcccgaagcggcgaaaaaagaaaccgagactgttttcccctctgctggacgacgacgacgatttgatcatgtcgaacttccatgtgatgtcatcaacacgtactcacctggctaccttcggtgatcaccatcacaacagcatccagcactttgccgcgccggaatacccatgaagtcgttgggaggtagccgtcagcacccaccctcactttcggcgaattgtccaggcactcatcaggcatttcagctaacaagctgcatatacaccattatatatcatcctcatctgcttattgtaatctacaagcttattatgcacattcgaattgctagctagctcgtcgaagaaaccaaagtgcgagcgatcggctagctgctgcaagaagccttgaccatggaggccagacaccgtgtgatgtcgctgctgctggtgctggtgatcggctgctgcgcctggggctgccgccctggcgcggcgcaggtgcccgtcccggcgaggacggacgggttcgtgtacggtgggaaggcgccggcgctgggggagacggtggtggtggaggcgtacttcgaccccgtctgcccggacagccgcgacgcgtggccggagctgaagaaggcggtcgagcactacgcctcgcgggtgaccgtcgtcgtgcacctcttcccactaccgtgagtatacctatatgttgatatatactaccgttcactatatgctatatgcaaaattcttgtgggacaaaatctcaaattagtgcgaataatgtttagtatttataaatatcttagtctctaacaacataagttgttagtatcctgaattccttgttcatagtatcaggtactacgtacgatcctaccgaatcaaaacgatactaattatgtctaatatactaattttctctatatccaatcttagtttcatatgatcctaacggatcatacacatgtcgtatcttggtcactatgatcactatttaaaataatatggattgaaaataatgtcaaaattaatgttgtaggatttaatttatacaacatattacaaatgttttatacaaatatgtaatttttaaaatttgataggaaattttttttacgttttatcccaatactaattactagcatcccgtttttgaagcatcaatatatggtagagttgtaattttcagacttaactgaactatgacgtacggtaaatcttttcaaaatcgcgttgtaactatgtgaaatttagctgaaacttcatataggggaggagtgaagcgagtggaagaagagtctgtgcatgaatgtcatccgagacttgaccaagttgtggttatccatgtattaaggacatccgaaaaactaaagttagtcttgctggtttcattatcaagaaagctactcttgtgacttctcctttttgaaacgggccagatggagacacgttaacattcaaacaccacttattgtttcgtttgaaaattaagaactccatagcagtgattgataacaatctgcaactaaacttttacacagaataatcaagctgaactgagctgtagttacctgagtatattatcctaagggtaattttaccatctttagacaaaattacccttaggagaaattatctggaggtatcatgtttttttagtgtaaaactttggcacctctaagtactaggtagtagcctagtaggtgtctcaaggtaccaaattttagtgtaaaatttagttaccttagatattttatcaaggaccataaaaattctcttatcctatccaaacgggctattagtatttcctttcctttttcaaatgcctgagatacagccagagaacagataacactattggaaaattcataataatatgtaaaacagaaacatgggaaactagcaaaatatattgttttgtcaccgccatgtaatggcaaattaattttgtggattaatttccatcgttgagaaaaacggataccattggaaataaattaaatgcccgaatatatgctccctccataaaaaaaaaacttaatcaatatcctaggattaggtttttttttatggagagagtaaggcacaagcaaaggtagcaaaattgtttcctcgccttgtaaatggcagttttttttgacaggccttttgtattttaaatgtgaaattatcccatcttatctttttaaagttacagcgcccaatccatttttattatcaacatgaatagactaattacaatcgaattgctttatgtcagttgccgatctttataattggagattacacaattctaacaatgagaaactcaactcaaagtaaaattgacgataagaaaatcttacaatcaagaacgattgccaaccaaaaagttgcctgcggatgggggaaaaaaataaaagcaacaaaacaagtagcgctttgggcttggtattagtctattcgttcggcccacttcttttctatttgcacaccgcactcaacaaattgtattggctcctctagaaaacctaattatttaggcaaaagaaacagagagataaagaattggttctgctttttcctagcacaaagcgcctttaatcttttgtaaggaatatattatataggaatatatatgttatgaagaatcattcggcggcaaacttatgaagccacaatttggtttcatttttattttagataaacaaaatttcatctggaaatatcccgtcaagtaacatgtaataatctaaacgtttcagccattaaactaggctttgttctacacctatattcaattttgaactcacagaagtacaatttactgaagtgatacgctattatattattcaacgaatgtggaccactatatctagacatgataataattctaaatgaaattccaattttcatcttttacgagaaagaaaaaatgtttagtgcaccctgcaccaggcattttgtccctcgttttactacgcatcaagtttaatcaatatttttattttacaccactcttgacgcactgtgttgtttgacaatagctatttaattaggccatgtctgctaccatttgtatgtattttcagcttgaataacagttaatcgttgagtagcatagcatgcccaagacacattgccatggtaaattcatcacaagtcattatttcgtaattattttctggttcgttttgctctttgcaatgtgcagttatcacagcaatgccttcatttcctgccggtcaattcatgccgtgaacaagataaatccgtcgtttgtgtatcccctgctcgagagattcttcaagtaccaggttatgtcctctccattcatcattccgatagtgtcattacggatttacataatgccgagagattgaacagttaaatgtcagaaagaaagacatttaaacagttaagttgagatattaaaataggtaaggtaacataaatatttatgtggagaatagatcaataccagactcgatagcagtttggttacagtcccggccgatattaatttcctatccagccacaattaaacttccacaagatagtaattttggtaactattatcttaaaactacaggagaagtaatatttccaagacggttgtgatagttatcagagctaatcttggtccgatcaattccattttatatctgttttttttttcttgttaacagcagaattttttttgaatgtttaattagtttattacgtagaaaaaccgccaaatgatcgatcagacagcatgattactgaatatcacaacaaaatataatcgtggacttcttgtctccttgcaaactatagcatgcttaacttggtgacccacaatctcacaagagatcaattggaaaagaaatatgtccgcactcttccttttgtaattttacatttaagttatctcaaaatagaatattgatttcctcatagttttcttttatttcggaagtcactacttccaattaacgtcagattattattgatcaggagggttattacaaccagccaacgtatgggaaaacaagagctacagtggatgcagaggtagctaaaaaccttgttgcccccgtcattggggaagccaatttggcagcatacaaagcaggtttcaatgattcaaaatcagatcaagccacacgaatttctttcaaggttagaatccatgtgctcccagagaaaactaatttcattcaatcagattgttcatatatactccctccatctctaaatatttgacgccgttgattttttttttaaaatgtttgaccgttcattttattcaaaaaatttaagcaattattaattcttttcctaccatttgattcattgttaaatatacttttatatatacatgtagttttatatatttcacaaaagtttttgaataagacgaacggacaaacatgttaaaaaaagtcgacggcgtcaaacatttagggaaggagggagtattatttatcctggtttaattatgtaccttttccattttatcttcttgttagtatggttgcgcacgaggtgttacgggaacaccgtacttctttgtgaatggcatcccccttattagtgactctggttccccactggaatacaacaagtggaaatcaatccttgatccattggttggcaagatgtagagagtgtttcaactaaagtcctctgcctggtgttaaatacaagactcaagacaaataagcttggcgcaaaaacagtatgatttcgccaagatatagatggaacgatattgatcacaaagatcaagtttagttaggcaaataaaagggcaaccctactctaatgacatatattgtctttaccttgtattatgagacagaaaagaatttctataatacaaaagagatgtagctctcacatacaatggtatcccagtgtgctaccaacaagacttgtatgaaatatagtatgcattttaagatttcggatgttatgccaaactacattgataaggaagcagtgttacattccttggttttcattatccatatatcttttagccaaaaaaagtaattatcagaacaacacaaagaatataatctgaggtgagcccacgccagtacagaaatgggccagtagggaaattggcaccgatatgggcaaagctgcaaaactggcagtattctgattttttgttttacaggcaccaaaaaagctctaagtatattctgaagggctatccctgctcgctcttaatgagaaggggctagttacaaacccatttatatacttgtgatagccaaagacaaaacgtactatagggcaagccaaagacaaaacaagagagtttgggaagaaggtagtcctgtctgacatgaaaacgcactattagttatctacttcctccgccctaaaatatcgctaggatgggatttgaaatgggcggaggtagtaattcataagcctttctagaatttaccttcaaatccgtgtgtctttcaaaattttccactaaagatacgaattgttttattccgtaccattccatcaggttgatagggccaaccgtcatccatctactaccaccgtcatcctagctgccaattccaccatagctgtggacaagccaatgggccgactagctcctggtgttaggaggatgaggttgtcgccgtcatcttcaagcccaacattaagtggctgacctccgtctccgtgtacgccgatccctttctatcgccttcaactagttcaaggtcgaaatctcctcccctctcaagtgctttgtcagactcccgcacggtgctgtgcagccactttcctccacatcgatccctccgcatcatgctcctgcagcagcatgctctcctgtctcccacactcccacaagcgaccacttcctcatgctctcctccttctctgttgtgcacctctactccgcatggcactagacgtcggggatggtaggacttcgcaacagccacacctcctgccattctagagcttgagcaggtggtcctcgacggtgcaaagctctaggtgatactgcacgccacggttccaaggggaagactgctctgcacatggcagccacagtggggaaggtataggtttggggggggggggcactggtcgatgcagatgggtgacaatgccacgactaatgattcagtaggaccactcatcccctctcaacgccacatgtgtcatgacgagtgtcctgagccatgtcatggagctgactataagatcaatgtgtgttttgattcttattctgtgatgaacaattggcatctgtgattattggttttgatatttggagattactatcgaagtggtttttggatatagctgttttgtcggttttgttgggactggtcagaccgggcggttgttgccggtcagaccggctcatgtgtagcggtcagaccggccggcccgcggtctgactagccgacgctgtgtcgatttcggttttgggttgtttctttggatatccgtgattgtttcatggttatggcttctagatggatgctatacgtatgtaatactattgtttgctaacaatgagtcaagttggggatagcttggtctcggaatatggtttctttgtttgtttcatatgtaggtgactcgatgcctcgggagagtatttgcagtgatggaccgggagtcggcttggtggtaagacgatgtctgtggtggtcagatatcatgcgggatactaaggctagagttgatgcacgtggttggtgaagattccatatggcatatgatggaggtattgtgtgcgtatgggatgcggagtcgaatttgaaaggagtccaaattaggtatgattggttatgtaaagtttatgtcttgtactagagggtttcctaaggtgtttaggactcttagtatagtntggttcgggcttaaggctgcctacctcatgtataaatagagggggagcgtgaggcttcccggtatcgcttttgtatcgcttttgagagcaattgagttgctagtttagttagggtttcgagtttagtcgagatttttgtaaggagtgctgttggtgcactttgtaaacacagagagaagcaataaagttgtcatctacttttagagatcttcgatttgtgtttcaccgggtttcggcggtctaaccagcaactcaccggcggtcagaccggcggcaaggcggcggtcagaccggcgggagcacggcggtcaaaccggtggctgcaacaggcgcggcaggcgacatcggcggtcagaccgggtgatctatactggtcagtccgggggcatccactcggtcagaccggcagatcaatctcggtcagaccgacttccgtcgaattcgagggtaacttttatttccactaaaagttttcggtttttggatataccaaccattcacccccccttctggttggcttagttcttgtgattcaatcctacaagtggtattagagtcttgttttcttctttggattttaatcgatctagagtttttgccatggctactcccactaggttttcaactaagcctcatgttttcgatggaacggatttttctcattggtgtagtaggatgcaatcttatattatggctgaagattatgatatttggagaaaagtttctcatccttatgtgattcctgaagctattaatactgatgctgaaaaaactgcttttgaataaaattgcaaagctcgcaatattcttttgagtggtatttctcgttcagattatgatcgtgttgctcatcttcaaactgctcatgagatttggactgctttgagtaattttcatcaaggaacaaataatattaaagaacttcgtcgtgatctttttcaaaaaggagtatattaaatttgagatgaaacctggagaagctttggatgactatctttctcggtttaataaaattttgagtgatcttagatctgttgattcttcttacgatgctaattatccacaatctgagatttctcgtcactttttgaatggtcttgacatgtctatttgggagatgaaagttacatctattcaggagtctgttaacatgtctactttgactttggattcgctttacacaaaatagaaaactcatgagatgaatattcttgctcgtaaagttgattctaagtcaagtgctttggtttcttcctcgacttctttggatgttggtggttcttcatcgaagtcttctgttcttgctttatttaatgccatgtccgatgaacaacttgaacaattataggaggaggacttggttttgttatctaacaaattttctcgacctatgaaaaatgttaggaataggaaaagaggtgaaccaaatcgttgttttgagtgtggtgcacttgatcatcttcgctcgcattgtcctaagcttgggagaggcaagaaagaagatgatggtagagtcaaagatgatgaattgaacaagaagaagaacatgaaggagaaggagaagaagaagcattgcatgcagtggttaatccaagaactcataaaagtttttgatgaaccggaatatgaagatgagggcaaaggtaagcaagttgttgatttagcttttattgctcgtaatgcaagttctgatgttgatgaatctgatgatgataatgaagaaaagcttagttatgatcaattagaatatgctgcttacatatttgctaggaaacttcaaacatgttctattgagcttgatgagaaggatcatactactgagattcttaatgctgaaattgctagattaaattctttgattcctaatgatgataattgtcaatcttgtgaagttttattttctgaaattaatgctttgcgagatgtcaattctcttaattgcaaaaaattggaatttgagattgaaaaatctaaaaagttggaatcttcttttgctcttggatttgctttacatgcttgtgttgttgatgagttgattttgacaaagaacattttgaaaaaaatacaaagttgctttttgtgcaagttctttggtcaatgcttcatgtgcaaataaggcaaaacaaaataatggtgttttgatttctcaagattgttcaaagtgtgttttgaatgagttaaagttgaaagatgctttagagcatgttaaacacatggaagtaattgttaaacaagatgaggtgttttcttgctcaacttgtagaaaacaaaaatgtcttttggatgcttgcaaaaattgtgctattcttactcaggaggtttcttatttgaaaagttctttgcaaagattttctgatggtaaaaagaacctcaacatgattcttgatcaatctaaggttagcatacataatcgtggtttaggttttgattcttatgcttatcatgctagacatcctcctaatgttttgggtgttgctaggagaggtgaaattttgattgaaactgagcctaagaacactgtgtttaaatctgctggcatcatgtcttctttgaatgcatcttcttcaaaatcaaatgttgtgaatgcaaaaccttctgttgctgcaaaaccatcaatttcaaaaccatctacttcacaagtttgtcgtgagaagtacacttgttctttttgtggaaaagatggacatttggttggtttttgttttaga

SEQ ID NO: 38531 - DNA, 18790 bp, Oryza sativa
tttttttggatttttgggagaagcaaggtgaatttttggagaagagaagagtttttgagaagagcatgtttttggttcaactgggaatttctttcttttaaaaagagggagaagttttcttttggatttttgagcacgatgtgtacgtttgtacgaagtgtgctttttaccgcttttgtttttatttttccaaacacgaaaacatttttaatgggtttgccaatgtgttcatcaagggggagattgtaagattaacgtgtgttttgattcttattctgtgatgaacaattggcatctgtgattattggttttgatatttggagattactgtcgaagtggttttttgatataactgttttgtcagttttgttgggaccggtcaaaccgggcggttgttgccggtcagaccggctcatgtgtagcggtcagatcggccggcccgcggtctgaccggccgacgctgtgtcggtttcggtttcgggttgtttctttggatatccgtgattttttcatggttatggcttctagatggatgctatacgtatgtaatactgttgtttgctaacaatgagtcaagttggggatagcttggtctcggaatatggtttctttgtttctttcatgtgtaggtgactcgatgcctcgggagagtatttacggtgatggaccgggagtcggcttggtggtaagatgatgtccgtggtggtcagatatcatgcgggatactaaggctagaattgatgcacgtggttggtgaagattccatatggcttacgatggaggtattgtgtgcgtatgggatgcggagtcgaatttggaaggagtccaaattaggtatgattggttatgtaaagtttatgtcttatactagagggtttcctaaggtgtttaggactcttagtatgagtttggttcgtggctttaggctgcctacctcatgtataagtagagggggagcgtgaggcttcccggtatcgcttttgtatcgcttttgagagcaattgagttgctagtttagttagggtttcgagtttagtcgatatttttgtaaggagtattgttggtgcactttgtaaacacagagagaagcaataaagtcgtcatctactttgagagatcttcgatttgtgttttaccgggtttcagcggtctaaccggcaactcaccggcggtctgaccggcggcaaggcggcggtcagaccggcagcggcaacaggcgcggcaagcgacatcggcagtcagaccgggtgatctatactggtcagaccggcggcatccactcggtcaaaccgatttccgtcgaattcgagggtaacttttatttccgctaaaagttttcggtttttgggtgtaccaaccattcacccccccttctggttggcttagttcttgtgattcgatcatacactgaccaggtccatcaccaacgtcgtggcggtagcaccatagtcaccgatgccgttgcctaacatgggacgaaaccacccatttcattctccacatcatgacacaggtgtgagtcagtggatcaatcggtatccatggtgcagtggcaatggtgctgagtggcgccaacggtggtggttcttggtgacgcgttgcaatgtggtgactgtagatggatgttgaacgtgtggcctggtcaaatggatagagtggcacacaacaaaacaatttgcatcccttatgagcattgacaatcaaactttcatggccaagttaaggataacataaaatcatttagacatgtgaaaagacaatggagttataacattggattacatcaaaacagttggaaatccggcaaatccctttagtaagagactataaaataatacgagtgatactgcatcgaaggaggtgagttatactatggtggtaacacaaccaatatgatgagagatcccatggattaggacctgagaagtacaagccaatattcaattagagaacaatatcttcgttaaaccttattaagtgaagatgcagatgtttcggttacacgtcctgatatctccgtaggttacgtgcaactcattggttttggttacgcattatggagatcatggaggcatcatgatcacttgtcctaatatcactataaatactgagtcgttgaatccacgcaacgcgcgtgaaaataatctagggtttcccttcttctctgtacaacatcgtgacacgtagtctactccatcccacctagcaggttatggtcttcgtcatcattgatgaataagatttttgggaagcgctttgcgcaattgctcactatttgtctgcgatgacacgtcttcctctatgttcaagtgatgcacgttgtcatcatcatctggtacttcacgatgtatgtgcactaagtgttgcatgtaccccatccaataaaaaatagtgggtacgtttcaactatattttgtatatttgacctattcatgtttagtgatgttgtatatatgttttgatcatatccgtgcgagatgatcacgttagtttatttgttcaatgtcatgatttatttataagataaattaaacaccaacatatgtgcttatattttcaacatgagaagctatcatggcggccgttgggtgcagcacacatgacaagtagcacgacgggaagtgatagcagtagcgtgttggagaaatgggaactaggatacccctttctccaggtcttagggtaacatttgccatgtcatcacattctacggaagcagaatacaatactagcagaatacaatactagcacaaaaatcaagcagaatacaagaccgagcgagtcaaccaaatattggaggatatgttgagagccagtgcgcttgactttggtggagcatgggaaaaaagcttgccgtatgccgagttctcctacaacaacagttaccaggctagtctgcaaatggcaccgtttgaagcactgtatggacggaggtgttgcactccgctcttctaggatcagacaggggaacgccagttgtttggtacagaagttttaaatgaggcagaagagaaagtcagagctgtcagggaaagattgagaatcgcgcaatctcgacagaaaagctatgcagacaaccgccgaagggagctcgttttcgaagcaggggattatgtgtatctccgtgtcattccgctcagaggagtacacctcttccaaaccaaaggaaagttggcaccacgctttgtgggaccatatcggattttggaacgtagaagtgaagttgcttaccagcttgagcttccctccagcatgcttggcatccataatgtgtttcatgtctctcattgaagaaatgtttgagagttccagaggaacaggcaagtccggatcaaatcgaaatccaagaagacttgacgtatgtggagaagccgactcgtatcctcgaaacaagcgaaaggagaactaggaacaaggtaatcagattctgcaaagttcagtggagccaccactcagaggaagaagccacttaggaaagagaagatgagttgaaggccgcccatccgcacctcttcactagctcttccgaatctcggggtcgagattccatttaaggggggtaggtttgtcacgccttgaagtttccctccctttttcttgctttaaaaatttgttgaataaatcgttcgaagaaatggttcaaattaacctagagctaatttcttaattaatgaatgcaattaataattggaaatggcattgtggaatttctcttgggttccacatgtcataatacattaacaggaattttagtggaattttcagagccttaaaagtaattttaaccaattaaaatcatcaaagtgcaattttaatacccggaaaaataatttttctttttctcttcctcctttttctcttgatgggccgtcgacccatctctctcccgcgcccctccctcttgctgggccggcccaagccgcctcctctcctcccttggggcgccgacaggtggggcccacctatcgatcttcttcctactccaactggccggcaaccgtcgtagaaccgcccacgccgtcgcctttcccgcctctcccacgcccactccgccccgcgcccacgtcaccgcccacctcctccacctctcccgcacgcgtgcgcactcgcttggaggcgggattcgatttgaatcccacccctctctctctctccctccactcccccacgtcgccggcgcaataggggccctcctcagccacgtctgcccttcccgtgcccataaaatccttcccccgagccccctctctcgtttacctcactcgctgcgctcccccgtgcctcctaccgccgccgcaccgcgctcgccaagcttcgccgccgttgccgctctccggccgtgcatcgccgccgctgccgcgccgtgaaaccgccgctgtcacgctcgccagtgccgtccgcacctcggccgccgctcgcttaccgtgcgccgtcgccgtaccgctctccccacacaccgctgcctactgccaccttcattcgccgctagccgccgctagtcctaccgtcacgccactccgtcgccaccatcagcctcgcgaggtcgaggactgcctcgtctgtcacaccctgattttcgttacaggatttataaattatttaataaattattatcagaatttatattaaatgttcattaatttactagtgaagttaaatgtgggaaataaaaatataaagcatggatgtatttaatttttattaaattcttcatggttaattatactctctagaactttctcggatttttcggagctcaattcctaattttaatcatacaaagagaagttcagcaattatttaaatattaaattaatcattaaatggtctgattgtaattttgttaagtactttgagtgtccaagtattttcaggatttttcttgaaattatttgagcataggaagtatttttaacaattcaaagatcatttcattgattaatttaattggaaaagtaataataatcctcctcctcagcttgggccgaatccagcccattccctcctttccctctcccttcctctcagcccggcctaaagtctgtttgacctccctggcactacagtactccatcttcctcctccagacagagccgagccagccgtgctcgtgcacagtgccgccgcctccgccgtcgccgtcgcttgccgtcgccgccgttggtttcgccaagaggtggagaagctcggccgccacctctccttcgccgccggccgccgtagcccgtccccaccggccaacccgagccgccgccgtcgcctcctcgtcgccggccgtcgtcggtcgtcgtttggcacgagggtgagtatcgttgggttcgtctcgtcgtcctctacgtgtacatgtcctccaaaatcccggccgatcaccctagctccggcgaggtcgctatccgagccggccgccattgatgacgtcatcatgacatcaacatcttccccttttccagttatttctaatagattaaatcttcggaaaatcataactaaataaccgtagatccgtttcaggtggttcaagttgctaaatttttctaaaatcaagatctacatgttaaaaatatccacatgtactgtttatgcttgtttttgtactgttttgttgaattttgttctttcgctttagtttccgacgttccggaggagagcgttttcgttgaggaaggttcggaagtgtttgcggaagctcaaggcaagtcacacagatcccaaataaccctttgagcatgttgaacccgtttaaagctattattttatttcaactatgcattattttcgaatgtcattgggtggtgaacctttccccgttaattaatggcctaagatgactttattttcctatgggttataatttgattagcatgaaccttatatattggattggttcagctaaatgctatatgtatgtgtgcttagccatgcttagaaacattagctaactaaaggggttaattataaactatattatattatattattattatggttatatttaatggtcgctcacgatggttaatcgtgtgatgttaattaattgataaataaaatctggttaaggtgggttgtgagcatatggttttgatggttgtgctcatgacaattaaggaccggttcgcgagctactgttgtgagacatttaccgtaccaaccacaagccagcatgggcaacggctttaccttttgtatagcatgattcattgcggggtgccagactgtgaagcggcgagaagtccgtgggggtcgctggggagtccattgcctttggttttgagggggagattataatccaggaacggtgcactgttttgagttgtgttgtgcaaagggtactgtcacgatttccccctttgcaatgccgtggtggtatttcggggcatggcaacatgtgtggaatcgtgtcttgtgggtacagtggtacacctctggccagagtaaaactattcgaatagccgtgcccgcggttatgggcgagttgagcaatgtttttcgtgattagtctcacactactcatcaatgttaataatgtgataattaatttgactcctggtttggaatggataattcctggtttggaggtttgatctgtacgaccggggttggttgctcaggtttggttgggcctgagcagcatgggtgtgctgttcagtgttgattaaaattgatgattaattactctactgttttacttatcttaaatctttgctaaacgctgcttttgcaaatgagcctatattatgccatcctttggaatccttgtgcacttgcatatttgctgtgtggcttgttgagtatgtcatatgctcattcttgcaataatcatcaaacctcagttgaagataaaggatccagaaggagaagacgtttggcttataccccagttgagctgcctgtgggagtggagctgaagccatcgctagatcgttattccgctgctgttttcttttcttttgtaagtatgtaacgttattattaagatggatttgtatattaaattgtcagtttgtgtacctcggctgattcctggacgaggattttatgcacaaattagttcggaaattactagtgaatttccgggcgtgacatcgtccatcccgcgcaccccgccgtttgctgctagctgccaccgtctccccccacgtcggccaacccacggtaagaaccccctccccctgtcacatcctgatttttgtttcaggatttataaattatttaataaattattattagaatttatattaaatgttcattaatttacaagtgaagttaaatgtgggaaataaaatttcctaaatataaagcatggatggatttaattttcattaaattctccatgattaagtctactctctgaaattttctcggatttttcggagctcaattcctaaatgatacaaagaacagttcagtaattatttgatcattaatgatctaattataattgttaagagcttttcttgtttaaaaatccttaaattataaattgttgtttaaaaggagtaattagaaatgatcttaaaagcctaaaagagaagatctaattttaatttgctaaatctcaatataaaattgggctagataaaattttgataaatacttctcttgaatctttagttcctagatttttctgggatttatttgagccaaggaagtatttttaatcaatggaatatcatttcatgaataatttaaatagaaaaaggttttaaaatctttcttttggttttgggccgaaagtcagcccaagtctctctttccttctccctctctcctccccggcccagtcggcccagtccgcgagccgccgctctcctctctctctctagtcccacctgtcagtcttcgtcttcctcgcgccgccgccgctttccaatccggtcgatcctttccgtttccggtgaaatcgttagaggggaaatgatcttctcgatctcctccaccttttctcttttggaatcatcgtctttttcgctttggaagttcgtggattcgaggtcgaatcggatcggtctctttcctccgaaccctaacctttccttctcgtcgccggtcaccgtgggcctccgtcgccgcacgctagcccctttaaaaggacccccgagctctcctctatccgccgccacctttgccttagcccgccgtcgcgtctagcgccgcctccgcgtagccctagccgtcgccgtcgttgccgtcggttcagccgcgccgcgccgccgttgcagccgccgtcgtcggtcgccgtcgccaccatcgggatcgcgaggtcgtcgccgtccccgtccaccgcttcgccgccgccgaagaccgccggagcaccgccgtcaccgtcgacccgaagaccgtcgccgcctcttcctcatcgccggcgccgtccgttgctcttccgccgttgttttggtcaccggtgagttcgccgcgtcgccctctacccgttggtgtcctccgtttgcgtcgtcgcgctgtcgttcgccggcgagcatgcgttcccgagccgccgccggtgatgacgtcatcgccgacgtcatcgttgccatccgtcgtagaccggtcgtggaccgttcgatctcggccgtccgttttggataggatcgatctcggccgttcgtttccttagaccgtcccgtgcacccggaccgcctttgatgacgcaataatcctccttttccttttcaaaaataattcattattgcgtcataattcaattaaaatctatataaatgctttaatctgatttaatctttgaaaattcataactaattcattgtaactcagtttaatgtggttgaagttgcaaaaattatacaaaataaagatctacatattaaaattatccataaattgaattaaatttatttaattctttttaaatgggctttaattagatttaatcttgtaaaattcataataaattcatatgaagtcagaatgaggccattcaagtctcataattcatctaaaattatgatctacatgtttgtttactttttatgtactgtttatttggtttttattagtctttttcttcgttttgcgtgttagcttgtcgtttccgtcgttgcgaaggttcgcgagtgcgccgaaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactttattccttgataccttgggttattataacttgactagttgagctttatatattggttcagctagatattagatatgattgcttagccatgcttagaaacattagcacattattgggataacttatgattcactattacttaatgatgatttaatgatagttcacgatggtcaatcgtgattggtaaattaattacttgccaactaaaacttgataatggtgggttgtgagcacatggttttgagagtcgtgctcatgacaattaaggaccgattcgcgagctactgttgtgaaacattaaccatgccaaccacaagccagcgtgggcaacggctttaccttttgtatagcatggttcattgcggagcactagactgagaagtggcggagataagcccacgggggtcgctggggagtccatgccttgttttataagggggtgattatgatccaggaatggtgcactgtggtgagttgtgttgtgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgggttgagcaatgtttttcatgattagtctcacacctctcacaataattatggatgttatacctggtaataatttgcttagctcctggtttggagttagatctgtacagccgggtatggttgttcaagatggttgggcctgtgcagcatgggtgtgttgttcagtgctgattaaaatttctgattaattactccactgttttacttctcttaaatgttttgctaaatgctgcttttgcaaatgagcctatattatgccatcctttggtatccttgtgcacttgcatatttgctgtgtggcttgttgagtatgtcatatgctcattcttgcaataatcaatcaacctcagttgaagaaaaggatccagaaggagaagacgtttggcttataccccagttgagctgcctgtgggagtggagccggagcttcgctagattttattttccgctgcagttttcttcatggtgaggacgaagtgcctcttaagtaagtatttatcgttttagttaatttgatgaatctgtatattaaattgtcagtttgtgtacctcggctgattcctggacgaggattttatgcacaaataagttcggaaattactagtgaattttcgggcgtgacatcccctcctttcttctcccgtgtgtgccgctgccttggccacgccgccgcttcagccgtgcgccgccgccttcgcaccgaccgctgctgtcttccacgccaccggtcgtcgccggtggccgcgcgctgccaccaccccgctatggccggccggctttgaagccgagccgagcccggcgactgcctccccgcgccgtccgattggctttggcccgatctggaccgtcggtccgtggaccggcggtggaccacccgcgtggtcccggttgacggtggaccagcgccctttgagccgctgccaagtggggcccgcttgccggcgccgctccccttgggtgacgtcatccctgggtttattgcgcaataaaattgattaaggatttttacttattagtaaaaacatagtttatcttctaaaattcataagtaattcatccgagctccgtttaagtccattcaagtctcagtaaatcaagaaaaatgcaaataatccattaaaaatggtttttttttcctgttttagtagtcttatagcatgttttgcttgtgtgctttgtttgtcgcataggtttcggtcgtttcgtcgatccacggttccttgaagacgttgttgtggtctcatctgtgcgagagcaaggcaagtcatgcattacatttaatcatattgtacccaatttacaaatatcccgcatttgtattaaatgttgcatcgttttacaatgtcatgtgagatgggtcctattactcagccatttattgtttaccttatgccattgataacttgggtatcaaaatgactagatgttggtttaggaaaatgcttagccatgcctagttcaactagtacacaaatggggatcatattattacatagactttgactattagcatagctttggattggtgccaccgcaatggtgttagttaattaaaatacactgaatggtgggctgtgtgtgcatggttttgctggtcgcacccatggcaattaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccgggttgtccggttgtccagctgccggattcaccacggcgcacgaggggactgcccactgccttttgaggggtgggggtgaaactttagcgtggtgtggatggttagaggagggttatgcgaagggtcttgtcacgatttccccctttgcagtatcatggtgatacttcggtgcatggcgacatgtgtggaatagtgtcttgtgggtacagttgtatacctctggctagagtaaaactattcgaatagctgtgcccgtggttatgggcaatcaaccaaattcactatgattagtctcatccctagtttagcttaatgaactggtgtagttcaggtggttagttgggcctgttgcaatgtggtgtagcgttggacagtgattcgttaatcttgcttaatctattgcaactgttttactgctttcaactactgtttttaaatgcctgctttattgtaaatgaaccttttagcctcctttggttatatcctgcatcatacctcatcttccggtatgacttgctgagtacagtgggtagtactcagtcttgctctcttttcccccacaccagagcggaagttcttcccagttggagctgtctcagaaaggttggtttcgtcgctgccgtcaaggatgtctgtggagtagagtcgctccgctacagaagtcaagtttccaagtttagctcgttttatcttttccgctgcatttgtaatcttttctatttttgtaagacgtggatctgtatgtcaacaattgtcgtttgtgtaccctctcactaacaagagcttagtaaccatgaagtacactggcagaggggttagagagcacattttgaagatgagtggcatcgcttcaaagctcaaaaagatggacttggttctccgtgatgagttccttgttcaccttaaaattgcctccttgccttcagtttttgaggtttttctgttgtgaactacaacacactgcccgaaaactgggactttgagaagctcattgccaagtggtgcaagaaggggcactatcagaaggattgccctgaattcctaaggcatctcctaaagatagggattctgtacgaggaggactcttcaaagagtagaaagacgcaatagtaatgtgaatgttgtatgcaatgaagtgaatgttgcgtgcaatagtgtgtcttcctcgtgtaacaatgtaagaagtgagcgcaaacgatgcaatgaggaaatctcagcgaaattgtggcactgtcgtttgggccacatttcgagggggagaattgaacgattgattaaagaagtaattttgcatccgttagattttgcggatacaaaatattgcatcgattgcaataaagaaaagtatgttaaacaaataaagaaacgagccatacgaagtttaggaaaattggatagttatgattcatttataacattcacggatgattatttgtgttatggctgatgtagaaagtcagaatgatctaaagattaaagtagtaaagtctgaccgtggaggagagtactacggtcggcataccccttatggccaaatacctagaccttttacaaggtttctacagggaaaatggcatagtagcccagtactcaataccgggcgagcctcagcagaacggagtagcaaaaagacgcaaccgcactctaatggatatggtgcgaagtgtgctaagccactccactttaccgataagtctatggatggaggcattaaaaaccgctgcccatattcttaatcgagtaccaagtaagtcggtgtccaaaacaccgtatgagctatggacaggaaagaaacccacgctaaattacgtacaggtgtggggctgtccagctgaggcaaagttatttaacccaaatattgggaagctagatcccaagacagtcagttgccatttcattagctaccctgagtaaaggggagcatggtatcccgagaaattagtcttgaagagaagcgggtatgtgcacctactccgatgattcaagaaccttctttctcgatacctgttgctgctgcaccgacaacacagaacgttgcgatgcaagcacctgttgttagttctcctgtgacaacaacgaatgagcaagaggaacctaagattcaggatcctacacaacaagttgtcacacaaaaggaagagcaacatcagccccaagtagaagatgtaccacaactcagaagatctcaacgagaaagaaagacagttattcctagtgactatcaagtctatgctagtgaagaagttcaaacagagggtgatcccacatcgtttgaagaagccatgagaagtgatcgttcatcgaagtggcttgaagccatggaagatgaaatgagataaatgagtgccaataaagtttgggacttagaagaaattcctaaaggagccaaaacagtaggctgcaaatgggtctacaaaacaaaatgtgactccaaagggaatgtagaaagagataaagcacgacttgtggcaaaagggtttactcaaagagaggcaaaggaacttgtatggaagagggtgtttgtaccatagtttgcaataggtagtttattgagtagaccagattatttagattagtctttatgtttgagagtggtttgcttgagagttgattattttagccttgcagtcaaggaggtggcatgcaggggcattggatggagttcagtgcagaaccagcgtcggcagcaggtcattttcatgaggccaaacgcatacgcagtacaaggatatatggtggtcattctacttctacatggccatacattggcccatgcatgatcgtgcaagaggtttcgaatagcttggtttgcaatgcattcgtggtgaggaggctgagcccagttgcacttgtagacgaacagaggtttaaaataagatatgatcatttgatcgatttgtttctgtattcggtcggataaggaaaccatgagtagtttggatttgtatacataccactaccggagaaaccacctttgctgggttggccaaaaaccacattagtcctggatccaatatattcccttaggacacgggacaaaacatcattttttgtcctggttgaaaagcacaacgccaacaaaacatcattttttgtcctggttgaaaagcacaacgccacttttatgaagatcatttttagtttcggtttaaaaagcatccggtcccttactacctttcgtccatgttggtattaccaaccgggactaaaattcaacgcgtcgtatataatcccttgcacttatcctctcctcctagatcccaatctcttcctcctcatcttttaacttcctcctctgtcctctctccctttcctatctcttatcctctcgttttctttttctcgctgctctctcttatcctctcctttttctttttcttgcagcagccagcagagagcggcagcggcctgcgcgtggcgagcggcagcggcagcccacatggtgggaggtggcagcttggcgcgggagcaagcagcggcgaagaaagtttatttagttgttgatttatctgtgaatttgttgatttgtgatgtttttggatctgtaaatttgtgatgtgaattgtgaatgttgatgtggatgattttgtgatgcttatgtgaatattgatgattttattgttgagtttggttagaaaacaatatgcagacaacaaaaaaacaatgaaaataaaagaaaaaactttagtcccggttggtgttaccgaccaggactaaagatgggcatctttagtcccagattaggggtcccggttgcatacccgggatgaaagggggttgcgaaccggaagtattgatgcattccccagcagtgtgcatacgctagtcggatacgtctgctccaccgagactgccggtatatacacggatagatggccgtctaagccccgaacaaattatcaatatactattttctcattcttttacttttatgtgttttctattttgttttcatggctgagtcctagcaaccataaaatttccttaataaagcaaggaagttatcctttgctaatttggttggaaactagtcattcgttgtcacgtaaatacgatatttatcttttttgctaatttgttcaaaattagtcatttgattccacaaaagtgaactaatctcgaaattggcaccgctagccaattttgatctaacgattttggcgactccattgattataccataaaccgttaagtgattttgtgttggccacgaaaaaccatcagcagaggtgcatatctggcaacagtcagaacacatagccaattttctgaatcattcaatttagatattgtagtttattcatctggcaacagtcagaacacatagatgcatttctggtcccaatgaaatcgaagaaaatgaactgcaaccaattatcacccttatatatgcctcaaacacagttccgctgataagacaaattacaaatcttctgtaattattaattaagcacatggaatgagctgcacatcacaccattttgtgttaacgagatagctaactcagtacttcaattcagcccaatttgtggaagtggagggctattcgcacaaaagttgcagtaataaagcccatcagtactgaagcactcgcctttgctttggtacttatctgagcatatcgctttgcaggttgcatcaacgcatggttttggtacttctgtgattggtgcagcatgacactcttcagtagctgaaaccttccctgatatgtctggacatgtagatggaaatatcgggtttactatgtgtaggaggtataaaattctcttacataacaaggtaaatagatctcataaagacaatgtaagcacgcaagtttgcttccttatgtctgagaagtatttaaatacctaaacatagcaccatgagggaaattgcaaccagggcaagctgattggtcttcatctttttccttacaaacgtcaaatactagatgactggtgggtaatattgatgtttgatgaagatgcttacttggcaacacatgagtttttatagcattggtgctagcacaattttggaatcaatttaaggtgtgtatagataaggcatcaattcaataccgtaatcatggctaaaatgatcggataaaatacatatgtacatctaaaggcgtgtccttaccctggaagttgtaactgaaattttaggatgtgctttcatatccctatggagatagttcctagtatagcataaacttataatttctgctttaaaacaatacttgtttaagaaacagggttggttgcttaaaactatgacttaagattacattccctcctttttcaaattggaaccatgcaattacgattttacaggaattcgagatgtgccactacaaaccccttccaagcattatcaaaaaaaatttcaccaaaattcccccttcatcttcttcctttccctcaaccggaccatggcctgatgatggggttgggggctactgtcgctaaagtgtgaatgatggccccctctttattgggttcttggggcactgtgaggcccatgatagttaaagcaagaatagtaaatagtcgcaaatgctacctcgaagccgaggaagatgacccaacgttagggatgaaaatggagcggatacaaacggataaagcacataccatatttgttttcatattttttgccggatacagaaacgaatacgaatagcctgaatattgaaacaagtacagattatctcgaatacaaataagaataaaaaatgatcggacatgaataaggaaacatctttttcttggaacacgaaaaacaactcaacttctaatagaaacaagtatcaacatatataattagctcaatttctataaaatgtagtataatttataaatattattaaaaaatttaaataatattaatagtgtggactagtgttaagagatgaactactattaaaatgtaaaaaggtatattgaaggtcatagagtaataaagaaatggggtatgtctcatggcttctgcgaatatccgaatagcactgttcaccggatattcgaattattatccgtatccaacggaaaccccagtaccatattcgtattcgtatctgggagaaaatatccatattcgaactatccgaaacttatcccatccgaaaggtattcgtattcatttttctccgaagcggacgataactattcgctccggtttcacccctacccgacgtcaatgccagtgttgacggtcgttatagaccaatttcgaccgtcaatatgactaaaataaaggagagctagctatgcttacaatgcatatttattttagaataatatacttccacttgtacttggattttatttgagtgcaggaattgagcaaataaaataaagagaaaatgaggaaacctcaatcctaagcaggcttatggataagttgggcccacttgtcaggagtaaccgtctcggaaaccatcataactgtcacaaccgtcatagggacccacctgatagtggcccaggagaatttggaggcctgctgggctggcccaggttcggccgaaccaccctggcaacgctggctcaggctggccttacacatggacgtccaggatcacttgctaaaggcggttgcggggcattttccgacatttcgcatgctctacaaccatcatcacttgctgaaggaggagctcattcgctctctcaacacactcaaccaagctcaaatatatcttctacactttagtttagttttctagtgttaattggagtagaatagaatagctctcggagtcctcggaagtcttcggaggaatttcggtatggttgtagtagctttccttcttccttttgtaagactttcggaattaataaattactatttgtaatatactctcgatactttagtatatctaagtattgtctttactttatacctgtatcggtacagtcttatagctagcctaacagagaggtgcagtggtgtaggtttagtgtccgattattcggttgctctatgtcatctcgggggatgtagagtagtatttaataatgtgtatgtggtgtctagattattaagtatcactatctgtgcatatatgctacgggtcagtcgaggtgggccgctgatggtgacagctcagtacgggtattcctccatgatagtatatgttcctaagaaactt

SEQ ID NO: 38532 - DNA, 3022 bp, Oryza sativa
cctgctacgcctaaacatgatcacccttaatgcagaattcctaggtttcacttaccgttgtttgaagccattgatgcggttctccttttgttgtcaaccaaagtggaagtagaggatggagaacctcggaccacctcgcttgtcggtgtagaggatgtagtcatagtagtgaggacgccggcttgatcctgaagggctcgctggagatcacttgcagggtagcaacgcccttccggtcgccacctacactgtcccagaaccaccacatgtttcccctccagtgccaatgttgatcagggtttagggttttgttgtcggggagattgagacagagagagatcgtcatctactcttgggccggcctccccttttatattttgcgctgtagggaatcgggggtgactaaaaagaaaaaaattgggcgccaccgatcatggcgcgtagttaatcgggaattaacagattgaatcactgtgattgcgcggagacaatgggtggaacggtctagcgtgatctcctcccggttttttcaaaccgagagatcaattttcccaacattttcccctttgatcttgaaaagaggttaatgaattcattcttaataaaatagttcactaaggcaacgtgtcattgcagttatcatatcctaccaagacctaactatagtacctatagtttactataaaatttcgaaagaactctatctaatcttagtgggagttagttgagactaatgtccctatttccaggatcttagtcttaatcaaaggcagtcagttattaccatgccggctatatgatctttaattaagtcgggaggtaagcctttggtaagcggatccgcgagcattgacttagtactaatatgctcaatcttaatggtttgatcctggattctatgtttcacaacatgatacttaatgtcgttgtgtttagcaacactactcgacttgttgttacttgaatagaatattgcagctttattatcgcagtataatgtaattggtctagaaatgctgtcgaccactcttacactcgggataaaattcttaagccatacggcctgtcccgttgcttcataacatgccacaaattcagcctacattgtcgacgatgcagtcaaggtttgtttagagcttttccatgaaatagctctgtttgtgagagagaatacataacctgatgtggattttttagtgtatacacatcccgcaaagtcttcgtcagaataacctaggacttcaagttcttaagacttcttatatgtgagcatgtaatccttagtgtcttgcaaataacgaaagacctttttaacagccttccagtggtctactcctagattggactgaaatctgccatgcatcccggtaacaaatgctaagtctggacgcgtacagactggagcatacattaggcttcctatagctgaagcgtatggtaccattttcatctgatctgattttaatttatttttcaggctttgaaataatccaaatttatcgcccttaactattgaagcaggtgttgcagagcacttatattatatctttctagtactctgctaatgtatgatttctgagataatcctagtactcctttagacctatctcggtgtatttcaatgcctaaaacataagattcctcaccaagatccttcatataaaaattagatgacaaaaaatgtttagtctgatgcaacatatcaatgtcgctgcttgctaacagtatgtcatccacatagagtactagtattataaattttccacccttagtcttaatgtaaatgcaattatccacctcattctccttaaatctgaatctcttaattacttcatcgaatttaaggtaccattaccttgacgcttgtttaagtccatagatagatttcttaagtttgcaagccaaattgtccttgccttccataacaaaatcctcgggttgtgccatgtatatacatgctcatgcaggtcaccattaagaaatgcagtctttacatccatctgatggagctctaaatcataatgagcaacaagcgccatgacaattctaaatgagtctttcttagagataggagaagatgtctcattgtaatctattccttctctttgtgaaaaaccctttgctacaagcctcgccttgaacctttcgattttcccttttgagtcaagcttagttttgtaaacccacttatagcctactgttttggctcctttaggaatttctactaagtcccagactccattatgactcataaattttaattcatcttccatagcttcaagccatttggatgaatgttcactcgttattgcttctttaaatgaggtgggatcatctatcttcccaatatcttcacctaaataaacatcataataatttgggatagcagatcttctctcctgttgtgatcttctaagtggttcattttcgatcaccggcggttgagaagattcttgtggaatttcttcattatgtgcctcagaagtctgttgagtgtcattatttaattcattattattatcaactgagtcggtatcaccagaattttcatctggtgctaccacggtttgagtcacaggtacaatatgaggtaccaaatttattggaatattatcctgttggatttccggtgtaacattagcccgaatttcctcaagattaatttccctttcttgtgagcttccccagacttcattattttctaagaatacagcgtgtctagtttccacaaatttagtgacatggtccaggcaataaaatcggtaccccttagatgtctcagggtatccgataaaatggcagcttacaatcttaggatctaatttctttagctgtggattaaatattcttgccccagcacgacaaccccacacacataaataatttaatgtcggttttctaccggtccataattcataaggtgttttgggtaccgacttacttggaactcgattaagtatgtgtgtagctgttttaagtgcctctatccgtatatttgttggcggatgttaaatgccgattc

SEQ ID NO: 38533 - DNA, 1036 bp, Oryza sativa
accccctggttcggccgaaccaccagctccaccgttggatgtggggttttgcgtggacgtcccagatgcatccctgatggcggttggagggcacttcggacatttccccttcgccaaccgtcatacctacccctacataaagacatcactccctcacttcacacacacacttccaagcttgagctgaattataagaggctctattgtactatattgtatactagaatattaagagagtagtgtagaaggagtcggaagaattccggagttgtcagtaatcttctcctatttcttttattctgtttattactctgaattcattataatattcttcttgagtaatttagatttatcgtgtgagaattatctcttggttagttcctaaatagcatacgggattattgttcactataatcaactaaaatatagtgattgctttggtgagttatgaacactaaaatagatattaattgcttagacgtggtgtttaggtaattattatctaataattgatgcatatcccacagtacgtttgacgtgggtgtagaggttttgacagccctcgagatcacttaagtcctccctgtccgggtacgtagtagagggacatctgggaacagtgggttgctagtgcctgaagtattgcgttaggattaaaattaagctttccctagacactgtttctcactagtaaatcatctctatcctggcctatcatttgcttggtgtccttggatgaaccggaggaagctctgatcacacacgttcccttggcttcggtacccttggaatactccgtaggggaagtgctacatcggtatatccgtgtgcttgcggattttatctgtaaccgaatcaaataccaacaagcatttctggcgccgttgccggggaacggttgccgatcatttcttcacccctgctatcctagagaagtattcctgtcaaactcttctcgaccatggagcaaccttttttgagctgtctgctcctcggggcgaattctatgagccgcctccttcatcagagctcattt

SEQ ID NO: 38534 - DNA, 663 bp, Oryza sativa
gtgactgggacaaaccctgataatctgtttccactcagatctagcttattcaggtttgcgatttgactcaaggattctggaattggtcctgataaattgttttgtcctagcaatatggaacttagagatgaaatatttgctagagatggtggtattcttccagaaagcaagtttccattaaggtcaagaaatcgaagagtccccatgttacgaggaagtggaattttgccaacaaaagaattcgtttgtagatcaacagtgacaagcttggatgagccattgaaaaaactaggagggatctctcctgataggttgttacgcgaaagatttagctctatgagtgatgaacttcttgccaaggattcagggatggtaccttcaaggttgtttcttgcaagcagcagactttgcagagaagtgaggttgccgatgcaatcaggcaggaccccagtgagctccatggagctaaggtttatggagacaacttgagctggagatgtcgtgccacatctgacaccattccatctgcagaaatggactgacgtgttccatgagatgaaagcaccggtggggtcggttatgctttgcttgaagcatagtagagcttgtaaatcggtctctgatctgttgctgggctgcgctgatgagggtgttattgtgttg

SEQ ID NO: 38535 - DNA, 345 bp, Oryza sativa
catcatctcgacgagctgctggaacccgaccttgggcttccacccaagctccttcctggccttggttgcatccccctggaggctgtccacctcggcggggcggaagtacttcttgtcaatgactacatgatccttccagttgagccctgcatagccgaaggcggcctggaggaactcctcgacggtgtgggactcctcggtggcgacgacgtagtcgccgggcttgtcctgctgcagcatgcgccacattgcctcgacgtagtccccggcgaatccccagtccctggcggcggagaggttgccgaggaagaccttggtctggagcccgaccttgattcggccgac

SEQ ID NO: 38536 - DNA, 243 bp, Oryza sativa
gttgggcgcacagcatttcggccacgtcgtcgttgacttcgccattgaggaaaacgatccggtcgcgcagcaggcgcgaataaatatcaaaggaacgttctccccggctggtctgttccaccaccatcgggacgagcatcatcttctcacgcatcggtgaactcctgggttggcaaaagggaaatgaatttaacgcgtcaggcggcgagcatcatcgtcaccgaaccgtcattggcggcctcg

SEQ ID NO: 38537 - DNA, 1520 bp, Oryza sativa
cgtcgccggaggatacagctcgcctttctctctcccatgaagatctggcagcatagctgagagcctttgagaggaaaggagaaggcatattgagggtaataaatgtccatggcggctgtcacttcaactcctagctgtttcaggttttgatagcgcagcgaacggtttcagcctttcaggtgagggagactcaaaggcggacatggaagccgaatggctcagttctcttgcgtcgtgttgcgctgagagtggagatggaacgatagcaggtaggatgttctggggtacgtaggaacgtttggttgggttttctgcgtgagagacactacatgcaatctgatggaaattaaggggtgatgtggcaaagcgagatgaccaaaaaaatactattaattgcactaattggggatgaattgtattggtttataggatactatgctatgcaaaataagaaaaatactatatgacatgctgaacttcagccatttccccttaaattgataacatgttggtttcttttacaaactgttagtgttgttgtacaaaaggggacaaaaaaaaaataacggattgccatgtgtgcaatggtgtgcttgcttgaattttctgtttattcctcaaatggatgtaaaccatgcatcttgtgctgcagatggattgattgctttacgggctaaaagaaagggctcaccctgccaacaagacggcgattctcaggggctgctgacatagagataccaagccttccagaggtacaccataaataaaatgtgatgatgaaacatcttactagtagtgtagtacaagtaaattatgacgattactgcttgaatcgcacaaatcggtcgaccaacgttattaaagtttatgaacggagcactttgatgctataacctcctacagctgctgcatcggaactgtttttccagctgttgcacttactttcaatcacaaattgtctacacataatgctttcttctaagctggtggttcttaggctgggagtttctcaagtcaacatcaatgatgagcttttgccactagtctccatgctgtttctaacttccttaaattgtaccatctcaaaaacggttccgtgctaacaaatgttatctccgttagaccattgcagtcagtacatggtaattttgtgagccgcatgtccttgtaggatggcattcttgtttgattccccgcatctccccatcctgactccccgcatcttccccatcctgagttcctgacctagtgtatgaaaatccaagcaagtaaccaaacacaccttaatgtttctaacttcatatcaatttattttaacactgtagctgccaaaagttatttgattctgatacatatttaactgagctttctggttgtttatatattcagatattggtaccctatgcaaagtgcatgtccatttctgttccttttctgccattagacaattaaacatcattccatccattttatctggcacaattgcaaagaaacaaatagtgctgagcacttaatacatg

SEQ ID NO: 38538 - DNA, 14587 bp, Oryza sativa
aattcctgcagccctgcctagcggaagtcaactatataattcatagtaatagtacataatcaggcaggtagcactggaccagttaaagtgttactccataagttaccatttttttcttccatctaattcaaccatttgtcttcacaattccaatgtttaacttctctcccatgcttgtgcaagcaggacatctggcgtcttatacattccttgatgccaatgcgagatgctgcccgagctgcctgtgtgtctcgttcctttctaagtttgtggagatgccaccccaacctcaatttcagtagtgaagcatttgggttgaacaaaaatgcatgtggaaaggaagaattggctggacttttctacagcaaagtcgaccacattctcaaaaggcactcaggcatcggcgtgaaaaaacttaagattcagatatattcagattatagtgggaaaggctcttcatatctcaacaattggcttcagatttctgttaaaccagggattgaagaactcataatttcactgacccagttccaggcaaagtacaatttcccatgctctcttctgtcgaatgggagtggagactcaatccaatatcttcacctttctaactgttccttccacccaacagtcacacttagtggcttaagaagtctgatgagactgtatctttgttgtgtgcgtattacggagaacgagttaggctgccttctttcccattctcttgcattggagcagttggaaatcaggtactgcgataggatagtttgcctgaaggtaccttgcctactgcagcggctcatctccctgaaggtgtttgggtgtgacaagctgaaactgatagaaaatgaagctcctaatgtctccatttttgcatttcaaggggacaaaacggaactgaaacttggagaaactttgcaaataaagagcctatgcatggtccgctctggttatgtttatcatgctcgtgctgaacttccatccatcatgccaaatcttgaatctcttgccataaagtcatgcaaagaggtatgagaaattttgcctgacacatgaatgataggcatatctaatgagactagattctgtcttatgggttgtagcataattaatttgacctctttatgcagacggcctttgcaccgaagctgtgtagcaaattcctctgcctcaggcacttgagcattggccttattggatttttcccagcctatgactatttatccctggcttcttatatttatgctgcaccttctctggagacttttgacttgaatgtgagtagctgttcatatattattactgctatgaatgaaattagtagctgtgtggtggaaatgtcacttaaaatttctccctttcacatcctaggtaatgcagcggaacgtgcagagtgtttcaatttttgcacatcctgcagatctgagatcaatacgagaagagaagcatcacaaccttaagagtgtgacggttacatcattcatctctgtaaagagcttggttgagctgacatgccatatccttgagagtacagcttcactcgagtgcttgacattggatgcttctcagactggttttaggtgtgatactccaggcagcaaaatcagcaaatgccccccactagatagggacattatcatggaaggtcacagaggggtcttggctatcagaagatacatccagcctagggtaccttccacagtgaagctgactgttttggagccctgcagctgccattccactgaactttagatgtcatgtttatcttagttattcgatgtttaatcgtgctgctgctgatgatgattctgtagattcttagatgggtcatggtttctaaagtttgctcttaatgattactactagttgatatcataaccaatgcacatgatatccactagtaactctagtttccacctagcagcagtgttgtatgcacattaaaaagttcttcttccttatcttctcccttctctcatctgcatgtggcgttggtacttggtacacgctggtggaggcgcaccccgcgcttgctgactcattcacgtcgatgcccgtgtcgcttcacctcaccctcgtgctgctctctatgtgcgaggacatcgacaccgcagccgccacactcatcatcacacatcaacttcacgctgtcctctagatccgagttagggttcttgtcctcctcgctgactcgccgcgttggagcacgtctatttccactccttcaatccgacactatatcatgtaaaatgacagttttgcccttatattcgagatacatgagattgctaaatatattagtgattatgtggtagagacatattatgatacatgttatttattagtttgatggtgtatgcatcaaattggacgtggtagtcatctctagttgtataaaacttgtccttacgctctgttctattttttctacctttctcaacttaacccctcatttttcgcgcgcatgttttctaaactgttaaacaatatttttttttttgcaaaatttttcaatacgaaagttgtttttaaataattataataatccatttaaaaattgctaatatttaattaattatatattaataagtagctctggtgtaccgcaacgaacacagtcgaggaggcgaggggcgtcgtgggagagaaacgcggggagggcggtcttgcggtgcggggcggacggcggcgggtcagcgaggaggaaggtggtcgggtagtagaggccatcgacggcggagaggcggccgacgatgcggtccatcgccgcgggctccatcatggctgccgccgccggcgtcgtgtcgtgtactcgtgttcgtgtcggcgtggcgaggatgccttcctcttttagccgggccggatttgggctttaggcggggggatgggcttaggtcggtttggttttgaatgggccttggcccatggggatatgtacggggaattggatagggtggtggggccgggcgtggtgtcacgtgacggtggtcaggtacagtagctgtttccgtgccggtccggtcggtccaccggttgatccggctcggtgaccgtgatctttgttggcgtgtgaaagagagaatcgatgaagcaaagccatcggtactcgacggtacatggtgttttttctttttattttaccaataacttatatacggtcagtgaaaattaagtggccatgtatcaagagtttatttacaagtttatattactacaagtgtctaaattttatttcaactaatttaaacaaagtataagatatcaagcatattttatagtttgatttttacagttgttaaagctgcattgaacatcacagttgttcggtcatcagtcaagaatgcatcttagccgtttggtggctgtagccactgctagttatctactctctccgtcctataatataagggattttgagtttttgcttgcaacgtttgaccactcgtcttatttaattttttttgaaattattaattattttatttgtaacttactttattatctacagtactttaagcacaacttttcgttttttatatttgcaaaaaaaaaatgaataagacgagtggtcaaacgttgcaagaaaaaactgaaaatcctttatattatgggacggagggagtacgttagacgttgtagcagttgttgcagccacagcgctgtagcagacaactcttctgaacaagttcattcaatggttatggtcatatatttgttggttaaaattatatgtttaatatttctgacattaactagtataggctaataaaatactactccgtatagtggtagaatttattatttactggtgtacgtgtattaatcaattaatgtacaactcaactaatctacactactcctactcctacaagtaccatttatctactactccatttgagattcaatttttaattcaggtagaattttgaaagtgctaaccaaaaacaaggcaacagacagcctcacaattccaaaaaccgacagccatccgcctccatcgctctctcacagcctcactctcactccaccccactggggaaagccaaagccgcgggccgaagccaacgcggcaaaagcccaaccccccgagatccctccccgccgcgccggcggaatccccgggcctcgtcgtcgtcggcggcggcgatggggtcggtgtccctcaacgtgccggcaccccgccgcggcggcggccggcgcatctcctgccactgcacaccgtcgctgctcaacctgctcatgttcctcgccctcctctccaccaacgccctcgccctcctcgccttcttctcctcctcctcctcctcctcctcctcccccgccgcctccgccgccaccgcggcggcctcgacgatctccgaccacgtcgcggccatcgcccgcgagatcgacacctcctcctcctcccacctgccgtaccgcgcggacggcctgccaccggagctcctcctcttcctctccccgcacgcgctcccgctgggccgcgacgcccgcacggggctcacccacatgccggcctccgtcgcgcactcctgcttcaggtcgcccgccacgctctccctcctagccgccttcatgtcctacgacccgcacgccgcctgcccgcgcaacgccaccctgcagcagcaccgcctcctctccaaggcctgcgagccgctgcctcgccgccgctgcctctccggggggccccgcgcggcgctcccggcctccaacatgggcgtcgacggccgccgctgggtcaggccgcgccacgactacgagttcctcctcgacgacgtgctgcgcctcggcgccaccaggatccggattggcctcgacgtcgccggcggcgccgccaatttcgccgcgcggatgagggaccgcggtgtcaccgtcgtcaccacggtgctcgacaacgccgggaagcccatgaacgagttcgtggcggcgagggggctgttccccctcctcctctcgccggcgcaccggttccccttctacgacggggtgttcgacctggtgcacgtcggcaccaatgcgctggacgaaggtggcgcgccatcaatggggaattccggcacggaggaggcgctggaattcttcatgttcgatgtcgaccgcgtgctccgcgtcggcgggctgctctggattgatagctacctgtgccagagtgaggagaggaggcaattggttgtgaatctcattaagagatttggctacaagaagctcaagtggatggtcggagagaaagccggcacggggagcgcaaagacggcattgtacctctcggcattgttgcaaaagccggcgagggattgatactgaactgatggatgaattgctccaagctcatcacttgatccgaggtacgaatgtacctcacaactattacttgtagttcagctgttttgatggcaaaaaaaaaaaagaaaagaaaagggaatgccatttaggttccacggaacacggattagcttgattacattggttgttcagagatagtgaagtgacttaaaataagtgcaaaagtggtacaattcttctacttttgttattgtgcaataggttgccattagatgggaaacatatgttgtaatagtaggatttgttgctcaactgggggactgaaaacaggacttccattccaatgatgtgttctttcatatcaggaagtaaaggagagtaaatgatgatgatcatggagctttttatttgttactagtatgtgtcttgtgtggtccctctgaagctgaatttcccttttgtgttgtgaatacttgaatagtgtattgcatagcttttccagtggatttgttcttctggaaagttgaggacttgaggatctagattccactctttctcttcttttttatagtgctaggacaaccagaatcctttggtctgtaaggaaagctgaaaggtgtaggaaaccacatgacacagaagaacatgtcaaagaattacattcctacttgtttgagcctatgcttggatatgaaaagctttcctgacacaaatcatggtatggactgctcatgtatagtattgaatatgtatgatatactttgttcctattttctccttgacaatctctgttgtatcatgtaacaccttcattttagttataccagtcaatgtacaagtgtagcacaaacttttccccgaaaaacaaacatgctaactgtatgggaaaggagctgcgcgtggaaattatatagtttttgtggtttcatacttctgtatctactggctagatgctaattcttttgcagttctatcacacaaaagggaaatgtggagaaataattgggaatgtcaggaaaatgtaccagccattaactgaggggcctcatcagtaatttctaaaactgctaacaaaatttgttagatgatgccaagaaacaagaaattgctacgtcatatcatagtaattgaggatctctcggtcaattgaaccccttcggttgacgttatagggtaagtttgcgactttatatctcaccccttcaattgaggcctcctctggaatggagaaatttcaaagaaatttttggtgagttgaactaaatcctgtaaaattcaggtgttataaaagaagcactgttaggaccttagttgatctgtaacatccatgtagtgaatctgtgaatggcccagtttcaaactcatgtttttgtgttgaaagtttagacgtgtaatgtaaatgaactagtggagagcagattaatgagttgcatcaacagttcttttttcttttcttttttttttttgcaacatataagttgaatttagttttacatgtttgtaaggtgatatatatcatattaatctatgttgttaaactttttcaatttttttattactattttggtgacatgaaaaaaacgatgggatgcccccctcgagtaattaaaatccatctaagatgattaggtcttctgctctatgcctgtttatttaagctagctctgatcggtcacagtggattttttttttgttatttttctgaacacttttaatttgtaatttttataataaactcaccaaaaattttaaatccgtacctttttaccacattagtaaaaagtcatggtgtggtagacaaatgctatcacaccaaatgagtatggtgtggtagtgttgtcctgatatcctgccacgccatatttgttttccatgggtttgttttttttaaggtttaaaagtaataaaattttgtcacaacttaaggtctaaaggctgaatttacggttggtcacattagtttatttagttgaattagcttaagcaaagaagcacccgcgcatccatcctggttagtattcctaaacatcttcctatttcatctcgctctgttttctcaaagcgaaaaagtagctatatgctatagagaaaaggcggaaaagggtcgaataatgctcaaaccctattcaaaatcggacaccatatccacatatgtttgaatttggtgccgaatcagatcgttgccccaattttgaatacaagtacacacatcaatgcttcatgaatcatgatcaagaaacttgtaaaagaaaagaaaaatccagaacagaattcaagaaaagtaaaacgatttagttatctatcacactaactaatcactccataattccatttttttttctgtagaagagaaagctaatatacatgttagtgttagtacttatagtacaagttgctacactttacgaggccatcaatggcgccggcgtggttgaggacgccggagttggggaagaagcggtccaccatggcgtgcagcacgtcggaggtgagcaggctgtcggagccggcgttgtgcgcgcggccggcggcgcggtgcacgccgagcgccgccgcgacgtgctccaggccgccgcggatgccgccgccgccgccgcagaacttggcgaggtgcttcacgtcgagcaccgccggcccgaatatcttgctgaccttcgccatgaacccttccagggtgctcggcagcggccggccgccggtgagcaccttgacgaggtaggcgaagtcgtaggagcccgagaacgccgcccacgtcaggcggccgcaggcgagcttggagcggccgaacgcgcgggcgaagtcgccgtggtcgatgccgtggcggcggagggcggtgaagtcgacgccgtgcgcggcgagcatggcgaccgagctccccgagtgcgggtcgcggcgggcgtcgaagccggcgaagttgaactgccacgcgacggggcaccggccggcggggcccgacagggcgaggccgagctggagcaggtggagctcgtcgacgttgcgcttcacgacggcgtagctctcccgcggcgtgcggaggtggcgcggcgtggcgacgtcgtgcaccgtgccggggaactccgtgtccatggacacgacggggtaggtcggcaggagcgccccgatgctgcgcaactcctcctccaggttcgccgcccacacgtcccgcacctccacctcgtcggcggcggcggaggcggcgggcgaccgcggcgagaagctgggggcgtcggagttgagcttagaccgggcggtgacgatctccggcggcgccgacatgtgcatgaagcccaatccagattggacggcggcgatcgggaagaacgggagcggcggcggcggcgcgagcatgaccgggccgacgtcgccggggaacatcggcatggctggtcgcggtggtggtggtgacgaggctgctccggcgatcgcgacacggcggcgcgtctcgtttgcgtcgtcgtcgtcgagcggcggcgaggtcggtggcggcgtgcgtggcatcatgtccgggttttataaagggagagggcacgtagacgcgtgggcgtggcgagccagtccgacacggactcgagcagccgaccgagttggatcgtgaatcggattcggcgcgtatgtgcatatatgcgacgtcactccagatgcgatctctatttttattttttttaattaatgatttttatcattaatcattaatgatttttatttttattttttaattaatgatttttatcatatgcgatatatttattaatactacttctacattcgtagttgtattgtactcctgtaaaaatttgatataaagcgtgtgttgtgaatacgtatccagagcctcaagacaaacgaatgtttgattgatttagcatgggataaaaaaaaagtgtgcaatcgtgcggtcggaaacggtagtatctcttccaaaacgatttcagaattcggctataataagacgctgaaacaaaatcagaatttatatattgttagaataacatacggtcgaaaacggtagcactttatccataaaggatactcggttggtcgggaatttttatagccgttttcatctttacatcgtatctaatttgtaaagataattaaatcataatagagtattgactacgtgatactccattcgtcaaaaaaaaacatgtgacatactacgaatctggacagtccatagcaccccctgttaaatgggggatggtaggtagtaggaggatacttgaggataagatgagaaaatatttttagagcaaagcttaaatatataattacacttatcttagaacggagatagtccaaaagaagaaatgtggtaattttgtgccctctaacacaatgtgtatgcttaaagctttcattaattgtagtgttatacaaaagaagaaacttgtttggtgggaatggcaaatagctaaattccccgtattcggagggatcattttgttcatattttatagaaaatatgaaattttaaaccactatagtttaacttacaaactatagttatttttaaaccactatagttaaagttattttttgaagcttgagatttatggtgtgcttccacaatatttgaagtgttgtatttaatgtttaagactacttttttgatacattgtgaatacccttatatttgatccagatacaacctccatctgagaatataagggatttcccccatataattctataaaaaaaatccctcatattcttatactgaggtagtattaagttgtgtcaagcattgctgtgtactacagtaatgtgtccgtatcggtcacgggctgatgcttcatgctttgcattctctcttatggatcacaaacaagttggttatcttcagacactgattgtgtagaagactactaattcaacatgcctgagagattatgagtaagagttttagtttaacatagcaaaacttaagcatgaacggggatgtagctcagatggtagagcgctcgcttagcatgcgagaggtacggggatcgataccccgcatctccacctgttgttgttttcatttttgaaaaatgcaatctttagttttcttccatgcagcaatcatgtaaccgccgcatcatctacattctcccaaattattttttaaaaattgattcttgtttgtttttcttttccaaattgaaaaatgcaatctaaagttgtctttcatgcagcaatcatatgtaaccgccgcatcatctatattcttccaaattgaaaaaaatgcaattagcagttttctttcatgcagcagtgatccataatatacctgcaccatctacattctctgatcttagaatattaacaaacgacagcataacattcaacaaagttctgttgataacagcactgcaataacgatctgtttatcacaaacgcccgaagcaaaaatacaccaaaaatgctggaagaaatgttgtggtcacagtggaatcaaattattgagaggtcctcattcatcaacgagaaatgcatccatattaagtcacaattacagcattcccaaaaaatactcttatctacagaataggggcctgactatcagctgacaaatttcatcaaatcaatactaagtgttttagtaagttatatctgctggtgttctggtcacacctcctgaaatatacagcgcaagtatgctttcaggtatcaacattcccaacagcaagttcacagttttttttttcttttttagcaaaagcaagttcacagatttgagtacaggcttggcttgcttgcttactcatccaggtttaccctggtcctccttggcttgttgtatagtgttcgtacgcttacacgagtctggtcagattcatggctcccgattgaaagggaatccatatcatcgttgatcgtgcggttgatcatcaatatctgtctgtgctccattcgctgcctcctttcctgagattccgtgccatcgtcaatcgaattcatgctgttaccatgcatcctctcttgagccaaccaatttgcccgctctctgataccatccatgttagattgcatgccaggtgcatcctgctgatatcttgactctctcaatggaccaacagggcgtctttctctctcagcacttgaaccagagatggtaggctggccatggaagttttgctgtgacgaaatgccagtgacttgagcttgtgcatattgaggaggtccatctccgagaatgccgccccgtccaccctttccaggagatgttcttactttagatttcttgttcctgtgtgctttgctcggatttctgatctgtatgtcaggctgcttgcccttaccttcatctgatgatctgccagtttcttgtacagctgtttctagaggaattatgttaagcaattctggatcatctcggaaattgaacggacgcttcgctggatccatctttctgaaggtaatggatatcctgtgttttaattagtgtgtcagagttcaaatgttatacaggcaaaggaattgagttccaaaagccaaatgatagaacaggatatcagtatcacaaccttttggtcggaactgcaggaacacaatgctttgctacatcagcaccattgccatttaggataagcaccgacctgtgaatgtttgtatttagtatataagagaactaaagagctgcagaagaaaactgaaagacatgatgagacacgaataattgaatattattaaagtggccaatgcaaaaattacatacagttagtattttagagtttatgacaatccaatgagaaggaaacacagcaacaaacaagtatggagtagaaatctctctcagcaaaaacttcaagcaaagtctaaaggagaaaagttcagggcctgttcggtaggactaaatttggctgcaatacagccatcagctacagtactgcgcatacaatctctacagcagcagcacagctgcagaagtatgacagccagacaggcccttagtaatcataccatgcaataccattcaagaaatcgaatgagaagtctacacagcctttgaattcatgagtaatcaagtttaaaacaataataaataaaatcaatttgttaacatcccaaatagcacaactggctaccacaaataatctatcagcacagcgaaaagcatgagaacatacccaacaggcagaggaattggaagtgaaccagtgaactctccagggccagcaattttcagagtagatccaaaaagaatgttgcactcactgaggaatgaaacagtacagaatggccgaacaaaatcatgactatcaatatgtggtgggatgcaatctccagggtcatatatattgacaatacaactgtctggtatgcaagtctttggtagaacatgccaccgtaccaatctcttgatcatgatcttaaataagctaggcatcggatcagaagcaatagttcgaataatgcctggtgggtttccattcttgtcctgtcatcacagattcaaaccttagatggattcacatgtgaattaaatcagtaccactgcagtattcaagctgatgggatcagaggataaaactagagtatgtaccgtggcataattataacagcatccaaattggattgttactcgccctttaccacgcatccacctttggggttccgtatacgtacgatctgacagggggatattatgcttggatttagatatacaaaaatacaaataaacaaaacatggcaaataaataaatgcagctgtgagcccaagaaaattcatgtgcgtatagcatttgtaaagcagaaagaaggaccttggatagcactaaatagagtaggcttcccaatatatagtatacactcacccaaataaggatgagaaattctattccggtccaatggcctaaggtgaatcaaacaggcttaggtgcttcagggtactctaaagtgtggccatttgttagtgttatactgggccctcagtagataaatagtgcatagcttgaatattaaattaattaaattgaaaagaagaacgcagatatgtaaactggaatgaaggtcaggcatctcactcaacatgttacatttacttcaatcgtggttattgtggtgtgcacgactgtaagaagcacagaaaatcatgcatgtctgttttaatatccatgctgagaacgcttatgcagcatataagcaaagaaaccaaaaacactcagagattactgtaaataatacattgaaacatattgaggtttacacaaatggggaaacaccattatgacagaatcatgtgtacagaaaacaatgaaaatgttttgctatccgctacgcttctcctggacagacagatttcggcagatgcttctgattgtgtagtagggtgaaactgtgttatttttgtcaaatatggctgattatgttatgatggcaatacctataatttatcaaataccatatttatcttcctgcttgaaatcacaaaagctaatctgctacttgtggtaggtagatccaatgatttagtagaataattaccaaaaaagtttgtagctttgagtgcataccacatagaacaagacatgagaaaaccaattttataataattcttcggctttctactttgcacgagaacactatacaagttccagttctacacgatagaactactgtggtgcatatagacatctaaatgtttgcctatgatccatatccccacaactaccatagcctaagtagcaaagcatgaccttaattacagctaaaacctttgcctaaaattttacataatcctgacctaaaacccttttcattaaagcatttctcaaaactcaagactttacatgaaaatttagccaaattcaactagcgccatagaaaaacatatcgaatctccatgcagcttaaatctcacctccaagctccccgtgcttgcccatctcctgaagatcgtatacgtagtcgacaatacgcttctgttcggccgcgctaaacacaccgcaatgaagttccaggccagcgaggatattgacgagccgaccattgaccctctcaaaacagatgaaatccttcctccgcaccacgttccggaaccgcctcagctcccgctgctccctcgtcagctgcacacccggcctaccagcctcgctcccttcctcgccgtcatcagccgcggctgccgccgcgtcctcctctgccgcggcggcgagctcgtcctcctgagccatgtctgcccacgacttccgcggcttctccgccggctgcggcttctgcttctgctgctcctgctccggtggcagctgcggcggatccgagtcccatccgctcggctcgaacggcagatgctgcgggtgagccgtagccggatcggact

SEQ ID NO: 38539 - DNA, 8341 bp, Oryza sativa
ttctagttgttggtatccggataatcctggccgtccgttgtacgatcggacggtctcgctggtgtgtgggccccacctcgctagtgctctagttgttggtatccggataatcctggccgtccgttgcacgatcggacggtcaggatcggactcagcgaggagaagaggagaaaaatctcgagatgaaatggacgcgtaacctgactccgattcggatcccccaccggcgagatggcacgcggatccgccgccgcggcgatcgccggagttgtgtgggtgcttctcctcctcgtgggggtggcgtcgggggcgcgtcttccgggcgggagcgggggtaaccgggggcgggagccgcgcgggggagcggcggcggcggcggtggccacggagacggcggtgttcgcgctgggaagcttctggaggtcggaggccgcgttcgggtgcctccccggcgtgatccgcacctccgtcggctacgccggcgggtccaaggcccgccctgagtaccgcaacctcggcgaccacgccgagtgcgtcaaggtgcggtgcggagactcccacgcttttagctgttcttgatcgataccatgaaccaatgatatgttcagttccatggtcgtagcaattcatttccgtagttagcatcgtaatctgattggccattaccatttcgtatgtgtaagttaaaaactgaaagaaaatactcgcgagttttcatttccatcgtaatctgttttctcttggttccaagtttcattttcattgcttaatgaggtatcattacctaaaaaaactagaaggaatgttctatggtcaaacaggaacgattcatcactgccagatctgcttcttgtgtgtatttttttgtgcataaaacaatcggagatgtttgtccgttgagtgcttcattcaattgcatgtgtgtgtgtgttgtaggttttggagtggtatactggtattaatactttgcagggcctccttctaaactaactttgttggtgttttatgagctaagatgattgacatttttgagtcatttaggttgaatatgatccccggttgattcagtacaagaaacttctagaggtcttctgggcaagtcatgatccacgagaggtctttgggcaaggaccagatgttggcaaccaatacaggtgcttgagttttctaaacctaaccccttttgtgcaatagatctttttgttcacagtttaccatagtcagatttatatactaatgatgtgattatcttttataaacatgtttcatgctaaaacttagactggtttccataccagcatttagcatatggtatttgctaagtttcacaacaaagcaattgagaattgaaaggtgtacatttcatttcatcacctttgtctatcctacttcaaacaagtacctttgtgtacaaaatgttgccatcatggcttaggaaataattggtcactgaatggtgtagctgtcattctcactagtttgataggatcctcagacagcactgtaatgcgtcaattttaattcttgcttcacttatgtggtcacagatccatcatcttcacaaatggatccgtggaagctagattggctggtcttagcaaagaaaaagaacaagctaaggatcgccgcagtgtcattaccacacagatccaaccaataggtgcattttatccggctgaaccggaacatcaggtagcaatcccatctgaaaattcgaactcaccatgacattctatgttttatttccttttagttattgcttgtactttggtagaaatttgagctgaagcgcaagccgtttctcctgcaactgattgggaacctgcccgaggaggagctcctgacctcaacactagctgcaaagttgaatgcatacgctgctgagctctgctccccaaatacccagaacagaataaactccaagattgatgagattgctaagaaaggatggcccatcctaagagacatttagctcggtgttcctgggttttacatattaatatatcattatccaattgtgcatgattttgccgcaaatcttgtccagatgactggttgtggtcattccttggtcgcagcaatcactaattagcgttcatgtcctcctctgctcattttgagatctctctaatagaatctgcatgtatatccaaactttcgagttgtgtgatgtgacctgaaatcctgaatttatgattggttcttacagaacaggtgccgaaattgtatattgttactctggctcttttatgtgtaaaaatatatgatgtggattcattacattcttaatcaaaaacacttattcccatggaatgctaagaattgttcattcttttgaaaacaaaaatcacattttgttcttatggattttttttcacagtttgctcttcggaatgagtaatgggctaatggccacagtgaaatggcgccagcaacgctatactagatttttcttgatggtacaattgcatggaacacacaatctacaggtggaacataagaccctttttttgggaaacatttcgctattgttgcaacctcacacagctaagcagagactagttatttacatgctccatagaaggaagagattattttgcaaggctatttctcagaaacattctaaacaacaagtgaagacacaaatgcacaatggtcagaggccactaattaggttgctgcttgactctttttgaagcagttctggccagagcattgcatatctccctctttcttttcgcattttcatcagtcctgccagaagcgacgttggcctgtcgttccaatgcttccctcacaaagaatttcaacctccagagggttgtctcactctgcacccgcataggaagcatggttagaataaacaaaataaccaaaatattacagaggtaagtgtttggacagcacatataaaatcacctgagcatccatatcaagttccagttcgtctcctttagcttcgaagctagggttgtcttgtgcaaccatctccaatgccttagtaagctcttctggagacaggtggcagagacctgcacccagttttcttttctcatatgtagtcattttcctacaacatcaagattttggcaacatgccacgtgcatgagtttgacagcagttgcaacttataaacagcagataattaaatcgataggcaacagatgaacatttgtaagatgtaccggcatttctggaccaccatttgccgaagctcctccaactgcttgttgatttcaatcagctggaataagaaaccaaagagaacacacttaatatctaacagaatatcagaacattagtacaaggaatgaagagcaggagttgcaggcattttgtgtgtcagccttctagaaaaatcacaaaaaggtatatccataggtcaggaactcaggatatacacggctgctcaaattggccacattacatactcaagaattgaatccatagtggcacatctttattgacaaaccaaaaaaaaaaaaacataacaaaacacatttctgtgaggcctgagtgttgcagttcatattctgaatggcagtcaagtcattacattttgctttgtggaatgagtgatcattaaagctgccatcgatgtgccgaaaataacaaataacagtcaatgatgagcatacctcattgtcagtatcttttgctagttttgcaatagcttcttctggagaaatgttcacttttggaacaccgttggattcctcatccttttgtttcctttcctaaaaagaaaagttccaagttattactgtcaaatgctaagtaacccatatctgcagctccaaaaagaactaatatatgcttacaaacattcattcacctcattttcaactttaggaagaagctggagccatttctcttcaaatttctcaagcaatgatttcgccattatatgaacatcatgtcgttcatcattgtacttcattgcattggcaaaaattaatctaacatccgaatatatttctcggacattgttatacttgttgtcatctttcccttccattttcttttgtatggtcgaaaaatccataggtttggtgataatctgtaaataagacaaattgaaaacataaatatcactacaaactcatttcagggaggcataatatagtagtagtagatgtccaaatcaacactgcttgacaagcgcagagcaataaatatcacccaaaagaaaaaagaatgccatttaactgagatgtttatatttatatatagcaattggaggtctcctacaagctcccacgttaatgctattaggggggaagctggaacacattagcccatgaaaaaagggggggggggagggggggagtacaaataaccacattaatctgaaaagggaaggaaaagaaaagatgctaagcgttcatctgagaaacccatggatactctacaatagaacagatctactgtgtaaggaaacatctgattctgctagaaaaagaaaccaccgagtgatgtacactataagcataaaagaatcaatattaacacaccatctttgcatgtctgatttttgcaggattaagcaataaataaacagatagtagaagaggacaaggtagtaaaaaatgcctgacgcgacctgtgaaacatgaaacacaatccaaacacgcatagcacacatgtgcatagctgcgaatgaatccatgtttaaataggaaacaaatcaacaaagcaatcattagacaagagtacagcataccgtgcggtcatacctagttagcaagactctgcatagtcactacattgccaataaattaaacctacatggactcaaacacataggttctaaaaaggatgtactttataagaggtatttgcatctataaaaattaagaacgtgctgtactatcacaatattgcatatagtaggatagaatgcatacatgattattatgtgccatatatgcagatggaataaatcattcaaaacatttgaaataaaacgggcaagaaactttacaatttagaactacaaaagtaaaaatatcaagggatacaagaattctaaaaattatctgaaccatcgaaatatatgaactctaacaagaaagaacaattataagttcaagattaatcaacagaccatctggcaacaaatgttggtgcctgagccaagaagagggtcaaaattcaaaatgcaattatttacaaataagtcagcagaaaccatgatagaattagatttatacaatttactgaagattacaaaatcgagttaacagtaatttattgccgcacatattcaaaccagaagaataaatacagaaaatgaatttactttccactatttgccatattgaaatgtttgaattaaaagcttgtgataagtttattatagcgttaatactaaagctttggtccaaaataaaatcaaaggttgtgtttgactgattagaattcatacatgcatgttcttcaacaataaacggacacatatacacacacaaaccttaaacgtgacacggtagataatttgttatagatgtataattactagctcatgtgggtgcacagattctgactagttcatttaatcggttaccaagaaataaaataagtgtccctaatattgcaggacacatattgccaaatctgaaggatgcatccataaaccattaggattgacaaatcaatgctgcattccaagagtccaacatcattttggtcgtctgtaatcctaattcattatatcagtgtggaacagtgtcacaagtcgaacaagcgaactcagggaagagagaagagggggttcactctgctagcaaatacaagatgaaatgtgctagcagtattaccttgtaatagtcatcaagctgaaggcctaccacatcaaccggcttgagaaatggctcggcccattcatgagatgtgatctggaagaaaaggaaatcaagaaaaatattgagtgcatatcatgcgcatttcatttggaaagctagtagtgtgttttgagtgtcgagttcaactacgatcaatcaatatgaatttgagaggaaacaatggagcaagaccatacaaatttatcagcatatcatcaagctagatatatctgtctattttgaaggatgttttctatacatggttatggagcaaaattagaatcaaaactagcggcagaaatcttaattaaactgcacttatttatcattggaaataacagtagccacacgtgcacaagaccggacaataaatagctttctagattttttttcagttagacctatcaggtacagtagccatgcactatccaaaattagcctgcaaattaaaagcttttgcaccaagcacattctgaagcatgattcaggatacactaaatactttgagttatccatgccagcaagcaagaacaacatagatcaatgcatttgtcggatttttcttttttttttttcctctcgagatgtggttaagaaagatcacctggcgcacaatcgtgccaaactggcgcataagatcaggcatccctttggaaaggctgctatccttgcgaccagccttccggccaccactgccatgtttcttcccgtcgtagaatcccaccacttcattcaccctcctctccagctgcaatccacataaatctccaatcaaacctctacgccccaattatccgaatacaataaatgcaaaacaaagaaaaaaaaactgtaccctactgtttccctaaccaaaatccccaaaaccgcatactacagcgaggcgagaaggaactcgaaaatccttccgctgaagaatctcatctaccaggctaagcagcgagacggactacttccaaggttgggggagttggtatttatttacctggtcggtcttggagacgaggtcctcgacctggcgccggaacgcgtccacctccgtccccggggccctctccccggcggcggcggcagtggcggccgtctccgccgccgccatagccctccctccctccgccccctgtgggactccacctcccggcaccatatctagggctcgccgccacgcgcgtcgccggcggccgtctgcgagcgaaaaaggcgaaaccaccggcgcctcgactcgacggaatctttttttttattttttttcctttttttttgccccgcatctcttcttcccttcaccttccgaccctgtgggccggatgggatgggccatttcctgggccggaagacttcgccctgcaggatgtgggcccaaggtggggcggatggaattgttgggcctagtcagcctcgtgatttgttaacatgggccggagaaaaggctggggcgaacggtacaggggccgtagggcacacgtggaataagttcatatgagttccttaacttgtcaacgaatccgatttttgtccttaaaccccaaaaccagatataacggtccctcaactatcaaaaccggtgcagataaggtcctcgacggtttagatggcgattttttctgacgtggcgcctacgtggctattttgactcggtcttcatctgacgtggcgcttacgtggcaattcgatccggaaaaataataaaaccagtggaccccacatgtcagtttcacacacaaaataattaaaaatggtgggacccacgtgggccccacatgtcatcttcactcccctcctcttcttccttttcactccccatctcccctctcttcatctcgccggtggctgctgggaaagaagcagcgtgtgggcaccggccgtgggctccgcccggagggaggagaggagcggcgcgcgcgggcgtcggccggagagaggagagaagcggcgcgcgcgcgggcggcggccggcgagaaaggagccgcgcgcgggcgacttctccctctgcttcctctcccgccgcccctgaagacgacgacggtgacgggttcaacgaggagaaggacgagcacctcaccatcgctgccccgcccccgtttccaccgtcctccgcgctgcccaccgacctcgatgacgtcctcttcttcctcctctctccagaaacccacgggtcacgggaagttatgcggccgacggcggtggcggcggcaggtcatcagcaagtttttctacagtgtcgcgaacaacaacataggcagccgcgcaaagaaatcccatttgcctcattccaccacctagtgtcttcctaagaattttagcctgaaagtccatatttccatcgttacatcccatctgcagtttaaggtaacaagttaacaagcacaattgaacagaccttttctatgaaggccgtcgaaccaacaataactgatccaacaggagcgcctaagccttcagatatgcacacctgcagtgcaaatttccgtcgacctcctcgcaccgctcttcaccga

SEQ ID NO: 38540 - DNA, 2350 bp, Oryza sativa
cgagcaggtcgcagagctcggcatggggctcgctgactccggcgtgaactttgtgtggggtcgtcggggataagaacgcgtcgccgccgcagccagggtcgcctcacgccgccccttcctcttacgcccacagccgccggagcgtgcctccgccgccgcgcgccgcgggccgctgtctctccgtcgcgagaaaggagataggagagagatgaactgatgaagagtggggagaggaggaagaaaaggagggctgagaatgacacgtgggcccacgtgggccccactatttttaaattaatttgtgtgtgacactgacatgcgggtcccacaaggtttattatttttctaaatcggattgcccatgtaagcgacacgtcaatgccacatcagatgaagaccaagtcaaaatagccacgtaggcgccacgtcagcaaaaaccactgtccaaaccgccatttgcactggttttgacagttgagggacctgttgtatctggttttgtggttgaaggacggaaatcggattcgttgacaagttaagggatcttagatgaacttattccgggacacgttgctacttcgccagagagatcctcaacggctcgattgtcgcagtctcgcagagatcaaattgctggcaagaagtggcaagaagttttatttgcggttttttttttttggcggggaacggtttctttagttcaagtaaatggtagtacaagtgctaatgaggtggcttatatgttggctagatcgactactggcattgtattcatggttgtatctatgaacttgtaaactctgaatctaggaacttgtaaactctgaatctttatttgaatgaatgagccgaccttgatttaccaaaaaaaaaaatactcactagctgcttgatctgaatgttcaagtgggttgatagtgatggtgaccatgagtccatgaccgtgtcttggctgccacacgtgacacgacagtatcgctctcgtagtcgtaggcgtacgcgtataccaacttggttacaggatactgcttcaactttggctgcctctgccaaataactcttcacatgccaaattgcctatcacccaaccatgtacgtatgatgaactactaacttttcctctcttttttcaataataacttctaactgaccaaacgattgatatgtcaataagccatggacttgttattctggtttctgaagataaacatggaccagctttcaaggcctctttggatcgcaggtgccagatggtttcatctgaaaacgaaaggtaatcaaatgaatcagatctgggtgggcctgttaaactacagaacagaacagatgctcctccttatcaattctgatgatgcgtcggtggatggatcagtgaaagtcagcttcacagaataacagtgcctgactacttgtataatccggtgctccgtcttcataacacagcctgaatcggtgaattgtcaatacgcgctgtgccggtattcaacagaaagacaagtcaggtgctcatgacaaaggaaaattcattgaggacaaagtacattgatcacagaaccaaatgccacttgaacattttcaaagtcagatatagtaaatgcagcaatacgtacagtatgtttgtgatttgattcacaatcggtatggaaatattcatgtttgaaagtaacttacacatgaccatgaatttgtagttgtgaaatgtgaagaagtcttaccctcacaatattgaagatcatgggcaggacttggagacttgaaatgcatggcattacttcatttacatggtagggcgaactagaatatttggttcacataatcacattacagaagatgcacaaaaatgtgaacaggtaaaatcaccttgaaaagaaactttagttgcaatatgacaacagaaaacccataaaatcccaaatcaatcagatgttgcagatgagtgagcaatagctcatagtgtagcgtacagttatcaaaactgagatcttgcattgttcgacaataggctcagagaagagctgtctgaacaataagattgatgctaacttacatccaatggaaactatgctgattaacaataatagtacagacaatcatcatgtccttttcagttcctaagaagctcaatcctcatctcaaactcacaatccatgacagggacaccaaagaaaaccaaaaccccgccaaacaaccgttaagtattttggctgctgaaggtcaatttaccaccatagacaggatacaaagggaaggcaatacaatactcacaatgcttgtcctgaaggccattttgtcacatatgtcctcccgccttacatgcaagatacgaaactggtgctgactttttatcaga

SEQ ID NO: 38541 - DNA, 1920 bp, Oryza sativa
agagtgggcaccgagggcagggagtatttgtagggtccgcatgcagtgggaccctctacctgtgatgtgatgagcgaagtgacgaagacgcaaagtgcaactcaacacgatttttgtagtcttctagggggtgtttggagagaggacttatgttttggagagtttatgtttttgagagtttagcctctctctcccaaacacccccttacttacacaaacatatatttttaagagatgtgtgaatattatgctcactttatcatgtaaaaaaataacttagtgctggatataacacattatattactatgaatttagacatatttctgtcaagattcgttgtactataatatatcacatctaattataaattctcgtctttttagagagtatggtcgagttgaatttcatgtcgtgctagccatgaccaggcaacgggcactatgactttgtgagtctgatttttgagaaatcaggaaaaaaaactcaaaattcttgcaaacaatagcaatgtttttttttctaattacatggataacgcacgacaacactaacactaagtacccacacaccggcaagtcccaaagaaacgcttaaatggattaacggacaaaagcctcgtggagatcaacatttaaaccgtgcgaagtttccctaaaaaaaaacgtgcgaagtaaagatatgcactcgtgatccacttcttgggtatatgattattacgatagaaacaaaataggtaaatcatcaattttaactttacaggcaaattatgaaagaatgtgattaaaagacgtacaccctccattctaaaatgaatcatatccatatcatatagccccatcaattttggcatatcggaggaaaaagtgaaacgacatatttgtaaatgaaaaataatttgtgaataaaacttttatatacgtgttctgaacgatctaaaagcaaatgttgaaaaataaactacgatgaaaaaaaccccaaaatcaactctaaatttaagattgaaaattcaaactttagctgataagcgtgagtgaaaagatgaggctaataatatccatattattgctaggatgcctcaaacggaacatatcctatatagattaaaccgggatttgtttttttttcatatgattaattttctgaaggaaagggatgtaatttgggcttgggctgaccaaattgatagcaggccagatcaaatcatccagtcaattcttgtattaactctaggcgatatcagtatcacaaaaaggttgatagcatgcgtagcatagtgcaaagacatttaggttgttaatccgtagtactaattactaagcttcaaaatccacgaggcgtcctttgcctgcttaatccttccctttcgtgatcgcaactcgcaagcaacaggtgcaagctgccaagcacaccgccacggtttgtttatgtttagtcatccgcgcggatctccaggcactaggcagcatcgacatgagccacacgaatcgtagtggaaatccacgatctcgctgcgaagcgacagggtgccctgattttgaccaacgactactttgagagcttaggtcttcgctgagctcgtgttcaccatccccatgcattgacctaggacaaattgatacttttctactcgcaactattccaatgcgtgtatggatcctgctgagtttactttttcactctaaaaattaatattagcaattactccattcgtcctaaaatataaggaattttaagaaatgtgacacgtcctagcactaagaatattatgggactgatgttagtggaagccttgtctaacgaaacaagatatcttgtatgtttagttcacgccaaaattgaaagtttagttgaaattagaacgatgtgatggaaaagttggaagtttgtgtgtgtagaaaagttttgatgtgatggaaaag

SEQ ID NO: 38542 - DNA, 4742 bp, Oryza sativa
atcctgcaaaacaagtgtcggtgcccatcgaatggtggtaactctccttcagctcataaagctttaacaagttacaatgacacctagttcaagaatagcacgttattctaatcatgacgaccctgtataacttcggttctcggaaaaaaaaatgatgaaaagaaagcaacaatgatatatctttcaaacacttctggtatttccgctatgtatggtatgaatgcaacatatatctcatatttgacttgaaatcttgggcagcatctaaatcacgtcaaaataattttgagtcttattttgcaacatgggaattgaagtgcgtcacaagaacattgttcatgtgatctacgtaaagccagcttgcgtaccttagctatctcttcttcatcagaaacagtagcacaaacatactcggcatgtatgcgccctcgctaatgcaagttccacgctgcatcaaaagatgcttcctgtgtctgcagatgaccaaaaaagttcaaagcatgattaatgcatcactaagcgcaccatacatgtaaagaaaaaaaaataatggcttcaattgccactagtccttgcggtattaacagtaacctagtattcccttctagttgcattattattgtagtagtgcacaggcctgactgagctcaccattttaagaacacatttcatcactgcattaccagtagaataatgagcaggctagatctgattagtgattaccatctctcgtctgtaaacgagacaatgaacaattgagcatctcaatgtgcaaggacaacgactgttgtgtgcttccaattctgaagggacaaggagtatctctcagttgactgctcgtgatgaatctccataatcattcaatgtggaagacttgaactcctttttctcttaaagattctgtcattcctatgtaccttcattttggtacaagaaccagttcagctgcctctaccgaaattattatctttgtatccttcagatctgagcataagctttatgtaattctaggaatcttcttgtgtagattcaacttctcttcttccttagataagacatttgcaccgtggtagggcagctgcctgtattagttttcccagtttgttaatcttggtgaaagcaaaaaaccattggaaccacttacctggtgctaaagttgtcttgccaatccagtttctagaaccagttatttcctaacttctccaagcattagataagtaaccagccttttgttatgcagaagatgctccatcagtagcacgctttgcttagttactgtcaattttggaaatgttcaaagtcaaatcaattgtgacccagagcttgctgatcctcactgactatttgagcattactccagcaacggtatatcaggacttcaaccggctgtttcttctgtactctggagaatctgttggttcctaaaagcccttgtatgattacgctgctagatttgtttccgagaataaacaaaagtaggatattccacgggtcttccagtgagaacgtagtagggtgacctcaactgaaagggaattctgatattcatgtccacagtcttttgggtttagtgtatggtacacagctcttggtggacaagcattcagaatcatggcactatgtctgtcaactgacaaagtaataacaatggacgatgctctgctaacaaggaaaatagggtatccaccagagcctcttccatctttcttatggttgatttgcaagacggcaggtgtatctatatctgagtagaattttgcataacagatggaaaggatatcagggatgtttaattaagttctgacctccaacttctctagatgaatggccacatagaaatagcgcgaaagtatcagttggctctttcatggtttgatttgcacctttgcagttcctcttgataaaataatgagatggcagcagtacatctctaaccatcaccaagatgattttgtttagactatcacattctttctgaggttgtttactcctcagtgctctctctgaaatgttgagaacaaataacaaatacagaatagaaggcccactgttcaaacattgcatgcaaccattttgtagttggatttgccttcttttcagtttcctgagaacgctttcttccacctgaaacaataaatatatgaaaattcaaaattaaggagcacataaagcatgaactctgtggcatgttaaggtgaacaacaatataaaatggctaaaagaggcacttaaccttaattgtttgactcaataagcccaggttaatatgaaataattatttcagattgttcatacaccggggaatatatgctgctgataaagaagcctggaaaagctgaaaattaagactgatgaagtaattttgataaaaatgtgtatgctgaaatgaacatctagcagaatgggagaaggccagaacagctaataccatcaaaaatgtgaatgacagaagaagctgggaaacttctgaaatcagtagcccgaataaagaaaaatccctcttgcaatgtagaaggaaaatacagaaggtcatataaacactaatccgataccgaattacaaacccagttgagttatatgtgtatagagtaggcacctcatcttctctagcagctgtttcttcagctgattgttttgccagatgagccactaccagctcttacaatttcacaatggcaagtacgtagttcgaagttcgtaaatcagaaaatgtgcctttatcaatacacagtacagaactaaaggtactgctgtatggcataatttactgaaaggtatacaaccattcccaaacaaaacagaaaatgagaactgaaattcagcaaggtaagcagacatataacaggtgctagtcagcatacgacaaggatgaacttaagttaaagcatctttcaccaacggtcgaagaccatggtctagtgaacagaaaaaggggaaatcttccttcagaactctgcgccaaaatagcttcagctttgaccggcgatgtaaaaaaggatatgatctgcttctaattggcaacagacaagctctcctagtgttgaggaactttggaacactttgcaaagcagagagttctcatctttgtaggactaaaatctaagatagctgcacaaaataattacagcaattagaacatttctagtaacaattgtacacatgagctaaactcagagagaacaaaatggaaacctcatcatgcacaactcttaatggaatccatttgcgtgcttattgaatcatgcttgtgcaactaaccaccattacaactagtgaaaatatctcatgcagtcagataaaaaaaatattatgtggatctgagaaactctgccatgcatatcttctaacgcgaaacatgtgcttaaggaaaaggataaatgagcatgatcacagaggatatatctgtcccaaacattgtctatgcagtgctagaagcacttgttacttgtttgatcaattaaaatgtaatgccaggagtaagcaaaaaaaaaaaaatcgaagccagggctttgatcttacttggaataacaagaagaaagtttaatcaacatttgaccaaatcaccacttaatcagaacaagatttttctaagcaaattgattggattttgcaacttcagacaatcaagttaaattgcttatgttcaacttgctaatagctgttgatagcgtaattcttcttccatgactttgagtagtacacagtagtttgccttactttatgcattagaatagtgtgcctttgcagtccacattttaaacgacagaataatattgcaaatccatgatatttcaatttgtagagtgcacacctgctgcattcgggggttggatgaatcatgggcaagtaagaaggcacatcaggttattttacatatatgatgtcctcctcatctggctcatctgcatcccagtcaccttcttcttcttctgatagatttgcaccttctccatcttcctcttcttcatttccttcttgttgctccctttcctcctttaatttgtccagtatagcaagaatctatatatatggcaacaattagactatagtttcccaatatatttgagagatatgaaaaaaaaaacgcttagtgcaatactgcaataattcattgtgtgctaatgcaacccctgcaaacattggattgttaagttataggttctgtgatgttaaagcttaaaaaaatgtctgtatttggggctgattgcctcgcaaagaccctacaggaagaagcttacgtctggtgtggtatcaatgaagcgtaacctatgatcttatccaaataaagcatatgggtacttgtagctataattttcaggtaaaccgaattgcaaacagccaaacacaattttaagtttaaacagagatgcaaaatactaacacaacttgtaaggtaacaaaaacaatgaccatgcttcttttgaactatttggatcttgatatttgataactatccgaggagcagtactggacaatcacatagtatagatacgttcaaggatgcatgtactaaatgaagataaaccagtgaaagcagatattcattggaacaggtagatagatgagtttagagtgtgtaccctgcttccccgctccatggactcatcctcgatgaaccgtatctcaggcgtgaggcgcagcttcatccgcttgcctatttggctcctgacgtacttagtcttagccttgagcccagcaatggccaccttcttccccctctcgtccccaaacacggagacata

SEQ ID NO: 38543 - DNA, 2309 bp, Oryza sativa
caaatttacaatctctctatgactcgctaagcgaggggaagcgtcgttggagaattaacgcaggaggcagtgacctggaggtcgttggagagctcgacgtcggcgatggtggtgagggaggagaggtactggtcggcgccgagcgcggcctcggggaggacggcgcgctggaggacggggtcgcgggtgagcatgtccgcgagctcccgctggatctgcttcgccaccatccgcacccgccggtccttcgccatgcaccgcaccacgcgcagcgacgacgccgacgagggaggcggccgcgcgggcgccagaggggacgcgacggcgaggcgccgcggcagcggaggggacaccagcggccggcaggtgaacatcgccgatcacctcgacgcgagtgtagcggtggcggtggtggcggtggtggttttccggcggcttcgcggtgaggccgtggaagacgatgagtcggggaagtgggaggggatagtgtcgtcgtgtcgaatcgaacaatatctcgcgtctttttttagttttgttttatttgaaagcattttagacgattttaagaagagtttagtgcaatccattttatacagttctggttgtaaaagaaaactccagcaaaatcatcttgcccattcaggccaaaattctacaaatttctctctgtaaatttcatcgtgccctggaaaggcactaaaaggataatacgattttgaagactattatctgatgtagatggagtcatagaaataagaaatctaataaaaatgtcaaatactccctccattccaaaatataaaggcataaccacctctaacccaaagacaaaaaaataattattattatcatctcgtagttttattatcctaataaatacaatgcatgtatcaaatagaattagagaacatgagagtaaaggattttaaaaagtaataatttaatagagaaatggtcatagttaagggcttacatgcatgcatgccttatattataaaatactccttccgtttcaaaatgtttgacaccgttgattttttagcacatgtttgaccgtttgtcttattccaaaaaaaattgtgaaatatgtaaaactatatgtgtatatgaaagtatatttaacaatgaatcaaatgatatgaaaagaataaataattacttaaattttttgaataagacgaatggtcaaacacgtactaaaaagtcaacggtgtcaagtattttgaaacgaagggagtataagaaaagtagttgtgccttatattatggaatggagggagtattttgtaggattgattccatagtcaaaccaagcaacatacagcccatgggcaccgtgcccacatcttggaaaggaaagcccatctaggtaaccaggcctataaacccggcccactatatcatcaaatgccacgttgccctagacgcttaaaccctcacctcccaaacgaacacacacctcaacctcccccgagacgacggcggcgacggcgacggcgatggcgaaggagaggaagcggaggcagcccgccgacgcgccgccgccgggggacgacgacgaggggagggaccaccggagggagaagaagccgaggaaggagaggcccgacccggtgctgccgtcgcagatcaagaacaaggacaagcgcaaggaggtgcacgcgaagctcaagcgcgagaagaaggcccagaagcgcaagctcgcccgcgagcgcggccaggccgcgcagcgcgccgtcgagctcggcgagcaggcaagcgcgcgcctcgatttctcccctccgcagcgagctccccctctcgaattcctccaagctttgtttcttaggtttttctgatggttttcattttgggtgttcgcagccgccggagaagctggtgccgcggacgatcgagaacaccagggaacctgacgagaccgtgtgccggcccgacgaccaagaggtttgtgcacgttcttctgtgtttcttacttggattgatcctaccaatgcgagtttctcaattatcggagtaattgtaattttaatttctaattgtacattcgaacctgtttgactaatagtagtttggaatcaaggacatttatctgacagggtctccttaatgttgcattaggtttgtggaacatgagaattacatttctttggtagttaggctaggtatgcggtgaggttggggcaatttctgaattacatttctttggtagttaggctaggtatgaggtgaggttggggcaaattctttctttactagttatgaccagggaaggctatctggaacgtggtgccttgccgaggttaaggaat

SEQ ID NO: 38544 - DNA, 9537 bp, Oryza sativa
  unsure (1)..(9537): unsure at all n locations
taattatttgataacctctattcttaagaagttgcatctaacactttatgtttatctgcacatatgtctacagaggggacctgcctttattgaggagttaatgcaagtgatacccaattcgtgttatgttaaaagaggaacttatgaactcaagaaagtatgacatgttcaaagtagctaacctgttcatttgtttgaattagacacttcatatggactgaaacacatttctttttagattgtggaatatgcaaataacagagatttcacttcacttgttgttgtccacacaaaccgaagggaacctggtaagaatccatcaatttattagttcaaaatttgcacttgttatctgttatgacatatttattgttatttgtgtcacagatgctctactgatcatcaatttacctgctggtcctactgcacattttaaactatctaaacttattctgcggaaggacataaaggtactttatctgtattttctttatcatactagcaaaatgcctttgctatgggtaaaatgcacatgcttatttgaatatatgttattcacttgattcaaatgaatattagactattatataatacaagaaaatatcaaggactattttgtaagttgtgcaaatgtagttgtgggttggtgaaccaccaccaccgctattgtcttttacagtagtatagattatcacctactaactaatgttatattgttttcttaaataatatctactgaaactacaactcttagatgagttattcaaaattttgttggaaatggtaacctgtatttatttatttttatttttgtttttgggagaacttgttgaatagctttggtgttgtctacatatctttgtgctaacttagcatatattttcaccataccaaagggataggacagcaacactgttatccatcttctatgtgttctgataatctttgtatttgcattgtgaagaacaaatagtaacagctacttcagacaagcacaaattagtgctatttttgaagaatcatatgcatactatcttctgctactgcaaatctcctgtattagttagtttataataactgtttgatctgtttgtgtttttaattgtgatctgatcacgatatcctttgttcttagttttttgcacacatgtaagagtgagaaaatcccacggctgtctagatcttagcaaattgacaacaatatgctagttgggaactgtgattatgtcctctccagaaaaaaaaaagttaactgtgattatgtgttatgatgactgagagccaacacacatggctattttctgaattctttagatctaatgctgatctttaccctattaaacatttaaacctctatacacaaaaggaagaatataaaattatatgagtatatttaaagtcagatagtaaatgtgccattgttttattttcagaaatcttaaacacaatcttgtttttaccgaatgctatcaggaattcattagggacatactggttgtggtttggtatattgttatctgcaggaaaagagccttgcttgtgcataacaactccttttgagggtcttatattattgttagtaattagtgcggtggcctattggctaatataaacacatagtgtagttcagaagataaaacaaactttgatgatcacgttcatcacaatgatgaatatgaaaatgtcaactaattcgtaacgttgtttagatagttatggtaataacaatgattatatcatagctgcatatctgttattacaccgctaacctctttagactaaaggtgcactggaagtgaacaaagcccaagttgacatcaattggtcatcctacttgtctctagtttgtctctaggatgacttagtcatctgagctttgccctcaaaatcaaatgtgcatgtgactatgttcggtatcatatgacatgtctgctagatgctgatccatgtctctatccaacatagcatgttttagttttagtttttccagtctttcaatgattgtataaattattgcaattgcaatggagttgggttgataaccatgttgctgatggtcatctagattgatggaaagcagaaaaaaaatagctggaaggaacgtctttattctgctgcacctggactttgactaattttagtagcgtttcatatccagatttattcagtttatttgatatgttcttgttaaatgacaaaaggttctcagcttattttccaatattatataaatctgtttttgaattttagctttgcgaaccagttaatattcatggctttgtttacctttttggttgcagaaccacggcaaccccacaagtcataagccagagttagtgttgaacaatttcactacgcgccttggtcatcgtgttggaaggtgatttgtgaacatgaacccttgtgctcctttgctgatcctgtttagaagaactctgttttcttttacattagcatgttcatgtctgctgtttgcttcacttgtcaattttccccttctgccttttcaggatgatacaatctcttttccctcaagaacccaatttccgtggtcggcgagttgtgaccttccataatcagagagactatatttttttccgtcatcacaggtgcatttatgaaaattcaagtaggaaaaaccatgttattaaaggactcctgtgtgtctacgtaattgtcttttgctgggatttgttgcataatgtggatcattacaagtgtttttagtaattacttcctggacatttctttagctcataattttgttgatctgtgaagtgtgttatcaaaaccatgctatcctccttgctagtcttgacatgtgcttttgattatgtttgtggcttccattttactgtgagtattcaaacttattttcttatgcaatactaatgctaggtacatctttgagatgaaagaaaacaaaattgcttcaaaggacaagaaagctaagacttctgaaagcaaaagccaacctgagaagcaagtaatttgtcgcctccaggtatttgagctacttattcagtactcactacaagttctgtaggtgatggcacatatttcattcagttcacaatctgttattggtcatcaccatctggcaaccccaaccaaagtgctttctatgttgcgtgtttgaagggtgtttctggttttccgagatatgctctcgctttcaacatcaaatgcttactgtcttgccagttagacaaacacaatgatatcattacttaggcctaatgctatttataattgttaccatgttattattagccctagcagtaaacctaagctgttctgatgaactaggaatgtggtcctcgcttcaccctcaagctgctcaccttacaacatgggacctttgacacaaaaaatggggagtatgaatgggttcacaaggtactattattcatttaccgtcccatgcccacactacactctacatgaaagttttctgacatgctgcaaatcttgcatcattgcatcatttacagccggacatggacacgagcagaagaagatttttcttgtatttagcatgggatcctcatgccacaccagatgaaatattagtgttgttcggaaattactgcatattcgttttgtgcacttagaatcgtatcacaaatgtaacagacctctatgcacatttgaagcaattttgatgatctatcaaatgagttgagctatacgaatcttggcctctttactatatggttgttgttcccgtatccagtatcttgcacaaaagctgccctttgttttgttccagccctaatatgtcttgctatccacaagatgtatcatcaaatctgctgccatacaaaggtcgttatcatccaactgccatgggattacacctcattgttcctgcccttctctccatccaagaacttatcattgctggccccatgttcttcaaggctgctatagccaccagcggcgccatgacagccccaggatcatcgtatccccgaggtatacctcttctcggcctgttacctactctggttataaatatttgatgtttaggttagataacacttattttaaaagtgaaatatttatacctgattagcctatatagtactctaacttacaagtagtaatgagatactggttggccattgcccatcaaggccgctgatcttttaaccctttttattactgcaaagtactagatgccactcatttaaccctttttattactgcaaagtactagtggatgagctgatggtataccctatacctctttctctatctttaagactgtaattacaacttgtgatatctgtggccattgcccattgctagcgctgttaaacttttgacaaatttcatgctgttactactgctaggtagtggctgagctctgatgagcaggctggctggcagatagctgcctgctgctgggtactgctgctacacatggcctgggggtcccatcctatccaagtaaggccatatgtttctgcgcgtacgtccgtgcaggccagggcgtacgacacagaggtgcgttctctctctctccttctcttggtcgtcttctcttttagatgagatgagaggatcgcattgcaccgctagcttgaaagagaggctcctctccatagagtaattgccatctgaaattgctgctaggtgggttggtcacgagtgcagcagtgcagcggcacatggcttgctccctcccctggccctgccatgttatctgctccagtttggtccaatgggtgagtgaagttatactgccacttcatctctgtttctgcagcatctgcatgctagctactaggtaaatgtttgttcatccctcttcttgaacactgtcagttagctgcatatacatgctcagttgctggccctggccatggtagatctcgagttacagctaaaaatcaccccttttatcttcagttttgaactgagttccaggtcactagaagtcttaaccatgcagtcaaatttgggtgagcagcttttatgcagccatttgggtattaaagtggatactggaatattagtatcgcgcacaaaagctaagcctggacataatttgggtgagcagccattgcgtacatgcacctacgtgcaactaggcgttaattactctcgtttttagatgggaaatacgttaatttatggcgtgttactgcatgatagcgaagatgatcactctgaataatctgcactgtacgtggcaagtgtgcatgcatgggttgtggtgcagactatttacatgagtggatcagatctgtgcactgttggatcttccgtgttcgatctgtgtgtgttctcatgcaactcaaaactattatggtccgagctgagcgaaagcaactgccgagtaacaactaagctacctgcatgtagctatatatacttctgtagtctgtaccgtaccacgtacgcacgtacaactacgataatatctctcggagggcgtatcagcgcatagccaatatgaggtgctaattaatatccgtgcttgtatacttcctctgcctcgttaatttgtccagtttcatcgctcgaaataaatttgcgtatagttacaccagaaatctaaggtatatactcctcatttctaaaatgtagggccagttcggtttggttccaaattgtgccctatcaattcattggtaattttcaatagtgtttctagttgtttggattggtgccaaattttaacaatacatctctttagataaaaaagttttggccgtctaaatttggtagtgccaaaaattgcttaaactttggcactaccaaaattttggtatggcaccaatccaaactgacccgtaattattttttaaatctaaaatagaaatgtagctatattttaatacgaacagagcaattactggcatcaaattgacgcagtacgttaagtaacatgaggtccttccgtcctttgctagtggctacaaactacaagttatacaaaaacaactagttatataagctgcctgtcagtcagtggtggtcactactacaagcacacggcgatagccaatatgaatggccagaaaattaggctagctctctgcattcacatacgtactgacgtacatatcccaatcaatacaccacgttgagaggctttcggccggcaattaagcccgaaagatatctgcaggctaattactgatcatatacatatcacacagggatattgcacaatcactgcatgccagatgccacattatattgccacatatacacccgggctagctagatgcttgctagctagctaccttttcaacctcatcgtcattaactattatcacgactactctttccattaatcaaaatgtatacatatcaagaacacatgcatggttgcattttggatatctcgatctctagctatatagctagctagctagcttcttaattagccggccggtcattcattaccttaatttgcatgtacaacgagaccaaaaaaataatgagtaaatgatgattcagttcgttcgaactcatcactcaccaaaaaaaaaaaaaacagcatacatgcaacgacaccagctaagctagctagctatagctccaaattaattaaacttcgccttcgtcttcgtctacctctagctagggcgcgcgctaatctgcgcatgcgccgctagctagctccgacgatcaagatgatcaatcgatgaatctcgatccggccggtgtggttcatatttacacggtagtattcattgctagatcgagctaagctagctgatcttgccggagcaatggaagaaggaattaatatagctagtgtacagatgcggcggcggcgggttcagcgggtgcaggagtagtggagggaggaggtgagggagcggaaggcgacctcctcgcaggggaggacgaggaggccgccggcgccggcgccggcgaagccgaactcctcctcggcgcggcggagcagggagcggaactccggccggtcgagaagcgcgaggggcaccacgaaccgccgccgccgctcgccgacgtacaccgcgaagtggcccctcggcacgtcggacggcaagccggacgcctcctcctcctcctcccactcgctgacctgcttctgctcctgctgccgccgccccaggctcgagcaccgcttcagtatctgcttcagccccgccgcgccgcccttcttgatcgccattgccgccggtgagctcaagcttgctgtagttggtggttggtgatggtggtgacgaggaggcggccatggcgagggggtatatatagggagaggtgggcgaggtcgtgaggtctcgccgtggttggtgctggtggtggatgggcccgcggcgcccgtgggcttgccgggcctgggcctggtacagggtgtgggacccacatcgcaggtccctgtgtttttcaccttagacctagtaattagttgctagttgctactacctccctcccaaactaattacattttgagagaattaaagatagattagcaacaaacacaatttaacacaataacccaatttaatgaccacacattacctacataaacttgattaaaaggaaggtcgagacaataagcccacttaattaccattcttaaacttgattaaaaggaatatttggatcctttgtcagcagaaatttttttgggataaaatttaaatgatagaaatgtaattatttaagacggagataatactagatagtaatggtagagttgcaatggttgtgattagtgaatctgatctgataatggtagtccataatgtggtaccttggggagctccttgttttttcatttttcctttttatacaggagtttttgttgagtgctagtacgggcccattctttgaagatgaaaattgatggatgatcgccttaattacagggatggattaaatactatatattataaatctaataaataacttagaacaatttatttaagcaattctgatttatgaagttttcggacaaattatagttatcaaagcgtggcaatgcatatacaatctatcagggttaatccaaaaagagcgaggccttagatttagagttaaatgatgtaatgtctcattttaaatatgtaagttcagaatttcccacctttttttacttgtatgaaacatggtgattttctggcctttcgaattggacctgtttggaatatggtaatcttccaaccttcaattccgaataagtcaattttcatatccacatcaaaatgaaatatttccttcctacgttcgaggcgggccttcatagaatgttctagaagaaggttgttcgaagttatccaagaaggttgttctaagttttcgaaagtgaaaagataaaaaggaggagaaaaagttgtgatggggggctagctaaaatcctcgatatttccctactcttgcaatttgcatggtagagacaaggtcaacacactatagttagctagtatattgtaggatctaagtatcaatcaagtggcagtgaacataaaagagagaaaagaggagctcaagtagtggggaagcaacttcaaggggttgacatttgacaaaatggcagtggaaaaattccaagtctcacatcaaagtgagtgatcaaaaccaccctttaatttcttctgctttttcaatgccctgcagccagtgttgttgcagacacgttcaataatggtccatgatccatatctttcaggtatctctgaccactgtacgtctgtaccggccgttgccgctgctgcatcctctacgcatcacaaaagatgcctagatagttttttacaacagtttctacttgcatttcatcaggaaaaaaaaaaagaagaagattcatctgtgtttctgaaagagaactacaacaagatttctctcctagttcaggttaatcaggttcaggagtcaagacttcaggtagcaattttcaactattgataatatttgaataaattattttattttattttatttaaaaaaatataaaactattaaccatgttaatttaacatatgaagtataaatttcgcatggatttgagatctcgagccgtgtcaaatagggagatggtaaagattacatagtgaactcacatcctctagagccgaagtattgcaagaaccaatagttcacatgttaattaactcaaaatctagtgcagcaatatccctcaaactgatgtaattaagtatcctcctagctaagtagctaggcttggctacttcagaactaattaatcttatctttattcagttaactaatctttgaatgatagttgatcaatcacagatagtatgtattatcagctggtagatctgcagggcaaaatataatcaagggctgccatgcacttgccactggcactagtgtggttgcatctcatgataggtgatgttgctatgacatggctactgggcgtacggatgggtggccacccgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 38545 - DNA, 5441 bp, Oryza sativa
actaagtattaatagtgtagtatgtaactattgtatggataagctattagattggctatagataaattagagctagtagttggctatactattaaacttgctcttagtatgatctaaagagcattgtgtaccacatttatagtcattgttcacttgtttcaaataattctccaatacggaccggtctcaaactgaacactcgagatgaaaattagtctgcacttgctgacagttttggcagactagagtttatacttcatgtatactcatctgttgctttttcttcaaggacaattgaatactgtatgtttttatttgatttttaatccatcaatcatgcatgaaagcgactacgggtattctttaactccaaccgtgtcattcatgcatgcaacaaggatgacagtttgatgtttttaagtcgtacacataacagtgaagataacagtgtatgcgtctgtttcttcaagcaaggagcacatcgcaaacattcttttcactttccaagtatctcacatagcaaactcaaaacaggttgcactagcgaagtctaaatacacaacaaaacccaaacttctcctagggtatcccaaaatgagagtttaagtacttcatgaagctgctaccatcacattttaatcacataaaatacaacatcagtgattgctccaaatgacgaactatagccttctgtgactgaaaaggataaccaataattaataagatggcactactagctccatagtaaacaagtatttgcagaacacagtaaacaagtatgcaaaaccgcagtggataacaaccaaattttcccttctgtacaacatctatgaaagcattgtagcaaaaactagacaggaaagttgtagatacagattcaacaagcaagtccaagaagagatgcttatatacgaatatcaagcagttgtccttatcaattataaaaacttcaaaaggaacagacacctcaattgccaattgatcatcagaatttaacagtaacaaaaaagagagggcatggaaccagggagatgataagcaatggtgattgcagtgaatgctgtaaattcaggattgcagtacacaagaagccctgctccatctctacttctcatcatacacagatgcatgtctttttttgagggatacacagatgcatgtctctgcaacaagtctgccacttcacatgttatgcttttcaacaagacagttatgcttggaacaacaataaagaaattagtgcagtacaacccaacctgtcttcacactctaagaattggcaaattagtccaaattaaccaattttgggatcaaggtaaagcaataagatgttataggcatcacattttaattactgaagcggttctattataccaaatgtcaagtttagtagtgaagcttggtgtgaaaaattctataggctcagtaattttaaatgaaaatagatattgaaatgaaagtgactcagcttgtaagatgacaaaaactgctcaaatagaagcctcacatgatgtccttcagcatcaactgctgcatatcaggagatccactagattttcacttcagctagctgtaactgcctagctcccgctttgcagcctcaacaattacaagcatattatatggtattgaatcttttttcacctatcctaaagccaaattgtgaatttgcaatggcagtacctgcagtactacttaaaatgtttgcacccaaataatcaaaattttggaatcctaaactaggataaatagatcatcatgcttaacagagaaaagaggcacaaatggatggacggtttccaggagaagcttaacagcgtggcaaatttcctggaggagatgaacagcgtagtgagtttagtgaagaagcagcggatcaacgaccccagcatgatgaactggtcgctgcagctcaaggacgctatcgacaaggtggagtttacaagaacagcaagaacaacaagaatagccaaagaatcgccttgtgctctcctccgcctcttcttctccgagggcgccacgccggtggcggcgtggcgccgtgggcgagggcgatgggcggcggctgcagagtggatgcgccgacgctatgctgcgaccgggagcggtgctcgatgggatggcggcgacgacaggaaagggagaagagaaggaaaccctaaccctagatttggaagaggaggggagaggaggaaaggcagcgtgctcaccggagagaaggtggcggccggatgagagagccgtgctgtcgccgtcgctgtcgccgtcgggtcgcgccgcgcgccgctcccgccgccgcctcctctcgaggtttttttccacacctcgggactagatgatttattcccgggccggggcgcagggaaaacgccgggatggaccgggttaaaatctagactgggcttaaccgaacgcatatttttctgtgggccggtatcctttccacgcggaataagttcacattgtgaccctcaaaagtgatcgaaatctaatccgtggccctaaacttttaaaaccggatatctcaacccccaactcttaaaaccggtgtaatttgactccctcgacagttttggagggcggtttcgctgacatggcgcatacgtggcagtattgactcggtcttctgtccacgtagcattgacgtgacgcttacgtggtattagaattaaaaaaatatatgcgggacccatttgtcactcaaagaaatttttatggacccactgacatgtggagcccacatattatcctctctcctcttcatcctcctccctctctctcccttctcttttctctccccttcgcacataggggtgggcattcggtctaaccgaaaatttcggtttcggtctttggtctttgaaaagtgaagaccgaatttcagcgaaaaaatatcagtaacgacaaatttggtttcggtctttttggtctcggtctcggtcccgaccgaaattcaataacattttcatatatgcaaagaaataatggtaattatcaacacaaaaatcacaaaaaaaattcgtaagcacttatgagtaaagactcttattaggttgtatttagacattttttgataattcagtctttttggtctattcggttatccgaggagactaactaaattgaccgaacaaaatcggtctttcactatctatgaccgaattgatgaccaaatttctcggtctcgtctcgatcttttcggttcggttttttttttctgcccacccttattcgcacggttgcagggacgggagctagagcgtcggcgatggggggggtgctcaagggccggcgaggctcccgtccctcgcgtcccctcctccgtggccgcgccaccgtccgtgcgaatatgctgctctgcttgcctatctgcatctttgctcggtcggtcagccctttgcttgttggcttgccgcttgatgttagtacacacatgcactgtctgttgctgctgcttgctagctcagtcctcatctgtcgccccttgccgattgactcgggaaccagcaagagaatgcttgatgcagatgcctcccaactcccgtggggtcgcgtcgttgtcggccggcttggcacgccgaccgcatccatcggcggcgccgccgcctcccccgtccgcgctgctcctcccaccttcaacgccgccgctgcaggtgcagaagaagccaccaccggatgccgccatcttcgaggggatgccgacgcgagacacaggcggcccttacccgttcgtgggcgcggcgggagagcggaagaggtgggtgtgtcgtggctggcagagggggcgtggagcgcatcggtggatagtgcggtggcagggccgagggtggcgaggccgaggatggcgaggacgcagccgttctagtggcccgttttcttccttccgacggccaacctccacggcggtctcgatctctgccgccgccgctgctccggccctcgcccgcacgccgcagtcgccgctctagtgctactcccgggtctccgccgctcgcgggccgccgcaccgccaccgccggcaacgacgccacggggagggacggaggaggctgtggatgcggttggaggaggcaccggccaccgccgctttggcccccgtccgccgccggcgccgtcgaagatctagcccctgcttcggccctcgcccactgctgccgtcgctagcccccgtcccacgctcgctgagagaaagagagagggggaggatatgatttatgtgggccccacatgtcagtgggtcccacccatacttttggtgaatgacaaatgggtcccacacacattttgtatttctaatgccacctaagcgccacgtcaacaccatgtgggcagaatcccgagtcaatactgccacgtaggcgccacgtcagcgaaaccgccctccaaaaccgccgagggagtcaaattgcaccggttttaagagttgggagggtcgagatatccggttttgtggtttagggacggattagatctcgatcacttttgagggtcacaaagtgaacttattcctttccacgccgggattatccacgggattgggccccgatcccggccgttgccggcccaaccgaacaagcccttaagatgaaaggaataagtttactttgtgaccctcaaaactaatcgaaatttaatccgtgaccctaaaccaaaaaactggatatctcgacccccaaactcttaaaaccagtgcaatttgactccctcagcgattttggagggcggtttcgctgacgtggcgcctacgtggcgatattgaccgagtctttgatacatgtggcgttgacgtggcacttacgtggcattagaattaaaaactatacgtgggacccattagtcattcacacaaaacaaatttgggccccacatgtggatctgagtggtttttgtttcttgttgatggaacctgttcttggatttggggatctgagtgccttttgatgatggaaagcaaaagaaaagagaagaaaagaaaagaaaaaaaaatcttgcattgggttttgatctctcggtttattgaatccttcgtcgcaacccaagagaggaatccaagctgctgcattggcggcggcggcgaggaaatcgggagcaatggcggagaagacggcggccgacggcgagctgtactactgtgcccatactgcaacagcggtttcgtcgagaagatcgagtctgcccgcggcgccgccatcgccatcgccgccggtggcagcccggaatccggtggcggcggcgcgatctcctccatctgggcatgcatcatcgacggcatggttggcaacggcaacgaagatccatcaaccacgtacagccaacggtagaagatcgaaggatgtgctgcggatgggcgtggcggtggcggagaggcagctgtccgacaacgacctgcttgatgagctcctttcgacggcgaacgcagcgagctgcgacctggtggtcca

SEQ ID NO: 38546 - DNA, 4632 bp, Oryza sativa
ctgcagccccatatttttaaattctaatgacacgtaagtgccatgtcaacgccacgtgtaacgaagactcggtcaatatcgttatgtaggcgccacgtaagcgaaaccgctctccaaatcaccgagggagtcaaattgttccggttttaagagtttagagtcgaggtatccgattttgtggtttaggcttatggactaaatttcaatcaactttgagagtgaccaagtgaacttattcctagatgaaaacaccatatcatttgtcacggtcaccgagccggatcaaccggtggaccgaccggaccggcacggaaacagctactgtacctgaccaccgtcacgtgacaccacgcccggcctcaccaccctatccaattccccgtacatatccccagaattttttttatttataattttttttattaaaagttttacaaaaataattttccattttgaaaattgacggaaatagtcgcctaccgccctctgggagggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaaatttgcaggcggcccccttgccgccctccgcgagggcgattttgcactgtgcgggggcccgcctgcaaatgggcggcgagggggcatggaattttgcaggcggcccccttgccgccctgggggagggcgattttgtactgtgctctatattttttttatataaatatcaatagttatcaaatctttttatattgaaaactatacaagattaaaatctccaagattggtaaaatacaattttattattttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcatcgtagaactggctagtaggaccagtcctaccggcgtgagacgaagaggccccagtaccgaagatcccggctgcaaatcctgctggacaaggaccatcagtttcgtataggtatttaacagtattaataaaaagtaaagtaccgtgtgggcgagggatcgacgctccgtgagaggaagagctggcgaacgcgcctgaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctgtaggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaggtcgacctctgctcaacgtcagtcaagtgcaaacctctgttcaacctcacctggactgcggtgatatcggcactgatatcccgtgccgcatcagcctatgcaagatggaaataaaaaattcagtagttgtcctatattatgcaagataaatgacataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattgtatggctcgatgatgtaattatcataaaaatttagaaatgaacaatccgaactcacgagtggtcggcaggggggacggtcggctgcacgttgccgggaaacacctgcctaagtccgaactgtctcatcacacgctgcggccagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggacgtgagcgtaacgacgctgcaataaacatgatcggaattagacatgttatgtgaaggaaaaaaaaagaagaggactgataaacttataacgcagcgaagttgcactaaccccacgtcgacaccagtaagtccccatcgtgggaccgtcctctggccactgcgcgctgcgaccaaccccgtagggtgcgctgtccaccactggtcgccctatggcaaacctctcggctgcccaaagctgaagcaacataggacagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacagttaagaatgaaatgttagtacaaaacactgatccggtcgcaaataagcacgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacaccgtcgacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgctgggtcacggtcgtccgccgccgcctcaacaagcctacaaagtggtagaaggcctgccgcacgcaacctgtatagagcaaacttcaaacataagtataaaacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaataggttgatcagaaacatataaataattagttcaacataagtaataaatgttcataagcgaattactaacacatattaaacaagagtacaaacaaacaaaagtgtttagtccgaacactcatcacgataacattatgatacaacaccgaatagttcgcaatactactagtacaacaatagtcggaggtactcattacaacaagattgaattgaaattacacgatagaagtatttagtccgaacactcattacatcattttattttctaaatcgaaagcattgttacaccatggaa

SEQ ID NO: 38547 - DNA, 2491 bp, Oryza sativa
caatagcaaccaatggaagtacccgaactcctcgcattacccagttgtacacctatgccaaattggttggcattatgccataccgagatccatcggtgttgaacaatagagcccacttctccttagggtcattctccatccactgagagaaatttttgatggccgaccctgacctccttctcattgttggtgggtcatcatgtaatgcaccaagaggtatgggaggctcgtcaccttcaacttgtggttgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttctatcttcaaccgatgtaaatgtatgtaggtcatagtaagtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccatggacaatcttccttcatgcacctcacttcatacacataatttgttgacttgaccaccctaaactctctctgcaatgaaactgcccaatgcttcaccgcctccttcatctcatccttatgagcataccttgcaccctcaattacctcgtactccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctctttcgttttttttggatttttagtgaatataatgaaatttcataggggaggggctgggctttataggggggaggcaaaaatcgccctcccccagggcggcaagggggccgcctgcaaaattccatgccccctcgccgcccatttgcaggcggccccc

SEQ ID NO: 38548 - DNA, 24209 bp, Oryza sativa
  unsure (1)..(24209): unsure at all n locations
ccactctcgccacgccgacacgaacacgtgtacacgacgcgacgccggcggcggcggcagccatggagcccgcggcgatggaccgcatcgccggccgcctcgccgccgtagacggcctctactacccgaccaccttcctcctcgccgacccgccgccgtccgccccggaccgcaaggccgccctcctcgcgctcctctcccgcgacgccccgctcttcctcgagcgctacggcgggtcgctgtcccgcgacgagctcgccgccttcgacgcgctcgccggcgactacgaggtcggctggcacctccgccgcctccgcgcggcctccgaggggggcccctccgcgtcccgcgtccgcaaccgccgccgcgcctacctcgaccgcctggtgcgcgagggggagtacttctccgaggaggctatgcgggagcgggagccatacctgcaccacgagtaccttggcaggttccaggatcccacgggacgggccatggcgaggccgggggagcggtggtccgagacgctgatgcggcgggctgaggaggccgtgatcgttgagaagattcgaggggagcagattaggagaggggttgatcccagcgagtgggtaggtggtggcgctgaggaggccatggaggagcaggaagaggaggaagaagaagaagaggaggaggaggaggaggaggaagagagcgaggaggagcaaggcatggacatggaggagaaaggaagaggtgccgataattcttccgagaatccgagtgtgactgaggtttgtcttacatgttctgacttgattgtgcttgctttcttgctgttaaattgcttgcacttgcatggaattgggaggatttggtttgcggtgatgctggatatgtatggcttgcatataattggtagattttctgataactttgctgtgggaatcactcacttttaggaatacaacatatgattgttggtccttggaatactagttttgttctttatttttatttgcactcttcactgtctacatagttgaagtatttggtccttgaaatactactagtattgaagtatttggatgtagaaaaatagttgctttacaagtttaatggtttacgatacatcgaattgacaacatggagtagatgaaaattcatttaatttaagtcaggttagctgctttcacaatttgcttaccttgggggcatcttatataacaagaaccccttcttggttatgttgtcatgtgccaaagtataagggcatatggagctggagcctttagaaatctatatattcttaggttttttgtggtttgagtcttaatcttcaccatggaatgctagttacatacttacatactagttatatctttatgtagcagccatttttaggaactaggttaaccttttacttgaaaaagaactttcttccacttgtatgatctgactcccactgctgaatccttttatcctgaactctgctaatttcctatacgaagcctaatgttccttatgggacaaaagtgcattcaatcaattcttgtgtcataggtgcaactagatcttttgggggcattatagtgtttcgcagcacaaatatgcagttcagcagttgattttatatattatcatatttctggaaaatataaaatttctttggccagtactttatacctgttgatccaacttatgctgctgaactccttttgtcccaaactcctccatacatcgataattttctattttctcgtaccctcattgaagtctaggaccaactgaaggaacattgatactataatagttttcacctggtaattattgaggtacaaataagatagtaaaaggtacaatcttgtggtattatctctgaccattggaatgactgttaacttggacagctccagtgtttcacatttgcgttgaatgatctactgacttcaattagatccacgctgactgcatatttctttgtctagtatgagagattgacacaatctgttgcatatgtgaagctcagcttttattaagcttttctattgtttctggtttttacattctgggaaaagaacatttcttgttcaacctgagaacctcttattttctaacgacaataactccccaatttccattgcgagtactccttatgtcacatcatcgtaatcatatgttctcgccctgagtccttgctttcaatctgtaactgcaggtggttgactccaacaaaactgcaggggcttccaagcaaacattatctgctgaagatatggaggatcaacttgaacagtttaccagcttgatgcaacagaagttcctgtccggtgaagactctgagcatatggactactctcggatcgataacgacgagatgctggatgaccattggtcaaaagaagccaactatgatgcggaggagaagtatttcgaagaggattagttcaaagttcaaactaggctgctgttatagcatcagttatgtagtgcatcatcgcatctcgttttttttttgttcatgttcagcacttacttagtctatcatgtacatatatctatatatgcagttgttgcccctctaatccgaataagttgagtaacttgcttatgaaaactaccgtatgtgttggaacatcaatcagaaaatagggtcctgtcttgtggagatgtttacaaattgcaaaatatttttatgcactacctccaggatgatggtgcatgcagggaaagtaacatgtgtgtattctatatttctaggggattacttgttcagtctgaaactgtgaaccgcatgagggaagtttccttcaaagcgaagaatgtatatatgggaaggcttagttagaagcagcgtgatccaaccagggtttgctttggttggacgaattggtcttcagacacttcaacgcaagctttagtattttttttttctcttttggttttgtattaagcccctgcctcgtgtgctgttctgatgcacgctttctttgtaccaaaaaaaatggagacaaatgacttattcctgaagtttttgtgaaagcttttgccgtgtcttgcctgttccattgtttttcttttcttttgctgtgtttgtgctagtgtattgcctaccttcttctttttattaattttctttcttttgcattagtgccttgactaccttcctcttttctttcctttttcttttgttatcggttaccacagtgtcttgcctgtttggtgcaagccgagaggcaaaaccacctcggttaataaagtcttaagagaaagggactaccatggtcaccgtgtgtacgggccaaccggccaagaaaacataaaagtctatgagaaaggacgatgtacatatacccctattaatgtgtatagtagatttctttcagaacatttaatccgtttgcagatagtgcaatttttattgttttgatatcccccattagatgaatatcttaaaacacatattctataacaattgaagaaaaaaaaggaaatacatttcttttttcaggaatagatagatattcaagaacaaataaaaaaagaaatacatttttcaggaatagatagacatttatgtaccagagggataaccaaactattccctctaaaaaagttagtttttactctgtcatttttctttaaaaaaatagctttgctcatttttaccctgcttcaaagaaaaaaaaacaattatagcatgcttgtactgtgaggagcagaggccaacgccgtcggtttgctgaatcagcaaaagccgaccaccgaccccacgttccgcacgcacgaaacgaaagtacgaaacccgcgccaacacaacccaaccaatcgtttaccgccacgtgcacgccaccccccaaccaaaacaaaaaccaaatttaaaaaatactacaatataaatactagtataataatttcttctcccataaagcttcgaccgaatccggctcgcctcctattaatccctctctctcctctccttttttcgatttgagaaaaaaaaaatttgctcgccttctccttccctcgcggcgaagacaccggagccaccactcgccgcccgcctatttcacgccgccgcgccgcgcagaccgacctcgtcctccaccccacccatctccgacgccgcggaccccggcggccgctcctcctttgctccattcatcgccatgacgcgccacgccggcgcccgccgccggggcggcgccggcgtcgtcagcctcatcgtcgtcgtcgtcgccgtcctctccgccgctgcaatcgccgcggagggtgtcgatgctgcggtgttcgacgacgcgcacctcctgccgcgcccgctcgtcatcgagctgcctacgacgacctcgtcgtcgtcgccggccttggcggaggagggggagggggaggcggtgccggcggaggtgaggtgcgcgagctggaggctggcgggggaggcgaacaacctcgcgccgtggaagtccctgcccgaggagtgcgccgcctacgtgcgggagtatctcaccggcgtggcctaccgctccgacctcgaggtcgtcgcgcgggaggcctccgcgtacgcgcggaccgcccgcgtcggggacgacggccgcgacgcgtgggtgttcgacgtcgacgagacgctcctctccaacctcccctactacgccgaccacggatacgggtcagttttcttttggtcacccactcagctccacaaatcccaaattgcgaaatcgttgggcggcgtgtgttcgaattggtcaatttccatatgctgatatgagcgcttgattagttgattttgaattatagggaacaaaattgcgaaatcgttgggaatgtgttcgaattggtcaatttccatatgctgatatgagtgcttgattagttgattttgaattattgggactaaaattgcgaaatcgttgggcgcgtgtgttcgatttattcaattgagatgctgacatgattgcttgcttgatttgaaaatggcaggctcgaattgttcgaccaccgggaattcgacaagtgggtggagaggggggaggcgccggcgatcccctccagcttgaagctgtacaatgaggttcgcgaccttggattcaagaccttcttgctcacgggccgcagcgaggggcaccacggcgtcaccgtcgacaatctcaagaagcagggcttccatgattgggacaagctcatactaaggtaactattccatgatttagccatcaccattctctaacaaaaattgctcctttatacatttccagttcgtcatgagtcatgacatttctatcaaaatttgcaccttgcaattgcgctaggcatgatattttctaagaagatttgattgtgcattatattttgcgtttagccaggacatttgtgagaaaatcagaggcatacccctagtattatttcattatttgccattttcattgacctgtatgtaatttgcttcaaatatgtggatgttatcaggatgtctttataatagggataattatgtggatcaatcatccattagggcgcctaaatcgccgaattgaggatgaggcagagaacctacgcccattgccaaacaatatgctttgcttgctactgtaggctttttttctgacagatgcttaatatttcccccatcccaaaatataatggattttgaatggacgagactgtcatatccattcaaaatctcttgtattttgggacggagggagtatctatttgttcaatgcttttgtgctacccttttgtccaatgctcatataacattgttgcggccataatttagcatctgcaaagtttgcttttcacctcattctaaaccttcaccaatcagtcaattactacagcattattcgacattaaaccatgagccatcaccacattacgattggtagaagtagaactagggactgttgctgaatatcgtttgtcgaaactactatacatatgttccacatgttcaaggacattaaaatttactttgcaagctacatactgaacattttgaacaacacattctttttcacaatggccagggcgccagctgatcgcaagaagacggcgacgatatacaaatcggagaagaggaaggaaatggaagaggaggggtacaggatcctaggcaactccggcgatcaatggagcgacctgctgggtttctccacgagcgctcgctccttcaagcttcccaatccaatgtactatattccatgacggaacagaagagggaaagagagggcgggtgagaaatgcggcgtttatttgatgcattttctcacccagcccattcaaactgactggtggagaaaaagaaattcacaataattcttcaaaggaattccaaactgtacaaaatctcactgacttcatgtagaatacattaaacttgtaaagtcgaatgtaattggatgaaatgagagactatttattgagttggtagttcatgatatactatattcttctcttgggaaggcttacttgaagcgataactgtttttgtgacgctgaaacatttcactcgcaagctgaattttcgttggagtctctgcactgtccatcgcttaacttatcttatttgcaagttccatgtagaaggcgaagcacgcaatcgttcgtcataaacaaaagaaaatactaacaaaggagaaagaaatatgagatagattgtttgaaagcgcattgcaaaaacatagccaccccattgcagtaaccgggctaccggaccaatccaatgtgacacacttcgcattaccgagcaaccgagaatttactaagttaaaataataaagagtaacaacaagtcggtgtggaacaattctgcagtccagttcagtaaaaatctagagcaagtcagatacagtagaaagttggaaaagaatggtggtgtatggctgaatcactggaccatcggatcagggttcccagcagcaagtatgtcgagcaacgagttctggggctccatctcttcatgccagagtggtagtttgtcaccagggtgaaatttcctcgaaacaccatcggcatttatctgcaacatgatcatatgcataagtaatccaccaatcctttggaaacatgatgggtagaacgaagagaacaggacatgtctctaaacttaaatctgcattgccaaactgccaaaccatagttgtactgaccaaacatattcagcaaaagaaagctacggaaaatgcaaccaaaacagatggccaagaaagacatgaggttgtccactctacctcactctagcatattttagcacaagagtacagcatgtctgaatgaagcaaagaggtaataccacactgaaatattccgtccttggaagttaaaaggccgatagttttcgctttaagattctttggcacagcatgccaaatatagcacagaaatttatatgtttgtatgaattccactaaaacaatcagttcaggtctctgaagtctgatgtttcaaaatgtctccaataaaggaacaaacaaggacaatagggatgaaaaaagagagcacttacggtgactgtacgaacaacccctccactagcaccatcacgggctatagcaagggaaaccaccttcaccacaaacttctgtagagatgaaagagaagaatcaagttaagagatgaggtggaacaagcaaaaataattatacagggggcactgaagtgatggaaaatggtgtttgcactctatgatcctagacttaacgtgggaagaactgaacataacgtaggcacttcgttctacctaacgcatcgaagaaactatctcttattacacatggtttacaagtaaagcgtacctcagcttcttcctgggacatgccctccttccattcatggtcaagcagtccatacaggtaactggaaccagaacctgcaatactcagaaataacggctagcgtcagaaactgtgattgatataacatagggtaaagtagggactcggacaattttatgatcaatgttctacaactaagccaggttacacaggagtatggtaatcaaagagtatggcaggacattaaaggaagaaatggatcgcgctaatttcaaatgattgcttatgcattgcttaaaaaaaatactgctcaggtaagtttgcaaataaatctcattaataggcttatactattgaactgataattattcttatgtgatacatagatatatagacacaggtggagactacatttcttatttgattactatgagcccaatgaaaagacattcaccataatatttctgggggaaacatacctccaattgcaaatggttgcctcagaattgttccaccaagggggactgagaaaatttggccaccctcatatttatcccatccaccaacaatcatgccagcttgcaacatgttctgaaaattggtgaaaaaaccaatatggcaattagacaatagcttaaaatcaatgtatgaaagaatcagagaaagaattcatctcatgtattagtgaaattcttgtatcgtagaatgctacagaaaatataccttgttctgataagccaacaacctaattaagttggctgcaactttcacagtagctggttgcccaagctgaattctgcaaatcgagggaaaatttagcatgggctatcttgcacagcaaatattcacagtaactactagttcactgtgttaattaatgaaatctaagtttattattgttcattcagtgccatcctacttagcttaaaaggagagagcattaatagatatattataattacacaagaacaaacttacgtgtgttggtggagaaaatagcgtacatattccgaaatgacttgtgtgtcggcagcctgtgagacaatgagaaatataatactagtgaactattggaaatgctgtatctgataatacttacttacttagtactggactattaacaactatgaaaaagaagcagaaaagaaaatattgaaaatgtgactgtaactcagaaggtataatttcccgctacatcaggcaagccaagacaaggggaaaatgaacaagataagatgcaatggtaaaacaaaaataatcacatcttgcttaatgaagagagtatgttttttacagcatataataataacacgaagcaacaacataaagaagggggcccaagactctaaacaatgtaggcacttacagatccagagcggcagacgtacacattgtcagtcagttgagtaattttgtcagatgcacggttcgccacatacattcctaagaattaacaccacataacaaaggcaattaaattaaagggaaaaaatagacaagcagacagagcacaccaacttaatattgatttcgattggatcaaccacatgctccaatatttggctaagttaataaggcaacatggctaaaacaactaagcttactagtctatgtaagcaaaagatcctaggtacaccagaatcaccgtaaacaccaatgggatgatacttttctcattctttactgttgagtgttaaatgagaaataaatgaacagtgaactcaaccagaacaatagaggttgtacccaacttcccctaattctacatcaaccgaacacacgacaataccaatttttcatatatcaggtcacaccaatttttgtacttatccatccataatatgctgatttaggcagaacacattagtggtacacgaaccaatttccactgacagatacattatccgatccggcagcaaacgctaaacacgtcgcctaatctcacaaaatccatgacctaaacatgggaagcaggatggatggcaggaaccagatgcgctaataacaaaaatccaccgcaacctagcataaacaagggtcggatcgggggtgggggatcgggggagcgtaccggtgctggtccgggagtcggcggcgaggacgacgccgccgtcgtagcagacgccgacgatggtggtccccatccggtgctccccggaggtgggggcgtcgcccgcggcgggagagggggagcccatgagagaggcgtccatggcggcggggagatcggcggatgcggcggcggaaaacccctaagcggcgcggcggcgagagagctcaggtgttcgctggctttggccgccaccgcaagaaagaaaaaaagaggaggcgacgcgatgcgtccggtccgagtcggttcgggcgttggtgcggctcgaccgctctaggatgagtcgtactttgatctgttcattgacgtgggacccatgtattataacatccgtctcattttaaatgcaatcataacatctaattttaaatatagtcatgacttacttttaaaaaatatataaaacttttaaataagatggacaattaaatattaaacagcatttaaaatggaatggaggcagtagttattatttataaagtccaaaaataaagtattactgctgagaatctgtttcataacaaggaactgatcggactttggagtgtactaacaatctgctgtaatcttttcatttgtgcgattatatggaaggcacatatgcttgtaacagaggtacaccacacgcacacacatacacgagaacatgtccttaacccttatcatatggttaaaacaacggaagctagcaataaatactctattcgttttaaaatatagtaatactattatattagacaccacataatactacgaagtctgttaagatctataatacaattaaaaaaagtactagctctaataactcgtatattgtccttaaaagggaatacaagaaaatatgcattgactagggatggtaatgggtcaggagggttcattggtcctttcactacccacctcagtcttaaaaaaaaaattagcacgaaaaactactaaattcaaaatttcagtccaatcatttcaaggctcagccctcatattttgtagactaaaaacttgaacccattacaaccccgtgacatgccattgaatctctaatgttgatgatagcaaatggtcactctcccaagacaatcaagtgagataaaaaaaaaaagacaaacacttccacgctgtaaacaagtagaatattcgtgtacaggcccacttcactaatctaaaagaattaaagaagtacacttcactggaagtctggaacatcagaacccaacaaacatcggcacacattagtcatttagtatctctcttgtttgtgtgttgctgccattgtctatcacacaccacctagcaattgtttcaatacaaactaaacgcaacaccaaaatgaagaagaattcatgaagaaagtggacataaaagaagactcatacagacagactctacataagctgatgcacattcttgtccagtcattaagacgaatttagaatgatgtgcaaacgccattgcatatttgatttttttttttaagccagcagtttcaagggcaaactttcacaataccgaactttttcccactgttttcttattcaccttcttctccagtaggatcatccagtgaataactttctcacatgtggagtcgacgaactggaaatacctcttgcccactgccttgctgcacacaagaagccaccacacagaagaaaatcctactccgaagcccaatcctgaaaatatatacagccagatatcatggacatcattatgctctgcttgatcaacatggttatctttctgttcaaaacagctgccagaagcaagatggatgcagagatacttgttgccagcatagatgtatggatcttcatcaccaagggtttgaagctgagagccctggggtaccatcccggacagattgttgtaggacatgttcaggtggctcaacaagtgcagtgatgtcatgctttcaggaattatgcctgacagtcggttccatgagagatcaagcgactccaatgaactcatattaccaattgtctctggaatatgaccactcaggagatttttcgagagattcaggtttttgagccctacaagatctccaacttcagcaggaattccacctgttagataattgttagaaaggtcaatgctcttcatcagataaaggatcttagaatacaatctttcttctcctttgatggtaatgtatagactctcattgtgatagagagatccaccaaaactatcaccagaaatctgcatcggtataatatgtcttgacctctgtgaagccatttcactaaaatttccaataccttgtggcaggggccctgacagcttgttattggcaagatccaacacttgaagaccttgaagctgtgacaattcagacgggatgcttccagtgaaacgatttgatcgcaaacgaagaatcatgaggtattgcatgttatctcctatccattcaggtatggaaccctccaaattattatctccaatatcaaggaaaaccagaagcccgcatgaacttagagaggaaggcaacaacccagatagcctattgttgttcaaatgcagggaaccaagaaaagtaagagagccaagacttgaaggtatgtgtccttccaggttgttgtacgagaaatccaccaaaaatagttctgtgctgttcttccaacaattaggtagctcgcctgataagctgttgtttgataggtctattgctgacaaccatggcatgttgcaaaagtacgcaggtatgcttctatttagacgattgcttgacaataaaatgtaacgtgtcttgttccctcccacactattgggcaatgatccagataaagagttgttggagagatctagcaggtctagactttctggcatatcaggaatctgaccttccaattggttcgagctgagccccaagaactgcagtgacttcatatgaaccagggatgctggtagcatgccagtaagcagattgtcagagagatccaagttaatgagagaggtcaatgacgtccaaagccaatcaggcaattgacctagagtccccgttctgtgcaaatctaatgtctgcattccaacttgtgtttgaagccactgcgggacttgtgattgtagtggggaagaacctaaaaggagttcataaagttgaaagggtggtaaccaatttgctcccacagaaattctcaaggaattgtaagataaatctagcttttttagcttagttagatttgttaggtgttgttcagacaagacatcttcgagtgaattgtgagaaaggtccagttcaattaactctgtgagctgactgatattggtatgtacatgacctgatagtgagtttttgctgagatcgactgagaagaggtttgggaaggatccaatccacccggatagacttccagatagattattattccccaatttgatcatagatagtcccttcatgcagcgggtcattgccttccccaaatcagcaatatcacctataaggttgttgttcgacaaatcaaggatctgcaagttacacaacttagatattggaattgctccaatcaaactgttgtcagccaagtaaagggtattaagggcagttaaatttcccacagattcaggaattgagccatgcagctcacaatagtccaaattaattaatgacagagtgtatatgcttgccaaccaattcgggaatctagagctgaagttgttgcctgatagatcaatttcattgagaactgtgaagttagactgggatagagaattttgattagtgggtggaagattggtaccagacaaacgaagcactttgagggaagcaagcatgttcaaagactgcagccaatctgaagccacagaaaggttccacaatgacatgtcaaggtaaaccagtgaagaaagctgagagacccaaagaagattgtcaacagagctactggaagtaaagctgctaaagttgttataaggaaagctaatatccaggtaattcagcttagataagtttccaagctgagggggaattttcccaccgaaattagcaaaggacaagtcaagatgcctcaggttcttcagagatcctatgaacgcagggattcttgcacctccaaaatcattcgaacgaagattgaggtacatcaaatgagttaaatgaaccaatgatggactgatgtcacctgttagagcatcctccttgctgatattatagtttgcgaggttgagcttgataatatgtccagtcctgttgttgcaagtcacgccataccagttgcaacaatttagacctacccaagaggacagcatgcctccagggtctctcagggtggccttcaagtcgaatagtgcatctctttcctttccaatgcatgctgctgctgctgtgattttggaggccaccagcaacaggggcaacaaagaaatcagtgcaaggcgcatgatgatcacggtgttggtaagtggtaaccttgaagctaatggggatttatatgagaaacacagactatatgagccacctggctcgcatcagcaccctgcaggataagatgatcaacaaatgccagctttcattattatgaaaactactcttagtattgactcaaatttaacctggagttgcatttaatagagacatagttttatcaagataatgttcttgcaacaagaccaaagaccagagcaattaatctacatttatacacggccatatctcttatctcagataaaaaaaatgttataaacttataatgatcttctggcttgatttgactacaccctaatgaccccgctaaattaacaaatcaaccaatagcgaaggtttatttggtcaatggtcatctctcatgagtcaatacgagaaattagttatcactcatcactggggaataaaagcaggaagtaacttaaacatttgccgcatctgtgcaacgatttgcattagcaatggagcagaaaatagtggagaggttaccaagtaggaggtgctcgccaccgctgtttgcatcggagacggcgaggaggtggtaggagggttgggctggtccgccgcggagcacttgcccgaggggctagcgccgccgcgcgcccgacggccgcctccgcgaggccgccactgccgccgcccatgggagccgggtgatggggccatgggttggctcccagcgtcaaatgcgggggtggaatggtgtgcgggatgcgcgtattcgagctgggaggagtatctcgaatcccggtggcctctcgcggcgggggatcgccggccggccgccgccgtgttgagagcttgaggaggaggcggcggcgggaggactaagacaaaaataatagttccaattttcccaaaataataaggaaggccagggtctaatatgaaaatatcccactgaatcgatgaattttcagcataaattgagccaattttcatgtcaattttgagccggaccaattgaaagagtactacatttcaagtgattctgttatcatttgagacacagcaattcagctaggcatttgcaaaacagaattaagggcaaagtttcgcatgaatgtcgcaatattccacgtgttttgctgaagtatctcaggttgcaagcaaagtttctgtttgagaagaaacttcagcaatttcagttgaaaacaccttagtcacacattatcctgcaaccgcacaaaaaacactaaaaatgcaatgctccatttttcatcaagaaaagtaaaacccattgagctacgagggtttacaaatttcagatactttgtagctataaagtttgcaaaaagagaagttgaaaagccttctggaatcagtaatctctgccttgttcgcttaatcctggttttgttccatttcatttttactccgtttcctgatttgtagatgatctttggttcatcaacgagaaacatactcggataagctgtattattgaacaagcagagataaaaccaaagacagataaaacgcctgaacggtaagacaatacttctccagaccatacaattgcatgacgagcccatacgaagggtttggaaacgtcagaaaaaccattcagctaaggcagaaaagcaacatacataacaacatgacaatcgatacaaccaagtatctgcaaacagaatatgtacaatgttgttatagccatcatctctcatattctgccaaacatttcacacacttcaagtacgtttctctgcataggaaacagtaggaattcccagttgaatttgtctcagttcgatatcaaaaagagcacgacgagtgctagtccttaaacccaaaatcatcaaacaggccctgaaagtggaagagacaactaatggtcattttgtgtacacttggaatcatggacagagcgtaacgaaggtattctgtagagaacgtttggtcgctgatataatagcatgctaaccttggcatcatttattccataagccacacaatagtgttcctgagaaaagagacaatgtaatgaagaagtggagttgatacacaagctgctagttttgtacgggatccctcaccaataagtggaaattctcatgaacttacctgcatcatatgccactcttcgaactcatcaaacaattccaatcgttcaatcctgcaaccatgcaatttcatgggtgttacaaaaaaaaaatagatgttatgtgaggcaagatttaacataatgtccttcgtgaagatcaaatgtaaaactcagaaactcagcatcatacatcagaaatattacctgcgtctttcttcactgtcaatgaaatcattgtatatttttagcatatcccatgcaacagctctctgcaaaaccaatcagtaaatccctagaaacaaatcatattcaaactgtgtcttgagtcttgaccaaatatacctgccatccgtgatcaagaaaaagattttccttgtgacttagggttggtgtagcatttataccaaggagagggcatcctctactctgcattagcaggacaacaaaaggcattgagctatagaataatgctatgaataaagtaataagcacctcaatatatctgtccatgagaaacaaaaagacaggtaccaaccaaaaacaagcaaaacatcacctagcttaaatcatacagtaagatgccctccataaactaagatccacaaacagaagttatttacacaaatgactacaaatatttcatctcaaacttcaacttgtcatgtttgtaatttcaggctgccttcattatgtgcataataagctaataacttcttatactgcctccttcaattgtcatgcagcaataattagcagttcattgtttaatataggtccaacagctcttgtataaggatagtttatgagaatcaaaggccacaaccgaattgttcaatcaggaaacctgcaatatgcccgactctttggaactaagtaggcctctttgactccgctcagagatatttacccgactctttggaactaaatatgcccgactctttggaattttaagatatatatgttccttcttttaacaaaggtactataaaggtactatgattggaagcacaaaaaataaggaggtctattttttaggtattgtatagttggttgtactttcttgttggcatacaaaaaggtctgcagttgattaaatttacttctcgaacaaatccatgtggcaatcatgcaattctcctataaacattccattacacctcaggggcaaatggctcatgcaccacaagggaataaaggattacaggttacaaaggttcatggacaatctacaagaatgaacaaaggtacctcaaggtttataatcatttgctctccaaatgcatcatctggatggatctgcatcagagtagaagtcaatagtgcaaaaatatatcacatatgagagtggaagagtacaaatgagagaatgatttcacctgctcatataagaaaaatatggcagtggagaacttatcagatgcccaaataacaatagaactggttgaagctgggtctaagtaaattagcacacactctgcaattataaaggtcggcaagctgatgacaacagaaagatttattaagaacttgaaaatttgatcatgattcaagtgttagagacaaaggctacgcgatgcaggtatctgacttgacaatgttcctataggcaagaggtgtacagcataagttcattggctgattaaatgagctaactcctaaaaggggcacttgaataattaatcaaacttctctaaaaataggacaagctatgacatatgaaatagaacaaaacatgaacatttatgttctgacaagtaaattatacatggcataacaggaaaatttagttataaaatataacataagcgaaaaacgtagagggcataaattatgaagctaactgaacttgcactcattgtaaaccataaagatataccacaacaacaaagaacaaaaaaaaaaaaaaaacttacgtagggtccatttcagccatctgaataactgaatcaagttttggtatgtcacgaatatcagcagaaaagagcttgtaatgcgcacttctcacttcacctttttctgaaatatttggccattatcaattaatatcagaacacggaaaatagaaaatagcaaattctgtgatatggaaagttcacttcaactcacaattctggccagggtataaatcattttggtcactaagaccattatgctgtcaattaagttataccaagagaaacattcttacaaacagaatgaaatagctacctccaagagaaaatataacaggaactttatacaaaaaaggtactgaataaatcaacataaacgtggagaatggcctctagatggattcaggcaaacaaaaaacaaataaattagcctctagatgtggagaatggcctctagatggttgaagctgggtctaagtaaattagcacacattccttaattgtcattagacacttatttctgctaaagatgcatataagaaaaaggcaccaagtattacggtagatacatatagaaagaacatggtagaaccattagtggggaagatccttagatataaacagggtaggcattaatcgacagtatcatatgcaaatgagagaactaccaattgatatcgaagcttctggtcctaacttttccttcatttgactatagtggttaatgatggcagcctttttgctggttacctgccaatcatcaaaagttgccagaaaagttacttatgcacaaagagaacaagctgctccgctgccattacatgcatcacattatgcagagtactatgctacacttgaaaatagcaaagaaactttatctacctccttgaatccaactcaacataaaggtatggagcaatgccttcgtcctacagtaacaaatacagcacagactgagagagatgaattgatattaaaaatataccaatatactttgtgaagtttgatcttaaacactgcctccaccaaagcaggatatgattaagatgcaaggcgtactggaacctatttaactagtttatagtaacaaagggcatacagagttaaataaaaatgatataaattattcagatcaaacagtagatctgataatgggccgtaagcatgtgattgtgatgctcatgaatagtgagtaatggataacctgcaactggaagaatgtcgtgtcaaagccagcaccaagagataatatttgtttccggttttgatcattactgccatttccagcaccgaggaactgatgcagaagcttcctaagaacagaccaacgtgcatagtaccctttgcagagttatttggaaaggtaaacaaattagaattttcaaacattttcaattttagagaagcagataaagattcaatgaggcactaccaacctcgatttattattggagccctttttgttgttcgtctgacaaagaagtgcacataatcatccttcatgtatcctttattaacacatgacctgcaaaggaaaaatgaaaatgagtatggcatatagcaagcagcaacagtcaacctctactttgaaaactacaatgacatctatatgtataagcaatacaccacactttccatgcatattgaataacatggaccgtgttacatttatctgttcattgttcaagatagcggcctctgcaatgtcataggcagaagaggtgaaggtagatcatttgctctgcataccaaggtcagtaggccagataagcactggaagttgagatgcccaatcaatttcttcaaaccagtacttaaagcatcaattcactccaaacaaataagcaagaaaatatcaagaaatttcttctgaaacacacaagaatatataaagttgcaagctagctgatccactcaacagaaggacttcattcaaggcaattggtaaaagaggcacatagctcttttcctaccattacacactgatttattgcagagagaaataaaaatagaatcagttcaaaggagtggttatacgacattgcatggtcctacgcagaaaagggtcacctaagtggagcgcgattctggatcttcacataaaaactgtataaaccatccctcttgcttagtacaataattgcattttagcatcacgattcagcatggctttggcttcattttgtcacggtattccattttgtcagggtattcactagcgcaacaaacagtagcagcatagcgcgaccgcggattgatccaaacaagcacaggggcgaccgcttcccgatggcgcctcgtgcaaaggagagaatatcacgcggagcacacgagacctggtggtcatgcggatgcgactacgcgaggggaaggagagctggagaggtagagggggggagtcggggttggtcactcacagcttgctggccgcggcgtcgtcgttggtggcctgcacggacgccgggctgctccgcgccgcgacgctaccgcctccccctcctcctcctcccgccgccgccgccgccgccgccgcatccattccggccggtcgatcgctgggtcacggcgtgaaggggagaggaagacgagagacgtgatggaaacgaagggactaatgggcctcgaggaataaagctcgagaactcgacccgatttagatgggccgcacgtagctggcattcacggcccggcccaacacatgggtcgcacgtgggcagctgtcccgttcggattgggctgcaggataacgggccgttggagtagcggggtccgttttctgttgggccttacaaaagaaaggcctgaataagcacacggcttaacctacctcgacccgagtacacgttcttttctacgggtgaaaacagtacgaaaatttccgagatttccaactgccgttttcagtttgcaccaaccgtttcagtcggtatcaataattattggtgtcaaaaataaaaacggcaatatcttttggaaatggtagtggaaatgagaaggaggtttttccgactgtttcgtcgataaccgtatttgtccggaaatttccgtcaaatttccgaaaaaattttaaatgttccccagtggcccagccagcccaacccattggaagcctggctagcttgcggcccattaggaacgggaagtagctagggaaaaacgttgttaaccctaaggcatggcatgtgaactttgttgaactttggtctacttaatttatcaatgttgaagtattgttaaactttgtttaaattgttcgttgaacttattatcgtatcattaatcatcatataacagtgttatatgaagtgtgatgatgcaaaaatgttataaagtcatcttcatgcatagttatgtcacactccgttgttttcgacttccgacttccaacggtgccatttttgatataccaatattaccgatatcgttaccgttttcgggtctaccattccgattccgttttcaagaaaaaaatatggaaataaaaatggtagagggtttttctgaccgttttcatccgtattcgtttccgacgcatatacttcgtttttttttctaaaaactttcatccgaaaaatttctaactaaaaactttcatcgaagaagctaatcttctaagtttttgaaaccatggtaaatctcgcggttactgcgataaccgccttaccgtggggtggtggtaacaccattcaaaacggtttggtgaaccctggtgatgacacaattttattactactacataggaagaaaatgacgggagtgatggcgctaccgagaagaaaattacgtagacgggaagtccttcaaacaaggacttctagttatgcacctggataacggagataatactcgcaaaagaaaaaaaaacagaaaaaaaaaaactctggatgcactatattaaaacatggcaaagatacactgacgtagtgatgcatgcatcttgtatacaacaaggaactacattggttgtatctgaaccagaacccagctgtccagaattaccagatgtccagatgtccagaattacctaaacttggatctcctatctgaaccagcagtctacagacctactccctccgtcaaagacaaaccctggaattgcgtgtctaactttgactgtccgtcttatatgaaacttttttataattcgtatttttattgttgttagatgataaaacatgattaatactttgtgcgtaacttgtctttttaatttttttcataatttgtttaaataagacggacggtcaaacattgggtacggaaaccagggtttatctttttttgggacggagggagtaccatacaagttatacaagaacataaactagttaccttccgtagtatatccaaattccaattcgtagcaggtgattgagttctggctgccaagacgataaatttccatggattggcgtcttcctgctttgatcctgttgagttttatctgaactatagcacggaactcatccaatgtcttgtcagtgaactggaagtaggcatttcttgcagttctgctgaatatgaggatggcagaaacgacagataatccatatgcaaaccctagcagagtgcataagtatgtccccctgtcaatcatattctgatgttttctagtagtagtatgttgcgagcatattcttgatagcgaggcaccacaatttccacaaagatctgcattgcctagatatggttcatctgtgaaagttgaaaactgagagctacatggtatcactcctgacagatcattgtaggacaaattcagaaccgatagattaatcaaatctgtgatgctcggaggaattgatcctgacaaatcattcgacgagagatcaagtgcctctaaatgactgaggttcccaatttcgtcaggaatactcccaagtatgtgatttcctgatagattcaaggcaagcaaaaaagatattgctcctatttctctggggatttctcctgtaaattgatttcttgatagatcaataaagtttagcgggtaatcgtacgttgagctgtaactctcaagtttatcagtgtatacgtgtatggccaaatatgtacgtccatcagtataaactgtagcaaatttggcggaaggaatcatgacagcatatccatgatcaacgcacatggatgttaaatttcctagaaattgtggtacaggaccagataatttgttagaagcaagatctaaattttgcagggcatgaagttggggcagtgactcaggtatttcaccagaaaattgatttgagcgtaaagatagagtaatcagagagcccagactatcacccagccatgatggtaagcttcctgataaactattagatccgagatcgagaatgatcaatccattacatgactgcaatgaggagggtaatgtgccagataaactgttctctctaagagataatattgcaagggaggttatgaaacccatggttgaaggtatttctccatgaagattattattcgaaaagtcaatggtatgcagtcttgaggaattcttccaacaatctggtagaacacctgaaaataagttgtttgagaggtcaactaattccatcgaatccatctcgcaaagatatgctgggatagttccattcagttgattatctgagagcttgatgtaataagcgtacttggctcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 38549 - DNA, 1103 bp, Oryza sativa
ccgccgcttgaccagagagtgacagagggaggtgggagaggaagcttatgaggagtagtttctttaccacgggggggagcttgggcttggcggcggcggcgctcctggtcccgctggcgctggatggacatgaggcgcatcagatccagcatccccatggtggtgaggggatctctctccgccggcctttcgtcgtcgccggtcggcacttctcaacgtcacacacaaaattggggaacgagagttataatttgtaggcaagatagatatagatatcagagttataattttaggaaggagcccaagcagtaggcagtagcagagttctgtttcaattaggatgaggtctccctacgacaacggggaaggaacggaacgtgtggaaaactaaaaatatatttatccacggactccctacttccaaaaaaaaaccaacttctagttataaatttagacatagtgtatgtctagagtcatagcaataagttgattttttttatgaaacggagggagtatgtgtcatcctagtgtaatttacactctaacttttatatatattaactacaatacaaggggtgagagatagggaagaagggagtagtaaagctgacatgtggggttcacgtcggccacactattttaatttttttttgaaagaaacacagcaagggtggcggacggagcatagcggtgcgggcgagctcatggagcagatgggcggtaggtagagccgaccaccagagcgtcgccctcgcgacagccacggactctccgctgtcgtccttggtgaggagctccattgtcggcggttcgtcgacgacggtggaggggcagagatggcggggttggagcggaggaggaggtcgttctcgacatcgatgccgccatctccactcgcccctacgacgatgctgaccaccacgccgtcagtctccttcaagaagacacccgccaccccggctccggtcaccgcgccacccaccaagtcaccaaggcacccatgccggtacccaaggccaaggccacctcattgccgccctcgtctcccccaagtcgaggctttcgtcgccgagtccccacatccccaccacggcgcacgccga

SEQ ID NO: 38550 - DNA, 8453 bp, Oryza sativa
atgtcctcgcacatagagagcagcacgatggcgaggtgaagcgacacgggcatcgacgtgaatgagtcagcaagcgcggggtgcgcctccaccagcgtgtaccaacgccacatgcagatgagagaagggagaagataatggcaaaattgttgttttacatggtttttcttctgtcaattaggtgggtgacatgtggatcccacgatatttttttgtgtgtgaatgacatatgggtgtcacattttttttattctaatgccatgccacgtaagcgccacataggacaaagactcggtaaagaccgccacgtaggcgtcacgttagccaaaaccaccgagggatattgtttgcatgggttgtgatagctggagaagtcgatttacccggttttgtgggtggaggacaggaatcatactgggcgatagttgggggagccgaagtataatttttccctattgtttgtgcgtgtatatttttcatctgggctgcctttgggtgaaatgcgtggcccatttgagagtccacacccacctgggctggcgcctgagccagctaagcgtgaccaaaaagaaagaaagtggcggggtttttcaattttggtttattagtggtgaaaaaaggggtgtgtttgttcagtggaatcctagccgcccaaaggagttggaagcatcttggccgtccaagagcgatccgtgtcgaccgatttggaccaatcagagcgctggatcaaatttggcacggattgagatggtttggttttcccgctcagcgctttgaaaaatttgggggataaatatctgaggaggggatggggcccagacgtcagccagggccagccccctcgtcttccccttcctctctccactcctccaccaccaccggccgcctcgccctccccgccggccatggcgctcgtcctgcccgacatcaccgtcgccacgatcgaggatctccacgtcctcgccatgctcgatgagccgcgcttcatcgacctcgtctccattcccgccgtccgccgcgcagccgagttcgaggtcgccatcacgccgaaggtggactacgatgggtgggtctgcaacaagctcgaggatctccggcgcgtcaggcgcttcgacgacctcctcaccgacctccagaagaggatcctccccatgctcggcaacaaccccgacgacaaggcggccctccgcaatctccgtacatgcgggtacgcaatgtggagcgttcgtcaacatgctcacccctccctccacaacctcgtcgggttctactccaacacggtgacccggaaggctcgccaagctctggatccgtacaaggcctacacgatcaagcaggagtggctgcacgccatggcgcttcgggtggagggatcccggtctgctttcatgccgttcgacagcgactacgtgccaccatctccgcccatgccaccatcgtcgtcagctcgctcgtcgatgtccacggcgtgcgcttcgccatcgacccgcaccgcgtcgagctcggcgccgtcgacgccgtccgcctcgccccggagtacctccacatcctcctcgagaaggtggagcaggagggatggatctgcccgacgctccccgctctgcgccacgtcgctcgcttcgccaacctcctcaccgatctccaggatcgcgtcctccccgggctcctcaacgaccacaccgacccagccgtcctacgcaagctccgcacctgcgggtgtgggatgaagaagctgcgtgccgtcgccaagggtcctctcctccgcttgacgcgcctcttcagcaactgcctcacccgccacgctcgtgacgcgctcgacgcccggaaggacttccgcatctctgccgattggatcgataagattgcagttcgcgtcgacaggtgtctcactataccacttcatcttcaccaccacctggaggacccgttcgttgatcatctccatgatctcccctgagttgagtgccaccctgatgtcgagttgtacagacctcgctaagtcccactaagatgtcgttttagtcgtacaaggatgaacctcccctgcgtcccgtcctagtcctaagatgtctttgagtcttacaaggatgaacctcccctgcgtcctaagatgtctttgagtcgtacagggatgacagtctgatgtctttcagtcgtatatacagatctcctatgagtcatttgatatataaaatttccattaataatctactttaggacattgctcatttctgtgatcaatgcatgcattttagaagcatgattagatttttcagcatcttgtggtgtttattcgattaccgttactttcgtttacacaacgatcccactgacggtgaggaacctgagtacgaggttgagccaggagtagaggttaagcatggcaagtgccctcctgtagctagctgcattatctatcggagtatctgtatcgtgtagtaactagctgaatgcccatgcgttgcatcgggattttaagaaactagctgtgccccccgcgcgatgcgccgacatcatccaagataatcttaatcataaaagaaaaatcataataataaaaaataagcatgattgaaaacaacatagcacataacagagctacacaataataataataataactcgatcagaaagagaatatcacgatgttctcaattttgagtgatttaattggaccataatattttttatataatcaatgttacacgaacaacgggtatctcggtgcataatacaattacatcaacaaaaataaaataaacaacattagtatttcaatacctagcagagtagcagttcccaggaagaccaatcagtgggcgatgattaatttggaaggatagtcaaacaaaactatgtccacagcacatcacagttgtgccccctgcgcattgcgcgggcatatgaggcaacctataataactcaagatcagaattgggcatatcacaagataacatgcaacactgttccacagtaatagcgcaatatcaaaaagggcatataatctaacaatgttctcagttttgaagtgatgtaatcaaaccaaaagtttttttaagagcaatcttacactaacaaacatggatctcggtacatagtagacaacattcttaattcgataccagcagatcctaggaaaaacgaatccttgggcgatgattaatttggaaggacaacggacatcacatcatagatatggcagtggcaactcatattgtatatgttttacaatctatacaaattggccattagcaataacaaatagaaattaaggtttactgctccatgacccagaaccagtgattttatagccaattctggagatatgagagttcagtattctcgccagcttgtcattaattagcatcgatctattttagccaccaataagaaaaggaaaatacatccacattttaaccttgatgaagagcatgcatatcccacactgtacaaacaacaaagcataatttcaacagaataaaacagtttctaatttcctaaagcatgctgagtaatatagcatcagtatataatagcatgagaaagttgaaattacccggactggcggtcacaaaagcatcagtggaagcctgtaggaagccataaacccatgagctatataaaatacgcaacaaaccactaaaatgccatcacaatattcagttatcgtgttagctaaggtccaatgtttgcctcatattgtggtctctgccatgcgcccatgcctgaaaacgaaaatggatgaaagtggtcactgagatgctgccaaatataaatattgacccatgcaaaaatatatgctacagtttagccgaataccggtttatatgataaaaaatagagtagggaaggtcgtttatcaaaacaactaattaaataatgatcatgcatagggatataacaattggacaacaaataagacttcccaaggaactacccaaaaaactgaaataataccaggcaataacaggtagagaaaccctaaagagcaattgccaagtagctggaagccttgaacttgaaatatgaaaaacatagaaattagcaaacgaagccactcaaagaagcaagtacactattagaaaataaaaaaagataaatgaaacgaaatatgcccatgtgttgttgtggatgattgaaaaatcgtatagatatatttgagataggatgatggcacataaatatgtagctaggtatttaaacaaaaggagagggaaactgtgttgcatatatctgttttagtagtaactgagctactcatcatatagtattgggatcacatgtaccaaaacaaaataaagttacatacctgaggcaaggaaaatagaatatgcatttaagcgtatggcaggatgatatgaaaaatagcttttaagcaatactacactacaacaggaagcaagtggatttgacaaactttggtagagataggacagtactcttcatcaactttacattgaaatcatccatgcatttcttgggcatagaacaatggccatgtaaattatcaatggtagagtaaaggatggtgaaataaattaattggacaacataatgataaaaggggatcagggagctgacgaaccactgtcctggattaaaatgaagatatgcaaggaaaataaataaaatattcattagatattgatgccagacattaatattgttttggcaatgagaagtggccaaacggcaacaatcggaggacttctttttattgaaaaatcgtatgacttctggctggatgggcctagcccaaacctgaatcaagattagggcctaatccagatagaaaataatggggagatcatacctcactgtcccaaggaaggtgacggcagcacaatggctagaagaacacttgctccactccatagcttgtacccaaaccctaactgactcacaagatatgtcatccaaattgacgctgcaaaggatagaagcaaggatgctgaagatggagaagcagattgagttagggcttggcttgctctgctctactccatacccataccctaactacagatagattcatcacaaaataagtcatccaaattgatcactgcaaaggataaaagcaaggttgctgaagataagaagcagatcaggctagggcttggcttaccagactgcacatgttgtcaacaccgtgcaaagaggtggacgaaggcaactatggcagcgggcgtgcacccttcgtccaccttgagaaattggccggtcgagcaagcgaatcaagcggaacggtggcggcgcttgcaggtggctcgcaagaaggcgacgaccccggccgctagctccgcaagaaggtggcggcggcgggcttcgcgactcgcgaggggaagatgaagatttgagtattttgggaagggaggcgcagaggatgtcgaggatcgaggggattggggaagctatgccgggcgcagcgatgtgcatgtgaggcgtggacggttggatcaaatcaacgcgtggacatcggaaggtgcatgctgggtgatgaactgtagtactgtagcatcttttcctgggctgaggttgatcaaatcactgctagtagtgggttgtaaaaactaaggatttaatatgataacccatcaaacatggtaaaacccaaaaaaaaatattttcactgtaattatcagattatatctagcataattttagacatgtatgtcaaactacataattgttcgtagggatgaacaatatattggacatgaattatctatatttctaaactattgtatatgatatgctagtcctcgggaagaaaaagtatttttaatatttggttgagaatttccctttacttatttcagtctataagaaagttttctacgacacccatatattcacatggagtgatggaggccatcatccatttgtctccagaagcagatcgacagaataaacaccagaaaaaccaacctactattgcacaaggcatagaagcccatgaacagcccagcagcccatcgacattcctaaccctgactgctaactgcctaactccaaccccggtccactcattgccccacgcggccacgcccgcactcgttccccattcacatcgcacacacgccacgccgctttggatccggctccgtggccagcacccgcatcgccgcggcgcgcgccaacggtggcgccgacctggccgtcttcgagcagttcgagcggctggtgcgcccacccttctctatcccccctctcgtcgacggatcccgccgcctgtccgcgacgggttcgagcagcgggcgaagcaagagcagcggcggcggtgagctcgggcgtcagcggcatgcaaccgtgaaggtccgccggcgtcggcgatgggaagggcggaaccggcaccccctccctgcaggctgctcgtatttcgccacctctccgccccacacgcacgcggccggatcctttccccctctcaccgacaatgtgggcccacaagtcagcatggcagttgtgggaacggacaccacggttgctgtctttttaagatggtatagataataatataagtacgccctggcctgcagatcgaaccgttaatttaatttacagctgcttctgtagagtagtggtgtgctcatccctcttgcttaggcattaaccacgcctgaatatacatacgcgcatgtactcctatcttgtacaaatactaattactgcatgtaaaagatgtaacactactgcagtgataatgttcagaaatcactagtggcactgctattgttattcctgttcagtgtattgattgttctttaacagatttttttttcgaaatatataatcaaaatactgcaatggccaaatgatcggagataaaattgggtaatgtataatctttgcaacaagagcactgtgtaccacatttagagcaggtacaatagcaggttataagctagctataaacatattttaaacagataaaggaagagagagagaagagcaacgggctacagatctatagccagctgcagcacggactccaaaacgtaatgtgtgtatgataggtgggaccagatattaatagtatagtaagcaactattgtatgaattggctattacattgactatagatgatttgaagctagtagtgggctatactattaaacttgctcttatagtgttccttagagcaggtacaatagcaaacatattttaaggagataaataaggagagagaagagcagcgggctacagatttgtagccagctgtagcacggactccaagacgcagtgtgtgtatgacaggtgggactaagtattaatagtgtagtatgtaactattgtatggataagctattagattggctatagataaattagagctagtagttggctatactattaaacttgctcttattatgatctaaagagcattgtgtaccacatttatagtcattgttcacttgtttcaaataattctccaatacggaccggtctcaaactgaacactcgagatgaaaattagtctgcacttgctgacagttttggcagactagagtttatacttcatgtatactcatctgttgctttttcttcaaggacaattgaatactgtatgtttttatttgatttttaatccatcaatcatgcatgaaagcgactacgggtattctttaactccaaccgtgtcattcatgcatgcaacaagttgccctactattcgcgtacgtatgttatgtataggtacatatagatgaattcaaatattataagaaaccgatgcatatataggtgaaaagaaattaaaggctacacactaaaatttgttacaaactctaatgtttagctttttataacccacaaggccacaagtaggtaaatcaaacgttcgagaacttctgctagtaagaactttttaatgtgcatacaacactgctgctaggtggaaactagagttactagtggatatcatgtgcattggttatgatatcaactagtagtaatcattaagagcaaactttagaaaccatgacccatctaagaatctacagaatcatcatcagcagcagcacgattaaacatcgaataactaagataaacatgacatctaaagttcagtggaatggcagctgcagggctccaaaacagtcagcttcactgtggaaggtaccctaggctggatgtatcttctgatagccaagacccctctgtgaccttccatgataatgtccctatctagtggggggcatttgctgattttgctgcctggagtatcacacctaaaaccagtctgagaagcatccaatgtcaagcactcgagtgaagctgtactctcaaggatatggcatgtcagctcaaccaagctctttacagagatgaatgatgtaaccgtcacactcttaaggttgtgatgcttctcttctcgtattgatctcagatctgcaggatgtgcaaaaattgaaacactctgcacgttccgctgcattacctaggatgtgaa

SEQ ID NO: 38551 - DNA, 1249 bp, Oryza sativa
ccaatgcaagagaatgggaaagaaggcagcctactcgttctcggtaatacgcacacgacaaagatacaatctcgtcagacttcttaagccactaagtgtgactgttgggtggaaggaacagttagaaaggtgaagatattggattgagtctccactcccattcgacagaagagagcatgggaaattgtactttgcctggaactgggtcagtgcaattatgagttcttcaatccctggtttaacagcaatctgaagccaattgttgagatatgaagagcccttcccactataatctgaatataccttaatcgtcagttttttcacgccgatgcctgagtgccttttgagaatgtggttgactttgctgtagaaaagtccagccaattcttcgtttccatatgcatttttgctcaaccccaatgcttcactactgaaattgaggttggggtggcatctccaggaacttagaaaggaatgagacacacaggcagctcgggcagcatcccgcattggcatcaaggaatgtataagacgccagatgtcctgcttgcacaagcatgggagagaagttaaccattggaattgtgaagacagatggttgaattagatggaagaaaaaaaatggtaacttatggagttaacactttaaccggtccagtgctacctgcctgattatgtactattgtactatgaattgtatagttgacttctgctaggcaaatatggtcttacccaaatcatgtattaggtgctcggcactatttgtttctttgcaattgtgccagataaaatggatggaatgatgtttaattgtctaatagcatgttattcaatggcataaaaggaacagaaatggacatgcactttgcatagggtaccaatatctgaatatataaacaaccagaaagatcagttaaatatgtaacagaactaaaggtgtgtttggttgcttgcttggattttcatacactaggtcaggaactcaggatggggaagatgcggggagtcaggatggggagatgcggggaatcaaacaagaatgccatcctacaaggacatgtggctcacaaaattaccatgtactgcctgcaatggcctaccggagataacatgtcacatttgttagcaaggaaccatttttgagatgttaaaatttaaggaagttagaaacagtatggagactagtggcaaaggctaatcattgacgttgacttgagaaactcccagcctaagaaccaccagcttagaa

SEQ ID NO: 38552 - DNA, 1190 bp, Oryza sativa
tcttcaaggttgaaggagaatcctccttctcctcgcttgaccaaggatggaaagcaggaaagtgcagttcttgttgataaggatgatactatacacttttggtttcctttattagcaggtaaccacatttcttgttctgcatgtaccttctgctgctttcagttgatttgtgtacagataatacaaataatgtgtccccaacttttcaaaaccttgcaggattatctgaacttaccttcgacctacgacctgaaatcaggaaaagtgccttgcaggtgttatttgacacattaagaaaccatggtcatctcttctccttgcctttgtgggagaaggtgtttgattcagtgcttttcccaatatttgattacgtacggcatgccattgatccatcaagtggttctccacaaggacagaatgtggaaagtgatccttcagaacttgatcaagatgcatggatgtacgagacatgcactttggccctgcagctagttgtggacctctttgttaagttctatgacacagtaaaccctcttcttagaaaaattctgttgctcttgacaagtttcataaagcgtccccaccagagccttgccggtataggtattgccgcatttgttcgtttgatgagcagtgccggatctgtcttcgttgatgaaaaatggttagaggtggttttatcgttgaaagaagctgccactgagacccttcctgatttttcttatattgcatccggagcttaccttgagaatgtaccaatagaaaatgggggctcttcagaaaagacagaagacgagtctcgaccattggaggatggcactggagaagcttctagatcaaggaacttgtattttgcaattggtgatgccaagtgccgggctgctgtccaactcctattgattcaggtatgcactattccttcagagaaccgttgtttgataaactagttcttaattgatctttttctggaagcatatttcttcatcaccctatgatttcctgatttttttttttcaaatctccctcctggtgatatggatgatttctctagtcactgtaggaacgaatttcttcattcagaaacaacagaactttgatggagaactatttatcaatcctatgaatatctatcaacttattttgttttcaagattgacatactggaactttcaagtgttattctagtttca

SEQ ID NO: 38553 - DNA, 6878 bp, Oryza sativa
ttgatgttttgccattccccattttgttctgtttatcattctagttactgggggaggttgtctcttgcagagctgagcactgtagttctttttacattaatttcttttagctttggggagtgtatgttacaagatgactgaattctgtacggtagcttagttcaaaattgtgcccgttctgttggccaagttcaaagtagatatgttttgcattatgtaatttatattgttgaaataatggcagcttctgtgctgtttattcttaccctttaggatctttggcacaagttttgatcgactaaactagaaattctaaaaactatgttcaaacacacgaaacacgagtatagttcacttcagtttggacatatatccacacgttcctagcttcatcctaactagcgaaattccgtttgctacggataaaagaaaacaaatcataatatttcctaaaataaataaaagcgtgtttttcaacaatgttgcccaccttattgctacatgtgaatactcacttcaatttaatttaattttatatagagagaatatactctgtctttgagtttgtcatagttcaacgatttgttaggctgacaaactcaaagataagtatattctctatatgacattgtctctttctataatatactgatgaatttattaattgttttacgatatgctactggactaggctttttttaataaaaaaacaaaaaaaactcttaaagatatacaaggttaacaattgatttatctcattagaaataaaaaaataaattatgtggcctttttacacaacatgaaagttttttataagttacaagttatttttggtatttttaattttttttttaaaaaatctatttttgtgtgatatatgcaagagaaattgcttactcaaaagtcaaaagataatagccaaaaatatcttatgtagcatatgaaagttgatttacattaaaaataacaacaaaagcagtgtaagaatgccaattattttttttaaaaaaataatagccaaaacatatattttttaaaaaaataaatatgcaacttatttattaactttcatgttgtgtaagaaggccaaataaaaaatttcatattttttaaaacttttaatgagatagatcgattgttaaccttgaatgactacaaggatatttcagtttttttaagcctagtccaatgacgtgttgtaaaacaattgataaagtcgccggcatattatagaaagagacaatattagtggtaaattgttaaactagaataaactcattgatataaattagattctcttttatacatggtatccatttagatctagttatgtaatatattaaaagatcaagaggtaatgtgtagattcagtcgccataattgaagtttttttttaaaggagtataaataataataagcagttgcaatgtggttcaagtctgtactgtaaaggaatcttgcgttctgcgtgtttgtctagttcgtccagagttcgtccagattgcttcattctgtaattctctaattctgtatgccatgctcttcagacgctctgtaagagcgactgataatactagtgaagtttgaatatgtatgcttcggaatgatatacatttctgtttacgttggacgcaatgagttttgataatgcggatcatgcagaagataaccgttttccctgtacaggacgagaactttgcggagcagccgaatttctaatcagtacgttgcgtcgttgcattgtacagttttcagtttcgtatatgagagacttataaagcatttccctgtacaggacgagaattttgcggagcagccgaatttctaatcagtacgttgcattgtacacttcagtttcgtatatgagagacttataaaacatagcctaccccctttcgtttttacccaagtaaatactacaaaaggaagagccccaagccaggcagtgttggggcgccaactgaaaatagagcccatcgacacaatcgctacgaattgacaccaccaccgtctcacactcactgccgttgggagagatggaaaagagaggaaggagagagaggagagtccttaatatgtggagccaccatctcgttgctgttgggagagatggcgaggagcggaagagtccctaacaggtgggatccacctactgattcaacgagttaactgtggttaacctgccactttaccaggtaccgcttcccaaaccgaaaggaggaaaaaaaaggacatgtgcaagcacccaccgtgagttaccacgggatgacagctaggatgaaggccctctgttcacagtgcaagcatcgagtcggacccacagtgcacgactttaccaaatcaatccccaaactcctccctcatcacgcactctccggctccttcctccctccggtggcggcttctcccctctccccgtcggcagcttctcccctctccctctcctcgcggcggcggcggcggcggatcgagaaggccgaggcggtggcacgcgacgagctcggcgtcgtgcgagcggtggaggggaggcgacgacagatccacggtgttgtggaggctggggacgcggcggattgaggagaccgaggcgggagcggcggagctcggcgtcgaaaggctcgacgcgcgtggcggcggcggctcaagaacgggcatcgaggaggaagcgggcgaggtgagcgccgggcggttcttggcggcgggtgcgtccagcggttcttggcggcgggtgcgtccggcggttcttggcggcggcggctcaagaacgggcgttgaggaggaaacgggcgaggtgagcgccgggcgggtggccggcggttcttggcggcagaatgcgtccccggctgcctccttctcctctctcccacgccgccgcgcctcacctcccacgccgcggcggcatgccggggacgccgccgctgtgcgcctcgcctctccgtcgaccgtgccgcccgtgccactcgatttgttgatttgttgccgatttgctgccgtgtttgctgccgcgatttgtgtcgatttgttgccaagcatgggcggtgcgaggacacgagctccacagtgtagaaaagcagtcgtttcctcgcctcgcgagagaaggaacgcgcgtctcaggttgggggcggggcgctctccacaggcgcgcgtcctcgctccacgcaagccagaatccaacgtggcccccatagcaccggtccaactgtgtgcaatgtgaagggcctaaggcctctcccactgcaagcacccatcctgagttaccacgagatgacacgtaggataaagagctttgaagaccctctctttacagtgcaagcaccactagtgggacccacaaatatctgctagtggggcccacggattcccacctccctcaaccggctcatcctcccccaaatccccaaatccactcctccccgctggcgccggctcttcttctccctccgccggcatggtggccttggtggcggaggcctccaagcggtggcggtggcggcggcctcgattgcagcggtggcgtcgtcctcgaagaagaagtggtggcggcggcgtccccaacgtcgacgagctcggcgtcgacctggccaaggcgccggccgggaggaggaggtgggggagtagatccggccggcggctcatcctcggcggccgcagagcccgctctccctctctccagcccctcacggcggcgggatgcatccccggcggctgtggctggcgcgccggcgggagacgtccccggctgctgcggcggcggcggccaccactgcccgcgccgccgctcctcctcccagtccgtcgcgcctcctcgcctcccacgccgcggggaggagggagcaagaaggcgccgcacccactgcacgcagcggcgaggaggaggaggaggaggagtagattcggcggttggccaccaccaccggcctcgccgtcgcgtcggctgccccgtgccgttactcctcgtcgcggtccacggcctgctgctgggacttctccggcgggacggcgatttcgcagattccatctcccacgcgtgcgctagggcatggcactcggagacacgaccttcacagcgcaggcgtgggtcgattttcctccgccgcgcgtccttgaggtggttgaggaactcgtctcccaactaaggagcgagggactacgcagggacgcggtgctgcgcgacacgtcggcatttttcctagttggcaccagaaagcaacgctccacctcatcgcactgtaagaggcctaaatttattcctttcagcgtgactgacaaaactcacgcccaagtgcgcgtgtcattaggcggcgcgtgtgtccgccaataatttttggctgatctgggaggcacaggtctgatcggacggatgcagatcaccaaagggtgtcggagttttaaactccgacgttggtaacaagaacgcctttgcatgcgagaatgctaatgggcgatcaggcgcatcgtgcattcgtgcccgtgcctgatccctgctcctttgttcatggaggccttcctgcggcacggccacagcacaagacacatcctgcatcaatatgacactatcgctccttcaacgacgccatcagcgacgaggctgtactattgacagcaagaagaggccaccgcctcattcgtgcctcgcctgcgctggcgacgacgaggaattgctagaagtccgggacaccaacttcctacgaatggccggcagaaattaagtagggagtcggagccccgcaaaaaggggaaaaaaaacgctctttggaaagagcctatagctagcacctcggcagaagtagatgtttcagagtgattgtacacttaggccgtgtttagttcctcctaaatttctaactttccatcacatcacatcgaaaactttcctacacacataaactaccaactttttcttcaaactatcaactttctcctaacttcttaacttttccaccatctaaacacatccttaggttcaaagcaaaatagcccataatgcaagtcacctgaccaggccatggttcaaagcaaaatagcccataatgcaagtcacctgaccaggccattgatgaatgagtcaacacgatgttgtcagacgatgatctactaagggtgtgtttagttcacaccaaaattgaaagtttggttgaaattgaaataatgtgatggaaaagttaaaagtttgtgtgtgttggaaagttttgatattatggaaaagttgaaagtttgaagaaaaattttggaactaaactcggcctaaggccttgtttagatcccaaaaaattttggcaaaaaacgtcacattaaatgtttgaacacatgcgtggagcattaaatgtgggggaaaaaaccaattacacagtttgcttgtaaattgagattctaatcttttgagcctaattacatttgctaataacagattaattaggcttaataaattcgtttcgcagtttacaggcggaatctgtaatttgttttgttattagtctacgtttaatattttaaatgtgcgtccatatactttaaaaattttacacccaaagaactaaacacaccctaactaggtcacaaagtcgcaagttccctcagaacactggtgattcgaatttgtacaatggtcaacaagcacaacaaataaccttcggattaatccaggttaactgtacagcaagcttggtttgagcaaactacacaggttaattcacaagaggtgtgtgacactgacacacaaaccaacaacgattatcttcatgcaagtaagcacatgtacagtgaggtctcagtgaggtttcaaacacacggcaacccagaacactctagcgggacggaggtacggatggctaaacattctcacaaataaatctggccttaaccgctcgacttcgagcgaagaagaattattccagcaactgaaggcgtcacctcgaagaatacacaagtagctctacagaaaactcgtggcttgcatcatcccgtcattcacagtaaagaatcagcaggccaacgctagcatcttgcaagcagctttttttagatcttttccttggcgaagaaccgactgaaaccccggttttgtttctcgggcaattggttagaaattgaggaagatgatctcgatctatgctttgggcgcttggatccgtttggtgaaaggaaagggcttccgtccgcttcagagggggcattgtgtgtcttgtacccattcactggggattcatttcctgatgcatgcatttcctgatctgtatccagttgacctgttggcttctgtgagtattcaacaccttcggttgttccagccgcgtcctgcaggaaatcttccattcgctggtttggcgaggaacccattgattctgctggaggacgcatagattgtagttggcgaccaagaatcaatatcgtctcctggcattctgcaagtttctctgctgcagctgcgatctctttctcctgtcaacattttaaacgaatgtgctgtcagtgtcagtcaaatgcctggaatttccagaaaatatcagttttgcgcacagtacagttctaagtactcctgaaataagttagtatgaatctaaattcagcctattgatttgactagtaagtgatctaatagtatcatactttttcctgtatttacaaatgaaaatgtatagcgaaagcatttctacaagaataataataaacaacacatgaacaaaatgtatcagcagccctatctcgaagataatttctctatctaatatagcaacttgtattgttcaaaatcatagctacctcacatttaatttctctatctaattcctcatctcaacaaagcacaatcatcccccatttaatttcacatgtttccttgatcccgtgaaaaactccaaaagtgtttttttttagataat

SEQ ID NO: 38554 - DNA, 1156 bp, Oryza sativa
agaagatccaaagtttgttgttcatacctgctttgctttggtatctgcatcctcatccacacacattgaattcctctcgttctcataccttcatgtcaatggattaagtaagaagaaaaacctagcagagggcagtgatatctttgtaccaactattaatcaataataaaaaaaaattttcagtttcacctttcaatcttctcctcgagatctctatatcttgttatatcctcctgatgattttgtctttcatcatcaagttcagctgtcaaaacttctattttggactgcagcacttttatttcgttttctaattcagctttccttgactcaagtgacttgtaggattcagccatacacttcaactgtgtctcagccaagctgtttgatttctcactggcaaccaacttggatgtcaactcttcaaggctcttctccaactccttaaacctaaattttgtctcttctataacttcattgcactttgataattctgcctccaaattcaacttctcagatttaagttgctcgaattcctctgatgagcatatctgcacagcagtcttgacatcacatccagagtcagtaggaccttcaatctccggatcagaagatgaacgaggaaggcaaggaccagaaatgctgtcctttagtggctcaagctgcactttattttcaagtaaagtcactttatcaacataatccaaattattattgtcagcttctttggtgttctctttcaacatcatgaacttaatctcactggttcctgacaagataagagacagcgtcataacaatgtcatttagaacattctcatttgatagagctttctctactagtgcagagaactgctgtattttgtcacataaaccatcacaatctgaagactgcccttggaacttggacacttcttggtcaagtgacttaacgaagtcttgaatctttaaaatggcattgactagttcttgatccatagcatgcttgctcccgctgcttgaatgcttcattagtgatccattgtcagctacttcaaccatgtcaccatgatgagtcttgctatcatttgatgaatctgcctcatcttcaatatcctttagaatatttctgatactatctagtatatttccagcattgttctgtggtgattcagaat

SEQ ID NO: 38555 - DNA, 1645 bp, Oryza sativa
attcctgcagcccctccacttccattttcatttgagctaatgcagcaggccctggtaacttctttcgaacaagaccccgtaatctttggcattcagcttccagttttgatattttctttacatcctccatgtgctgtttagttgcaacatcagctgagcgcacactcatgttcttttcctcattgcggatttcaagctctttggaaacaacatgaatttcatatttcagtgaattaatttccctttcacctgactgaattgtgtttttcaagacttcgatttcagcctctgctcgagccttttcctcatcaatcttcatcaaaaggtctccccgttcctcgagtgaccttgagagtgcatcattctcagcaccagccctaatgagctcctgttcaaactcaagtaactttgcttcaaactcggcctttatcttctcccactgtttggtttttgcaaagactacatcatgtagcttctgctcaccttcttctttcacagtccttacttgcttcatgcattctttcagagcaccatccagatgggcagctctttcctcagccgctagcttagccaatgtaacagtttctagctgaagcttcagtgctgaggcctccgcttcagctttctcccaacctaaacatgacaaagcatatagcccatcaaaaatacatctactgtagcagttttataaatcattcaacctttaagaaaacatatgaatggccgaattctgtttccactttaaagagagcagtaccacctataccaacatccactagcacaaggtttatgaaaataaaagtagtagttagtaagttattctactcaaataggaagagtaaaagaacatagtgatcctctgtgcacctgatacagcttcttcagcaactttagcatgctgtttcactagggcatctttagtagtgatctcagactgtgccgcagagaggtcctcattcaaggccttcaccttttcatttaaggttttcacttgttcttctgattcagtaaggtgtgcatatgtttctggtgaaatctgcacatattttggagctttgtcatcctgaaaagtggaaacatggcattagaagaaataaacatgtaaaggtaaggtaaaattggaaaactttcaggatgcaccagtagacaattccatttataatgtcagctttagagataagaataaatgcaaacaaatatcaaatgaactggtaataccgatgtcccctatgggtattctactgactccacacagcagtatgtactttagcagttagcaaaatatgtcataatctaaattttccctaataaattttgtgtgccacaaacaaaaatgcaatgagttgctctttgacaaaattatatgtagaaaaaaaaattatgtctttctgcggtacagtgggtgaaagaaaatgaaacaaaatactatgtgagtgatatagtgtagtccttaattgagcatcagagagggcctatataaaactaaatcagcaaatacaaaatcaatcatgaacgaatctaccacaaacatgaatagttattttcattttaaatataaatggacaaaatgcaaataaaccagtccaatagctaataaatggcctcgttttagtcaaaaaaaaaatggcctcgttgcaacccagta

SEQ ID NO: 38556 - DNA, 11923 bp, Oryza sativa
cgcgatacggcaatcgcgcgccactgtcgctcggcgaagagagagtcagttaaggctgccacctaagacgcccgcgagagtaaatcgccggcgtgggacagcgaatgtttatttaagcccatccggagggttaggccggacggaacggaagcctccgccgagatgaccggacacctactgctgctcgccttgccccgtgtcaaggaagaaggatccattggtttcttactgtgctgcactgctgctcctcatcatcagtcattccgtcccatctgctagcagtaggagtcgtcgtatcgaggacgcgcgcgtgagccggagtaaaagcggagagctactactagtaccagtaccactctctaagcatcatgatacgcccattaatggcggtatttgctgggcagatttgggcttgagccaccagatgcgctatacttcagcctactcactactactaataaatccctcgtccttgcgggctcaagtggggttgtcctttttctaccatctccttttactaatctcgcagtggcagcgctgtactactactccccggccgctacttctatcaatcattccacccccaccggatgaagtgaagctggccgtacttgccggattctttcacgggttaaatctgtaccatgtgttccatcggatgggattgaatgttcggggggaagaagaactcgtcgaggagggggtaaagacggagcgcgagaacggcaaggacaagggaagcgcccgaacagggcgagcacgacgcggtgattccaccctcgcaagcgcgacagtgcgttgccgaaccgacaccgcgcgatttgatttcactgcccattgatcataatagtactagtagtttctttggcccaaacaagacaaggaaacacgaagcgcaaagtccgggagggcaaaaaaagaagaagaccggtgaacgggaaaaaaaaagtcagaaactggaaataagaataaacagtgaaattttcagatggagcggattgaacagggagctcgcagcgcacttctcactagtactactgttcaaagttcaaaaataaaaccgacgtaaaagcctcaaacaaagcataatttcctggaaacaatccagaccaaaaaacaaaaatcgcaagcattgcaggaacacagacgcgcaatcacagggctgcaaattagcaacaacgaaggaaaaacacgggaaaaaattaagcaggcacgcagcaaagggattcggagccttacgggaggcgagggcgcggctcggggaggctccacgcggaatgcagatccggcggggtcacggtcgccggaatccgccgcaattccggcgtgaactggatctgacccgcggctccgatcgacccggccggcgtgtcggtggcttcggcggcggcggagacgacgacggccacgcgtaccttgccgctcacacctcctcaaccgatcagcgccgcactgcacaccaggagctggactgtggattggatgattcacccccactcctctccctttttcccctcggccctcgcctccctcctccccttttgctcccgcaaccttttcttcttccctctggaatcccaccaccaccacctcctcctgctgctgcaacgagcactagctcgaggcggcgtctcccggtttggtaatgcggctgcccacctctcgcccctgctccctatctagcatcaatggagtggcggtggcggtggtggtgggggaaggaggagagacgcgagagaggtgcggagatggaggtccgggtgctttttgttacgggggggtgcgcggctgcgctgctggtaggtgggcaaaaaagcggggagggagggaagaaagtggcgaggtggggaaaagcgggaggagagtgtgtgtgtgctgtgcgcttgctgtgaggagggagggagggagggagtgatacgcagcagagatacacatccaacatttcatcacagtaggatggatggagatggtgacagggatgatataacaataaaatacaggtcttgcattacaataatagcatcatttctttttttagttactgctgagtttttctcttaaaatagttgcacaggcatggcacaaataacctgtttagttggtgaaatgaaaatttttaggtatcatatcagacgtttgacttgatgtcggaaggggtttttggactcgaatgaaaaaactaatttcataactcgtttgaaaaacgcgagacgaatctttttattctaattaagccgtcattagcacatgtgggttactgtagcattttatagctaattatggattaattagactcaaaagattcgtctcgcgatttacatgcaaactgtgcaattagtttttctttttatccatatctaatactctatacatatgtccaaagatttaatgtgatgtttttggaaaagtttttggaaaactaaacagggccaaaggcaagccttctctcttagcaattttccattacagtttacacatttattacagagcacaccaggtaaggtgagtcctgtatatgcagctacgctcaacaagtcaacatctcatcaattctatagttaaacaatgtgattcctccgaaaaattgttatatacttcctctgtttcacaatataagttattctagcatttctcacatccatatcaatatgttaatgaatctagatagatatatatatgtctagattcattaacatcactatgaatatgaaaaatgctagaatgacttacattgtgaaacggagggagtataagttattttaaaatattatataaattcattctttaagtttgtacttcctcctttctaaattgatcatcatataatataattcaaaatttctcaaattgatcatcatataaccgtatagacacgagtttcatcataatacaattaatgcagcatgggagaatgtgtagatggcatggtgttttaatcgatacatgcattgtgggagaatgtgtacatggtatcttgattgatgaaatttaaattattattagtcttgatgtataaacatactccctccatactaaaaaaaagtcgtttaggacatcgatacggtctccaaaatacaactttgacttcttgtttctataaaaatattcattaaaaagtgatatatgtatacttttatgaaagtatttttcaagacaaatctattcatataatttttacattttcaaactcaacaacttgatagttattcatgatttatattcccaaggtttgacttaaacattgtcctaaacgacttcctttataaatatggagggagtatatgatgatcaatttgagaaggatgaaataataattaaaatttaataacttacgtattaatagtattttcgttttgtgggtcatcatgtaaagttaaacatgacaactgtggtacaggatagagggttggaaattataaatagtgttatcaccgtttccttgatgcaccgatgaagttgtattgtactactctatcaatgattttgatgaatgtcggtgtctcaaaactactactccagtatgtatctaccggtgtctcaacgtgattttgatgggtttcgggtaagcagggggcacagtgctggagcccaataccaacgtccttcgccgcgtccgcaacaaccaaaatagaaccacgcattttacatgtcaatcatgccaacaggctgcctcccggaaggccataatacacgccacttgttttggctcttcctaatccttatctcacatcgatctctaccatctactactagctatctattgtgaagtctactagtttaattatcatatcgattgaagagttccaaggaacaaaaacactgacaatattaagcatcggacaaacggttgggatcggtaggtacaatatttttccgtttaatcgtgacacatgtccttgatcttgttatgcctatcaactaagtactcctagctaacagctctacatatcatcttttaaagaacttcacacagacacggattgatcgaggttattgtccacgaacagaagtcagttggagcatcactagcctccaatggttcatttcactttccgaagtgccttggatgatgcacggaacctaatctgaattctgaaagatatagtaaaacacttgctgttgcgacttgcatttgttattctttcttgatagcagtatttactactgtttgtcgtaacaccgatgtacagtggcggatccagaaaattaattcaatggtgtcatatcatatctactggtgtcatagtatgctaaggcttcgtttgttcccgggtgttctgggagattgagagagaaaacatctcgttttccgcgcgcacgcttcccaaactactaaacggtgtattttttgcaaaaaaattctataggaaagttgctttaaaaaatcatattaatccatttttaaaatttaaaatagttaatactcaactaatcatacgctaatggctcacctcgttttgcgtatcttcccaatctcctcaatccccttctcctcaaacacaccctaattatatttaaaacatagtgttataatatatgaatatgcagtttaactataggttttaccgaaagtcgtcggtgtcaccgttacacggtagatccgcccctgccgatgtagggtggccttgctttctccttggagcaaaatgcccctgtgccagttgctacccctacaaataaaaaagcaaatctgatcgatggaactcgcaacagctcaccacctaatacctatggtcataaaacggaaagttgcctacgatttatagatcgaaaaggatatgagaaaaaagggggctttagaaaagaaattactctagctaagctcactcatccatccgtttcctcaagtacaatgccgagcaaaacccagccgtaacactccctcatttctctatctgaccaaaaccatgacaagcaaataagttgtcattaagcaaagctaacagctaagcaacagctcaatcaaaaacatgtcactggtttccttgagaaaccaactaaagattagtttttttttggtttcttagccaaagattattcattccaacgtgacactggcgcactgcccgtctgcaggactgcaaaaatggcattgagctttcccacattgactgactggcaatcctcgcaataaacaagcgccacacatgtgtgtgaaagtaacaaaaggcgcctcccagtaggtaggtggggacgcggtggaaaggcaggctggttcacctccaggctatcgctcctcctggctctccaaaagagaaaagagagggatccaaagatgccaaacagtgcctcacttctgtactcctactactactacttcactccataatctagcctgtgcatgtggctgcaacatttcacctcgccatggctacgtaagcagcgaagctttcatctgtgtgcctgagtgtcagtgaagccagtggcatgtcaatgtgtcatcaccacgcagtactagtagtagtagtaccagaaatacggggcgtatctcacgtctaatcggacggactactagcggttaaaaacaggcgagacgactgcgactacggttagttggctaacgtccaaggagcaagtgcacaaaagaaaatgtcgcagtaggtggcacgtattaccggctacaacgccacttcatctaccgtgtgagtgtgagtgagcgaggcacaaactatgagaccggaggtttttttacaatagacccacttgtgtgtggcacgcggggggaagagctagatcctgagccgtccgttggacgggtggtggatcggacggctctggtcgacctgactgcgctgatgcaggggtggttatcttatcccaaactggagtaatttatactagtaatagcgcattagtgctcggtataatcagctggctggctggtcaaatgtggtgctcaactgctgcggtgaatgacagaatgtggtaacatgttcttctgagaataatactactgcagccagggtgtaatcatgggctggttgggcatgtgcggggttacgtctaaaaagatttgatgctgattggcttaaagcgcggggattgaagcaggtgtttatgctttttagagtttggtcagatctactggagtgtcatgagaatgagatattatcctctctgacacgtgtatcgctacattatttagctgggaatgttattttctttgctatttttcttcagatttgttatcgagttgttgacagttttttcccaaatgaaactttcattttgtagaccgttgaatccctgttaagattcatgtacctagagaggaaaaataatcgatttgtgcgcatgaggaaggattcgaacccataacctcacacatagtcacactcacacggtgctagccacctattgtaattacactctagttatattttttaaaaaaatactccgaaaactatcaaatattctttagttattattttctttgttgagtacattggagaattctatctctatacgtgtgatcgatcttgaaagaagaagaccaggtcgtctgaaactggtctttcacctctcgactgcagccagccagctgctagtaggtgcttcgagctgcaccagctgtaaagacccccaaagtcagcttaaactaactatagtacactaagcatcatgcacggagatgcagattgcaggcttggactgcaggggcaagagttatacagctctgtttttaatggaaagagaatgtgcatagcactgttcattgcagctccactgctcgattagctgcgtgcctgcgtcactgtaaaatgtgaattgtgtaacgcaggacttccatttgatcgacaggaattcccggtgataccgtgagcctgtgacctgtgtcactgtgtgatgataaaactgatatttctggggaaaatagagcggatatgatttcgtgaatacataatggccaattgtgtgtgtggtagcagaaagttccatgaggataaatagatagcagtactgctaatctgctataatacagatgagacaatgcacaatgtatgttttagtgattgtctcaataaagaagagggaattggaaagcgaaagcttaatcagtgcgaattgatggacagaatcggaagaagtggctctgggtgggtggctcgctactgaaaataacaaaagtatagttagcagctgagcatcctatcaactgtcgagtgcagggcatcctaagaatgtcacgggagagaaaaaaaaagggtaaagatcactcgttctcttttttttttctccctttaagttccaccgtttttgtttttcataagttgggcgtccactttaattcagctccaaatgctccattataattaatgcaaagtgtagtgtaccgtgtctatatagctgcttcttttaaattagataggttaattatatcatccagcatgcgcttgtcaaaactgaaacagttagccactttgttgtgctgcagcctgcaggtaggctgtaccagtacaacgcattcggttagagtacgaagcttgctctttgcaggcgtcgtttactcgtcttggatgagtaataaatcgatcggaatccaacatggagctgccatgacaagggacaagactaaagaggatataaaaagcaataggagtgtaatacatccgtgagcatgctaatgaacctaccttatttagtctgttaaccagaaatgttacgtgtagatagacacatagtgaaggcacaagtatgtcagtatgtgtgctggtgcaacgcgaaggtaaattagcggagacgctgaaactggaagcaaatgattaattgaagtgcagcctttttcccaattactcagatcatttaagatgtaggacaccgggtgaattgccccaagattgacattttgtagacatttttttagccatctaatgcgatcgaatactgaaaacgtgatcaattatagtctcggcttctctgaacagaccatctcaatactgagatgagaaaactatacaactctctccgttttttaatagatgacgccgttgacttttaaacatatgtttgaccattcgtcatattcaaaaaattttatgtaaatgtatatatataaatcatgcttaaagtactttgagtgataaaacaactcacaacaaaaaaaattataattacgtaaattttttgaataagacgaatgatcaaacatgtgataaaaagtcaacggcattatctattaaaaaacggaggtagtactagctagtactgtagctaaatatcgatcatctcctctggaacatcttgagtccatgcatgagatgatctaatctagctagaacttggttaacctacccggctagctagctaaaccccttttccctgtcacgccgattgctcaaagccgggagcagcgcgtcttggcgtgcgagagtcggaggccgatcgaagattagcgggacccatgcggcgtcctttcttattaatagaagtccccaaaaaagaagcttgcatgcgacgaagcatatatcccccgcgtcttcacaagaaagcgggcgagaaaaaaagaaggaattccaaagcttgtagtacgtacatcgccgccggccgtcgagtacgtcgagtcggttgccgcgtcgctctccccgcttttctccccccctgcttttgttagcttgtcacaccacaccgctctccatctcatggtgcgcccccgtgcgcgcgagccacccagccaaagccgcgtaagtccgcgcagcggcgcagcccgccaccgttaggtggcacgtacttctcccgcgcgacgacgatcgcgcgcggcgctggcgacatgcatcaccgagaccgagcgcgcgcgcggggggcgtggcgtggcgtggcgtcacgttcgttgggcgcgcgcgcggatagcgtgcgtactgcgagagatacgccgcgcgcgttaaccgccgcggaccacgcgcgcgcgcgcatcgatcacatcacatccacaggtgcgccgaatcgaccgggggcgagccgccagccagacgacacacacatatacgcgcccgatggcaacgtgacacggatggttggtgacccatccggccgccgtagttgcacttgcttcaattcttggagacttaaattactgttcgatcgatccgtgccatggcatggagtgggggatcggaattgattgtgctgctggttagttgcactgtcgttggatcaatcgatcgcgagcagagggccggggaacagctggtatatctgggccggggcgtgtagataggtaactagtgcgtcgcaaccggcgtgatgaatagtgtgcggatatacgcgagatgatcgggctggatgtgtttgggtgcacggttgtatgtgtggtccgaggaaaagtacctgcgtactgatacgagccattcgtgaacgcttacacgtacagctcgctgagatgtgattgtagacgtatattgttcgcacgtgcgtgtcgattcctgccctttcgtagtattacatccttctggctatatggatcatgtacgtacagatgatgcatatatcgtgatggactaatgactggttgaacgaccaaagcgccagggtattgcttgttcatgtagctatatgcacatatggcaaaatttgccacatgacattcaaattttgtgtaattagttggaggacaccgtaaaattgtgtcactgctgagggacaccataaaatggtgtaattggctgtaacacactagaagtattattttatgatatttgagaaaaatgtggagagagaaatttaacaaaagacaagtttgcccctacctgctccttctccacctgaccacggcgcagcggtgtgctatgcagggaggacggtgcatgcgcgggtgcacaccgagatggggaggaggcggcggtgagtggcgacgaggaggaaaaggtggccggctcaggatgggggcagagatggagctcccatgctcaccgggcacaatggaggcacggatggggacaatgaagctggcggtggcctcgtcagtgctttgggaggtcccagccgacacctagcggcgtgacgctagtggggagggcatggtttcccggcggcgagggaaagggggagatagggagaggagccatggacaggagctcggccggggccgtcaatggcgtcggttcgctggtggccaaactacgaccaattaattcgcacaacggccatgattcgtgggggatttatggggaaaactgagagaacaggttggggagcaacccccccccccaattaatttggcgaaacggccggcggcgggggtgaagcaggataaagaatagtgtgcatgggcatatttgtactttccacgatttttctctctccatttatatcaaatatagtaaaataatatctctggtgtccagcaaccaattacaccatttttatatagtgttccttagtagtaacatgattttgcagtatccttcggccaattacataaattttagacgtcctttagtaatttttgacgcatatatgcacacacatcaataggtccggccagttttgtgacgcgtaagatccacctatctatcgtactcatcagtttgcgtgacggattaaagtaaaaaaatttcagtgcttgtagaataaaaaaagaaatcaaaaggacacgaaagggagaaggtcgattttcacgcaaactgaaaaaaaaaattcagtttgcgtgacggtgtaaaatcaaaaaaatcaaaagcacaccagggtcacaattggtaacaaattgcccatgctgagtatgaggtacgagcagggtttgacttaccgtcggtaaccgcggcgcggttaccgggtttaccgcggggtacggtaatataaataccacggtaacccccttaaattcaaataaatttaaaatataatttaaatttttgataaattttgcacggtttatacggtttttcacggttaccgcggttaccacgtggtaaccgtgcttaccgccggggcgcggtaaccccggccccggcggtttggaaaaccctgggtacgagtcacaagagctcaattactaaggtataatatcacaagaactctctccttttcatattataaaacacttttatcattttttatcaaatttatagaaaaatataaatatttttaacaccaaataaacataatattaaaatatatttaataaaactattttggtattacaaagtttgctagaattttttttataaatttaattaaactatagacgtttgacttaaaaaagaaaaaatcaaaatgccttataatatgtaatgaaggattactaaattaagcatcactatatctacgtatagagaaatctcctttacaaaatcaggaatgcctattcatttcgtatataaaaaatcttataacaacaatctttttcttgaatagcccagattgctctaagatttatatagactctataacctaacccaccttttgtctttgccttcttcttcttaccatggatccactgtcactactcgccaccatcttctccaaacacaagtctgggcctggcgctaattcctcagtgcttatcttctagtctccgagttgcccaattcttgatcgaccatgggtagattctactgacatttttcttttcagacaaataagaagtactccatccatcgtaaaatataagcattttttggactggacacaatcttcgaaatactactttggccaataatatctatataaaagtaagatgctttaaagaaaaatatttgcatattatgatagtttgttttatgataaatctagtaacatcaattttacatgattgattctctcttttttctattatagtcaaagttaaaaatgttggatctggccatattctaaagggaaattttgctacgggacactgtgacttcgcagtcttagctgtaggacattgtacgaagtgacttttgaggaaaaacagtttcaaaggttggatatttgccagtggacaccg

SEQ ID NO: 38557 - DNA, 1074 bp, Oryza sativa
gcaactgccatcgccaaacctctcctgctgtcggggcacgccgctggccagcgctgacgctcctctgcgcgccactggtcgcgtccactctgcccttgccctcccgccgtcgctgtcggacatcgcctgcccaccgttgtcgctaaaatgtgggatagagggagaagcgattagagatagaagtgaaggaggggatagagaggagagatatgagagctgacatttaggcctgagggcatttttgatatttcacatgatttatctctcctcttcaaccagaaattattactttaatacgtgcggtgtccaccagcaaatatcaaatttttaggagtattttttccccaaaagtcacttcgtgcgtatcctagagctaaaaccgttaagtcacgatgtcctgtagtaaaatttctctattctaaaaatgtttataatgtaagacggagaaagtagcaaagatgtttaggtgtgtttgatttgggtacacactgggagtgggagtccgggagtctggacccgtgagcccctcaaaccaaacgcctccaaaatatctgtttcatcccaattggcattttctcccacaaatcaaacacagggagtttcaatttacatcaggaccatgagcgtgcacgaaaccagtggaatttgcatgcatgtgactgtcgctgaatacatcgcactccagtacagctggtaggcacgtatattacgcatgttccttcacgtacgtagaatgcccacgtttctgtacatccagctgaagtacgattatctggcaagttatcccaaatctctcggcgcgtttaattaacgtgctcggcgatcttaccctgagatttttctcttgtcaacgttgcgatagatgccctgtttattaatttcctttcggagcaacattggatatgttgcgtacgggcatgatccctttggacacaagctgaacaatcgaaagcaggcccgcaaggacagagcaagtggcagtgcatgtgcgtagttaagagtggtcaataagatcagaagaggttggcaactaggcgtgtcaacttgcttaacaggagaaggggggtccactat

SEQ ID NO: 38558 - DNA, 2894 bp, Oryza sativa
tatggaggagtacattgacttggtcgcagttgccacgattaacaacgttcagggtgagtccccaacacgatgaggaacccgatgtgagattgaattcacggtaagcttggagattcgtgcttgtccgcaagcacaaaaacgacagcggtagatttggcgtttactgtgccagttggggccaccgagaaagggtggttgcgttctgggtttccctggatgatgcgacccgtatccaagtcctcgtgccgtacgccggctaagcatgagtaggccactgtttacgtgggcgtgcagaggcgaactgcatttgctacgactgcctactgctattgctgtgctatcgtgcaccagaacaagtactagctacagtgctactgctaggcgtgttagtttagggggtgtttgggagagaggggctaaactcagaaccgtaagtctctaggagatggacttatattttttagagaggggctaaagtttatctcctctctcccaaacactcttttactgcactactcaaaaatactcagcatgtactatgagcatctaatcctaaatacttaccctaagatgccaggtagactcatatataatgaggtgaaatagagaggaaaagagagagaggatgagccactcccatacaagacgtaacttttacataacctataagagaaaaaggagaaatgtgaagagaagattgggtaaacaaataaatttaaactattatggtcagtgtactagaattatcgtagatgtgatttattgcgcatgttacctttttattgatgaatagtctacatggataaatttaagggtggcatctacgtacctcttctataaaggtggcatcctttagagaaagataatagtggctataagccaactataaatttatgtggaagataaagataaaaaaaattgatgagttatcatgtactaaaagttagttatacgtacatatgtttcaagttaattgcattgaatatatagtgagagaaatagagaggccggaggaaaaaatagagtaaaccttataagtaactattatatatgttagttttaatataaattaattgttaatagttatctacatattaaacttgctcttaaccagccaacctgtcatgctccttgacttggtttcactttcgcactttcgcatgccttttcgccgtgctgtgattgagtacgggacaatcccggatcagcggatcgtcccaatcatttgtgcgatcaatttggctcagctcccttattgatctatgcgtgcactgcgtcgtttggatgtgtatcatcggctaactggtgcaccaaccggtcgaaaattaagagaattggcgtgtgattaaccagtcgatcaacagctccgattcagcaaaaattgatcaatatatagtacgtatattagttgtttactatggtggcaacaaaaacaacaatttcagccgcaaccacagcttcaacaagagcatatgatgagaaaaaaaaaataattatcggcaggaagaaccgcactaatatcagccagaagggcaatatcaatatcaacaaggcgaaggacaatatcaactttaaagaaatcaatatgaacaacagccgatacaacatcaacatatgggtaatagaaacaaagagtgggtcagaaccgcatcagttccccaccacgaaccgattcaggggatgtctttccaagacgatccgcgatcctaaaatgggtggaattcattgtcggcctcttgtgcaaccagcgttcactcctcctccacagcatccagaaatcaggtcaagtataattcctaatctcgtactcctaatttcgtagtattaatgataattatgggtattttcttattaagattagattaagctcctgttctcctaatttcgtaggttatcgatttccctgcatcggccaaatggccacgcgtgcatacgtacggaaacctcccacggtccgtgcgtcggtcaatgcatgggtgtggtgtccggctgtccgctgcagcgtttgtcggacgcagacggaaaactgtttcgttcttcactgggcgaggccgagatcgagtgcatggagttcagttcgccatttcgccgcggccggagaccggtcgatcctcctcctggcgcgtgtgcgtccgcgcatggagacgacggaacgtttgtgcgcactaccgcgctacgtccataaaacacccctgttcgccaacgtccagctcggctttttacgtggtcccctcgacggacgctggccccgtacttacgtctgcaagatggaagaaaaagttggcgttgcttgatctagtgtgtggttggaggagagtactgcacttctctggtccatcgcgatgtctcgatctgaacaaggagaggatataatttggaaaacattttctacacatagatgtatacatgtagtttaaatagttatataaaaatttataaaattcgattagatagattataataatataagatactatattagtctaaattcgatctacacataaagaaacaaaaataataatttttttctacaacactatctgattttatcatttctgtttctatagttatagatcaaatagccttgcatttatgtttgtagaattatatcattccaatcgatattactattttattaaaaaaatctataactatttaggttatatgcaaatgatgagtgacatgataccgggatgtaaaaaatccatgtccgaggactttatcagttaacatagcgtagttttctccatcatcttgctagtgacgagtttatggtccaaagctgtatcagagaccgttgtgatgtagaaatcaaaccatatatcacttggaaagaacgtgcagatgtcccttttttctccagcaagagttggatgaatattaagatttttgtg

SEQ ID NO: 38559 - DNA, 641 bp, Oryza sativa
ttttgaaaataaaagaaagatatatcatgcaaccaacatatagctccagacaaaagaactaaccaccaaaataagtaaacattttcctgcgcaccccatacaacttctataattgatactgctggaaagaacccaaattgcatatagtaaaaagtcataggaacagtgaaagacgagtggttgggcaagtataatacacacttcagtgcacaataattccaccatatatggtgagtagtacaataatataatcaaccacccctttatcactcatcaaagtgcaaggtacataaaccacgcgtacctcacggctccatagtcatacattccatccactggcgacgtgtacacacacccgatgatccagaagcagaggtttctgttacaatagacctagaacagtagtataggataggacaagcccaggccactactaattccgtcataagaaatccaacctttgaagcaagaacaaagggtactaatactacagtcagcacacgcggcggcggcggcccccacgagcgaccaagttggcggcgcacagcgcagaccaccggaccggatccgatcaccgtcatgccagaacgtcgaacgcgggaagtaatcgccgtgccatgtacttctcgcactcatgacac

SEQ ID NO: 38560 - DNA, 6450 bp, Oryza sativa
ctgcagttagagctgagtcagagtaagaagacgtgataagggtgactcgaatcaatgacattatccaactgtccacagtccaacaactttgctatagaatatttcatggatcagagggacatgaaaatctgaactcaaactctttcataaggccatatccaagctggtgttgcaatggtggattcccctgctcctctattatataaggcatagatcctctcaagttatatctgcagtaagagtcagaggtccaagacgtccaagtgagagcgaaaggtgtcttttccagaagacactaaccgaatgactagcatggccacaatcacagccaaatctggggtcatcgccgtatcgatggtcttggtcatgtgcgctgcctctgcagctgctggcgacaacgacatgctgccggcggcgttcgacatcctgcagcagccggcgaaggaagccgccaacctcggccacggctgctacactcggtgcttcgccggctgctttgcagctgggttcgatggagattactgctcggacttctgctccaaggaatgtggcgatgatgtccggaagttcctcagccggctgtcgccggagaactccgctatcgtcggtgacatttgcaacatcccaaggtgcatcagttcctgcgtcgaagcgaagattgatccaccgtactgcaagatttggtgtgaggatatgtgcggtgatgatgtccggaagaaccaaatcgggctctcgccgtaagattccaccagatgcgtttctttcggtccgcgcatcaatagtgcctgcgcttgcgttcagttagcgctgtgatctttcagtagcaaactactagcaagtagcagtagcttgtgtcgtcgctctctgcataagtgtgcttgcttttgttcttctatgttcccgtgttcttccacggttccactgttcttgttgttgaaggcgtcaaggtgtgtagccgactcgtgcaattacattatcttcatttcgaccctgttatcagaagtacgtactgttttagttccttgaatgcagtgatgggcgtaccagtttccgtttcataatcatgacttggtgttctgggacctgatgtccattttttgaaaggtcacccgggtgattcagtagagctggctgttggctggatcctcatgatgttttgattcagtagagctgctcaattgaagatagacgagtaatagcaccatgtgttggtaaccttatatgccgatggacttaaaaagcgaaaaattggatagatctctaaacttgtatataatttttcaaagataatagtcgtgcatcgcgttaaatcttgtccgagtaccaagtacacatgatcaatgacgcatgcgaaaaaaaagagagagaagaatcaatgtgcgcctgaatgcacactctttgttcttatcatctgatgaagttccaatccgcaattctcttttctaggaaaacaactccagtaagaactccaaatatttcgagatccgcatccccgcacgctgcgtctctcactctctcctcctcagtccgtttcgctatccttttgtcttgctcgatcgtttcgcggactccagctgccggtcgatgatgacgggagcgaagcttgcggagaaccgatcgacggcccggcaatagccgccggcatgcgcatagtgaagcctttctccctgctgatgccatggcgggcgtcgggcgatcaatgaagtgcgccaccaagagtacgtacctcctcgtcgtctacaccggcgagtactaccaaatcatcctacttgatcaacgacgccattgacgactccctcactcccgtgcctgacatcccccgccctgagcccctgacagcctcctcgccatcgggagcggaacatccatcttttcacttggcggtggcgcctacgtcgtcctcgccgagctcctcatgaccaacgtccacaaatggcgccatcaggttcgttgacatgaagaggacacacggtcgctgaggatttgaagctggccatctggatcctgtcgctggactccggcggcgagtggaggaaaggcccggagtgtcgtgtcggagacatttgggcaagcgaaaagtacgttgtcatgggagtgccgcggattagtccgcctccggtgtgccctgtcttgcgcacggtcaacgataatgtcgtctgcgttatcgtgaacgatgccgacgagactgtgtacgggagtgtggatgtcatagcccagcattttcttgccatcgacgtggaacgtaaggatcgaggtgggtgctctgctgtccgtcgttaccaagcttcacgccttcaccctgatggtggggtagaacctgtacggctgtaccctaaccacatggcttgcgaattcagtgagtacatggaacactgacaggtatagaggtacaaataatagcctctagtactgctaggaccatccaaaatacttgtcattgtcaattgttgagtaaattttattttagggaacttttattatcaatgtttcattttgtaccatcctttaaccaatgattttactttaaatcgggtattttttttacctttgttttacattggttcaccctaactctcttctcaagtataagtatataaatgatcttaagtgcgttggctcctactcatcaataaactcacatagcaatatgcaagataatttctttggcatataacaagtttgatgtagatggataaaatagttgaggggttcaaaatatcacaaaagtaaaaatacccgatccaaagtaacaacattgtttaaagggtgatctaagatgaaatatcggtaataaaagatgacaaaaagtaaaatttactcttaatttttcatgcatatttagttctaaagtaaaaatctgtatattatgtggtgtaattaggatttatatgaaaggtgatttatctacatgtaataggtcaaatcaatggtggtccactatacaatttttatcatgttatgtattatatttagaaataagactacttcacccctaaagtattgatgctgatctacataacccctggagtatgaaactgggtattttattccgtaaagtatcaaaatcagttcaaataacacctagagtggttattgaaacgggctcttgaactaaagaggagactttgaaatgggctaagtattttattcacaagtgaaacgcccgagactaatgtaaattagtgttagtatagtaactttaggcttgtcgattagtgcgtgaaaagcaatagttagataaatttgggtttactagactaatctttgcgccacacaatcatttgcatgtcaaaactacctataaaaccactgtaggggttatttgaaccgattttcatacttcaaaggtagaaatctagtttcgtactttataagtggttaaatagaccaaccccaacacttcagggtattccttatatctactatagttttaactttgagttaaatcttaaggtggtccatgccctacggcagtagcggagccagaaatttaaatctgtggggtcaattactagtggtttgtatttaagtgggatcatttctctttattgttttggatttatacataaaaattgaggtttataggacgttttttaaaaagctggggtcggccgaccccacagaaatggcctaaatccaccactgccccaggtgccacctagttaactctgcatatgggcctatgatcccttcgatcacttttcattactacaatggtgtttgaaactgatggatattaagctggtgcatgtagaatgaagaaaataattaacacattattgattaaaatttaattattaaaaacttgacaaattaatttatttgataattttaatgtaacttttatatagaaagtttgaaaagtgtaataacggaaactgagttaaaatctgtacgtgttaaatatattattcccctttttaaatttatagaagaagttaaatatgaacgttggaaaacgctgaacaagtgaacatatcccgcgatccgcatttgttgcgactcgtttcgatcaactgattctccttcccggccggacatccacatcatcctgcgatcgttcgtttccctagtcgttccaggctttttcagctctactcccctccacccaggcgcaaatcatccgccatggctcccgcctgggtcttgctcgatcgcgtcgtcaagcccgccgtcttcgacgaagaagagagcaaaggtaagggagaatcgaccggcgccccagtgaagtacctgccagccagattaaggcaggaagtccccgccggcatgcgggacgtgaagccctacccagaggttgcggatcctcccattatatctcgcttctccatgctgatttcgcggaaggcgatcagggtagtgaaatccgtccgtgtccggtgcgccgacaagagccttgtcttgttctacgccggcaccggcttccccggcttctcgtcccacggctgccacctgatctacgacgccatcgacggctctctcactgcggtgcacacattcccctttcctgtgtccggagtcgtctgggtcggcagagccgctgtcctgcgccatgccggcggcggaggaggaggaggagacggtactaccgcctcctatgtcatcgccgagctgctcaggccgtttcatggctcccttcccgatgccacgctcgtgatgtggttgtcgaattcccccgcgtcgacctccggcagcaacggccaatgggtgaaggaggacgttcgccttcccggcgaggtgtgcacgggcaccgaccccttcaccaccgacttggtgttctcgttcggtgaatcgtgcctgtgctgggccgatctgttcatgggcatcctgttctgcgaccttgcgacgctgcgtgcacctcggttccgtttcatcccattgcccaaggcttgctccttcgaccccgtcggcaagtatggccggcctcacatgcccgagttccgttccatgggccgcgtcaacggtgtcatcaggttgatcgacatggagggttttaccaacgagtacctggccgtggatgaggtgaagctgaccatctggaccctgtcagccgacctcagcgagtgggagaaaggcccggtgtgtactgtaggagacatttgggccagtgaggaattcgtcgccatggggttgccgcagcttagaccgatgtgccctgtcctgagcatggttgacgaagatgtcgtctgtgtagtcatgactgaagtcgagattgaggagagcgatgtcacagatttcgacgatgagggcaacaagctcaagttcaaggcccagtacgttcttgacatcgacgtgcggcgtaagcgggtgttatccatcacccagcaccacattgaaagtatgggtgatcttataccagatctcatcgcctgtgagttcactgcatactcggagctctcaaaaggcatgcaggtattactactacgacacccaacatacttagttatttactcacttgaagtatattgttctgttaacacaataacactttccacagttctaatgcttggttatcatgtccagtcagttacatcttagtatctcacgagtaacggagtaagtatattaggctagttatcctactgaactgaactctagatagcatatgtgtgtgctaatcagccatcatgattgtctaatgccaaatgacttagctcttttgccatgctacagccctcctcgtccaaaccaggaacgccattttttcattctgttggtacttctaggaactggagaacgctgtcatagttactttcacttcactacaaagttgtgatggcttgtccagtagatgtatccaattgaattcttgattcagaattgatatagacctattttatttaaagatgttacatgtggtaaattcaaactgagcaccaagtcaccagcaaggttctgtaatgaaatttgtgaaaagtgcaatctatccataacgtgtgggcttggttggttttagctattttacttaaatgcctcttagaattgaccttatcagcatgcccttgtgtgagtattgctcattattattttagagagtacagacaaatggggccaatgataggtatgttgcggcgaggcaactacatcatctgaccaaacctgaccataattcttgtcgcagttgtacgaaaatctcttttcttttttacttctgaagtttttttagcgttgtgtgttggaaaagagatttgtctaactaaaattctctatgtaataagtatagaatcgtatcctctataccatagtatatggaaatatcatgtgtaccagtgtaaggccctaactgagttatgttactttccctagctggtactccctccatttcacattataagactttctagtattgcacacattcatatatatgttaatgaatctaaacatatactccctccgttttgaaatgtttgacaccgttgactttttagcacatgtttgaccattcgtctt

SEQ ID NO: 38561 - DNA, 4784 bp, Oryza sativa
taaaattatatgcctacataaaaatatatttaacaatgaatcaaatgataggaaaataattaataattacttaaattttttgaataagacgaacggtcaaacatgtgctaaaaagtcaacggcgtcaaatatgtgtagtagatgtcctaagactatctaggtttctcaatgatgaattttcatttatatatatttggccacatattaatttcctgtctagctctgttaattgtaactttggtatgcactgagggaattattgaagtggattaagaaccattaggccattttaaatttgtctagtttgacatacattaatttgtttctgctaggcaatggtggaaggaaatgagggtgaggaaagcacaaagcggatgaaggttaaatgatctctgcatcatgtggaacttcgatggtttttgcaacatatcaagtaggattaacattgaagattggtgtttgattagcacccatctatgtggaaggatgaatgtgatgtaatcattctctagaagttatgatgttattatcagatggtagtaaaactgaattgctagtgtgttttgttaacgctgatggttttaacattacttcatagctacctttgaattgtctggtcatgccgggctggttgatggctgactccgataagtgatacaagtggtacctgatgatatcttttgtcaaactctagcactccagtcattaactagttgtaaatggaatagtattagtacttatcttaaggcaaaatctcaaaatcgtacagtcttgttcttttatttaaaagaaagaatattctgtgcacaatcttggaactctgtgcggcacaatcttaaaactgtgtgctgtagttttttttttttaaaaaaaagaaaactatgtgctgtaggacgttttgtgtttatatcagactaccaagaaaaagagaagtgaaattttacgcatttccgtgccaatatacccaagttgctacagagtacagaggatactctgactcatactctctacgtccatttgatattttacttagtcaatttttttaacatgtaatcaaatttatagaaaaatatattaatattttcaatataaaacaaacatattatcaaattatatttaatgttaaatttaatgaaactaatttagtgttgtagatgttactaattttttctataaatttagttaaactaaaaaaattttaattaagaaaaaagttagacgttatacagtatgaaatggagagtatctcccaaagttagcacgggaggaagtcaactccaactctccagtgagagccaaaggaggcattttttgaaggcacgatcgactgactggttcgaaacaatgacactactttaggatatttttgttggatcagaggaagtgaaagtttataaaaaaatttcatttgaccatttccaagttgctattgtttggagtgcaccagtttctctataaaatgggctgatcgatctcccaaggttagctttgcaggaagagcttggtcctaccacagagctcgaaaaaaaaagtgctttcgagtagacacgagtcacacgatcgagtgactagcatggccacaatcagaggcaaatttgggatcatcatggttgcgatgatcttggtcgtgcgcatcatcgccttcgcatctgccagtgacaacgacgagctgccggcgttgttcaacatcctgcaacagaagcccgggaaggctgcacaggtcggctccgactgcttcgacgaatgctggagagactgcatcctagggacaccgtttacgagtttgtgcgaccagctatgctatcaaaaatgccttgttggttcccggaagatctgaagcaggcgcttgcattaaggttggtcagatgcatcagtagtgtctgcgctgcgcatctgcgttcagataacagcattgcgatcatttgtttcgtcagtaaattgagtataataatttggcattagcatgcgtcgtctctacgtatacatgagtttgctttagttcgagcattcacaatgtataattccgtatgggtattaaggtggggtccacaatatggataaagcaatgaaaagatctgtgcaatgtatggagcccttccaactctaaaaatgggatccacaaccatataattatttcgtttttttctcttccctatcagtgctctcgttactttgcctgcaacattgtaaaaaagaattgttattttatttggagtgtccgtcctcacgtgaagggccgatttattagggctagggtatgataccgccgcctgcaatgtatagagcgtgtgctacagtgaaaagattctcttagtacccttgttaattcacacattgcaggtgctcttagtaccgcttttttcttcgaggctccaataaatgtttcggctgttcaagccgtcatggtactacctctactatgctgatatcgagcctgttcactttgatatcattttcaaccatactatttttggtaaagttgctaaaaagtgtcttcgtttaatttgttgctaaatttgataaatacataagaaatcttgctaaaattttggtattgccaaaatttggtaaggtttattttggctacaatctgaacaggtccatcgttttgccttcatggatcaataattccctgtgttggacagatatgccttccttttccttgtttatgtcattaattatataataatgtcctgatgtgtgtttgcatttaaccatttaacatgaaagaacacaccgacccgttcatccgcagcaactcctggttggcctttagataacgtatttagagattagtaatgatttaggctccatttaaaagctatgcgacaaacgagagaacgtattttttaagataaaaaaaatactttcccttgattctagacttacaacttgcaaccattatctagctcctttgtgcttctgggcctcgccaaaccagcttatgcctcccgatggtcacggtgaagctatggaatgccaaccacaaaagtagatcaccatcaacttctaactctggcttaatcctcagccaggcgaataggatcgaagttagagtaggtgttgtttgcttcgagagggtggttatggccactctggacgttttggtgtagccgcgggcggagagccctagcttccggcgtcccgcgcgctccccatggatctgaacaaagcgacactctactttcatgaggccactggcccttccgccatggcagaatcatcggagctccgatgataacttgttttgtaaaactacggtcgttattaacgggagagtgaatatggactagatcctgattaatatagggttttttttgagatattatgtatcaggattattaggggcgatcagaaattttgcaaattgctcaaactaaaatcctagctattggtttttagaatacgtaaaagctctgcgtatcttttgtgtcaaggagagaggagttttaaacctttacaaagtattggttgagaaaacaaaggaacacaaaaggaaaggaaaaaaaaagagaagcgtgagccgatatgcgacaagtttggcgatcgataagcgggaggctcctcagatgggcaggccgaccgttgcttcttccgtggccgcacttgctacctctttccacgatttcctctcattattaaacaccatattgttttgttttgttcctttcaaatgtccaggctaccaagatgacaatggtgtcaaagcatctcctatttgctttgtcaaccttcttcctagcgtcgcaccaccactcaatgaagcaagcattgttggaggggaagtaaaggggctgtcaaatggtgtggagcttggatttggggcagtcgagaaggatgtggtcgatggtttctttttgttagtcacagaagacgtaggaggtagggtgtgacagccctcttgtgctcagcatgttcgccatccagcagcgtcggtatgccacaagctaggtgaagtatttgcactttgattgtgccgagctcttaatactagctattagtagctgtagaagattttcaaaatgtcttctacctactattccatctatccaaaccattattatttggattaagatagcaagtaaaattaaatggagggttgaagaagtttgaagttgtcatattttctatcacaaattttaaacgctgtaagtaataaaattattggtagctatcccatttctttcaaaatgcccccggcaaccggcgcttatgcctgtcgccgtctactccgacggccgcctcgtcgccgccatggtccgatccctagcaggcaccgcctctcccctccctcgagctacatgttgccaccacctcacaagaaaaaggacaatatataccactccattcgttgggtttcgataaaatgccatccactacgatgcaaaagataaaatgccactcagtaggttatcttcggtatatttttgccgctttgagaaggcttaagactaaaatacccctgttgtggagagagaggaagtgagatagaagccggacggcggccgtggtcgccggtggcgagcacgcgtggggcgggcggtggaagcctgacggcagtggagaaagaggaagagagaagggagccggacgacggcagtggtcgctagcggcgagtgcgcggggagggggagggacggtggagagagaggaaaggagaggggagccggacggcggccgtagttgccggcggcgagtacacgggaaggtgggggaggggcagtggagagagagagagaggaagggagggggtgccgtacggcggctgtggtcgccggcggtgg

SEQ ID NO: 38562 - DNA, 7913 bp, Oryza sativa
attcctgcaccccttttagttttaagtcttctcgaagtggtaaaatatccccaagataacctactgtcattttattctttacatcgtagtggatgacattttatctaaacccagcgaatagagtggcatattatcctttttctcccacctcactgcctcccgtatcccgaatcctactaccatcctccttttcgtcctatcctctcccagaccatggggatggaagcgccagatctaccggcccctccgaggtacgcgccactcgtcaaactccccttttctttttccagtaccccaagatctgtcaccaccgcctgccgccaagttctaaacaatgcaggattgaggtggagaactgcttctccctctctgaaaatacagggtccatggtggacatgatcaatgtcgcggcacgatgtgcctttttactttgtgcaagtgagatttcatatgatgttggagaacgctacaatttcgcgagcattctgcttcatttcagatacacctgttgctcactgcacaaactcctggtaattcccatggcatctgatgtgttagtagtgtggtatgatgcttcatgaatttatactagtactaatgtgctagtgttagttatagaatgtttattcatcacccggttctttccagaaaatattgtacagcttatacccaatcttatggcttgttttcatctggagtgctcaagcctcaagggacatacatgtattactgctactaccaccacttaacaagttacatactcattttcatctgaatcacaattctaatacttgtttcttatgcccagtcaacactaacttaaaccagttaccagactgaacattagataacaaatgtcccagctcccttatcatactagtggttaatctctcacacgtcatattaacttagaaagatgctttaaatgataaccaagtattacaactggtgcctgatactctgatagaaacctttgttacattctaggactcggataaatgacatcatctattatcaacaagggataactcttctgtagtaggatatggatatccatgtgaggtcatcagagtagcaagttgatggatcatcgccatgatgctattgctgcatacggaagatgacctgatttatctataaatgatgcagtggtgctgatgaccaatgccatctctgcatcagtcaggtccaagtgaaagcgaaaaaaaggcttttcagaagacaagatcaagtgactggacggtcacaatgagagcaaactcgggacttatctttgccgtgatgatcctgataatgtgtggcgcatctgcagcttccagtgacaatgatgagctggtggcaccgttcgacacatccaatggcctgagaacgctgtgaacggccacttgggctgctaccccgggtgcttcagagactgtgttacaaggatgcctgaatgctgttctgtgaggaaatttgctgtcagcatggccgatctccttcggttcacgcatcagtaattcatctatttgcgttcagataacgttgtgaccatttctttcagtagcagtagcttgcgtcgctctccgcatgagtaatcttaagtctttggcaattcactgtaatatatactaatatgctcttccgcggggtcccccattttaattcttcaagccggcgaggtgtgtaatagattgggatggcctatggccgtgatctaagggcagttgatgtttgtgaattcagactgttcctgtcgatgtcatggaacgcattgtggacttgtgcttggttgtatgaggtgatgtttgattcactagcagtcactgttggttagatgcaaaaggataaatggcgtcttgcattgctgaccccttactggttgcagtccagatgtaaaaaaaaaaatgcagatgaacttagaagaccttggacaaggataccaaactttaatacccatgtgtgtcaattactccattctgatctgaagattgactttgcagtttgcaatcttgctaaactgaagatagctgtaagtatggtgaaagaaaaacaaaagctaaaaaaaagatgttgtccggactgccatgtgcattgtattctacaaggcggtttttgcagggagataatagaggtgcacacaactcgagtattctgaactctcgcatatgatgcaagtggcattcgcgagttacttagtgcgatgaccacagatctcgaaccaatgatccattttctttttataactatgatccaatgatctgcaaccatagatgtattcccatgttacctgatacaataagatgtgtcagttcatctatataagacatctacagtagtaagacgaaagggagccaacttctgtagaacagtattagagagggtcagtattgctcatacaacttgtcctatatggccgtcactacaacgggatcaaaggccatcgcggtcgccttcttgtgcatcgcctgcttcgcccttgcagcgggcgccgccgccgacgcgccgcggtggcttcacatcaatgccgcgcgcgtcggcacgagctgcatggagtgcgtcctctcctgcatctccggcgggggcctactcgacgtgtgccgttctctctgcgaggatttatgcgatgatccagaagccttcacagtcgtaggtagcagaagcagtagtcactgaaacatcgaatggcccatctctgccagtattcagattgccgtcgcagtatcctcaggtccatcttaacttgccagctctgtccgctattactggttttggatcctggatgaatgaagtgatgtatttgctggttctcctgtttatgcactgtcgcatcatggccgtgatgtatcatgtatgtgccctgttcgatgtgtgtgtttgactgacaatgctagatttgccgagccaaagatgcctccgacttgaccctctagaaaggcagaaaccaatttgtcactacagatctgcaggcgctgcatgctagcagcaccgtaatttacagataaaaaaaatatgtgttcaacctttctcaaatcactacagagtctgtaactgcttggctgatcagtttggatgcacggactcaagtcaatcaacatccattctgatcccagcgacagagccactacttggctgatcaggcaatttactcttgtgtttcaatagttgtaagaatcgatctactagtatcattacctggtcgagattcgagagacacgatgaataaatacgtagtacggcatagtgctcgaggccaggtagcagttgttcgacctgtgcggatagtttcttcagaaagagaatccaagaaacaggcatattcgcaggcgcatcgttgccaaccgcccggaacaaacgtcaatcaagtttgtcctacgaacgcttcactcctcgcctccccgctccgcgttcttgcggtggattcgcatcttgtgaaatgcgaatccaaccgaaggagaatcggttctacaaatgttcgctttcgcctgaatccaccacaattgcgtgcatgcccaactcgaattctacgaggaatcggaatcatgaacctctcaaccacgattacttgtcagttgtcaccaggcagataacaagcacatgcgtgtaacacctcaaaaacagattctgaaatgcgaattccaaagccaagtggctacctgtacatcgcaatcaccaggtcggttcaatgttagcagtgtgatcacgcattcacatatatgagacccgtgaggccgtgacaaacatactgaacatatgttggaaatatggtcataaatcgatatattttaatccaaaatgttaagacaataatcatgatataaacagtgtagtgtgatccaatgacaacatgtaacattactagtagcatactaaagacatcatgaacaacattatgaatatcaggaataagaacatagcagtaacgcagtaacatgctagaggcatcatgaatatcaggaacaggaacatagcaataaagcgctaacaacgagaacaggaacaggagaaggatataccctgagaatggccctccgctggattgtgaggcagaactgcctccgttggcattgttgttcgcggcaccggctccagctcctggcgcaccacctccagctccagctccaggtggcgcaccacttccgccatctcctccagcagcagcagcggcgccagctccaggcgcagacatggtgggcgaggacgaggacgagcagtcgtgcgggaagcactccccaaaaacctgatcacctgcctacccggtacgcagatctcaggcgaaggtgtggttccggaggccctgctccttccgatctctcgtgcacgcaagcgatcagaagcgaggaggcgagagcagcacaggcgcggaggaggaggaactaacacccgggaaagaaacagcacaggcgcggaggagaaggaactaacacccgggaaagaagcaagcggatcgttctgatcggactcacggcctccttatctatcaggagagaggcagtcatgggaacgtgggatcatggacgcgctgttgtggaggcagtcgatcggactcacggcctccttatctatcaggagagaggcagtcgtgggaacgtgggatcgtggacgcgctgttgcggaggcagtcgtgggaacgtggattagtggttgcaaaagagtagcgacgtgacgcacgcacgccagccacgcctcgccctcggcctcggcccggtccggcgcgcttgcgcgtgtggctttccgacccccacctcaaccagtcaacagggagcctccaataactccctatttaggttgagatattcctcgcttaaatcctgaggtggtattattatccttaacacttattatgggcctttgagatttaataggataaattgggcctagcccatttattctaacaatccccaccaaatttcaaggcttataagaaatgttctcaaggttgtgcctgtttgatataccagggttttggtggagactgttaagttgaacttccacctaggaaatgagctacatcagaccacaactgaacaatggactatgccttgaattgtcagttttgtgtgatctggtttcactcagacccttgactggtactgggctgccgttcgcatcccctctgtttggagcatataagtcaaactccaggcctttcatgagtatctagagatcgcccaaacctcatagactgtgactagcagtcgaactcatataggtgtgttccttctgagatgttctgcaggtcaacatctctgcttggaaaagccactcggatcacattaaggcatgagccatcttaccatgcaggaaagaagagaagtacatcatgaaaatgagcccttttcaagggtctcttctctcagtcacataatagtttgtttcgccatccaaattcacgggatctccgatcacaatggacaggtttccactattgtgcgaccttaggtgggtatcaagcccatttccctcgatgcactgtctatcacattacgtggtagccccttggtaaactgatctgccagatttctagccgtttggacatagtccaatgctatcactccggagtttttctgctttctgacagatttcagtcttctcttgatatgcttagatgacttcatgttgtcctttgaactgttcactttaataatcactgtttgattatcacaattcattaggatagctggcactggtttttcaactaccggcaaatccatcaggagttcacgaagccactcggcctcaactgtcgcagtatctagtgctgtaagttctgcttccattgttgacctcgttaagatggtctgcttgcaagacttccaggaaacagcgccacctccaagtgtgaacacatatccactcatggcttttatctcatcagcatcagatatccagtttgagtcactatacccttctagtacttttggatacccggtatagtgaattctatagctcatagtgccctttagatagcgcattactctttccagagcctgccaatgatcatctcccggatttgagacaaaccggctcatcttgcttacagcaaatgagatgtcaggcctcgttgcactagccaagtacatcaatgaaccaatgatttgagagtatctcagttgatcctttgctattcttcggtttttccttaatagcacactgggatcataaggagtaggagctggcttgcagtcactatatccaaagcgactcaaaaccttgtccacatagtgggattgcacaagtgaatcccaccctcatatcctctttgtagtttgatgttaagaataacatcagcctctcccaaatccttcatttcaaaactcttggacagatagtccttgacctcctcaatcacattgaggctggtcccaaagatcaatatgtcatcgacatataagcacaagatcactccttctcccccaccatagcaatagtacacacatttgtcagcttcgttcataacaaagcctgcagatgtaagcgtggtgtcaaacttctcatgccattgcttaggtgcttgcttgaggccatacaaggatttcaacagtttacacacaattccctcctaaccttctattacatacctgtctggttgatccatatagatctcctcctccagctctccgtttaggaaagctgtcttaacgtccatctgatggacgagaagatcatgagaggctgccagagcaagtagtactcgaatcgtgatcaagcgagcaactggtgagtatgtgtcaaaaaagtcctcgccttccttttgggtataacccttggccacaagtcttgccttgtacttttcaattgtaccatcaggcctaagctttttcttgaaaacccatttgcatcctacgggcttgcacccatatggacgctcaacgacttcccaagtaccattagacatcatcgagtccatttcactgtgtactgcttccttccagtagtcagcgtcaggagatgaatatgtctcttctatggttcttggggtgtcatccacgaggtatacaatgtagtcatctccaaaggattttgcaaccctttgtctcttactcttgcgagtatctacaatgttgtcctcctcaggattttcctcaggcgtttgatcattgtgttctatcggtgcaaagtgctcatgggcatgacagtttcttgactagaggtgctaggtgtatgtttcatgggaaattcattctcaaagaatgtagcatctctgaactcaaaaattgtaccaacatgcatgtcgggtactccagagtttactattaagaatctataacccataatgtgaatagcataaccaaggaacacacaatcaacagtgtttagtccaagtttccgctttttggctataggtacatttaccttggccaaacagcctcatgttcgtaggtatgagagatttaatttcttcctttctcattcctcgaatggtgttacttccttatgcttcattggaattttattcaggacatgacacgcagtcaaaactgcctcaccccaccattccttggaaagccccgcagtgtctaacatggcattcaccatctcagttagagtacggttctttctttcagccaccccatttgattggggtgaatagggaggcgtcctctcatgaataattccaaactcttcgcaaaaggatgcaaattcattggaaaaatactccccacctatatcagacctcaaccgtttgattttcctttcaagttggttttctacctcagctttatagatcttaaagtaatgcaatgcttcatcctttgttttcaatagatacacataacaaaatctagtgcaatcatctatcagtgtcatgaaatatttctttccccctttagtcaacacgccgttcatttcgtacaaatcggaatgaataagttctagaggtgccaaattcctcgcctcagatgccttgtgaggcttgcaaggttgtttcg

SEQ ID NO: 38563 - DNA, 1485 bp, Oryza sativa
taggttagacatcaggcttgactttcttgttgttgcgggatgcatgacggttcttcttctgtaccatattggcactacaacctccctcaacctttttgccccggacgtcctttgccctaaccttctcctaaacacccaaagagtcaatgagatcagaaacactgaactcttgtctcttgtgctttagaaaagtggcaaagtccgaccaagaaggtggcagtttggcaataatgccacctgccacaaacttgtccggcaactcacagttgttgttctcaagttccttagccagcatctgaatctcatgagtttgttctactacagaacggtcatcgaccatcttgtagtcatagaactgctctatgacatacagctcactgccggcgtcagaaactccgaacttggcctcaagtgcatcccacatgtccttcccagaaggcatgtgcatatacacgtccactatgttgtcagtaagtacactgatcaatgctccacggaacagataatccgaagcctcgaacttagcctcttcctcaggagaaagaggtggttcacttcgtttgccccgtgaaacatagaagcattgcatcgctgtcaaccacaatagtgcacgtgctttccatctcttataattagaaccatcaaaagcatgtggtttcagtgcagcagcaaagccaactaccgaaaatgacctatcaggtttttggattgttggaaatatggtcataaatcggcatattttaatccaaaatgttaagacaataatcatggcataaacagtgtagggtgatctagtgacagcatgtaacattaccagtagcatactaaaggcatcatgaacaacattatgaatatcaggaagaagaacatagcagtaacgcggtagcatgctagaggcatcatgaatatcaggaacaggaacatagcaataaagcgctaacaacaagaacaggaataggagaaggatataccctgagaatggccctccgctggattgtgaggcagaactgcctccgttggtgttgttgttcgcggcaccggctccagctcctggtgcaccacctccagcagcagctccaggtggcgcaccatctccgccatctcctccagcagcagcagcggcaccggctccaggcgcagacatggtgggcgaggacgaggacgagcagtcgtgcgggaagcactccccaaaaacctgatcacccgcctacccggtgcgcagatctcaggagaaggtgtggttccggaggccctgctccttccgatctctcgtacgcacaagcgatcagaagcgaagaggcgagagcagcacaagcgcggaggaggaggaactaacacccgggaaagaagcaagcggatcgttctgatcggactcacggcctccttatctatcggatcgttttgatcggactcacggcctccttatctattaggagagaggcagtcatgggaacgtgggatcgtggacgcgtccttatggggggc

SEQ ID NO: 38564 - DNA, 5367 bp, Oryza sativa
  unsure (1)..(5367): unsure at all n locations
aagcaagcggatcgttctgatcggactcacggcctccttatctatcggatcgttctgatcggactcacggcctccttatctattaggagagaggcagtcgtgggaacgtgggaggcagtcgtgggaacgtgagatcgtgggcggtgcgcagatctcaggagaaggtgtggttccggaggccctgctccttccgatctctcgtgcgcgcaagcgatcagaagcgaagaggcgagagcagcacaagcgcggaggaggaggaactaacacccgggaaagaagcaagcggatcgttctgatcggactcacggcctccttatctattaggagagaggcagtcgtgggaacgtgggatcgtggacgcgtccttatctatcagtcgtaggaacgttctgatcggactcacggcctccttatctatcggatcgttctgatcggactcacggcgcgtccttatctatcggcctccttatctattaggagagaggcagtcgtggaaacgtgggatcgtggacgcgtccttatctatcagtcgtaggaacgtgggatcgtggacgcgctgttgcggaggaacgtgggttagtggttgcaaaagagtagcgacgtgatgtgacgcacgccacgcctctccctcggcccggcgcgcgcgcgtgtggctttccaacccccacctcaaccagtcaacagggagcctccaataactccctatttaggttgagatattcctcgcttaaatcctgaggtggtattattattcttaacacttattatgggcatctgagattcaataggataaattgggcatagcccatttattctaacaacatataggagagagtttggtgaacagcaatcaccaactgcatccggtgactcacacatgacttccctttgattacttggctacgagaacgtcctttggttaaactaaaagtctggtaaagctggtcaagtagcgttgttcgtccagcttgccgacattaccacgtaaccgaaaggtaacacgaatcggacctcgtgctaacactgcaattaagctttctctaaaacaaagcatccaaggaaggtggtaccttcccttcactaatctatttggcaggctgatgactcggagaactgaagcaaaagtagcccgtccgtgtcgctgtcctcctagattgtggaggttccagcggcctgcttatccccagaatcattcgtaacctgggctcgtatctgattccttgatagagatcctgagtgtcgcggactcgcggtgtgcagtactggattactggtagtgatgcagtgaggagtctccccgccgtccccggaatcattggtaaacctggcacgtatctgattccttaatcagaatggagttttgcttgagtgctggactagtggtactgtgtcgtgggctagtataccgtgtataagttaaacaatttcaactttaactattaatagtgaaaaataaaaaataataatcacgtaaaattgatgttactagatttgtcattaaaaaaaactatcgtaatatgtaactctttttcttaaaacatcttacttctatatagatattgttagtcaaagtagcatattagagatcgtgttgagtctatattttaagacggaggaagtagtagttttgtttgagtgctggagtagtggtactgtgtcgtgggctagtgtaccgtgtaaaccggcaaaacgccgcaccgtaaaacaagcgcacatgggtaccggccacgggctctggggctcgtggcagtcgtgggtgggttggggggacacggcgcgcgacggcgccacatgcgcggcagcgcggccacccgccgaaccgcgcgcggggcggagagggatcgagagggtgagggtgagaaccgcgcgcggcgccccaccgtgcggggcgttgttgtcccgtgcgccgtctcccacctcggtttcaccgcgggatctcgcgggcgcaccggtgtttgcgcgaccgtacccccacccacatggcgcggctgctgtgctggtgccgctgcgcgcgcggcacatgtgccaccgctccatgcccgcgcgttctcgtcggctcacgtggccgcgtcgggttggacacgcgtaggctgccgtctctctcagagcaacccgggcacatgcggacgcggggggacgcacttctccatgtgtccgccggccgtacgcgaggcccaagggccaacgccactcctcccgcggtcccgcgacgccaccaatcgtgccgcgtcgccgtcgccgctgcaatttcgtttcgggaattcttggagattggcaccgacccggatcaggggcggcgacgcgatcgcgcggtgccattatgcccgttttattggcttgtttcgatatactactccgtattaaaaagaaaaagaaaaccctggtctcaccgagatctatatgcatgtttctctgaaagtctgaagttaatcacgcgcccaaaatctcggagttactattggccaagagagggctcgtccaatcgtccttgctgcaggcacgtgcttttcgtacatcagttacaaggaacacagcaattccaatcctttcacatgcatctatgcaagcgtaccacacagatggccgccgaagcatggaaaatggacgcctctaactccggaagaaatgtcacattgatacgaactgggctagcctgaaagattcacaacctggtacagctaacttaataacaagctgcaggacgatcgaagaaaacttgggggaaaaaggcatgtgctgaaaggacaacatcatttccatagatccactgttggatacttaaacggctttaattatgagatttagattctagatctctcctatcagctgctccatggcctcccttcacagctaagaaagccgtgaatttttaggatctatactagctactataccacttccaatttcacatgactagctcctgtattttcagttgagtcttactggtatttcttttccgtccatcctatctactctctctgtttctagttttacgatattgtttagttcattttaaactaatcaacatcaaagagaataaatagagagtatattctgtactcaggattcgtttcatcagctcgtaacaatcttaccccttttgtcttccgtcactcacgtttcagctaatttttcgtagtaacagtgtccatagaacctccgcatatctactgctcctagtctcctactacagtgaacgtaccccaattcccagatgatggagtttccactttccaaagagagtgaactagcttaaccttgtttttgccttgacagcttaggccctgtttacttcacttcacaaacaatctatgtcacatcgaatgtttcgacacatacataaagtattaaatatagattaaaaaaattaattacacaaattacgtgtaatttgcgagataaatcttttaaacctaattgctacatgatttgacaatgtagtgctacaataaacatttactaatgatagattaattagacttaataaattcatctcgcagttttcagacagaatctgtaatttgttttgttattaggatgtatttagttcacgctaaaattggaagtttgattgaaattggaacgatgtgatggaaaagttaagtttgtgtgtgtaggaaagttttaatgtgatggaaaagttagaagtttaaagaaaaagttgggaattaaaccatacattagcctacgtttaatactttaaatatatatccgtatatgtaatgtggcatgaaaaaaaaaattgttcccgaactaaacaggctctcatttacggctaattattctttcagtggtaggcgacgtacccgtcgacagcgaggcgtctgtggtgacttcatcaatttcaagatatgccagcccagtcttccggaggtgcttatagggatagggtatacatgtgtgagttcataggggtgagtgtgcgcacgttatgagcataagtcggtgattcaccatccaggcagtggcttggatggcaagcaagaaggcaagcggtggaactgggccatcactgacacagtgacgcgccttaaccggtaacgcggcccccacggttcggtgggagcggaccagtcgcgtggatcggccatcatcatcctgatatcgctcgcgtgcgtgcaagctgtgcgtggcaggtgtgaatcagatccccgcgtgttgtattccgtctccacctagaagcgtacgtacgcggtgtgtgtataacgcgagcggccagtcggtggtgctgcctttgcctgcgtattttgcgatcgtttcgtgaaggccgcggcttttctctttaatcggttactccgagttggggttgcagccacaagaagtagaaacgaacgtgtacctgttcagctatacaaagtaaacgataacaaaattctaatttgctacttaccaggatgtgctatttagggtttgtatttatggtcatgttagcttaaggtaataaacaagaggaagagagcataatagcagaacctctattttccctacttatatctataaattacatgtaaacactccactggtntggcaaacaaggtagcagctgaacacaagaaagaacaatctgaaaagggaaaagtgggtgacaggtggccaccagggatgggccagtgaagctgtctctcttccccaatcgagccgctttcccctgtccgaacgctacaaaaactttccacacgccaccctctcccataccaccacatctcccaaagaattccccgttccaggcagccgagttcggtccaaagtccaaccccgcgactgcatacaattccactcgcccagtcctctcccgcgaccgccatttgactcgcagggagccaacgccgaaaccgcgccaatcttttgcccccattttagacgggcgctgactgagccaaacccaacccaacccaacccccccgcccggcgcggccacctcacaagggagcatcggcacagccaaccgcagcgcagcggcagccaaaaacccaccgtttccaattcctcgcccgattttgaaccgctctccgcccgaccgaacctgttccactccgccgagcggaaaaaaaaaacttcttcgccgtctcgaaggaaatttattgggaagaaaccgttgcgggaggcgggcaaactgaagcggcagcggcagcggcagaggcgatggagcggtaccatccctccgaggtgtatgagctcttcgtgcggcacatgaacaccccgaggtaagggttctcgttgctgttgctgttgtggtgtgttccggtttgggatcatcgatcgaacgggtggtgagggtgctgttgttgttgcgcgcgggcgcggtgtggtacagggtggtggtggacagcggggtgtgcgcgacggcgacgctggtgcaggtgcaca

SEQ ID NO: 38565 - DNA, 9153 bp, Oryza sativa
  unsure (1)..(9153): unsure at all n locations
acgggcgcgccgatcgacgacgcggcccgggtcaggcgcatcgagtcccgcctcaggcacgtcctccgcggcggcgcgcgctgcgcgaggacggtcctggctgatccgtcggcggccggaaacctggaccggaggctccaccagctgctgaaagaggacggggaggccgacagccgcggcgccgcgccgatgacggcggtggcggtgcaggattggggggagagagggtactcggtggtgaccgtgagctgccgcgacaggccgaagctgctcttcgacgtggtctgcaccttgacggacttggattacgtggtgtaccacggcacgttcgacaccgacggcgatcacgcgcagcaggtgagccttccagctgtttctccccatcatccagctttcaagatttgttttggttggtccaatttccccaagtctcattgttaattttgggttcggtgttaccaattcccctctactctgttcttctctttggttgagctggcttcctctcacgaatctagatgtttctttgggtggttgtgttaggcgaatcgtcttctgtcatttttttcccaaattcttttacctcgcttttgctttctaatgacgtttaccgtttcccttctttttttgtttgatttcactgctattcctatgtcggccccatcgtcgatggaaattatgatttcgaatttggtgaggctgatggaatagttgctatttgcctcgtgtgttctgcttcgcgatgttggattaaaagttgcattttttttgggtatacatgtgtactagcttaacctgagctatgtttgcttggcttcaccgcttgcaggagttctacatacggcgttcggacgggcggccaatcagctcggaggccgagaggcagcatgtgatccgatgcttgcaagcggcaatcgagaggcgcgcatccgaggtacgtgatggagtagcagtagtatctcctttgctttccctccatgccacgccaccgatcgcggccgtgctgtgctgtgcccacttcgcagcaccaagccgcgaagtcactttcgttcttgcccgactttccactacaccccccatgtgttcggccgaaatcccagccagcgcgcgcggtgcccgtccgtctgacgcgatcttttttctgtgtgcagggcgtgcggctcgagctccgcatctccgaccgccgcgggctgctcgcctacgtgacgcgcgtgttccgggagaacggcctctcggtgacgcacgccgagatcacgacaagggacgacatggccatgaacgtcttccacgtcaccgacgtggccggccgccccgccgatcccaagacgatcgacgaggtgatacagaggatcggcacggagagcctccgggtggacgaggagcggtggccgcgcctttgctcggcggaaggcgacgccgccggccgcggcggcggcggcgggctgttctcgctggggagcctcgtcaagaagaacctcttcagccttggcctcataagatcctgctcgtgagtacagatgacgtgtccgatccgatggcatgcttgtgtaaatatgggggcggtccatgggttagtttgtaaattgagtagatttttttatgctctttttttaggatttattagttgtcacgtgtatatagtagaaatgaaaaaggctgcttgtcggtaattaacagcttggaggtttaaagggacgcgttggtgggtcatgcatcttttacatggaaatagacagatagaagatgaatgtaaatagggtttgtacataagtgctacttaatgatgtttaactaaaaggaactatcatgtttgacctgcaaatgcaactagtgtcaattctcatttgatcccttcaggcacctgttgtatgcaatgcaaatgggggcatgttttctgtgaactgtttttgcctgattgttataggagcctagtaactggtgtattagcggcccataaatattaacgtaactcattccacacacgcaatctttacatatcctgtggcaactgaataatttacttttatcactgctgattgtaattgtaaccacttgtttacaagttgtccaaaagcgctgccatgtggccagacaagagaaatccgagaacactaaaaatattaccaactagaatcatctaaagtctaaattaaacgagtgaggcaacaagaacgattaatcaacggaatatgacagccgattcaacatgcttaggttgaactaaagaactgtgctccaatcctcatccatgtcaaaaaccctttgtacgaacgtcgctttaccacgaagaagtaaccgttttcaatgtatttgccgacaaagcttcactgtccatgcgtataaaaccatttgacattgctacagcctcattaaaaagtcgttttgagagagtccaatggccacttaggtgtccatgcgtgacatatgtgctcacggcttttgtccccgtgaaaagaaacaacaattaaagagggggaaaatatcacaattgctcacacctcgcatcaccgcgcgcggcttaagtatttaaccacgtactcgcacggaccgggcggtgccttgctatcatcgttggaattatggccgtttctcctcttatcaacgcaccaggatgcacacgaagtccgtgggtttaattccttgcgcgacgaggacgacgctgacgctcgcttagaatttttaaccggaccatgtcacgccgtgcggaacgaaccggcttaccggtttctgaacgttctttgcctgcaggttttattacgaagcgatcgaggagaaacccaacaactgccgacctaccgccaactgccaccgatcgaatcgagctgaaccaaaccgaggcgtgtgcatgccttggtgccaacgaaacgtcgagacgatacgatctcggttttgctttcggggcagctgtgcgtggtagtagctcaacggaagaaaacgacctgtaacctttttagtttccgtttccctcttttccgtcggagatgggcatgatgtaggtagctcaagttcgtaccaaaacttaattggggattgatttttgggggtgagccgtagggttccttgtcacgtgaatcctccaaggacgacgggtggatgtagcgtccatagggagcaaaacgtgcgggaaaccgccacggattagccgatttatgatcgaagctagccaagttggcaatttggtgaaatgacgatttgcgagctcgatcagaatcagccggtaagaagactgaaaaaatgaaaagaaaaatcatgaccggactcgaagctcgaattcattgcaagtttatccggacgtgaagcattgggcgaagaacaatgaatagcagtagatggcaatgctgctcatcagggtcccctttccttctgcttgtgttttctgggcccggatctcagctggtccaaccagcctttctgctactccaattgctgcaggggtttggtctggactatgtcggtattgttgcgtgccgcgtgctagacctactcctaccaatctgcatatcgaaacggcatcgttttcagaggacgacccttttcctggcttcgatctcgacaatgaaactagagctgctggcgtcctgtctggccccaagagtgtacatactcacaaatacttttttttctttctgttagtgccttaaaaatgacagctccagttggcaagaactgtcaagtgcctggcaagcaaggtagacggctagacgcttccctctgcctcgacccttgcccgtctggacgaccaaggtaatggcccccagcatcggattccttcatacagcttgggttgctgatcaatcactggatcaactgcatgtcctgattgctttatgctgtactcctgtagagccatcaggtagaactgtacaagttactacaggaacagcgatagtacttgaagttgacagtactttcatggttgcaaggtctgtaatgcggcaatggctaatcactgcataaattgattaacatagtgcaggaaaaaaaatgaaacgaggcaacaactggatccatgcatttcgtgctgcaaaagaatggttcttcccctgctccacaatccctaggagggcagggagaagactatacagtgaggtaatatgtggttctgtacaaatgaatttgcggcgtttgccagttttggtgaagtttgtgacgtggttcacacagatatttacaaccatgcacaaacatacgtatctgagagcttttcagtctaaacagggtcactgcttctaggaattattcttacaggaaggccgactggcgtggggtcattagtatcagatgtgccatgtcgagcatcttcatccttctgcgggagatcagcaaaaggaagattcaacccttcctcaatgtcagagtcgtccatataccttgtagtggacaaatcttgaggtcttctccagctgctgctacttctgttatagcttcgctcaagctcttccacacttccatcagacacatcaccagagtgataactggaacggttaccagcaacatatcgatttccaaattccggaggctccagaaaacttccttgttgaccagtagaatgttcaggtgcttgatcccaccaatcgataatatttcctttggtatcatggtgttctactggagcatgatgaaacaaattgcttgatgtcgatgcatccatatggcttcgaaccctttcatggttaaagttccactcatcgcgatctgctcgaggcgggggaaccatatcagagtcccagccccttgcttcttcaatttcagatgctttaaatgctgctgaacctgtgttctcactggtctcagggaacacttcgttgaaataaggagcctcggttctatccaagtgaggtggatggcagacgtagtaccaatccagaatatatggatgacttctttgatctgtgtcaagcaatcctaacgggcccaaattgtaaacagcaggtgagatggcctcagcacggttatggatatcactagggagtagttggtggaagatatcatccctgtgacctctggtgcttgccacaaagcctgatgcttccattgcttgatattgtgcaagagcctgctgccgtatttgcttttccttgaacttttggaggttagttaagaattgtttgccttctgcatttggttcccatgatggatacacactttgaaaactgtaaacaatcatataatagaattagacctatttttagcattaaaccttgggctgagctagcttgtattaagctaggccatttgtatcttcgaattttgcaattggtaacaaccaattacaagggcgttgtgtcctacgcctggatctacccttggctgcaacacttgtgactaactaaaacctcctaactatacatagtacaaagtggccagtatccattaggcctgtaggacaacagcagggcacattgcatacagttggaagttgggtggatagctaatctagtccctaaagttccaccagaggctcaatttggtcctttaagttctattttgtccacacaggtcctctaagtattcgttttggttcgaaatcatacttgcacccacttgattagccaataataagtcaacatttctattacaaaatatcccttatctaagagaactcattgtacacaaatttcaacagaaaaaaaaaaacagcacacaaccattgggtattggaggggtcttgagaaacaggttcactggccaaatagtacatatttgtctttttcttttcctttttcttatacatgtgaaattagggaataatagtcatttatcaagagagatgctaattagatttagctatatgtcttcacaagtgggtccaacgatgagtttgaactaaaatgaaaacatgaaggactaatggtctaatatggacggactgaaacgtcaaggaccaaattaagcctcaagtgaaacttggagtacaactttgcttattctgttattcactcttgaaaatgcaatgtacatggtggactaaagtactaaaccaaaaatggatgtcgctttcttggaatatgatgtgacgagggcagcaccgtagtgcctatattctacagagtctatagtgctgacaagaagacacccaaaaaagtatcatggtcaagtgttcagctttggccatatttatggacaaaacagtatactcaaataatactctggtaaattcaattaaatgctggaaacacatttgttgtgattttctgagaaatattttcatcatatatccatagttaatgttgacttgtacagtctagaccatatgcactatgctgttgacatgggcaaactacatagacaaactaacacatttcctcgtaaaatgttcatagaactaaaatacccccctagtttgaacaagagtatgaaataacaatagcgtgcaaatcataccacagtacaacctcagagccaagaactactaaagtacaccaaagccatttcaataaacaaatgatggcccttaagatatctttttaataacaatatgagtacaatataatagctagtaagaaacacatgaagtaattcaaacttgaaattaaatgtaccttaaaaatgatttctccattttcccttgggagctcctaagcgttttaagtgcatcaaatggtgaagcatagtttctatttccatgtcttctgaagtcaaacaagcttaggctattgaaacacagagaataaatgatgttaaatgttttaaaaacccagtggcaatatatgataacaaaattcatttcttaagaaacatcaagagagaacctgcacacatctcccaccccatctacataaatcgtgaagtctgagatgaatcgcagaatatcatcaacacgctgtataataaaaggagttcactgtcaaagaactttagaaaaaacactgttgttgagcaagttcagaacattacctttggtacctcaaagatgagcaagtaaggagagatgaaaatggaggccatctcttcaagcagcattactatggtaaactgcatttgtaaaattacttagttaaaattcagagcaatatgatatggacaatagagtattaaacgtaaatcaaccaagatacaaatgtaaggtactgatatctagactgcaaagcacttaaacaaagagaaactcattttcttttcatcttcagatatagcgctttaactgaaagcaatataaaacaactagaaaatgccaagctttgtcattagttctatcagagaatttgaacactattatttccagattcacctagcaaaataagcaagtgagactcatttaaaatgcaactgctgaatcacccagtggccacgaacaactttaatatcaaatgagtttacgattgtcagcgttactgcgatgtaacttagttgggccgtcactttttcatgtacttctctaaggtgggcattgcacttgtacaattttgttgaataacattctgttgagatcaacatacaacctttcatagttctctcaataaagaaagacnnnnnnnnnnnnnnnnnnnnnnnnnnnnnnntggtgacattccaaagccaaattgtacagcacataggacaagtaagtatgttgattagttgattcagtacggtatatgcacattgcacaattctctcagtcaactctttgcaaaccacctttttttcgtgtacttttgtgtgcgcaccttgcatttgtacaattttgttcaaataagattatgtggacatcagcccagagcatttgcgcagttctttcaatgacaaaaaaataaagagcagaatcacaaataactagaaaatttgatgatggtgatggttgaagttccaaagccaagtagtacagtatacagaacactaaatatctaattgattatatatggtatatgcaaaattctctcgaactgataaaatacctgaaatagtgtttcgaattctcttcgcaccacttcactgtcctctttaccacgccacctcttaggcatataatgcgtttgttggacaacattgcacatagcgccttctgggtcaattacttgaagttcatcagccactacttttcgacttatggcagctattgttccaaaaacaatagtataccagaatagatttcttccaaagatcttcagaagatatgaatgtatgtgagatttagtaggtcaataagacatgtgtaaatgtgtaatagcaaatgagaaaaagtggaagaaataacttacatggccctcaagaacagattcacccagaaatccaatgattataagagcaccagccaaaccaccagaaacaaaagatatgaattttgccattatagaaatcagtggagttggaaattgcttcaggtaatttaaagagtgcacagcgctgttgttcatcctatgtctgaagaaatgatctacctgaaattattgtaagcaactgagctttagacgaagaaaaacaaggctgattgcatagcatgatagtatctataggcctcaacaaatggcagagcttgcagttaatataatacagtaagcacatggcaggcatttagaagaaatactggacaggacaatgactgcatcataatagtaataatatctctgcaaaagaaggtacctcattatactctctaaaaatccaccttgataagtttgaccatcttctagatgaagctgtactggggtgattataaatttcttcagcatgtctcagaatgaggtacactaatgggaatattacaaggcagggtgaaaggataagcattgaaatgcccacaaatacaagtcgcttctttaacacagctgggcttgttagaaaatctttccgaacacagaatttactgcagaagaaaatgatattggctttcagtatagttttagaggttaaaactacacacacaaaaaaatcgtggaacatcccaatgcgatgtgcgagctcttgctagaaggtttcagcggatgttgtacaaactggaagctgggagggtatcttagcacaaatacgtctttaggtgctattgtgcaaaatccacataagagctgtttgatgggaatagatgggggtgaagaaaagcatccagcttttacacagattgaatatctaaattactcgatatctctatgaagtcatcagaaaatcagtaaagcagtannnnnnnnnnnnnnnnnnnnnnnnnnnnnnnnnnnnnnnnnnnnnnnnnnnnnnnnn

SEQ ID NO: 38566 - DNA, 5608 bp, Oryza sativa
atgtgacgccagatcacgccaataagcagaaaaggcggcatgacgaagttaactgacagatctgcatgagagaaaattcatgattaaacggttaagatagtttaaggccataagggcattgctcataggatggtaatttcatcaacaataaacacgtgtatagcagaggaaatgatgacacataactcattgcaatcctgcaaatacagaaaaaaaaagtgagaaaaacttaaggcaaccccttcaaaatctatcaaatttatatgcttaatgcaaacagaaatctagcttatcaaaggggggaatcacgaatgcttaccagaatagccttttgataaaattacacagaatgcattccatgaagaactatagtgaacttgtagatttagaacataaaagttatttgcaataatttgcataacagtagtcctccaaaaccattatgcttcagacgttaatatatatatatatatatatatatatatatatatatatatatatatatatatatatatatcagcatttgaaaagattaaatgaaatatgaaaagaaccttgcctgaccatacagaattgaatatataaaacaaacagaagaaaatgttcctgaagcatttgacatggacactcaaccattccttgagctttgacaaataatatttaacatcttaacgctcaatgaatattgtagatagtagaatttataacatgaaaaaagggacttggcaaaagaagataaaaacactaagatctatttaatgtttgaataataaataattatgtatttcatgtggcatcacaatgaaggatttatactgtcatagtaaacatccacccagtcaatcagtctaatgcagaagggtacctaatacaaaacaaaacaacgttcatctttcacacatacacttgtagcaccaaaattaaaccagtaaaccacatataacaccatgaaatttgagaatatacatcatgcatagtcaataccatgtcattaaaaagtgatgttcaataggctcgcaaagaacagttgcagttttcttgcacaaatgatatgtactagaataaacaagagggaagtgaacaatttttaggtatgaacagggataatgtttttcacagttaatggtaataataactaatacactagatgcaattgaacaggaaagatgacaaagattcctcttgcaaagtaaagagacagcatgttattgtgtgcaaaaccttgcattaaatttacaaaatgcacatgcacattcgtgcccacacgcacgtgagagagagagagggagggtgagagttctacaaaacattaagttatgactaaatagctaatcaagaacagaaccaaagttatattgtcttgtaacaagatggaaacccacacggggactatacataagttaaacaaaggttgagtcgataaatgcagcatgtatatatcagggcaggcaggtcactttggttcaagctctacctatagatactacattaaattggtacaagctgatgtcctcctgtatacagaatttacatgatgttcctggtatcagggacaatcacatctcacacaagtccaccatgtctaaaactgacatctgcatcaccactggaatccaaacctaccggtgaatcataccatttggctccagagtagaatccttctacatgaatacctaccaaacctgggtcagctaccatggtctcatcatgcatcaatggcttgataatttttgaatcctccacaccatcgtcatcaccacagttaagaatactcttctcaacaaagtcgcccacgtcttccttgagcatccatttgtcacactttggactatcactcatgagcatcttcctatcctcacattctgccgtcattccatcccacgagacaataggcccaagacttgaaccaaaatcagtatcgtcatcatcaagcatctcatcatccctgcagaatgcaccgtcatgctgatctaaatggtgagaaacgtcagctggcccccatccaggaacctcctcgttgcctatcatcagtgtatcttctggctggcagacattgccatcaaaattaaacttcctgatcctgtgcaaacactcagatagctcattggatagtgaacccaaaagctctgggtgcatcttacccaccttcccttctaacaagccaacctctgttttgagatcccgaatttgctgcaaaactgcaagatgtgaatcatcagtttcaacatcaaaatctcccttaatcgtaaagttaggatctccttcctcactgacaccataaatgtctggatcgaactcaagagctcccttatgcccaactaacctatgaacaattcgggcattgccatcaagtggccctggctcatgccctgaatgcactgcataaagcttgaacactgcagtaccctcctcctcgtatacaaaactcttgtctttctcattgtaattagctattggcacaattgcccgaatacgaaacccacaaccacacctctttgattgatatggttcccgcttcaatactcgtgtcttcttcccatcagggacacttcctgaagaagacgtagcattcacaccacttgaagttggcaccccagcacggtggcatgcataatctttcacctcggccatgaatggtttatgccttatatacttctgcctgatacagagaaccaccttatgcttagcagccaactgttgcagtcggcgtggaacatctcgcgcgggcacatctagtgtctccgtatattcaaacctgcggcgccgtttcccccgccctggcgatgacatagcaaaatcaggctgtcccgcaggtgcggccttacatacagcacatgcagagacacaaacacggacgaatgactccggaatgccgtagaatttggcacccacggtccatgactgcttgattcggtcgacggtgtccttgagcccgagatggcggagcaggtcggggtcggcgtgcgcctccgagactatgtcccgccactggccgacgtgcgagacgcgctgcccagggttggacttgaagtggagggaccgcccgtcggccgacgcgccgagcttgtcctggatgcgcttccaagcggtgaggtaggccgtgtcctcgttccggtccttccacaccgcccgccacgaggcgagcacggaggggggcgtcgcggagcggacctcgtcggcggccgcggggcggccggcgaggacgcatcgcagcatgagcgcgtgcgactcggcggtgaaggtgtagaactgcgatgagatgtgcggcgccgggtcgatgggcggcaggacgacggaggaggaggaggccgcgccggagctagggttcgggcacgggatttggatcagcgcctcgtcgtcggcgtcggcgtggaggaggtagctacacgggctagggtttggggagctgaggtttgggtccgggtgggggaatttggggaaggaggaggaagggaggaggggattcatggcggagacggtgggggaatgcgaggaggtcctcttcggcatctcggggatttttgggggagggagagaaaaaaaaaaagaggaattctcctcttccaatttcactcctatctccggtcgtcatcctcggggtctctctctcttttccgcaacagaatgccgcggcgggttgcaccacccacgtttcactgcgtgtgggacccgccagatggggtgcggtggacccgggatgtcagttggttaggtgggttgattttttggttcgatatgaatggcttctgtctatctgtcttgtcgccttctgggctcctcgctgcgctgtgcgctgctcgctcccgatgttctccgcctgcggcccgctggtagaagaagaggacgacggggactgccgtgaccacagctgacactgaccggcggggactctactggtgtaaacactctgtgggggacccgttgtcaggggtacataagggcacgtgcgttgttccaagacgggagctctcaactttaagctaaccctttgctatagaaaatttagagcaacttttcaataaattttttttacagaaaatacattttttagcagttggaaagcatgcacgtgaaatctcatcactcgtttttcacgcgcatgcttcctaaattgtttaacggtgtattttttaaaaaaaaaataaatatatgaaagttgctttaaaaatcatactaacttattttttatgttttgtagctaatagttaattaatcgtgcactaatcgactgctatgtctttcgtctgggaggtgagtgggctcccaaccctcaccaaaaacacagaaactcaaccaacacactttaggcctaggtatttaggaatttaaagacccgggacaaaatgtaaattaagattataaaatatttaaaaaaacatatgtccaatttaaaactgagattgcgacattgcatgggtgtctaacatggacggctgacaacgtcatggactataggcgttagcgagacaacaagatgaacatgcagcaagccagcaacaatggggactcgaaagtctgggattttgggtgccgatgtgttgtcgtggcaagatgaacagcggactacaatgtcaaatgtctcgctcactcttgtaggtcgcagcctcttgacgcaagggctagccaagcccgaacgactagacgaagtcgaataggcagggctagactttgaaggcaacgaccaaagcgacacaacactataacaattgtgcctagtgagcttttcactagcaagtgctccaaatttctaagatctttgtgtgtcgtgatcgagcagattacgtgccctcgtcgacaaggttggatataacatccctagttccatataaagctaatatagaaggttgtggttgtatctgtctacttagaaccatgcatagctaacaaatacattgtcgtgttgcgggttcactattatctatttccttcgtctcaaaatatagctagtagactagtatggagtacataatcgtagctacatgccaattagtccgttaaagcggagcattgtttatttttttcgacttgagctagagtaaaacttgttctaaaaaaatagagtaaaaccatattccgctcaaagtacgatcaaccataacttacaagtagaattaatgcaactagatcaattgaagaaagccaatatgtgccgattacccattttgtaactacaaaaacacgactattagaaaatgacctaatatcaaataattataatggatgaggcttcgaacccaggttatctagcccaccaccttgtggagctagcccgaagacccctgggcgtttctcattatgtactcgtaatcatttgtccctatataatattctcagtaagaaaacactaacgcaaaacaatccgcatgttgtttatctctttatttaagttaattttctactgttgtagcatcatgttgcctcatggtcatggtggtgtttgaagtgatcccaatgtgttcataaagagtgagcttttgaacaattttaatagttagtctacaataagaattaacttctctacatatttgctctgttctattccaatgtacatgcaaattattctcatgaagtatagtttaatcaattatatttaaagaagttgcataat

SEQ ID NO: 38567 - DNA, 1369 bp, Oryza sativa
atgctcccaaccccactcatcaatgtttatcatgaaatactccttcacttcgggtgtttctcaaagtccctagtccctctcttcgaatttagctcataagagtaaccaattcgattgcgagatttgagttttgtatttttggatcctgccacttttgatacggtgattgacgtttttttcaggaatccagaggtggcttctggggagaagaagatccggtgagtacaatttctcttgatattccggttccatctgtctatattggggagctgacacgggtttaggtggtcatcacgagcggtgaggtcatttgcaatggcggagctggaggctcggaagatgaggtacccaaccactggcactgaaggactcctcatgggcatccttgtcgagggtgaggcaaatgatcttggattatcactgaaatttgttcgctggcatctcgggcgcctaagggggtgaattatttgtgaattgtcgatggaaattggaacagatgagtggggaaagatacaaaatatgatctacaaggctatagggattaaacctttgtagtggcatgaaagttttacaaagatactatgatggcattttccttacttaaaatacgtttatacaaaactgtagaagtcagggtaattttggtgcacgtgtacatgcctcatgcatgttgaaaaatatggagcagcatgccaaatgcaaacacaatggaatactatcgaataataaatcatctgccttataggttgtaatattcatcatctgagtgcagagttattaagttctcaagttcctattgttctatccatgtacatccgcaatagtgacacctggagtctctagtcatggaaaatataagaaagaaaaaaaaaggccattttaatgtagcctcattggtatttcttccagaatgagtagccaggataacacagtaaactgtctaaaaagtaaacatgcttcaatgtaaaacagttgggagtaagacaacccttttggttcataatgttaacaatgtttagacctttgcttgctgacttatgtagattttgtgtgatggcgtccacaaataaatccaatgtcttctataaaaataagatggagagagactatgataatttaggggtgttggtaaactctgcaattctagcctcaacctttgattggttttcagtggttcagatatgattgttttttttcaggttttattttgatttgttgggacagtagcaaactgcgctgtgctctgagactatgttcacgagcctacataagatataagcctctaaactgtcaggagttcttattgacatcttaaaactgtaattgacgtatataccatgaaagtacccagctgttgacctagcattcg

SEQ ID NO: 38568 - DNA, 6803 bp, Oryza sativa
gcccatacctgtaaaagcagtgcaatgtattttcaaaatgagcatttctgttgcttgctcagctggattggtgcaattctattaaaagatccttttgaaagataaagattttgaacgggttcagagctaatgtttactagcattccatggaaagtatctggtacgtttttcattagtgttgaaagtaggcagtggactttggactgttcaatggagccatgtgagtatgtgacacgccatcttcagatttccattttttaaatatagaaattatattttgatatctgtcccaacatgtacccctaaatacgtagcacagttttttttttagttggaggagatttgccttcttacgccaaatgtgcaacacgagtttggtattgacactatactttgattccaaggacatctacctttaaatcttacgttttgtattatgttccaccttgccttgtgctataaatttctgcttattggcgcataatcactctgacagagtctgtatgatcaggtggacgtcatacattatattcgtcgatactgaagtgtcatgacttgacgagaagtatgtacatactgaaagctgacgccatgttggtatgatcaggtgacctgccgccttcgtaggtttcagctgtgaagtcttcatcaggtatcaattctactcctatctgccacggaaagggcacttcctattggatcacaactcgaggatgaatggaatggtacgtgatccatgaccgttctcttgctgtgatgctgtctgctactgtatgtaggatatgaaggaaagcaatggaattaattagaattcttgcgtgtcagcaactgcataaactctggaatcaagtttatggttcactgtttacactgttcccccattttagcatgatctttccgattacatgaatctattattccctctattacaaaatataacaatttctagttataaatctgaacatgtattttggaacagagtgagtaccattcattcacttcgctgacattgcatgcatacttaaaagaggtaactgggtattataaaaacttgcttgtactcctccgcattcactttaatttgctggcattacatgtttataagagaggtaaatgagcattataaaaacttgcttgtacttctctgggagaatgtaaacgtcaaccctcatgcctacggaagtaactagctatgattatactaagccctcaagctaatcaatgaacaagcaaaaatctgtgtgcaactccgtgttgaccctttccctgtcaaattcaagcgtgtaccatcataatgacagactgtaaacaataggtagaatttcacttctccaacgcacttcatcgatcattttactcttttatatatccttccttcagttccttagaatgtttgcatcaaaaagcatgtgcccctgcttgtttatttctggattggagttcccttaggtcctaatccagatctctttgggagctgtgaccagtgagctctgagcagggcacccctcaatgcaagtctcctccactctaaaacaaatcactgtcataatctctactagttctctgcgagtctatgagtcagagcatgcatccatgagtctgtagtcctatagatatcatagctcatgcctaaataatactattctttttccaagatgttttgaccatattaacaatgcacgggatggtagtattagcatatggtttctcacatcacatgccatcgagcactggacaacaggacaagtagccaagtagtactgtagtgctgaaactttaggaagcaggttcttccttccccacactgaagtcacttcgggtggaatagaatggacacttctggctttggttcggcatggatgtatgcccaggtgcctgtcacgctttgggtccaatcattcagttgtactggcatgggcggtggtcgttgtcgtagtgctctcaacttagctagggtgatgaaaaattttctttgctcatttcctttggccataatacaataatttggctaacatgattatcaaaactagcgacaatcacatgaaaacatggaaaagattggaaacatatatatgcatgatattaacgatcggacaatttcaatctaacattagcatactacagtatagcaaattttcccttatttttgtactagctgtggcaaaacagatgtctccctgttgtattctgagctgacatcttgtcactgaaacccattacctcccgcaggatttctgcgaggaggtagtactccccagctcactgaaaccaatagagaaatggaagaggtgggccgacgcctcagacctcagcttttgtgatttctatgcgctgaccacacgagtggaaagaaagaactcaaagtagcatgtgtgcatactcctatgttgcataggcaacctgcataggtactataattaattaatttacatcatgcatagttgctctattctaattaaggcttttcttttggataaatggtctttaaaggaaattcatatgattttccccatattttttattttatggaacaaaggagtaggggttctagaatcatgtgaaattccttaggaatggcttaacacatggtgattttggaggaaaattaatctgatgtccaatctcattcgtttttcctgtcgtctatcaagttggtgattatttccgtatgtttttttcaatgttttctgatcttctattttgcacatcagcacatgcgttggtataaaaaaaaagtcctacataattgtttcttattcctgtattctaccgttcttgctttcggaaaaactctataaatagtcgaagaaaattcgacgtcaatgtattttcttcagctattataacatggaagtgtttctaataaaaatggatcggagaagttcgtcttaatgattgttcatgcttgcggcactagctaagccatggagaaattgttggacagtttatgaatcatctgtgcgtgctagctagctatacatatgtaacggcaaaatagttactccttttttcatcctaaaatatcataaattttaatcgaatgtgacacatcttaatactatgaatcttaatagggagtctgtctagatttatagtactagatgtatcatacacatcggatcaaaatctatattttaggatggatgaagtaactaagataaatagcattctcagaaggcatgaacaaaccatgaatatcttgccttttctttatccctagaggttgtatttttttccttctatatttaatgaaaaagcacactctcgtgctggttccattcaaaaaaaaaacatgaatgaatagtttgcatccgatccgttacactttttttttcaagtacctgcagtagacgactagacattcatgtcaagatatatatttttttcgtgcaagtttatatagagcttgattataggctggcttaaccggtcgatagtcacgcgtcattttgatgccggctgcagcctgcaaacgaacgaaagcaaagttacaaagacatgcgcagctttcctgaagattgcatccaacggtttccccgaaatctacgacttaaagtttagtaactgcaatatcattgtgagggtaattatgaacttctgtaaggccctgcttaatttgagatttcttctaaaaatctaaagcccgaccaggacaatgatcttacactaaaacaagattactattaggaaaaaagttgtcatgcatgtataaacagctagctagcagcacaacatgtatatatgtacaaaggaaaatgcatgctttagtgtgtgagctcgcaaaccttacagtatgagtttagtgtttctttcagataacttcacacgtagttaattatcgatacccgcccacccctaatttattgacaatatattgcatgctagcgcatcgcataaatatccttatcaatgtactgctaatggctggacttgtacgttaatccaacccttcccatcggcatcatcaacgcagaaactactgttaagtaacttaagtttgccaagctcaagcttaaaaatcctggtgcatgcatgtagctaggagtatagcccttttctgactttctgtgtgcgggaagcaaaaatacacctgcgtgtccatgtaggcatgtagctctccctgtatagtacatctctctctgtctgtctctgtctctgtatgtggacttgtggagcgaccaagatcatatgcaccatgcgtaggagtatggctgcatgcacagtgcgcgctagctgcagcacactgccgcattctgatcgatcagggtgctagtatatagctagtcttttgagctttgaccaagacgtcaagctgtgcgtgtgtccggccgggcgaccgaccagcggcatgcagatgcagtgcagcaaagctaagctaggatcgatcgatgccaagtgaagtccatagacttcacgtggggggggggggggggggatcggatcatgcaagaccgtggccacgggagactacacacgcagtcacacggccacccaggccagctgccgcctgccggccggccatgccagccgcgcgatcgacgtgccactgaacgcggcagcggaatgtgtgcgagatcgacacagtagtggtacagtgtgcgtgtgcgtgtgtgatggatgtgtcgacgcgaaatgggatggctagctcgacctcgcatgcatgcttgcttcacgcaatcttctagtagccctttttaagagagcgaaagagctagcagaaagatcacaaggggaagagaaaggaagggccagcgagggccgggtgtggttgtacaaccagcaagctaggctcttcttccatgccgtggctttaaagtctcatcaataccacgagaacaaaacaacacatagtagtagcagtacgacaagcatgttgcagtagtatagtgtagccaaagtacaggtgcaagagaagaggagaatactgtcaggaggggagaaaaaaaggttcaaggagaaggaaacagggaaaaaaaagagagcaaaaaatccagagatggaatggaactgaaacttaacccctgtgcctatgaccttccaccaataggacaagcaccaaaaggagagagatcggggaggcgacttcagtttccatattacgcatatgcccttccctcctccacttctaccactgccataataataccatcaccattcctcctcctcttcttctcttgctctcctctctcgtgctccatcgatcgatcgatctctaccaacacaactacacacttgtttacctagctagatcatctcatcaggtataagagctctcgagatcgatcgagcaatgagctcgggaggcggagccagcagcgcgctcggcggcggcggcggcggcggcggaagcggaggaggaggaggagggccgagcggcggcggcggtggaggaggcgggccgtgcggggcgtgcaagttcctgcggcgcaagtgcgtgagcgggtgcatcttcgcgccctacttcgactcggagcagggcgcggcgcacttcgcggcggtgcacaaggtgttcggcgccagcaacgtgtccaagctgctcctccagatcccggcgcacaagcgccccgacgccgtcgtcaccatctgctacgaggcccaggcccgcctccgcgaccccgtctacggctgcgtcgcccacatcttcgccctccagcagcaggtactactaccacttgcttaactccatgatttgatttccaacgagtttgatatcgactgatcgatccatcggcttgattgattgattgatagtattgtttgatttgcttggaaaatccttggtctacttctgctgcgtgcatgcatgcatggaccgatcgatgcgtatggatctggatcgtcgtcttgtcctcaagctagctcatcagcagttggggggacaagacgattttctggagtaggcgtgtttctttctcgagaaaggcaaggtctctttccatggaggaaaccaacacggccaagccaagcaacgagcagtgcgaaaaagaggctaacacgccaagcgtgtaaccaggagactgtttccctgcatctggtagtacctgccatgaatgatatgcaagtctcatccgtcgccgtccgcgtcgtccgatctcgatcgatctctatcgacgggatcgatatatgatcgtacgttcaccgtctggccgcgtgtgaaatcttgggctctgaacaatccacgaagtggtgggagtacttgtgcttggttttcgatctgacctctcgaaagaacagccctagcgccaatctctagtcctagaaatccaaactttgagttctttttctaccaatcatttgatgatctgtttgcacaattcaactcgttaatttcatctcgttattattattacatgcatgtgatctactatatgtgattgcgtgatttgaaccttgcacgtactaacagttttttctgtactgatgcatgtacgtttctgccacgtacgatcttgtgatcatgtactcccacaggtggtgaatctccaggccgagctgacctacttgcaagcccacctcgccacgctggagctgccgtccccgccgccgctgatgccggcgccgccgcagatgccgatgccggcgccgttctccatctcggacctcccgtcgtcgacgagcgtcccgaccaccgtcgacctctcagctctcttcgacccgccgccgcagccgcaatgggcatcgccgctccagcagcagcagcaccaccaccaccagcaccatcatcaccaacagcagcagcaccagctccggcagccctcatatgccacgctggccaaggcgccgtccggcatgacggcggcggc

SEQ ID NO: 38569 - DNA, 9553 bp, Oryza sativa
tttggtgcggcatggacagagttcgcgacgacgaggaggagagcaagcaacgggattggaacgggccggtgatggcgagcaggtcagcaaggagtaggtaagcagcaatggccggttttcgcgtatccgccttgttgttagccgagggtgcaagaagatgccccacttgctgcttggttacaatgcggctttgcttcaattctgcaggctgcaggagaggaaggtggtacgggggagcttcagtagtagtatagctttgacatgtaggagtaacatttgtcactggtagcatttgtcaccgttccattaattgaaagattttaagaagcttctgttcctagtaaccgctgataaatgaaagagaaaaaaaaactgatttcatttttttgttgcgactaataactgtgagttgtgatggtcgtggatgaatttttgggcgtgctcatcttgtagttatgaatggttgcattttatgtggaaaggctataattaaaatcagctaccgtggaaaaattatactgctccatcgatgtattatttaataaaatatagtctgtaagtattaattaggtgtgcatgatgtaaaaagtaaccccctctgacttcatcataggttgagaacattgttaactttaaccattcttatccactctaaagatccaagtccatcttggtacagctgaaaataaaaagctgaggccatcttcctagggaaactattctaatccctcgagggaatgttccctcgtttactcaaaaaccatttaaatggttatgaaaaattctggaaaaatttgacaacattcatacaacacatatatacaacttcacaaaatcttaagtccaaactcaactcacacgtcgagatataaaaaagacaaattcagcgtatgaatagtagcgtactgtttatatctaaatttgtcttttttgtttctcgatgtgtagatcgaatttgaacatgaattttggtggaatagtaggtatcattatattctacattattaattttttttagattttttcacaactatttgcatcgaatttgaaagaaaaaggtatacgagaggatatcccctcgaggaattagaatccactcccatcttcctatagttggaaagaagctttaggcatggttgctagtactactctccaatatcggtctctgatagccagctagctgatctaacaagtctactctctctatctctcaggtctcacattaggaggtataaaagcatttgaattttccatcattattaccaacattttaagtagtacattatatagatattttgagggtcgatatatatggatcagttttaaaagtggttgatttgaatataccttcgtatgcatgaataatagttaaaggcaaaatgcaattaagaccatgttaagctagccaatttatacaaggagttaccggtggagaaaccatctttactcccggttgggaaccccctttaatcccggttttccaaccaggagtaaggatccgggactaaagatgtccatctttaccaaccgggactaaggagacaatagcggcagtgcagatggtttctttttctttttcttttttcatttttattttctcccgaatcaagtaggcaaatccctaaatctaactaacatcccaaattcacatcaccaaatccacatcacaatcataaagttacttatacacacaaatcaaatacatcacaatatcctaagaaattactcaaatacatcacagatccaaacaatgaatcacaaatttctaacttctcagtcaaatacatcacagtgaatcatcacaaattaaaaaaaaaagaagccgctgccgccgccggtcgccacgaacgacgggcgcggccccgccggccgtcggccgccgcggccgcggccccaccacccgccacgggcgccgccgcccgaagccccgccgcccgccgttgcagcgcgcggcccagccgccggccggcccgccggatgggaaggggaagccggccaggaaggggagagaaggggaggagaggaggaaggggaggagttggagaagagagttagagaggatagatttgaggagaggtgtgagattcgatctgtctaagttgtaactgtggaagagagaataaggtatagggattatatactacgtgtttaattttagtcccgattggtagttggtgatctttagtcccggttattgacatcaaccggggctaaagatcctcggccctgtgacatacatctgacagtggatgaaccggaactaaagatcatcttttgtccctaaagatcaaaatttttataaccgggactaaaaataatctttagtcccggttctcttggatgtggaactatcgtggattttgccggaccgaccaaagatgatttctctaccagtgagtagctcagaattactatatataccttaatttatatgatgttcacaccttttcttttacaaaataggataattaaacctaacctctacgtccaaccgatgtacacagccaatgcgatgttcacataactactagtagtaattatttatgctggcgtgcagttgtcttcttctgttctttggtcatatagtagtttatgctgtgtattccatagttaattactgtacgtatatatatatctgaccagcaacctcctgccgcaagccctggcctgtcaattgacgcaacgacatgtatcattctccacgtacgcatgcctctcttgcgtgttatcgaaaaaggctaggttagtgaagaaacattgcgtgctttcgcgcacctggtgttatttattcatatcactgtagatcattccatgggtcttaaacatatgatgctacacatggcgaatactaattttccgtggccacgaagcgctcaatattcgccatgtgagccatccatgtcaaccattgcaaaagtttgcagctgaactggacctggttctactggtcccaatttatgatggcccattagtcacccaacttaggtacagcccaaagaccatagcccatgaaagcctccgcattgactcctcggcccctattgcgtcactgggcgtcgcctcccctttctcgatcacccgcgtattattatccccttattaatagccgcaacccccagtaatctcccactgacattacgggcccacaagtacgcgtccccaccagccatagactgctcctagacccgtcgcaccgaagctcccctgccaaatctacgcacgcgacgcggccatctctctcccttctcccccaacctccattagccgatccaaaccacctcaaagccccggaccgcatcactctccttctccccccccacgcccagatccagatccacccggcgcggcggcggatccgtcgaggaataatggcttccccggcggcggcgccgccgcctaccccgccggagtccgacccgcggctcgtggaggccttcgtgcccttcctcgagaagctcatcaaaaacgcctcgtggcgcaacaaggcgcactccaagctctcccacactgccaagtccatcctcgaccgcctccagaacccgccgccgccggcggctgcggcgcaggcaccgtccacgcccacctcccccacgacgcccacctcgtcgtcctcgcagccgggcccgctccgcagcctctcgctcgcggactcggagctgctgctcggcccgatcaactccgcgctcggctccggcagcgccaagctcgccgaggccgggctcgagctgctccacaggctgatcgcgcactcctacatccatggcgaggccgacccgtccgccgacccctcggcccagctcgtcgcgtccctcctcgatgccgcctgcaacgcgcttcacctcgacgacgagcacatcgagctcctcctactcaagacgctcctctcggcggtcacctccacgtcggtgcgcctccatggagattgcctgcttcgcgccgtgcgcgcttgctatgatatgtacctgggaagccgcagcgtggtgaaccaggccactgccaaggcgtcactcgtgcaaatgttggtgatcgttttccgccgcatggaggcagactcctccacagtgcccgtgcaacccatcgttgtggctgatgtgatcgagctgcctgaagctgcttctggtgcttcgcctgccgctgatgccaactttgtacagggattcatctcgaagatcattggagacattgatggtgcaatcacacctctggcacggacaacttcttcagcagctgcaggcgcaggtggagcagcggctcatgatggtgcatttgagacaagagcagcagaggaaggggcacatccagcagatttgcttgattcaacagacaaggacatgctagacgccaagtactgggagatcaacatgtacaaatctgctcttgagggtcgtaaggatgagattggtgtggagggggcagtggtgggcgctttggatgatgatgctgatgtgaggattgggaataaactgcgaagagacgctttcttggttttccgggcattgtgcaagctctccatgaagacaccacccaaggatgctccagctgatcccattgtgatgcgtgggaagatccttgctcttgaacttctcaagatattgcttgaaaatgctggggctgttttccggaccagcgagaggtacagctgctctttcctcgaattcagtttgtgtttttgtttcacgctgtttgcatcctgaatttattgttatattaaccagcaacatcaaccaaaatttggttcatcactttattgtttattccatgaaaagtggtgtagtaacatccagctgtccaagtaggaaaaagctcataacttatcatcctgaaaagatcaggcattggtttgctaatggtagtgcagttgtggataatgttgctatgtaaaattttgttaccagaagtcagttctgattgcaattttatggaagttagagttgcgtgatttctatttatttcataaatatcgaggctggaacacattgaacttaaaccactgccacttttctttgctgatgttgattccaatagtgacaactgttggcactgatataagcgtataggctgcacctagtaaggcatagcactgtttgaccgttaattttaatggactatgcaattggtcaattatcctaacggtagtatgcacttgtatgctgctggcattctgagctttttgaatcagaattttggcaaaatggcaactagtaagctaccaaaatgaagcccaagtggatggattgaaagtcctgctctatagaatccatgtataaattttttattggaaagatccatggcctgatggccccatattccttgcactgttctatttgattatagcaagtttctgcaagatgatgactgcgatgtgttatgaggaaaaggcgagctttgcactgtcattttgttttgtgcaacctgttttctagtatttaaattggtgcattagatctgctgtactttatgcttggaaaatagctgaaaatattgagagatgggtttgtcatgaagccataaaaaatggacgtataaaacactaaaatcttggactgaaagttcactaagcccacccctggaacagtaagtttccgtaacaacttgcttgtttcatcaccacttagcacacaaagggttatctggaaatatatatttgtattctcaagcattatttgttagcattacacttcatctgagatcagtcctactcccatgacaactactccacatggactagcactaattcagttaggttgttgccctcaacttttcttctgaagctacactcatgacaggaaaccatattcactgcaaatggccatataatcaccactcagattaattttaaggtcaggaaacttgatgcccaaaatttgttgaaataaaaatgatgaacatagcttatgaatgattattaccattcacctgtccacttcgagcatcttcttttcaaatatgtgatgaacgcagtatgtttggtttgtataggtgatgcaattgtattttgatattgcacgtgccattgtcatattactctatatcagctaatgtagagctgttacccatcttcttggtgcttttgttttcttgaatatttctagttctaactactttgtctcaatttatacagatttctaggggctatcaagcagtatctatgcctctcgcttttgaagaactgtgcctcggcacatatgatagtctttcagctatcttgttcaatttttattagcttggtttcaagattcagaccaggattgaaggcagaaattggagtattctttcccatgattattctgagagttttggaaaatattgctcaaccaaattatcaagcaaagttgattgttcttcgtttcctggaaaaactctgtgctgattctcaaatcttggtagacatttttctcaattatgattgtgatgtacactcatcaaacatatttgagaggtaatttataatactgtaattgagctatagtgagcttctttttaaaggtccccccgaaggacctataacactcattaggatgctaaccagatattgtgttatcttaattttggactacaggatggttaatggtctactaaaaacagcacaagggcctccagcaggcgtgtctaccacattggttccgcctcaggacaccacaatgaaaagtgaagccatgaaatgcttggttgctattctgagatccatgggagattggatgaataagcagctacgcattccagatcctgactctcctaaagtagagtcggagcaaaatgataatgatggaggacacgagatttcccacacagaggataatggagacgaatgtagtgaagcatctgattctcattcagaaatgtcaaatggggtttcagaggctgcatctttggagcagcgccgagcttacaagatggaacttcaggtggatgttattccatagttatttctatatgtgtagttgttggtgggaatttgctggatgctgtcctttgccgtatgactcgctgctgttctgttgcatatttgattttatccatttacttatctgtattggtcgattgatttatatgaatggcaggagggtatctctctatttaatcgaaagcccaggaagggaattgagttcctaataaatgccaacaaggtgggggaatcacctgaggaaattgctgctttcttaaaaagttcttctggtttgaacaagactatgattggagattatttaggggagagggaagatttatccctcaaagtcatgcattcatatgtggattcatttgattttcaaggcatggagtttgatgaagccattagagcctttcttcaaggtttcagattgcctggagaagctcaaaagattgatcggattatggaaaaatttgctgagcgttactgcaaatgcaacccaaaggccttttccagtgcagatacagcttatgtccttgcttattcagtcataatgctcaacaccgatgcacataatccaatggtaaaaaataaggtatgtatcttattggctaagtttttgtgtaatataccatagacagcctttggttctgttgtgatgtattaattaatgcagatgtcaccagaagatttcattagaaacaatcgaggtattgacgatgggaaagacctgcctgaagaatttatgaggtccttatatgaaaggatttggaaaaaagagattaagatgaaagaagaagaatttgttccccagcagcaaaaatcaacaagctcgaacaaaattcttggattggataacattcttaatattgtcgtacgcaaacgagattcacgtatggaaacaagcgatgatctcattaagcatatgcaggagcaattcaaagaaaaggctcgtatgtccgagtaagtcatgctagatgtctagatggatagctcaatacctgtatacactaaatgcatgttttccttggtcatttttctttgctgcccatttgatttctgcaactacattattttactgatttgtctcatgtcaattatttatctagaatattttatgaatgaatcaggtcagtattctatccagcaacagatgtagtagttttgaaattcatggtcgaggtttgctgggctcctatgcttgctgccttcagtgttccacttgaccagagtgatgatgagattgtcatatcccagtgccttgaaggatttcgcagtgcaatccatgttactgcagctatgtcgatgaagactcaaagggatgcatttgtcacttcacttgctaagtttacatcacttcactcggctgcggatattaagcagaaaaatattgaagccattaaggtttgttctacttactgtgatgcaaatattagtagcgatcagctgctatcactggcaggaaattactacttttgttgttaccattattttgaaaaatatatggctgaaaattattggaatgaaactgacacattgatgttttgtttcacttttactggcttcaggagtatagttgtatctttctccctttgactgtttcatattattggattgtctagcgcatgttgaatgctcgtgaaagtgtaatatctgaatttagtgatgactggaagcggctggtcttgtacttgttagaactgctataaactaactttccattaaagtttaacgttagttccttttggttggcattttgaatatttgtattatgcttttcgttctaatcatattccatggtgcttattgcatggttttatatattagttttagcataatcataaattcagccttttctgttctcatgctaatttgttgtggctacgaattgcttcacaggcaattctattaattgcagatgaagatggaaattacttgcaagaagcatgggagcatatattgacctgtgtttctcgttttgaaaatctacatctcgtaggagaaggtgctcctccagatgctactttctttgcactgcaacagccggacctcgataaatcaaaacaggctaagtcatccattcttcctgttttgaaaaagaagtctccaaatactgttccagcttctaaacgaggttcctatgatagtgctggtgtgggtggcaaagcttctggggttgatcaaatgaacaatgtggtgacaagcctcttagaacaagttgacatggctgaaatgaatcgtgtatttgtaagaagtcaaaaactcaacagtgagggcataattgattttgtaaaggctctctgtaaagtttccatggaggaattgcgatctgcttctgatccacgggtttttagtctgacaaagattgttgagattgcgtaagtacagggcttcctatattcagattgcaatgtatttccccatacttttctttgatgtatttatagtatataggcagtatatgattgtgtttccctttctcttgtaggcactacatatgaatcgcatcaggcttgtctggtcaagcatatggcatgtcttgtctgatttttttgttacaattggctgctcagagaatctctcaattgcaatatttgctatggattcattgaggcagctggcaatgaagttcctggaacgagaagagctggctacctacaattt

SEQ ID NO: 38570 - DNA, 9861 bp, Oryza sativa
cctgcacccccatcctaaatgtccccatttgcatgtccacaatcctctgccgccttcaactaatgtttcaaaattatccatcaccggagtttcaacgcttccaacggttgagtggtccagaggaatattaagaatcggggttctcgatgattctgatgatccttcggttattgatgagccttctgatcagctgataacgctagacgacaaagtattgtcattccataacctgaggttcctaactgaattggtaatagcaggttgccaaaatctcacgtccatttcattgcaaggtttgaggcaactcatatatttgaggactttggaaatacgcggctgcccaaaacttttctcttccaatatgccaccagagcttgtacgtgagaacatggcagctacatatcacaatgccctcccatctcttgaatatctctttattgctgcctgtggaataacggggaagtggctatctttgatactgcaatatgcgcaggccttacaggacttagatttatatgagtgcgagcagataacagggctatcgataggagaggaagaaagcagtcaaccaaatcttatgtcaactccagaaactttgtcattaggacatcaaggtgactcgccaacaagctcagctcgagatggacttgtgcgcattccgttaaatctcatctcctctctgaagcacatatatattggtgactgccctggtctaacatataatgggaacgatgaaggtttcgctaaactcacctcccttgagagtctacgaattatgaatggcgccaagctactctcgtccttggtgcatggtaatggatacgatgagcggaagaacataaagctcatcccactatcacttgaagtactggagctcagaggttatgatttaccagaagaagtggtgcctgattttctaaggaaccccatccgcctcaaaaaattatctgttatggacactttaagtttaaaatatctacagttgcaatcctgcacggcactcgaagagttggagattgtaaactgtgaatcgcttgccacactagagggtttgcaatccctgcgaagcctcaagaatttgattatatggggatgccccatcttgccacaatggttgtggagttcattagagcaggtccaggagcttttgcctcgactggaaaggctcaagatcaagacgcctctgtccttaccacatctttctgcaagcacctcacctccctccaacgcctaacgcttttcgcttgcaactgggaattggtgagacaaacagatgagcaagacatcgcgcttcagctcctcacatccctgcaagagctctcatttacgtgttgccgcaacctcggagattttcccgttgatctgtacagccttccctcactcaagaggttgaatatctattattgtaaggacatctcgaggctgcctgaaaagggcctcccaccttctctagaagaactggatatcaatgattgcagtgaagagctaaatgaccagtgcagaatgcttccaagcaagctgaaggtcaaaatcaatcagaaatatgtgaattgattactggatggcttgataacatgatggaatagttctatcttccatcatgctatcttcagacttgacgtgtgcttagtgtcagtattgaactaagcattctgtgttcaggcattcaagctgctatacctatcactaccgcagtgaccgctttgaattggagtaccatataactacaagctgctttacttggaggttaagatgatccacggtataaaagggaccccccggaagggtcgcaaggcatcgaatcttattgccaacacacccacacagcctacaaagccgaagtacgcggagccaactcaccgggaggtcttgttgaatacatcgactacgatctcgtcgataccatcgatttcgtctacttccattgtaatctgtgattttccatcatcaatcccatataaactggactagggctattacctgacaaggggcctgaaccagtataatctctgtcttctgtttgcttgatgtcgtattacgtagatcctcgttgcaacgtaccccaataccctaattatccggtctacgagtatcactcgtcgacagaagtgttctaacttcttggcgtccctgtgttctcctgtggattaattatcgcagagctagctggctttggttaacctggcgaaaaggccaatcatgtggttcattacagagaagccagaagtatcagatattggttttcacgtgccaaactctgcactagcattgtctcaccttagaaccccatcctaatgttgttttttttgtaatcatgtattgttacggtgtttcgtattttaatctgtaattctgcgctatgaacctatactatgacttctgttgtactaagccagaaatatccgcaatgcacaagtttttgttttttttggtgaacttgatatctcaggaagatgaacagcgtcgcagatttactagtagaagtctaaaccttgtcagattacctgaggttcgccttccccatgcgcacgacttccactgagggcaggctgttgaaccagatgctcggatgctccggcttgtccttccgaagcctcggcaggatcccgctcgcaccgctgccgcatcgccgcctggatcctcggcggtgggcggtggcgggggaggtcccgtcccggtgaggctggctctgatccgggcttccggcgactagtcgtcttgtcgatgcggagagatggatagacgagagcgaggacttggcccatctcgcccgctaggcactccgacatcgagcgggcctcgtaccaggcctccgctgccggccttccgaatgggatggcctggtaacaagatgggccctgtcgggaaataccatgcaaaactcggattttttaaaattttatttattattaaaatatttacaacttttttattttaaagttttacaaatatgcacctctaccgtcggacttttttatgacgtggcacacggccgttgacatatgctaacgaccatatggaaggtggcatgtcattttgcggacaatccttttgccgtctttccaaagaggtgaagggggccgcctacaaaatatctagggcttttgttataggcagctcccttatcgccctcctatagagctacaagggaagcgcctacaaaatattataggtctctattttataggcagccctcttgttgccctggctgcctgtaaaatgaccggcgttcctccgtgcgaccgttacaacacatcaacgaatgtgtcacgtcataaaaaaaaccttttgagagggtgttttctactaaaggatggtagtggtgtgtgaggacgtcccaaagtctaggtggtgcaatgctccaaggcatgtcagcgcgaaatatctggatggatggggtctcaaataaagtccaaataaatacggtaaccatccaacctcatcgcagaccccgacatgtcttgaagagtgcactacataggctctaagccatcggatatgaaatagaagacaaccattggaatagccacaccagtcatctatgtcatacgcccgtcaaccactcaatggtggcgaccaaaagcgtaccccagagactcgatctcaacaaagacatattccccggttatctcaaccatttcaaacccatcctcatgtgggactagttgcccaggaatgcaacatattctcacataaatcatctcaagcatgatatccaaataataagtggttctaagcaataagcataaataatcttaataagtttctaagtagtacttggcgacaagccataaatattggttcatgcggtaagcgtgctacccaaaagcccataggcaaatcgactagggtaaatccctagttagaaccatcctggaaatctgcaacatcacaagctgcatcaaactccccatccaaacagtcattacctgcagcggggtctgagcataaacaagtaaaagaaagcaagaaatcagtacattaatcaaattaatgtactggcaagtcggaaaacaatcctagcatactacatgttggccatattcaaagataagctgtgtataggttaatttgcataaatgccaattttagttcacaacatgtttcgcaacgaaattttataacgatagtatagagtaagtaaaacttgtaatgtgaatgaataaataacacgcatctaccccttaaggtagatcatcaccactctccatcatctcatcaccatttaccgaactttacccaagtttacaaacaaaacattccaaccattttcaaaacattacaaataaggaattttgaattatattttttttacgaacgttattttgaattattcagattcgtagtaaaagtgatatctacctaacatctcttatattttattttagggcgaagaaacttgtatatagctcttctgcttgccttctccccgaaaacccccgatcctctctgtcttgtgcttaccgtcgcggcgtcggtcgccattatcgcccaagcgttgcgttgctccttttggacggttgggcctgacaaaggacaattctatgaggattatctgggcttgcccatcaccgacctaactggactagcccatcaaccagaagaggacgactcctccgtcaaagtcggtagccaccggggtcagctagcctagcgcgtcgtcgctgcgaaccgaatagctgatgaacattgctactagtctgctagctactcgcacagtaatctgtcctctccttgtacttaattcctcgcacagtaatctgtcttccacttcacctgctagtccgctttccccatcctcttgtcgtgctcacacggtcacgccatcggcgatcgccgatcgaggaactgcctctgttctgccggctgccgcgtctgatggaggaggtggaagccggtttgctggagggcgggatcgggtggctggcggagaccatcctggagaacctggacgccgacaagctggatgactggattcgccaggttgggctcgccgatgacacgaagaagctcaggtctgagatcgagagggtggatggggtggtggctgccgtgaaggggagggcgatctggaacaggtcgctggcccgatcgctccgtcgtctcagggagctgctctacgacgccgacgacgcgatcgacgagatcgactaccacaggctccagcatcaggtccaacgaggaggtaaagcatgtatgcaagacatacgcatccatttgcagaaaatctaattgttgtattctattgtattacatcgactctctcatagagtatatataaaaatacatagaagatttatctctaggactctatatataggagtacattgaagtacaatacaagagtagatttatatctaggactctattttatctttaggattatatcttatctctataatttatatttgactcttatctctaactatatatctatacttctaacgccatggagcacggcgtacgttgatttccagatcccttcctcttttacatggcatagtttactttttggttcagatgcatggcacggcgaccctgatgaaagcgcggatgggcatggagcagagcaaacagggagacctcggaggggcaaggttggtgaagcgagcggcagcggtggcaaaagacggtccgggatatggcagcactttgagagcgtggaaaataatgcgaaagccaggtgtgtcgactgtggcacggtggtcaaatgcggctccgacaatgggacttcggttttgcacaatcaccgcaaaagtggcaaatgtaaaaggacacgtggagcaactgatcaaccgccaaaccctccgaggtggtagtactttaaaaaaaaactagaatcaatcaattactgaaaactcaaatatttctcctaaaacacagatcatgttcttcttgtagtgccagcgagggcggagcaaattcatttgcagctggtaattcagtcggcagaaaaaggatgagaaccgagggtgcatcagcagacaacgtggctgctagtatgcacccttggaacaagactgaactttccaacacgatccaacaaatgactcatcagttacaagaggccatgaatgaggttatgaagctacgtggatcggacaattttgtgagttcaaacttccatcataatacaacttctgattcacgcctaaaaacatcgagccttctccaaaggaaaatgtacggtagagttgatgagaagaactccatcataaagatgataacagaagccaaatctgatggtgtaactgttatccctattgttgggattggaggtattggcaagacggctctcgctcaattcgtatacaatgatccagatgtgaaaagtttatttgaggacaaaatgatctgggtgtggctgtctaacaactttgacgaagagcaactaacgagagagatgctagatgttgtctgtcaaaaaaaacaggaaggatcatgcaacttttctaagcttcaagagatcttgaaaagccatatgaaaccaacgaggtatctacttgtattagatgatgtctgggatgatatgaataattaccgattgaacaaattgttggctcctttcaattctaacaatgcagagggaaatgtgattattatgacaactagaatatggtctgttgcaaaaaggattggcactgttaaaccaattgagttaggtgctttggaaaaggaagactcctggatgttattcaaacaatgtgcatttggtgatgagaaccacgaactatgtggaagtctaagcatcatggggcagaaaatagaagataaattagatgggaaccccttagaagcagaaaatattggagaactattacgtgagcatcacacagttgagcattggaataatattctcaagaccgaagactggaaatccatgcagctcagtggaggcatcatgccaagtttgaagcgtagctatgatatgcttccctaccagttaaagcaatgtttcttgtattgttctcttttccccaagggttactctttcagtaaagaacaactgatacaaatatggattgctcaaggatttgtagaaaaatccagtgagaggttggagcagaaaggtaggaaatatctagctgagttggtggactctggtttctatcagcatgttgaaagaacatcagaacattttgttatgcacgatcttatgcatgatttagcaaaattggtttcacaatcagaatttgcaaccatagatgggtcagagtgcgaagagctaccatcaactattcgtcatgtgtcaatattgaccgattctgcatacaacaagtatgaagatggagatttttctcgtaatgaggagtttgagagaaggttgctgaaagttagatcaagaagtaagttgaagaccttggtatttattggggaatatgactctcattttctcaaatccttccaagatgctttcaaggaggcaaaacacttgcggctgctgcagatcacttcaatgtatgctgattttgattattttatttccagtttggtatactgtacacatctccgttatctgggacttgagaacgagacccagcgaactttgccccaagctctaagcaagtgttaccatcttcaagtactacatattggctcatgtggaactcccaatatacctgaagaaataaataatcttgtcagccttcagcatcttgttgcacaaaagggagtttggtcttctattgctaacattggtgaaatgacctcacttcaggaattaacaaatttcaaggttgagaattctattggctttgagataacacaacttcaacgcatgagcgagcttgtagaactgggtgtgtctcgacttgaaaacgttacaactaagcaggaagccagtggcgcaagcctgaaagacaaacatcacttggagagactacatttgatgtggaagggtgtacggaatggatatgacagtgacgggaactacaatgaatacgacagtgatttgagctatagtgacagtgatatgaactctgaaaatgaatgcgatggtaacatgatacccgaaccttctatgcactcagaaacagaagaggagagactgcaaacgactgatagcaatgatgtccctagtttagatcatattccagacacagcaagtgaggtgcttgaaggtcttgaaccacatcgcaacctcaagtatctatggatatcttggtacaatggagctaaagcaccaacttggcttgccacttcacttacccatctgcaaacactccgtctagaaaattgtggagaatggcaaagactttctttagaaaggctatcactacttagaaagcttgtgttgatcaagatgaagaatgcatcggtactctcaattcgttcaccggaggagattattctaattggaatgcaaaagcttcacactgtcacttttggagagaagatagaaattggggatttcaactattgcaattgacttagctcaaagagcatataaatatgtacaagagaagtagaaatgtctataataccctcaatactcttaacacccccactcaaatgcaatgtgtatgcaataacattgcatttgaaaggtaaactaaacactagaacacaatccaaatattagcctatctccaaagccttgatgatgtcgtcgaagtgtgccaattctaggatgatgaagaagaaaagatgtatccccttctcaatgaactggaccttggagccttcacaaactgttcttcggctcttcattgattcggagatgttgatgatgatgatgatgacaatggaccttcacaaactgttcttcggtcctttgactgatgatgagacattgatgttgatgaaggtccttcacaaactgttcttcggaccttcactgagtgatgatgatcatgttgacaagctccgacatggagatgatgaagtgacaatgaaggccagctccgacggggaactggtgatgattaaagccaactctgacagcgagttggtgatgtagaaaagacgatgaagagatgaactggcatgactttgacgaattgagggtaagcaatggatttggattgactcgataaattgtagagaaatttgactcaatgatagtagcagacactaagtagtagcaaaagagatgaactggtgcagattcaacaaattaaaggatatgcattggagtattggacttggatggacttgatacgaaatatagtaaattgatgaccaagacatgaaattgatttgaaggcttatcgatagtagcggctgcaaaaagaacaatgacagtagcaggaacccattcttcaatcactaattagctgtaacccagctgcataaccaaagagtccaagagcctcaaatctgctcctatctatcctgttgctgcttgaccatgagcttacacgcaacagaaaaaacaaagacggagagaggggttgatgtggatctgaagttcaggaatagcctgggacgatgagaagatgatgacgacgagcatcggcggctggccggctcgatgggtggacggcagcggcttgccgcaatggacgacgagggcctggccggcggaggacgagcacccgcgacgggggcactgattggctgattgctgctcctgtttgtttgctcattggagatgaactggagaacgacaagctcgctgctgctgccgcttgaagacgagaaagcaacaatcagcgatgacgactgcctttgatgcggcgggcggcggcccagatctgggcgggacggatggcgccgcgaccggcggcgatgaccgcgacttccgccgcgatgggctgtcgatggacttgatgacaggagaacgaggaagtggtgctgctgctagaacctttgctgctgcttttgcttcttctgcttcgcttgctgcttgacgagggatga

SEQ ID NO: 38571 - DNA, 9524 bp, Oryza sativa
ctcttcaaatgtcccatcggagcttaccagtgaagacacgacaggtgcaaatcgcaacgccctcccttctctcgaatgtcttgatattgcttcttgtggaattaatgggaagtggctatctctgatgctgcaacatgcggaggtcctacagaaattgagtataacctcgtgttggcagataagagggctatcaataggagaggaagaaaatggtcatccaaatcttatgtcagctacagaggcttcgtcgtcaggatatccaagtcgagacgaacttttgcaccttccattaaatctcatcccatctctgaagaaggtaactattagattctgcagtttaagattttatggaaacaaggaaggtttcgctagatttaccttccttgagggcatagcaatttcgcgatgccctgagctgatctcgtccttggtgcataacaacagaaaggatgagcaggtgaacggaagatggctcctcccgccatcaattgtagaacttgagattcaagatgataattatctacaaatgttgcagccctgctttccagggagcctcacccacctgaaaagactacaagtacagggaaacccaaatttaacatctctgcagctgcattcctgcacagagctccaagagttgataattcaaagctgtaggtcacttaattctctacaaggcttgcaatcactctgcaacctcaggttgctgcgggcatacagatgcctcggcgatcttggaggagatgaaaggtgtctccttccgcaatcaattgaggaacttgatatcgacgagtattttcaagaaactctgcagccattctttccaaggaatctcacctgcctaaaaaaattacgagtatcaggcactacaagttttaaatctctagaactgatgtcatgcactgcactcgaacatttgaagattgaaggttgtgcatcgcttgctacattagtgggcttgcaatccctccacagcctcaggcatttggaagtatttagatgccctagcttgcctctatgtttggagagtttgtcagggcagggctatgagctatgccctcgattggaaaggctccagatcgatgacctctctatccttactacgtcgctctgccagcacctcatctcagtccaattcctagagctttacggagatccatacctttacattcgtggagtcgaagtggcaagactaacggatgagcaagagagagcgcttcagctcctcacgtccttgcaagagctccaattcaagtctcatgacagtcttgtagatcttcctacagggctgcataaccttccttccctcaagaggttgaagatcgataattgcaagagcatcatgaggctgccagagaagggtctcccaccttcgttggaagaattgcatatcagcaattgcagcaaagagctagctgaccattgcagaatgctagaaagcaagctgatggtatcaactgattgatgatgaatatgtggattaattattgggtggcttgataagcacacctttttccaccagcccaaatgataccggcagttcggcacacacctttctaagctatacatttaggagtaagtattttctgttaagacgttcaagctgctatacatatcaccgccgcagtgacctgttcaggaccatttcaaggggaaaatatgtaaggcaaattatatatgtagtgaaaacgtgaaaactaccgttggatccataaatggatgtttgatatttgtccatgtcactaaaagtaaaaaaaaaaaaactcccagattcaactatgagtaaaaattttattgggagtaaaatttgtactattgatgatatggacaaatattagatgttcatttttaaatccaacaatagtttttaggtttcctctgtatacgtggttggcactgtatattttcctccatttcaagtgccatataactacatgttgtttctctggatcaactttttttaaggaaaaatattgtaggagagtatcctacagcgtgtgtgtccatatagtaaatttgtttggtgctccatggtgcctgggcaccatgattgaaattgagtatatacccaattcaaatgagtatgaaatttttttaaatgtttaggtattaacattaactactttactaactagttcaaaacaagtttgaactgaatttaaacatgtttttgttagattttgaatctaggtatatagcatccaaacataaaattagttaggtatgtaagatcattaaaattgtatcttccatatcacatccttctatattttaataatatcttccaactaactttacatttgtatttgaagggatatattttgaatgacttaatttaacggtgttatttatcacgataatatttagaaatgagtaaattttaacggatatatttaaaatgagtataaaagcaatgcaagtaacatctactactatatttattctctactagtactactgctgaactattccttctctcttctactagtactactactctacatcgagggagcggtggcgaggggcgggtcgggcgggagagggacggcgacggcagggccaggcgggtgaggggcggtgatggtcgggcgggcgaggggcggcagcggagcggacaaccggagagggcgtgggagaagctacgagcggcaacgatgcctgggacggcgggggcaaagctgcgggcggcggcgatggctgggacggccgagcggcgggggcgacggcgggcgcgggcctctccgccaaatccgctgcctttccacctacaccagcgatctccaccgcgagttccggtacacacctcctttcttccgtcacttccagtagtcttgatggtggcataagttggattggaacatgggtagttggaggatgacgtgaggagagagaaccgccatatttggcttgtgaaggtctccgtttggaggacctccaaatatggcgtgtgtgatggagcctctgctggcccctttttccccttctatacgccaaaaatgggatggaggacgggatagcgctactgctggggatgctctaagagacttgctccggcccggtaccaaatcgtttccaaacgttggatctaactgggcaggatagatatttttagatccaacgattggaaacgatttggtatcatgaggtactgatacttcaaggtactttttgatggaccggagcaaatctcaacaatacaactgcattgagaagaatagacagccacttcttcagatcagaaagcctggtgaactaccagtcagtaaatggctaccgtaatctccacttttcacttatatgtacaaaggacacctgcactatcagaacacccacaaagccagttcactcactacaaactatcttgactaaatccaagcagataccgactcctcttaggccttgtttagatttcaacttttttcttcaaactttcaactttttcgtcacatcgaacttttctacacacgtaaacttccaacttttccgtcatatcgttccaatttcttcaaacttccaattttggcgtggaaaaacacacccttaatcaacttacaaaacaccaacactttggtgtatccacagcaccaatcacacaaggaaatttaccatccacctactcgtatcctactgttagattggccaccttacaccagagaaagggcattgccaaattctgagacgctgtcctttgagctccccgaatctgaacaaataacataaatcagatagaacacaacacaaaaatttccattcatcaagaagttggttgttctaattataaagtggcagtgatgaggacccaccgctcgcgacctcagtatccttctcaatctccactgattggtaagttgctgttggcatttttttcgccgggccggcgaataaccggccgatgtatattaagagaaagagttgctgttggcatttcatccccgatatctacatactcatccaactgctcggcctgtgtagtgatcttgtcaggatccttgctctcctgtaaacaacaaaacacattaaccattataagagctcatttcacacataagctaatagcaaccaagaacaaagcatgctgcttactattgccattgccacgtcaccgttgtccaccatcgtagcggtactgccattcaccagcacataactatcattagccacggaagcatcaatgacatcggcattttcaccattaacaatggcagcccgtcgactcttgttgagcgccttcttgaagttgttgacgaatcgatcaagctcccactgtgtctcgacatccatctcatcaatatccagctcgatctcacccccaaccagctcaggattgccgttcctcttccgcacaatctgcagcacattatgcatcttcttctctggcaagctctccaacccaaccctcagcaagttcttctcctccagggtaatctcccacttgatgacggtgtggtagtcgtggagcccgaggcggtcgacctccacgggggcgttgaaccagatgctccgcttgtccttcccgcagcgtcgccaggatctggtcgcaccgcttccgcatcgccggaaaaggatgtttatctgcgaaaaaaggatggttttgtattctaccgaaaacaaatcaaccatcataagaggcgacgaactgtattttacctcccaacccagcggcgaggttcggcttccccgtggcgagatccgccgttgaaccagatgccccgcccacttgccgttccgcagcttcggcgggatcccggccgctccgcttccgcctcgccggcttgagttccggcggcggcgggggaggtgaggcgacccatgggtagcgcttcggcttgaccctgctgctgcgacactgacgaggcgatgtgtcatgtgcgcggacaaggccgaggcccaactcgcctgcgacgtactctgcgaggcccataagtgttcgtttggactggcagtccattacggacaagaaggccgacggcgcgcgcgatacacctctttgtcttccccgccttagaataagtccacctgaactcccttaaacatacataacaaatctaatccagattccttaatcgcaatactacatatcttaaaccctcgactgtttaagccgatgcaaaatgactctcttcggtggttttgagaatggctcttgctgacgtggctcgttgtgagtctgcacgtgggggctcacgttatcctcttattcccttcttcctctttcctcaaacaacccctccccggttttgcacgagatggttttgctatctcgcgcgcacggcctctccacgcgcatgcatgaatgtgtatgctctttttctttttttctccatcttaattaattttgggatatattaaaagtatcaaaatttctattaaaacttaatttaaaacttttactccaaaattttaaattttgagaattttaaacttttaactcaaaatttaaaattttgaactttaaaattcaaaattttcaattccaaacttttaaactttgaactatttttttaaaaaaaataatgctaattacgataattaatactccctccatctatttttgatagtcatatttccaaatctgaaaaatttatttttgataggcatatttcaatccaacaacttatcatcttaataactttcttagatttaatgcatgactcttcattcttccatacatgattggctacatggacattgagaaatgtaagtattaatgaatcgcttatttacgaggaatgactagtagcatgtttaaatggatgataagtagaattatttatccttggtctatgtgtcaagatgaaatatgactattaaaagtagatggagggagtaataattaccgtaagtagcagcgcaggggcgttttgcacgatgagtgtgggggaggggggtgcgcccactgtgcaagttaaacagttggctcacacgcgcccattagagcaagtctaatcttaggctataaactaattataagcttatatagaagagagagaataaaaaataaaaagggttggctctcatgcataagctagctattcaagaaaaatacattaaatgcgcaggtgatagataaagagaggagaaaaaaataaagataacattatagctcatttatatacatgttaacttaaatataagttataatcttataattggatctagtattaaacttgacccaccaactcctcctcagcagcccatgtctggccggttcagcgtgctcgggtatactcaacatgggtgaggcacgacgacgggttcagcaatgcactcgagcagtcggagctgacacttttaggtcctggttggcacagctccaagcactagctctatctctcctggagctggagctcagccaaacagtttcagctccatctaaaattagagcggagctaggtggactctctcacaaaataaactagtaagttggagctgggtttagactgctccacaactccactacagaccgactccttaagctaaaattagcagttgtagctctattaaaaatgcgaatattaaggaatgatctaatatcaaataattagaaggggtgaggtttcgaacccagatcatctagcccaccatcttatagagctagttggaagacccctgaatgtgtttctgttgtagctctattaaacaagcccttagcagcatcttgtgattcatccgtgtgtttctccggcgcgtcgctttctgtttagagaaaaccgaatagctcgggttcggattcggttcgaggcgagggaaggcttaaaatcatttcatgcacacacagctgcccccttggcatttgcgtgcactgacacgatgccgtctgtcctacacgggttggtagtatgacgaaaggctgcggaaaccgatccagaaaattaaaccgtttggatcattggtttttttgactagtagccatgaaagtgaaattgtccgaaaaggataaaagagttaacgacgtcggtcgagctcaaagctctgcgctcaagaatccgagcacttcgggtccgggttcggttgttcagagtaacttcatgcccattgcccaatacgttgtcctccaccagagtgcatgtgagcagtgatgagcgtcattggagaatttggccattcgtacttcgtaggttgctggcgtcggcgagcgcggcgaaacccgaagcgctggttcggtttcggttaatccgtttcgcggtcgcacgcggacacggccatggtgccaggtcggtgtctcccctcgctgctgcgacgcttgacttgcttattactactattcatcttgtcgttgcagcagaacagcaacgtgcattcggttcggttttgggatctttttttcctgccccttcgctataaatacacggcatgaacactgaagagctcacccatttctcgacgctcacaccagctagagccaccatttctctcaacgcgagacagcaattcgcatacgctaggagatggaggtcatggcatccctcgtcaacatcttggcgctgatctccgaggcatgccgcagcgcggagaagctgccggcggcgctgatcactggcggcgtcgtggaggccgcggcggcgatcttcgtcggtgtgttcaaggcgcccggaggcatatttcaacaccacggcaaggcgccattctacctctattacggcatcacaggaggcgtggccatcttcggcttcgcggaggcgtgggccgggttctgggtctccggcgacctcaacggccggcgcgccgtcggaaagacgatactgtgggtgtcgattttgcctctcgtcttggtggctgcgctcggagggttcgtcttcatgacatagttgcaaacctctgtttcctctgtttgtacgagtgtgtgtaatctcctgtacctctgtgtgtatgcactactactagtttgtacctttgcgtgtaatccataatgcttttagtgtacttatgatattttcagttattatgtgatgtagcagtgtgattgttaacttttatgaggttttatgtatcatacatgaggttgtttatgttcttttatccatgttcctaactccctccctcacgttcttacatgtatgtttcccaaactattaaatggcgtattttgtctaaatttttttatagaaaattactttaaaaaacatgctaattcatttttaagtttttctactctctctgtcccaaaaatataacaatgtttaggtgtattcatagtattaggatatgttacgtccacccagaagttgttatatttaaaaccggagggagtaccatgtaattaattatgtgctaattcatcccatcgttttgtgtgctggctcccaatttgcatgtttttcttgcatttttctagttatgaatgttgtgcaggtctaccttttttacgaggatttcctccaacttttgtttgtctttctcgaaatcatagcagcaatcaaccaatcataatctaaaaaaaattcatggtagaaccagagcaaccaactactagtacgcatttgaaagaacaagcgtttgcatggtgtaggctgcggtgtttcaagcatattgaagaaatcaaacttgtcaggtctttgatggctcgcaactagtagttctcccaaaagagagagaagaagaagacatggacatgcggattaacagaatgcattagcatctcgaaaaaaaagacagaatgcattaaaataaagctgttcggttccgggttcggtttgtgccttgcagtactccagtagttaatcagcggagagcatgtatttttcatcttggtgggccccactgtggataatttttgtgcgtctcttggttttgtttgcaaagaaaccttgcgacccggttgcaggtttgggttcggttcgacactttgcttttgcacaggcgtactgcgtacatgtgccttgagaatgtctctgtcaatccgatttgaaaataaataaataaaaagatgatcctagtgttgttgagatgaaaattgctaatcggcaccgttcgggttcgggttcctgaaagcaatgacgtctcaaggcggaaaacctaattggcgatccatcgcctcgggacgggggtagcgattaatcccccgccccctcccttcctccacctggtttccttttttggcaccacattatttttctattttagtaaatttctatccctaaagtttatacacctcaagtttacacatctaaagtttagacccaaagtttacacatctaagatttagagaccaaaagtttatatgtcaaaagtttatatatccgattcaaatttgaatttgaattcaaatattttctatatatagtatttctatacatctaaagtttatacacctaaagtttatagacccaaagtttataagtcaaaagtttacatacccgattcaaatttgaatttgaattcaaattttttaatatagtatttatatacataaatttttctaatttttattttttaaaaaaaatttgtgtggtgtactgtaataggaagagaagaaggggaggagaaagtggggagaggagggaggagtgtattgagtatagggg

SEQ ID NO: 38572 - DNA, 10869 bp, Oryza sativa
cccccccccccctctctcaaggcatactactacctttaacaacaacatcgcgtgttcatcattttgtaatcgctccactttgctgcgatctcggcgaacgattgatctggctggcttggtacttcagtccggttcaagtgaggttcgccttcaacagagagaaagtcgagccggttacaaaccgacattatactgttgtagggcaaaaaccctaagaaagaaatataaaaagacaagaacctaggataagcctactccctcccttaaaaaaacaaaccctggatatgaatttggacgtacaactggacatgatgcatgtacaaatttatgctcagggtttgtcttctttttttgagacggagggagtactctatttgcttgaacactcctgcctccctccaagatcaaaacttcgggtgtgtttggttgtcggccacattttgccacaactaacgttaggcaagttgtggcagccacaaaagtgtggtggataaattgctagccacaaagtgtggcaaagtgtggtggataaggtgccgtcaccacgcgcggtgtttcgtgttcgtgggcgtggcaacgacagacaaatcaatagcctggagatcaacggcaaatcatcaaacctataggaataggattagtccaagcacagcttcatgctccgggccacttacgtgttctgagtcacgattgataaaggctcaaaactctgctcttaaactcaaagtcacgatatgtcaacaaaccgatctgttccggtcggattcggttttcggttccacggaactagccgtgctgccgtggtgacggaatatgcgtcgcgcgagttttaatcatttcttgctgttccacttgtgtccaataatccgtttgacccagcttctgctcttgcctctttgcgagcactgcaaatgtttcggtttcttttgcggtttcgggtaattcgtatcgcgtcgcggccgtgggctgcaggtcgttgtcgatgcttctaaatacttgactttgacaatcacctcctccttcagtccttctcatggcagcagcaacagtgcaagagcgggttcggtttgccactgttcgattcggttcggtttgcggttttttttgagaattaatattatttttatggaaaatcgcaaaagtagtggccaaccggggaaaatcgcgaaagtaggtccctgtcgaacgggtgcaattcgatagggcacctatcgaacgacgggcagtcgacaaacccctgtcgaacggctggcgttcgacacgctcacctgtcgaacggagggagttcgacagggcccaccacccggcgccgcgaggcctgtcgaaccgggggcgttcgacagggccctccaccgaccctgtcgaacaatgggcgttcgacaggccggtttaaagccccgtcccccaggccgcgagttcgatttgttttgaggaccacatcgccagccgccgccgagagtcaccacatcgtcgccgtgagcgccggagggagcgaggggaggggatagcaggccggagaggaggccgaggaggcgccggccgggaggaaagggttggcgacgccctccagcagtgaagttaaggtatacattagtaatccctaagtacaatgcatatgaaagtttaataaaaaattggtttaagagttgttaattgtttcgcattgttcgatgttagtatgtatggttagcacatatttgttattgctaaatgttggtagagttatttaagtaattgtacggttaaattagttcttagttagtacatattattgatatgttgtgtgttaaaataggtagaaaggtgttatattttatttggattattaaactagttgtttgttactaatagttgtaaattagtacacggcaatatagtataagttgtaatagggtaattatcgaatgattaaatgattaaacgtgagactatttgtcatgttttatcaggatgtcaggtgatatgcccattcgtctgtattatggcgatgctcctatataaatatgtgatagcggggtggatttgactgtatatgccttccatgatactagtctgaatgcaccggagcatatgggtttgaacgacgtgttagggtggttgtataatatgtttggggtagatccaatgcacgataaatttgtcataaatgccgtgtggccagtgaggggtcaacatggatggcagtggagagtagtggaggttgcgtcaactgggagttggaggaagtttgttagtaaagtaagggagaaaggctatagcctggcaatagtggtgcagaagacaacatgtgttgatcgatcgggggagtcaagtcatgccgtggtggaagaaactccgttggaaggtggacaagctgaaaatgtttggcggactgagcaaggtcgagggaaagaagtagtagagggtaatacacaaggagaggtcattgttcgtggtactaatcgtgaggccaatgactcggacgatgaagaaccggattcgcctatgcgtgttgatgcagcggaggagaatgaggcggtagtggatcagatggaagtggaaaacgaggaataccttgcacttgtagtggaaggagaagatacaacactgtgggacaacgaaactaacatacccgatgattggacgaccatatcaatgagtcgtatgaaggtaaacgatggtttagatgcccactggtgttatgatagtaagcaggtgaaagttggacagatgtttcatgacaaaggtcacttacaagatgcggtgaagaggtgggcatttgtccagaagcgtgagttcagggtgaaggtttcaaataggacgacgtatgacgtgaagtgcatacagggtggatgtccttagagagtgcatggttacaagccacaacatgacactttatgggtagcttcgagggttgagcaacatacgtgtttgttggagaatacccgtctggtgcacagaaacctgacagcggcatttgtgacacaaatggtatattcaaaggtggttagaaaaacatctttgtcccctttcaccataatgcatgacgttgagaaagagtacagatatgagatatcgtacgacaaggcttggagggcaaaacagaaagcattggagatgaggtttggaacttatgaggattcttatcacaatcttcccccactattggaggtgatgcaggcaagaaacccgggcacacacatggctattctcgatgaggtgaatgaatatggggagaatgtttttcgtcgggctttctggtcatttgggtgcatgatagaggcctttagaaattgcattcctttgctctgtgttgatggcactttcatgacaggcaagtacagaggaacaattctaaccgcgatcggagtcaacgcggatagccatgtcgttcctgttgcttttgcatttgttgaaagcgagaacacatcaagctggctatggtttttgcggcacattaaaatgtgtgttgttgaaaacagaccaaatgtgtgtgttctgcatgaccgacacgccggtttgctatcagcgatatagaagcttcaagaagatgtcacacagttcgtgccatggccagatttacatagcagatggtgcatgcgacattttggggctaatttttatagacaatttaggagtaagagattgatggacctgttcaagaagttatgcaagcagaattaacaaagaaagtttgatgccatatgggatcaactggatcgtttgaccactacacacatggaagaggttaggaaaaaacctatagttgccagacaggaggagccggagggacttgaacccattcctaatgaagcaccaagtattactcggcgcaggaagcgtggaagggccacgaagtgcttcacggagtgggtagaatttgagccaagggagaaatggtcgttgttgtacgatacagacggattgaggtatggtgtgatgacaacaaatcttgctgaagtggaaaactgggttaataagaaaacccgaccttttaccatttgtggttatcttgaagggcatcccaaggggtacacagaagtatctctgtaaaaggtattccatggctagtctgaacctcagcaaacctaggttaagtatagccccgctattacacagtacatgggatgagaaaagtaagaagggaggaatccacagagtgtggcctgctgggaatagagagttgttatttgagatacgacttcgtgacaagagtggtgtcggcattgggactactgacatcacattggaatgcacgttgtggccagagtatcacgcttgcaaatgcaattgcaacaagccttacctgttacatcggccatgttcccatgttcttgctgcttccgcaaaagggggtgttgatggaaacatttttgtttctccctactttagaaaggaatcgtgggaggcaacttggcgtggtgaattgcgtggttggcgtgccgtgtgcgatttcactcgtcctcctccagggcaagctaattaggttcctgactcaaatttattagttgatactaagggtcgtcgccagtcgcgcaggatcaagaaccttatggatgaagctgaagtgaaagatcgttctcgtcgtaagaaagcttgcattctttgcggggagaaccattcccgtaaagattgcagcatgtacaatgtagggcaagatgccacaggcgctgatgttcgtcgcgttccaaaggggaagtcgaagaagaaaaataattcttagttcgctattatccttggtggactccctactttgaagatcgttatcgttcaatttatgtttagtgcgtctgtaattttaatttgaactttcttgcacttttattacccgaatctatttgtaatggccttgtaattttcattttgaactgcactgcacttttaatatcgtcatgtatttgtattggaattgtaatttaaatttcgaactgcactgcacttgtaatatcataatatatgtgtcctgggcttgtaattttaaattgaaatgtactgaactgttcttatctgtatctatgtgtgctggtactgtaattttaaattgaaatggcatgcaaatttgttacttgaattatgttgcatacatttactgtactgttaccatacgtgcattgtactaatgtggttttcgatctgcaggtatggctgatcaatatgatgggcagctgatagacaaggagattgataggaaccatcgatcgcgacgtcttagtacaggaactttctgcaatgtgctaaagatgcgaggaccggatcaatattggcgtattgatcctctttgggttccaaggtgtgtgaaaatatattgtttttactaatacaaggtgtttatattttcatgtattaataacttgcgctctgtcatgttgtaggctgagagcagctgggttgttgacgtttgcacggttggtcgagccttcacgtgcaaggtccgaacgaatccacattgacgcggcgcttctgagtgctcttgtggatagatggaggcctgagacccacactttccacctcacagttggagagatggtgcccactctgcaggatgtgtcttatttgttggggctgccgatagctgggccagcagttggcccaacaatggtgaatgctggatgggcggatgaccttctggccagttttggtggtgtgctgcctgttgcactggaggatctcacagatgggcacgggcctacgaaaagttggttaaatcagtttcgacaggatgtcttccctgatgaccaggaggagtggatcgtgcagcggcacttagtcgcttacctgttgtggttgtttggatgggtgatgttcacgggaactcacgctgactccgtggacaagtacttcatccactttgcggagcagattgcagagttacctatcgcggagattccacagtacagttgggggtcggcggtacttgcggcgacatatgccggactgtgtgatgcttgcgtgaggaacagcaagcaaagttcactccctggatgcccgttgctacttatgttgtgggcgcacgagcgcttcgacattgggaggcctcagcttgactcgtacgcaaactacggtttgcgagagatgtacaggtctggtgttgatgacatcgacgatcgtcccactatgggatccttgtggacacaccgtgaggtattttttgttaaattcgtttatgttatcattatgaatactagttcacaaactttccttatatgactaatgaaaactactacttgttacagccgcagtgggttagcgggatgacacgtcgtgtctacactcagtttgtagctgactttgatcagcttacgcctgaccgtgttcggtggactccctacactcagcacgatgtcaatgatcgtgcaccgcacggtctcgcggatctttgcacgcgagatatgcaactctggatgacaacttgtcacctcgtggtggacgtgcacgtcgagccacacaatgtccacagggttctcaaacagttgggcatgtatcaggacttccctccgagagatggtcgtcctttggctgatagtcttcataggttagttcacatcacagttgtttaatcctacattttttaaaataaatcactacacaatattttttctgatgtgtgaatttgttgttgtgcaggtactccagaaaggggctcgggctttcctacgagctagttgttgtgaccacggttcagccgacggtacaagagtgggagcacgcagctgataacttggcacttcagacacctccagacgatgggagttattatggagcttaccttcgttggtatcgcagtgttacatgatggaggtgttttcctccacaaggagatagcaccgtcccccaccaggcagcgattactgacacgtttgcccctcagcctagatcagcttacaactcaatggtacgtgtttatttgtggaatttgagcaactagttcaatatttttaaaaagttagcaagtagttcagtatgtctaataaatgtgcaattggttcaactagttccttttcttacataaatgtggaactagttcagtatttataaatgatgtgcaactggttcattatttctaacaaatgtgcatcttgttaaatactcttaataaatgtgcaactggttaaataattttaattgccttgattatttgtggaacaggcggaatttgttgagcacgttcacgtggagtccgacaccatgctgcaaagactagaggcgagacctccagtcgtcaggcctgacgacgtggcgagcatccttcgcaacttccgtgcacgtgctgccgcactactacgtcgtgtctcctgtcggagcgcggcagatgtggtgcagacgtcgggccgacggccatcaccaccactaccccgacgttccagcgtggatcggagtggtccatcctcttcacgtcgcgggtacgaagcggcccacacatctcacggtcgtccttacctttcagcacaccccagcaccggagtacaccagggggtcagccggatcaggggtacccacgtcgagcacggcaccaccacgtccgcaggtattccaaactccgccttatgttcacccctcgcagggagcatctgggtcggcacacttcccttacatgccaacgggggacaacgtgttgaacacaccagcatggggacttcatatcactccgcgtgcgccagagcagggccacacacagcacacatgtaagtcattttaaacaataacacgctttagtttctaattatatgtatcgttactaactacgccatattttttggtttctccctcttgtgcaaacagacgatgagtacggttcggcgtcgacgcatcacggaatgcctgcttactcccctcgcacagcatttattgaggacttcttgtcacaccccaatccggcaccgccacacaacggcacctgataggagcgtgtcgtaggaaaaacggcgcgaatcgcttcctacgaaaccgcgatctcggtaccagtcccaggacatagtgctggtacccacggtgacaaatatgagtcattgcaaatccttaaaatagatagaggacttatttaccttaacttaggttgcagctcagaacaacccgagaatgcaaccgacgacacggacgaggaaacaccaacaacagcagcagcagcggaaccaacgaactaacacccaacaccacaggcgacggctgggaaccaggacgaaaccctaatcttcacttcactttatcttctcttcagggcggaggaactatatatatatttatatagagcaagggtgagtactttcgtactcagcaagtcacgggaacttaggtgtttaatgcaagcttggaagagaggcaaggttgttttgcaaatcttttatttgaagacattttgaaatcactaagtgatttatttctttctaagtttgggccgaaaagagacttgcgtctcgattcgactttaagaggtgcttttcaacagctcatttagtaatgtaccgaccccccgggtcagatcattacttctcggctcccagagccattccacttgattaatcggcaaccagagcctttttcattttctcggactcccagagtccagctgcccagcagcacaacagtccgcttccactcgggaagcctagtctatgatgcccgcagacatcccaaatcacacagattcgtttctgaccactcaggtcgtccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgtagaggggtacactttacccacaagatacgaacttattccgaacacccgtcggtatcggaggttcgcaacaaagcctttcccaagccaacccagggttacctcatgccacatagaaggatcaaatcctcacataaacataggccattttaggcgttcacaaatcaaactccaaccaccttgatcggtaagtgagcaagcttctcgtccttgccttaccaggaacccggtttgtccgaccccgccccgacgttcccaactattggcatgcgaggtttccctgaaccgactagttacttagccagggtgtcccattccaccttgtggttgcactttgattatgttcgatgagtttcccacaggaatcggtccttatatgcgaatacgggacagtgccacataggcacaacccccgcatcgcgagttttcacaattcattttattttcaaacacaccgacaccacatgtcgggtttttgaaggcttcacaaacccatttcccaagttttcgacaaacaacggtgtatgtgggatatttggtatacgcgctcagagagcacgaataccgaggtaccacaagggtggagcgacaaggaatcagggtagtaagacctacggaaattagtgcgactactgggtaggtccgtcggtttggcacgcaaaccgaggccaagcaagttaagtgtgtgattctaataatgcaagttgtaaacaaaataataatgacttttcaattataggggcaattgatcaaagggtgacttgccttgctcaagatcttcacaaagcttcacgaatcttcgaggaaacccgcgatcgacgaaaatccgataaccgcaactatacgcaaacaatcgaaaacctaaacaaaggaccaaaagaaagatcctatttagactaattagtagtgccattaaatagatctcaatttacggaattattggaagtggaacggagtcaatcggagttgcgaattgggtgatatgaattttgaaagtttaattggagtttctggaataggagagatgatttatggaatttatagaaataatattctcaagaatattattgacagtcattgaatccgggaccaaggaaaatgattcatggaattttggaataaggaattgatttatggaacaagggtggaaaaaggaaatcaaggagggatgtatactagacttgtttcggtggtattggtgcgacccaaaagctaacgcgactcggccgaaccaaatgggccggcgcgggcgcgaggaggcggcccatgagggcgcgcggggagagagggaggcccgtcggggtgggcgcggtccaccgcgcgggacccacatggcggtggttgggttcacggtggggagggtgcacgcggaggcgggcgctagggtttcggatgcacgcggttcgggcgcggcgcgccgggtggatggatggcggcgggcccacgtgcagccgcacggcttgccgtggaccgcacgcacgggagggaagacggagggaggaggctgactgggcgcgacttgacccagtcaagcgggcccgggactgaggtggcgtccacgtggaagccgcgtcggatggggaggcagaggaggccgggcaggctgatccgacggctcacggtgtgcggcgggatccggcgaacggcggcgagccggaaggggcggctagcactggcggcaggaggaggagaaggggaactcattccacggctcggatcatgaagaggacgcgcgacgacggccggcggcggcggccaatctcgccggcatgccgacgtggccgcgcgcgaggagagcgaagggtgcgcgggctcgggcttagccgaaccggtatggtgttgcgacgcgcacgcggtgacgcgggacccgatggtcaccggcggcgcacgcacggcggcgttaggcggcggcggaagcggcgacacggcgcggagacaaaggagaaggccgacggccttggggcagccagggggaggtcaaggggatccccgggagcgtggcggcgagaggaatcgacgcgagaggagccgacgacggtggattgcggcggcggcaatcaccggagatcaaaagggga

SEQ ID NO: 38573 - DNA, 951 bp, Oryza sativa
aggcgctaacggcggcggcgaccgggcggttgcgcggcgcaggcgcggcagggctgacagcggcaacgaccggccggtcggccacgcgcgagcgcgggaaagagcgaaggcggtggcgggttttgggcggcgacggcgggaagcggtgtcggcgcgagagagagagaaagagagagagagagagagagagagggagggagaaacagcgagagcgagagagacagagagagcgggcgacgtctctctctctctctcggctcgcatgcgtgcaacgcacgtgcgagggagggggagatgatgggctgggaggggagatgggccgggggaggagaatcggcccatccaaaaacacagggaggtaaagtagacttttacagagaaaactgctttggatagaattggagagatttagggtttggattcgaattcgaatttgatattcaaaatcgagggtttagggatgtatcaagggaaactcaaggagaagtcatgggaaagattcaaaaggaatacttgggtatttgttctcgggaacatagggtggggtcaaggaaaggaaacaaaacgggggtttggacattttgggatttggaaatgtatttggcgaggattcaaaggaagggattgactttcggatttagatttcggagacttgaattggaagaggagatttgaggcggaggattttgatttcgatgagagggaacaacgggatttgaattgatatccttggcacaacttagactcgcacacaaagaacgaaaattttcgcaattaggattttgccgaaatagtttttaacgactcacgaaaagcggagcgttacacttcttttccactgatcctccccaggggaaagtagggatggattactggcacgcagcacctcaggtcacatagcccacgcaggagacggaggccggtcaggggccagacgtgacaccacagcat

SEQ ID NO: 38574 - DNA, 686 bp, Oryza sativa
gacgagcggcggttcggtggtgagacctggggcagtgtccatgcgtgttcggggggctagccgagctaccacgcgagctagggagggagaggacgagcaagaagggagaacggagggtggcactaccaagccgagacgggcgcagtgacgagcggccgacggctcgggagcgagctctccggcctctggccggggaaggggaagaagagggatggccggagtcctcgtctcgtgtccacgcacgcaccggcctccgacgcgtgcgacggcgaagagacgaaggcaagaggtgggagcggcggcaaggcgtcaacaatggcgcaggtgtttcgagcgaggcggagacgaaacgagaggggagggcgcgggctttataggcgagggggagaggtcggtttggaggagggaaaccgacattggcggtcaagggagctcggctggtgttcacgggcggcagcggcggtttcgtgggcagtgcgaaggcggcgacggtgtggatgtgttgggcagcgaaggcggtggatcgagcggtggaaaatcgaaccgcgggagcgggaggattagcgcgggctggcgcggtcaaggtgggggcggcgagctggcgctggcgtctgcgtctctgcctccgagcgctagcggccaaggagtggaggcatggcgtcgttgcttgggagggaaaaagagaa

SEQ ID NO: 38575 - DNA, 267 bp, Oryza sativa
cctaggttcaaatttaatggtgtttgctttaagaacacctaaggggacagcaatgactgcagcatccgcaacaaatgttttaccactgcttacagtaacctccaccctattcctgtggcgaacaatctcaacaaccctaaagaaaagaaaataatgtggattagcaataaggaatggtggatggaaccatgaattttgcttttaaagtgagaaggaaaaactaaatggatatgcatacctgtggccaggcgtatatctaggcctttt

SEQ ID NO: 38576 - DNA, 2467 bp, Oryza sativa
agctggtgtcgttcttggcgcataacgacggaaatgatgaacagtcgaatggaagatggctcctaccgctatcacttggaaaacttgagattaaacatgttgattccctaaaaacgctgcagctctgctttccaggaaacctcacccgcctgaaaacactagtagtgttgggaaaccaaagtttaacatctctgcagctccattcctgcacagcactccaagagttgataattcaaagatgtgaatcacttaattctctggaaggtttgcaattgctcggcaatctcagggggctgctggcacacagatgcctcagcggccatggagaagatggaaggtgtatccttccgcaatcacttgagaaactttacatctgggagtactctcaagagaggctgcagctctgctttccaggaaacctcacccgccagaaaatactaggagtgttgggaagccaaagtttaacatctctgcagctccattcctgcacagcactccaagagttgatgattcgaagctgtgaatcgcttaattctctggaaggcttgcaatggctcggcaacctcagggtgctgcgggcacacagatgcctcagtggttatggagaatatggaaggtgtacccttccgcaatcacttgaggaactttacatccatgagtattctcaagaaactctgcagccctgcttttcagggaacctcactctcctgagaaaattacaagtaaaggggaactcaaatttagtgtctctgcagctccattcttgcacatcactccaagagttgataattgaaagctgtaagtcaattaattcgctggaaggcttgcaatcgcttggcaacctcaggttgttgcgggcattcagatgcctcagtggttatggagaatatggaaggtgtatccttccgcaatcacttgaggaacttttcatcagtgagtattctctagaaactctgcagccctgcttcctgacgaatctcacctgcttaaaacaattagaggtatcaggcaccacaagtttaaaatctctagaactgcaatcatgcactgcactcgaacatttgaagattcaaggttgtgcgtcgcttgctacattggaggggttgcaattcctccacgccctcaggcatatggaagtattcagatgccctggcttgcctccatatttggggagttcgtcagagcagggctatgagctatgcccacgactggaaaggctcgacatcgatgacccctctatccttaccacgtcgttctgcaagcacctcacctccctccaacgcctagagcttaactatcgcggaagtgaagtggcaagactaacggatgagcaagagagagcgcttcagctcctattgtccctgcaagagctccggtttaagtcttgctacgatctcgtagatcttcctgcggggctccacagccttccctccctcaagaggttggagatctggtggtgcaggagcatcgcgaggctgccagagatgggcctcccaccttcgttggaagaactggttatcgtagattgcagtgacgagctagctcatcagtgcagaactctagcaagcaagctgaatgtcaaaattaatggggaatatgtgaactgattactcggtggcttgttaggcgcacctttttccacctgcccaactggcgtgggctcgttcaggcgttcaagctgctgtaaattccattgccgcaatgacgaccttcagaaccgttacacaatacaaaggacatatgatggctagatcaactgtcgcagagctagctttggttcacctgaaaacataaggccaaacgcgtggttcttttaatcagaagtatcaaaaattggttttggtttttaacgaaaagatgttagaaatggttttaatgtgccagattctgtaccagaattctgtattttgctccgtaattctgtgctacgactgatgttgtatttaactgatagcaatcgaccggcaaaaccaatccgctccaatgcattgtcacatacaaattctataattctatctactgaaaaggatgattgctgttcattttcgtgattacagaaggaactgtgtatatcgtgctatttttgcattcacattgtgtcccaggttgtgctcggatcagccaatttcggtggttaattcactttgctgtgtcctctgtgcactcaagaattgttcgcacatgcaattcagttgagcatcgcactacgcaagttttttttttgttaacaaaggagtggttgacagcattgcaggttgctaaaacagtgtcaaaaatttgctaacaaaagaattctcttcagaaatagtatgaaaataaatgccacataagtaatctgagtaaaacagacataatcactagagaagactaacgacaaactcttctttttctatttctgtggtgaaaaactcagcatataatctcatgtatgcattggaggtgcataccatttcgatcatgtatgcat

SEQ ID NO: 38577 - DNA, 3890 bp, Oryza sativa
  unsure (1)..(3890): unsure at all n locations
taatcttgactaaatccaaacagataccaactcctcttaatcaacttacaaaacacctacacttttggtgtctctacaccaccaatcacacaaaaggaaattaatcatccacctactcgtatcctactgttagaatggaggccttacaccagagaatgggcattgccagattctgagacactgtcctttgagctccctgaatctgaaccagtaacaaaaatcaaataagacacaacccaaaaccttccgttcatcaagaagttggatgttcaaattataaagtgacagttcgatcgtaccactggatgatgaggacccactgctcgcggcctcagtatccttctcaatctccactgattggtaagttgctgttggcatttcatccccgatatctacatactcatccaactgctcggcctgtgtagtgatcttgtcaggatccttgctctcctgtaaacaacaaaacacattaaccattataagagctcatctcacacataagctaatagcaaccaagaacaaagcatgctgctcactattgccattgtcacatcaccgttgtccaccatcgtagcggtactgccattcaccagcatatcactatcattagccacggaagcatcaatgacatcggcattttcaccattaacaatggcagcccgtcgactcttgttgagcgccttcttgaagttgttgacgaatcgatcaagctcccactgtgtctcgacatccatctcatcaatatccagctcgatctcacccccaaccagctcaggattgccattcctcttccgcacaatctgcagcacattatgcatcttctcctctggcaagctctccaacccaaccctcaacaagttcttctcctccagcgtcatatccctcttgttcggctcccttgccttcggcttccgcattttcacattcgctgcccttggtttcacctgcaccggagctgtcgccggtggcaattccggtggcggcactggcatcggcggctcaaggagcttgagttcctgctcgaaccaagacatagatgccttgtacatcttctcaaaggacgccaggaggtcgccggcgaaggtgtggacctcgtgccccgcagggttgtatctcagcgcgttgctgaacgtgagccggacgtcggcggcgaagtcgtcgtgtgaggggtaccttccggcggcgaggttcgccctcaccgtgccgagatccatggggcacttgatgactgcgtggtagtcgtggagcccgaggcggtcgacctcgacgggggcgttgaaccagatgctccgcttgtccttccgcagcttcgccaggatctgctcgcaacgcttccgcatcgccgccctgagcttcgccggcggcgtggggaggtcccggcgaggcgagccatggcgcttcacctgaccctgctgccacgtgtcgatccgggcgatgagggcgcggacctggccaagctcgccggcgaggcggtcccgcagcgcgcgggcctcgcggtgagccattgcccccggccgcagcgccacgtagcttgacggcggcggcctcgtggccgagccgttggcgcgctgctggagagggtggttgggatcggaattgggggccacgggcgcgagcggggcacgggtctccccccactggtggtggtggtggtggtggttaaccccgccccggccggcgagcagggcggaggccatcaccgtcgccgtcgccggcgagggtttcgcgtgctgctgctgctgcgctggcgagagtgggtggatccgcacggggaaaggggagaagccgaggagatattttttttctctctctgtggcgggtggatgtgcccgaggcgagatcctgaccgttgatgtctattcggaggcagatcgaacggtggagatctgcgtagagttgcccgcgggcagtggggagtggacggctaggatgttggtaatggtgtgacgtggcaagatcttgctgcgtgatcgttatgacgtgattcgtgaacatataacggtagtgaaggtgcaactgggttattatttgagtgattagtactagtttaagtcttactacgtgattgtacatttgcacttagcttattactccatctgttctatattactcgttgctttgattttttttcgtagtcaactttttaaaatatgatagaaaaatatagcaacatttgaaacacaaaattagtttgattaaatctaatattgtatatattttgatgatatgtttaattggtgttgaaaatgctactattttttctctaaacttagttaaatataaagaaatttgattatgaaaaagaaataaaaaaacttataacataaaatggggtcgtatttttttacacacttagcttattacattgtgatacaactgtatgcatgtgccaatgctcccgtgtcttgctttcgaatctctctgtaaagcgtgcgcaccaaaagaaagcagcattatatggagggagccacgccatgtgcccctttgttctgcaagcatggtttgaactggtctcccaacctcctgatcaaaaggcctacatgtatgtagccatttttcttgcaacaattatatatacaaagtagagatcatagtaaaagtcatcgatatatctaacatatagatacataatataaaacgattaccattttattagctagcaagtacatagctgccatgagcagggaggcattagctactacttccttttctttctttctttcttttttttttttacgttggttagctcaaaattatatatgggaaaggacgtagtagtatgacacgtttcgttcttcgtttaaaaccacaacgagagcatcactgtatatatatgcggatcgaatatatttacgcgccgatctcggagcacgctgctgcttcggacgccggagcggcggcgaggtggagccgcttctcgccgtggacgatggcggcggaggcggcggagctcccgacgacgacgacgacgcaccgcttctccttggcctcggcgcggcgcaccaggaccaacgagctgcagctgctgccgaccatcacattgcgaggaggaggaggcggcgctggcgccacggcggcggcggccgcggcgacgccacggagcagcgcgtagctcgccgacagctcgcgcgccatgactatggccggcagcggcggcgcgtcgggctcctcctccgctatcgtgtccagcatcgccgggaacccgcggcggcggcggggcctgatgatcgacgacagcagcggcggcgcgacctcgacggagaaccgggcgacgagctgggccttcgccattgtcggcgtcagcgtcagcgtcaagcgtgcgctacgcacagcgatcggcagctcaagaatctgtggccatggaagcttcgtgctaagcttactggaaattaatcgtagtctgggtgctcgtatttatagacccgtacactgtcaatttggaattgcaatttaattttgagccatgcaatttgcaagtggatggttctctctggtgggaaactgacgagtagataaattttggaaagaaaatactagaaatgagacgattttggaggcagggataaatgagttgaaacttgaaagtgatcaggcgaccagagacactatcaacgtcactgtgataatattaatgtagtagtaatgcctagagaagtgttgctatactgtcccctgataaatgaagaattgtaaatgatgaatattcagcagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 38578 - DNA, 2293 bp, Oryza sativa
gagtgagaacatatgcataaatcattcatatagcatccaacacgtactgatgcatcatctctctcattacgcgacatacagtacagtatacaatataaatgttgttttgtaagcattctaatgaagaaaaaaatctcggtacgcatcgccaataagaatttcagcaaaagaaaaacgatatatttagtaaagactactgtcaatttcatccaactttttgtagaagattgtagcgaggtttccccatggaggacggcaatcacatgaggcggataagatcggaggagttcctttcatctccttttaggaaatttaacttccaggggcgctaggctgtccctgtacaagccgtcctctgcttgctcagccagcaacttggcattcttcgtacagtaccatggtgcacgcatgggttatgaaaatgaaacgaaagtttttttaaaaaaaaacaaatattttgaagccaatattatagttataagaagtatttgttgccaagattgaagctatgtaaaactgtgatgatcaataggacaataggtgtgagtgcacctgtgatattggtataggcccatttgtcaatgtgtgttacaagattattcgacagtaatagttttcatgtatgggttgtcagttccatttccatgtccatgtcgaaatgaaatatctggtaattgaaacatcattatcaaatgtttatttttagagatcaaattgcagtaatttgccggaacggagctgatgatatatgatcacaggttttttttctttttggcatttcatctctcttctcatccacatgaacccagtgagtaactgttgctccacaatcagtgagcagtgaatgtcaatgccaagaacagtagtatatcaagattcagtgaacaacatcccgagagtacttacattttggatgtcgtttggtgccaattggcagcattcagaataatgtgcagagaatctcatgcccatcatcttacgtttcagaacagtagatgaaaattcgcaagccacagaatgatgacatggaaggccagtaggagcacagtaaattaaaatcagcacaatccattgctccccttctctgagcttggttaaaggattggagatcagtggtgctgatctatcggtcgaaatcagtgtagctgttactggaagcccttcaccctctgaaacacgctgtgagctttgtgaccaggtaggttcagccgttcaggggatccaaattccaatggcatcaatcaacatcgcgctctacgtcaatttcgagccggtgcttgccctttgcaggcagaaatatacagttgaacaaatactgtactacccctagcatgttcctttgcaaaccaccactttctgaagtcatacttgtatcatattcatatgcctaaccttggcgtatccctcttatgctgttatgcaaataggatggcataagcttcatggagatgtaaccaggcatgcaaattctaactcgaccaagatgacaggaggcggctgcagtatttgggcaataaaaatggcagtttcaagtttcaaccatgttctgcagctgagggctttggtggtgttttcttttcctttaagtatctttaaaagggatacaagtagtaaccaccagttaatgaaatcccagcaattatgtcaaaaaaaattgaaatcccagcaaaactaggctcttttggctctagttcctaccgggcatgctcccgtagaaaacaacattacgtcaaacttgggggcaaagcactcattcattttcaatatcgatcgtttaaattaattgttcgtcacacatacaccatcttgttcagtaatgatggctcacattgtccgtaatccctgcttaactacatattgactccctcattttatactcaacaatacacaccagactcccacactccattttcacagtgactttatttagcgcaccgcaagctgcaccagcacactcctcatgccaaggagaagcaaataagataattgctccaatgctgccttcctcgagcaatcaggggaatggcttagtgcgctcgccgggtgccaagtgccaaatggccttagaagactataatttttgtgcagctcctggtctgttcacagccgggagatgagcagtgggactgagacagtggcggtctgctcccccattgcagggtggcacatctccagcatgtccagctccctgaaccgctcaagaaccctcattcggcactcctcagctgccatcagaccagtggagaaggcgccatgcacgtgccagtgtactggacactggtggcttctccag

SEQ ID NO: 38579 - DNA, 1068 bp, Oryza sativa
attgcattgaaaaaggagctcattcagcttaaatctaaagtgcaaatactggctggcacatgtaccatcatatgttctttatatgactgtcaacacaggaagcaacctgaaagtttcacatgtttgatgtagttggatggatgcttgtgtttcatgaatctaaaggttttgcaccttaaggctaacggtttgcttcattgtgaaagggggttttatacctccaaatgataaaaatcagtttatacagaattaacataaagaagcctaccaagtgatgaaattgccgatatcgcctgttcttctcacatcaaccctcctctaccccctccatcatggagggttagtagtgaggcatgttcccctgtctcagaacaatgatggtgaggtaagacaggacaattttaacattctgttgattccccacagaaacctaaccgcttggtctgtagctacacattggaagctgagatgtaggactgatcaaatttttcgctgggcaggcacaccaaagactctccgttaaaacacaatgacctcaaaggatgtgcaaaaggcaaggacacaatattattattgtactgttctttctagttatgtggacatggtgcaaattcagactaatgggcgatagacatgacatgaatttgtggctatatactgtttatcttggaattatttggtggcatactataaattagacaatcttttagcgagacaaccctctgccggatatgcttcagagcacttaacaagcaaaaaataatggccaccgaacatctcacacaatgactataggcgcactaaaaggcacaatccaaaagtaaagatatccataaatgagacagcaacgaaagccaacagaaaaaacattttataagagctgaacagtaaaataagaaaatggtggcattggaagataaagaaacttagataactagatccaccagcgaatattctcatataataatctgcaccctacatgcattacaatactatatgaatcatgcatgcatagaatgtccgcatggcactaaacttaacatgacatgcacttttgctgatctaatt

SEQ ID NO: 38580 - DNA, 6365 bp, Oryza sativa
ctaccaccgacagaggaatatgggaactcatccacgatggctgatgtctctttcatctggcccactaggcacctcccaacaaccataagcaactcagtgtgtttagattatcaaagcaattttatcactacaaccacctagagagtggaaaatttcggtttttgcactaaggttgcattaagtgcacaaatccctaaaacaatacatgttcgatattctactactagcagaggtattagcatacatcagcaaactttataaaacagtttcttctaaattcgattttccacctaactttacattaacagatgcaaaaaaaaaaagtcttgaactgagagggggactttataatggaataaacaaaataacataaaaatcagcaacagaatcaccacaaaaacaatggatgagaaaatctgccaaacgaagccaggaacttactgttgttcgccattgttggggttctgtttctctccttcacgattactactcgaattcgaattacaattggatggatttaacagaaactgcggggagaaatgcagcaggaagatgatgaggcaggccacgtagtggttcgagttcgagttgagtcccaggttcacgaaacagttcatgcagtcgtgcagccaaatcgccgcaacctcctagcaatttgatgtccaaccctttcacgatctcacgtcagcgccgagaattcgcgcgatcccatcaacttctcaggcaatccggtttaagtctggatcaactcccgcgtgatatcactgcgaaaaaatcaaaggaaaccaaccgtttattattcacccaaatttataaaccttcagttttagtcacacaaaaaccgcttcccagcacacgaaatccgccgcaaaatcgagagatttaagcgattcaagaaagccgatgattaaaactagaccaaaaatcaaccccctaagtcatcaggaagccaatctccgaatcccacaccagaagcgatcgaatcgagccaaggcaatcaacaaacctagggctccctatctttcccctcgcaaacccagtccaaaaatcgcacgcaagctatacgaaatcgcgccacacacccacctcgagatttcgattcgaggcgcacgcagtcgatcggagcaagagcaaaaaaaaacccgaagcagtcttgcggcgatcgatcgatcgatggatcggatggttttcgctggatttttggagattttcggagagggggatttggttttggggagaggaggagaacgagaccttccgctttcctggcgtttcgggagctttttgggcttttggaggtgacgggatcctgtcgagttgggggggggggggggggggggatttatagcttccttttcccgggggttacgtgcaccaccagggtcagcttaccggctacgtgggggccaccccaccaaacccgacatattttcaccgttgatctggattggacggtccggatcgacgccacgtcgcccgaaacgttggtgaccgcacatctgacgatattttcagcgcacatttacaccctactatgaaatacacaaccgtaaatcggacataatcatcgtgtacaatagggtctactaagtaatttttaagattgaacaccctccgtttcacaatgtaagtcattcaacggagggagtactctagtactgttttgtcttaaattattttttttctttttatatttaattaaagtataaacggacgcacacgatacatacacttcactttttactcactccaccacacacccacacacgcatgcacgtctttttatagccaggctagaactcgtaacagtattgtattatgcaaaaactgaacaatttcacgtgaaacatctgcaaatctcacgggaagccctcgagtttataaaaaagtttcataccgaataataatgtaatgtcatctgtgctcatccaaggtcatttgtgtgatacaataacacccaatggctccactagatggtactacaattggaggagcacaaactgcacagatgagacatgtcctgcacagatgagacatgtcattggacgttggaatttaactaggtatatcttcctccaattgtcccatgattaattttaaaaatacttaatacctttcgtcttccatggtgagttcattgatgatgcaacacacaatcagaggacggtcgttttattttcttgacctggtaaaggtgcatttataggtaacacgtttttttaatcctctccttaactataccccttttgcatatgagagccacttgcacatttatctaacaaggagcaactcgaaaaatcaaaatcaaaaggaacttaattcaccactctgactcattccattgacacgtcaccagttgcatttccacagcttatcattgcatgcaacacaaaaattgggaggaaaattatcacaaggaggaccatctcttctccgttctcacaaaccatgcattagcaccgtttcacagagaagagatccccttccgaaaaaaacaaactttagtttatctgatatttcaaaaagttatataatacgtagtactaactggcatgtatatcttgaaacccgtcgatccaaaaagaattctcaaatcgtaggaagaacatattcactggaaaggttgatatcgactggagcaaacagcatcacgatcacgactggagtacagtaacaagatggcaaattaatgattgtctaattgacgtactagtacagtttttttttttatttttcgtgaacgcgtaaaaactgttcaagtcactgtggatatgtttggaagatcataaaattttaaaaagctaccggtaaggatatgaaaaggttaagttcattttctaaattatataactatatattctcaaaatttaaataaaaatctagacggttgagaaagcttcgcaactgaaaaattttaaaagaagctaccggctaccggccctaccgctgtcagaagttgtccaaacagacctatatagtttcgtgcccgtttatcattggaccgcctatgaacccactgctagcctcgtgctcgtagattggcgacaactagctacgcatgcaaaaacgatttgagaaggaccgagaaagacgtgcgtgatggggccagataccgtggcctggcctggcctaaccggggccatcatttcatccaacgcacagaccattaggctctcgctatccgaaagaacagaaaattaaaacaaattcgccaccacaaacgatcgcgtcgctgcatctgctctctatctgtacacggagataagacacgagggaattatgcacaaaaaagtctctctctctctctctctctctctctctctctctctctcattttcggaggacgacgttaatctcgttaattaattcagaacacgtaatattcagaatatcaccagttgatattatcacataatttagacttttaacagagacgtgatctacagtgcattattcagaggatgcggcaaatatagagatgatcattatatcgttgaaacggatgagcgcgcgtagttaatctgtcaattattcgccgtcattttcccgagggaatatcgtgttcccgtggccatttcgtcttgttccgaggactaaggacaaagcttcacgcagtacgtgttggcgcttttctggccagctggacgatcatgccatcaacacagacactgaaagaacgattactaccttgctagtgacatgcatggcacgccaccttaattatatttctttccatggagctcggaccaactgcttgatgaaaccaaacacgagagctaatatgagtttcttatcattgctagaagtcgaaatcaaatcacgaggtccccaaacagtaggccattaatcttagctagtactagtagctactccctccgtcccataatattacaacctcgaattggatgtgatgttttatagtacaatgaatctggacatttatctgtctagattcgttgtacgatgaaatgtcccatccagttcaaggttttaatattatgggacggagagagtagttggcactttagatgattaataataataataagttcagctctgaatgatttatcacgtaaatgggaggataagaatcgaggctagctatacacgatgcttaatttcgtcgttgtaagttgtaagcgagaaagtgacagcttcctcagaagcaggaggccctccatggctggagcgaactgccagtgccacctgctcatttcgacgaatctcggcttttctcgctgcacatggaggaagaaactcatcaacccatctgttagccggtcggcactctggccggatcactccgtcggcgggatccctcacctattgtcacctcacccgtcgattggcaatttgtccgtggcatcaaggctacggagtagttcattagcgtataattaattaggtattagctatttttttaaaaaatagatcaatataattttctaagtaaatttcgtatataaatttttttaaaaaaacaccgtttagcaattaaaaaaacgcgtgcgtgaaaatacaagatcgacgacatagtacggccgccaatgcagcgagcaccagcgcctcctacgtgctgtaccagtttccaccaacctctgcctttctctgttgcgcgcagccgcgcgcgcggggtctcgcgccgtccttggcgacgagacgacggagggagcgcgcggcagcggcacgcgagagagtcgttgtgttgcgcgctcacgcgcgaggggatcgagtgatcgaccgacggatgcttcaccctgcgacgcccgagcgcgcgcgtgagcgagaccacgccaaacacgcgcgcagcccggccggtgggctgcaggaaaacgagtggatcacgcggacgcgcgcgcgcgaggcgcagttggtgtgtgtcccgaggagtacgtaggaactctactggtgtggcgctcggagtcggagaagctactactcggctggagtgcagttccagccaacacggacgtgtaccgagtaccgacggtgtaattttcacgggccccgtgatttctcccgttccaaaattaaagatattactacgaatttgaaacaaggaatttttacacttaggtaccacatatcacccattatttgcatttgacttaaataattatatatatttttaaaaaatgtaaacataaagaaaattatttttgtatcaaagggaaggcaccctccatttacattaagattgaaaacatcaattgggatgacataagcctatagacagacacgcaagactaaatttaattcatagctagagagaagaaataataaaatcaagtagagaatagtatatgtgcaaatcagataaaatttgtttttttatgcatatatcaaatttagatttgcatgattgcgtggagtcttataatatcataatatttcttgtcaaattttataaaaattttatataactatttagaccgcatgcatatacctagatgtcatggtatctagtggttgaaaatatttttcctacgaatcaggactagtattaggattattaacattttaaactaggcttatttattttgagatatatattataaatcgtttgacttttttatagtcaaacttatttaaattcgatcaaattatagtaaaatatagtagtgtttccaacacaaaacaaacatgttatcaaactacattcaattttaagtttaataaaactaatttcatattttagatgttaattttttttctataaatttgatcaacctttgttaagttcgataaagagtaaataagctagcgtgcaatcggaaggagtgcgggtcatggcgggccaggaagaagaaatcgaagcctcgtggccgatgctggcgccatacatgcaggacgcggtcagcgcaagatggatgtggagccgcccgtttcccatgtgttgaagctgcaaccaactgggagcaaaacatgcatgtgctatagctgatcctgcaggtccatttctcatgctgcaagagggcgtacgggtaccaggtttccctcccatcatcccatgtaccttgatggcttgatccgttgatcgtgtgcaaacctaacggacacttagcgtgagaagcatatttgacatatgagccggtaaagcattgttgtcacacgcacatgggaccgatcgacccctcgccacaactaactttgtccggtgccactatgctaatatggccggtttaagctattgactctaaagatcagggcaaagcgcttctacctcaaagaaacgagggacacatggctaaagcacgaaggttgcttttaatttggttgggagaaaaagaaggggtctagaagcatctgtctactggcacatcatctaaccaacacgctaaaagagcatgactagtgggagatgc

SEQ ID NO: 38581 - DNA, 2186 bp, Oryza sativa
tcattccacactgaatccagcaccgaagcatatcaaatagatgtgatggtcatccaatgcaaatggttcagccatggttttatcatcctggtagcaatgaagatatcaacttgttcggtccaaattgcaggtttttattgaaaaatacaggtactatttcaatagtaaaaaaggcatagttctttaatgccgagatgacaccagctagaaaaatatccagcatgtgcacagaaggttaaataagtttaagcactaaaaaaagctggagttttaaaaattaagaaatcttgctgaattcacttgccttcatggcctcgtttattagttcttcatttgtcagttttagatcaaaagtcattttctggaaaacctgagacaatatcataacatctcgcattgctctatgcgcatcgtcatgcgagacgatgccatagtgttctctcagtgcctccaagcttgtacgacgttttttccctgcaacagaatagtaacaatatgtaacttcggctagttattattaaatgaatagaccaaatagcacagatagggaacctaattgagaaatgaaaacagtaaggcagaacaaaataaaatgagatgtgtccctaactgggccccaacatatgtacagctccaagctactgctcctaactaggacaatatatcagcatttcacttttctgttaatcctcattatgacatacactcaaagcagtacatacgggaacttccagaaaagaataatatgttcgcttttcgacaaacaatacaatgtcatataaaaacctcaagaacggtcagcaaattccaagaactacggatttgctaatagcagaaacatggaaactgagttgtactactaaaccatacacaacatcctaacagaagcactctttttgcatggttaaaagatgaagtgtgggtttcatcttactcaatatgctcctggcaagcagatagtgagtcgtaattaaatgaagaatctagcttaaaaggatgaagatagtgagaatgacacactccaaaatgctgcgagaagtgtgtcctttttttcgcatgctcaaatcaaattgaccccaaaatatacagtatcttcacatgcaaaagacttagagtgagagtacttaccctctgctttcaccatcttttttgccaagagaagggtgtcaaaaaacagccaatctgcaggaagtggtgctgaacaacgatcaaactcctgagcaaggaaacgagcatcaaattgttttgcgttatgagcaacccacagaactggcttgccaggagcttggcgacttcgaacgaatgccaatagtagtgggattacatcactaaacctgtggtagtcatattaagataacattcagaataagtgaaatagtaaattaactgttggtgaagtgagatatgcataaccagttttccattgcaaaaactaacttattcctacaagcaaataatttacaataaaacctgccttaatggcatgcatgcttgtgaaaaagagggaatacagagctattgcatacattttccataactaattcaatactatggtctgttcacagcatcatgttgagtgacaaatacatcagggcatgttgacgacgactgttatcaagacatgtgatgaagagattaggaataatatggattcgttggatgcaaaacacaccttgggataccaggcctgcacacgagatcagtgccaattttaatgagatgttcaacgtagtcaggaacagtcctttcaggattaacaagagtttcaaaagtgctattctttcctccagaaagatcacagagtgcaaactcaactattctatgatccttatggaaatagccagtagtctcaagatcaaaaactagaatagttgctgccgccgcaacttccttcccatgttcctgtacttgtgttgtgaaatgtcgtttcccacagcttctaggatcaagcaattctacagttgataatccggcttgttgcttaagaaatctgacagggaagctactccatatactgttcctcagctgaatggatcgaagaatcgatgacattgtgcacaggaaatccacttaaaaccaatacgcagagccaaacctgtatacattgtcccacacaactaccatgtcagagtagatggcaagtaatcaacctcacagtgtttcgatatgaaatttaacctcccccc

SEQ ID NO: 38582 - DNA, 14967 bp, Oryza sativa
tgaaaccagtgtaatttaactccccagcgatgttggaggatggttttaacttctctagcagttttggagaacggtttttactgacgtggtggtgttgacctgattttcgtcccatgtgggggcttatgtggtattagaattaaaaaaaattatgtgggatccatttaccatcactctcaaaacatattgcaagacccccatcctctctctccaacccttcttcccttggcttctccccttatcctcatctagcatcggtgcagaggctgcgcgcggcggccaggcgaggcaacaacagcggcgacggtgatggtgtggagttggctcgccgatcccctccttccaacaaccatggacgacgaggaggagcatggcgcagcacggcgcggcgttgctgtctcccttgtcgatggccccatctctcttatcgggagccttccctcctctccgtccttcaccacccctcccccctcccagcggcggcggtggagaaggccgagtgaggcggcagtggcggtggaggaggctcgctacctctctctctctctctctctcccgaggacccttcctcctcctctccatccaccctccaccctctcttcactgtaagtgcggtggccgatgagttagcggtggcgcaagtttgggctcgcctgacagagcggataggatcaaggaaaagggtggggagctagagtaggaggctggtcgaggatggagtggagcagcgcaggggagcttggggtcatgctcccaagcagcaagggtctcccgcgacggagatggacaggagcatcgcgagcggcgtcactaagctcccaagcaacatggacgtgggacgtcgacaacgctaccgggtgatagagacagagtcggtggtgggagtcggatgtggggaagggtgacgaaaggggcacagagaggtgaggaaaactttggtggaagggccacagccgtcggtgaggaggcggcaacagagagtgacacgaattgcgttgcttggtatgtgaggaacctcacccacaatgacatcgtgaactcctcccacacgcgtgcttagttgggaagattctcctctgcgcgtgcccaactgacgactcctctcagagcacgacctcccagcgagatcctccccagcgcacgactggccagcgagctccttccccatgcgcagtctcctggtgaggtcccccctcacatgttgggataagggagagagagaggggggaggaagaggggttggagagagaggatggttgtgggtcccacaatatatttgagtgtgaatgacagatgggtcctacagatatttttgttaattctaatgccacataagtgtcacgtgggatgaagactagattaacaccgccacgtcagcaaaatcgccctccaaaacctctgagggagtcaaattgcactggtttcaatagttaaggagtcatctgatccagttttctagttaaggggtacgaattagagcggcctccttctgaagggagtcggagtagactttttcctaacggcgttgtgtgactgtgcggtggggcctttcgacctggtgagagatgggccgaatctaacggcccgttcctccgtggttttagtcaccgaaccccatgacaaccggagtgtactgagtaagcacggcctgagtaagatatttgggccaacatttatgtgctaaatcttctttgggccaaggcctgattaaatttagttcctactactgtagcgagcaagcttgctttcttcagttttcgttgcagtataaactataagctgttaagttcgatcaaaatcaatcttacatttaagatccaaaccgatgtgatgttttgttaatcatccaaatcgaaatcgagacttatcgtcagctagattagaagctaagcgtggggctatacgctggcgttttcatcagttggttctgaaggttctttcagtatcaagtgtactgtctgcatcctgcagtgcagcagggaatagagttaacctctctctaattattcgtcctcctttttgcaaggatttttttctgtcttacagatgaactcgggtgaatccaaaagaaaccaaattgatcgatcgatcaagatcaagtacagtaattcagtccaactccaaccactgtgtattgccactccatttctacaattctacagatgcacaaatctctatttttctttcatttcgtcagacgtgacgcaaccttcacgagcaagcgtgtgttcgtcgtgcttgcataatgctctacttgtccacatcacactgccccgtcgttgctgccgtccttatcccccgtaggatgactgatccttgtcttctgacgaacagcaacaacaacgcatgcactgcactgagctgagctggatggattgtatatcctagtatgtagacccgtatctgatagtatattgagatgtgaaaggaatacttcatagaatctttgccccatggttaactattgcagcatcatggaatcacgatcctgtagagattagttgtcttttttacagagttcggtgtacaatctctgtaggtgcagtgctgtccgtaggagttggtggtatttgctgtcatcctgaagctttaaggtgttgtttggttcactcccaatcattgccaaacctccatgccaaacatagctaaatttgtggcttataaattgatgaccacaccttaggtaacttttggctaaaagatgggtgtatgacatgtgggcctttgaattgaaaaactttggcatgccacaactttggaagtgaaataaacgagtatcctagaaagtgtagcaaagtttggcaaagtgagggagtgaaccaaatagcccctaagtagtttcacaaaacagtggctgaaatacaaacatgtttatgaatcttggccctttttctctctgacttattcatccaattattaaatcatatttatttatcgcattattgaaacgggctatttgcgtcttcatgacgagagttttcgaagaaaatccgtaacatttttaccatggtaagcaaacaaagactatatcaaaactgctttggagcaaaactatgggctcttcctaagaacatttttttaatttctgttaccagttacaattgatgtttaattaatttgtgtaaaagaagcatatgctggcgcgagtatgtcgcatgattttttattttccttggcctatctggaagcaacatgtatgtgttattacaaaaggtaagatcagccaattacttctcagtagtgggtaagattaaccaattacttctcggtagtttctcactcttgtactccaactgggtgtgttagcctttctcttgtgacatggaaaattgtattcaaaagcttggaaacaattttctatatcaatttgatctgtagataagattccatgcacgcgcattgatggtgcagaaaagaatttttagttcgtgccaattcacagaaatgacaatgcaataaggcattcgggagcttggtactgtttgtttgttctttaggtgccagaaacaaagggcagaaatcaaaaacttgagatggtcactactatgtcctgtccttagcaaggaacatccatgtgcaagcgtgctgttcttgcagctgtccaaacaaaaattccaattcagagaggccactagcggcatatgcaacgaaccagcaatttaattattgtacttgtatagcataatttaccatgaaatctgaatgagaaaatttacccccctgtataagagcaaataatattttccgcattacttgtacaattttttttctcctgttatattcaataaaattagcacaatttagtgtcggttcattaaaaaaaagaatgagaaatttggggtcattaagacttaaaagaggtactaaaattttgtgtatggagatttttttttggtgtgctgggagtgtatgagacccgtccatcacttctaatctaataattaatttgacacctcctgttatctaggtactgaaaggtagcaatttttttcgccggcctagctagctagccgatgtattaaggaggagagggtttagaaactgtacagggatgtacaaacagagccaaaagccaaaagtctcacaccaaaagccaaaagtctcctactactttgggactgttcctcagttacaaaagagatagtaatagatagagaagcataaatacctccattatttgtagatgtcacttcacatcaaagaagaattcggcttaatctcatcttttagatgctagaagatccttgctgtgaatggctatcatcgcatatttgacacaaactgcaccaatgctttcttcattccattattagtccttagatatatcagacgtttgatacaacacgcacacatgcagatatgctgcctgcctgcctcgtcagaaattaggaacaaactctcctggtccttaaaatttactagcttcaaatttatcctaaaataaagttattttttttacctacacccatatcatctttcatttaattttttctatctactttatattcttaactaattacttccatcaaaaattctaactgttttattaataatttatataacaatataacgaaaagcttacattttaggacggagggaatatccgtttgatgcacaacacaggacagcagcacagcaaccatctgagcctttaaataccccacaccacgagacctcccctgctccgctccaagacactcgcacgcagacatcacatccattccaggctcgatcgcttcgatccctttgcctgagaccgagtaagccatttctccctctgatcctcctgtgaaaatttctcctaacctttgtgattgtttgcctggtttctcttttattcttgcatgtgttgtttcagtttcttgtagcgtgattcttggagataatttacaaggatgagggttttctgttatttcttcccgaatctttgggatcagtcagatctgttctttttcactgtacagttcatcagtaatactgttggagcttcgattggaatcaaagtttagattctgcaaaccattcttcttgattgcatggcttcatttaatcatgcttcttctttttcttcagtttttttaaactgtactgtactagaggcagttagagtataactgttaatggatgaacttggtggctgaacttctaatggtgatgacttgagcagagaaatggagctaatcacaaacgtctccgagtatgagcagcttgcaaagcagaagctgccgaagatgatctacgactactacgcctctggtgcagaagatcaatggactctcaaggagaacagggaggccttctcaagaattctgtaagctaccttccaaaatagtaggctttatctctagaaaatatattagacttttagctagctgtttctatctggtagcacactgctggatgaactgtgtttgttttatttacatcagcagataataattgagcttaaagtagtgcaattgaaaagttcttggaaatatttttttcaaaaggatcccagttccatattttttttgatgtctcatgaaaagatagatgatagatatggccagaggcgtctccaatcctagtggaaagcttacaagtccgtgattataattaactttcggattttttcaagtttctgacaaggtttgagtgtaagtggatcagtttgcctttgattaatgtaatgacatggcggccaaagtggacaaacaacattgagtagaggacaaagatcagacgtgtcttgtgacatgtggtttgtatggtcaaagtagatgacagtttcattaagaattctcatacaaagatagtactacatgacaacattacttcttctcggtttcaaaaaaacaacattacttctgcatgtgaagatatagatcatctgcaaggctccagctcattgtagaaaactaggcttgcattcgtttcttttagacttgaaatatttctcttcaaactttgctgctcccagtttctatagctatcctggatatatactgtcatactgatgctcatgctagatgagaaatactctagctcagaaaaaaaaacacgaatattaaggaaggatctaatataaaataaatagaaggagtgaggtttcgaacccaggccggctagtccaccaccttgtggctctagctcagaaaacgtctgttgacaaaatagtcatactgcattatcttcaatcggatacaaggaagtctcgcacacgtgatatatttgaatatgaaaggtattgatcacaagattcttgaactttactttacccttccctgaaaaatggttccaggtttcgaccgcgaatactgattgatgtatcccgtatcaacatggctacaaatgtcttgggcttcaacatttccatgcccataatgattgctccctcagccatgcagaaaatggcccaccccgaaggtttatccaagttgcattcacctaattctttcctctttattttttttttcaaagcaatgtttctcatggagatgtttatctgacatgcaggagagcttgctactgcaagagcagcttctgctgcaggaacaataatggtttgagagatatccaaaagcttgttatgttttttttggtctcaaaatgattaattcagtgttctgatgctatggctcaacattatgttttttttttcagacattgtcttcatggtccacttctagtgttgaagaggttaattcagcagcgccggggatacgtttcttccaactctatgtatatatttttcttcaaaaatacttaagatgtaatgaggagcagtgttttcagtttctaaaccttagctgagttacctctgtctttactaggtttacaaggataggaatatagtacggcaacttgtcagaagggctgaattggctggttttaaggcgattgcactcactgtcgacactccaaggcttggtcgcagggaagctgacatcaagaacaggtcctaatctagcaactctgtacacaattactgtatgctttaccacgttccatactgtcatttcatcaggggctttacagtcttaagtatgtattctgaatttccgatgtcttgcagattcaacttacctccacatctggtattgaagaattttgaagcgctggatctcggcaagatggacaaggtttatctaaaactgaacccttatgcatctatatatgaacaaaattttcttatattcttaaatgtgttttatgtttttattcagacaaatgattctggccttgcttcctatgttgctagccaagttgaccgctctctgtcttggacggtatatgcttcgataccatccttagttttgtgcaccaaacaatgaatcagaaactgggatactgtcctggttcttctggcacttctctgtggcaatgagatgctgatgctactgatgcacaatgcaggacgtgaagtggctacagacaatcacctcgttgccgatcttagtgaaaggagtcatgactgcagaagatagtaagtgcagtttcagagttctggttgctcattgttcattgttatggcatgccatggtctgatggctgatgatcacatgaatttggtgcaaaatgcagctaggcttgctgtcgaaagtggcgcggccggtatcatcgtgtccaaccatggagctcgccagctagattatgttcctgcaactatcagctgcctggaagaggtatatgctattaattgctaacccagctactgtcataaaatgcacttgtaaacatcttcagaggaatcttcagtgcaactgacatattcagaaattctagcaagaaacttccctgaacttccatgatctatactgaaagtgtcgagcaaactcaggtcgtcagggaggcaaaggggcggctgccggtgttcctcgacggcggcgtccgccgtggcacggacgtgttcaaggccctggcgctgggagcttcaggagtatttgtttgtccccagagcctgcattttcaatcaagttagtacagtaccatctgaatttacagcccgcttaacgccatgagcatttgggtgttcgtcagattggcaggccggtgctgttctcgctggccgtggacggcgaggccggcgtgaggaaggtgctgcagatgctccgcgacgagctggagctcaccatggcgctcagcggatgcacgtcgctggccgagatcacccgcaaccacgtcatcaccgacagcgacaggatccgccgctccaggctgtagaggctaagctctgcagcggttgcagtgatcgaattgtccatgtatggtatgctagtccatttgagatgctactgctagtagttattgtgatccctcccacatttgatgatgccgggtaataaggagagggaggaggctgggatgtgtgcctccaggtgtatgtgttcggtgttcctccgtgatggaggagtatgtagcagggaatttgtcactgttgctgtcgttggcagggaatttggtgattcagagtagtttgtgttggaaaaaggaaaatctgtccaattctgtctcgacactgactgtgatgctttgcatcgtcatttgtcgtggacgaaacgaagcttttgcctctgttcatgatttttttaaccttttttattttaaaatttaaagataaacccttccaaaacttatttccaaaatataaaccttctcatcacatcagccagagtaacgtggccaaataacgctgccatgtcagcgagattggcgtgacaatattgttttgccacatcagttcagctagcatggtcaaaatgttcggattttgaaaataagtttgtgtagggtctatttttaaaattgaaaattaaaggttaaaaagattaaaaaaaattctctgttcatagctcaggaaatcgtttgctctctgataaatgggccccaggcccactgtcagtttcacatacactcctccccagtcacctacgaattccgccagcggcagtggcggcggcggcgctcctcgccgccggccgctcgccgcctcaccgatgccgttcccgcgcctccccgcggtgtaggtccagttcctagcagccagcgcttgctgcctgctggcctttcaactgcctccaaggctccaaccctagcgcggcgccatcatcatcccaatcgtccgctacagcctacaaatcgcggtgatggtcgcgtcagcgtcgcaagctaccgaactagcgccgcttcgtcgtcctgccgctgcggcttgcagggagagacagcgagagctgtgctgatgaagtgatgaaacttgtgggcttgcggcttccaggaccaaactgcaggtaccagcaccaatttttattccaagaacacgcgtgatactctcctctagtaaaatacttcagatatcagtcaatctttggtgtcttgctgatggggaaaatctgattcttgaatacaaaattagtacacaagtaaagatccttcctacctccaagatattctcccctgtcactgtcggtagatcaccactctcttcctcatccacacagatgaacacaaagaggaaagagcataaaaaagccccccaattcctccttccagttcaagagtacaagaaagacacaagcacagacaaaattcctgagccctgccccccgttgcttagtaaacagtgagtcctcttgctgatctatcgtgcagaaattccaaaactacacctttggttttagtatacttctttttcatgcatgtcttttaatttgatggatttgtgtgggggaaaatgtttcgcttgagcttctcgcatgctctattcctgttttatttcatcaaattttgtgaatctgtaagattaattcgattcatgggtaattggtaagcacgacatctgtgccattttatatcgtataagcacctttgtactgatgcatattacataagggccatcattttttttcatgttgcttttgccttccatactaagctggtcctgtagcattttggagtttttatggctgtgctgaagataataatttgagcagggagatggctctggtcacaaatgtgtgcgaatatgaagaacttgcaaagcacaaactgccaaagatggtttatgatttctatgctgttgacgcagaagaccaatggactctcagggagaacagtgaggcattctccagaattttgtaagttgtgctctaaattggtagggaatatctgaaaatggagatagggaggtcctgattttgtgttatattcatagaagttattgttaggatgtagcttttagttattttcatttgacattgtgttttgattttgaaataaaatatattacccattacttcgtctttcaaagtatattatggtgtcctttgtggataaatgatgttaggtttcagccggttgtattggttgatgtgtcctgtatcgacatgtctatgagtgtcttaggctacaatatttccatgcccattatgattgctcctacggctttgcacaaattggcacatcctgaaggttctggtttgctacctttatatctttcttttggcaatcgcatatttcaatgagaagttcctttagggatatttatctggaatgcaggagagcttgctactgccagagctgcagctgctgcagaaactataatggtttgaaagatcgtaacaaattttatgcattttgatatctacgtctgacacattgattcaccaactagtcatattttcagacattgtcttcatggtcatcttgtagtattgaagaggttaatttggcagggcctggagttcgtttcttccaactttcagtattacactattttctttcttagattcttcacctttcttctttaggatttatgctcccttacttcttatcaatgtcttgttcagatatacaaggacaggaacttagtgcaacagcttatccaaagggctgaaaaggctggctataaggcaattgtactgactgttgatgctccatggcttggtcgcagggaagctgatgtcaagaacaggtcctcatcgtgcaaccgtagtgtttgacttgtgcattatgcattatttaatgaaaatctgtaccctgcatcaatatccttttcttaaaggcacctttattgaaagaagaaactccaccgcaaactcattatctgcattatactttacattacattctaggttcaccttgcctcaaaatgtcatgttgaagatctttgaggggctggatcaagggaagatagatgaggttgtctaaaaactagtgccattgtgtgaagtagtcatgattctgtttaacaatgccctgaatcattctatttatctgatgtttcagacgaatggttctggtcttgctgcctatgtcgctagccagattgaccgctctttttcttggaaggtattgcagtgacactatgacttgtaatttccagataacaaccagttaatatgaaagattttaaccatcagaacaatgtcatatctcagacaattcttaatgtgaatgaaaccgtgtgatgttgatgactcatcctacaatacaggatatcaagtggttacagacagttacatcattgccggtcttagtgaaaggaattataacagcacaagacagtatgtcctttgctttcaattaccttgtgtaactacatgcctcattatccaagctgcagatctcacaagacatttacaaaaatgcagctagaattgctatagaatacggtgcagctggtatcatcatgtccaaccatggcggccgccagctagactatcttcctgcaaccatcagctgtctagaagagctatgccatatgtaactctcttttcaatcttaatgaaatttggtcggctccttcaccgactcagcaatcagctgtgtagaagaggtatgccattgataacccaatctgcacttcagcttattgtgcttttaaacacattttaactgaaaacagcacgaatctcaggttgtcagggaagcaaatgggcgtgtgccggtgttcatcgacagcggttttcgccgcggcaccgacgtgttcaaggccctggcattgggagcttcaggggtatttgtaagtcccctagctagctactgcttgaatgaaagatgatgctgaattgctcatgacacggcatctgcatacgcttcttgttctgtcagattggtaggccggtgctgttctccctcgccatcgacggcgaggccggcgtgaggaacgcgctgcggatgctgagagacgagctggagatcaccatggcgctcagcggctgcacgtcggtgaaggagatcacgcgcggccacgtcgtcaccgagagcgacaggatccgccgttgttctcggctgtagtgtacccaggtttcctttgcgtttgcgttcttgggagtgttttggctgactgtggaaaattctaatttgttttattgtgatgttttctgatctattatatcgaccctctcatggggtatatataggagtacataggggatagagacttggagtataatacaagtaagagtagatttatctctaggattctatctttaggactctatcttatctctaggagtcaatctctaggatatatcttatctctatatttgtatttgactcttatctctaactaacacattatatttctaacaaaagacatctttgcagattgcaattgatgtgattctgtaactttgcgttcattgtcagatggagatggttgtgtttttttagaaacttagtacaatcaggcatgtggagaatggtaagtatttagaaacacaattcaaacataggcgttcataaccgcgtacgtataacatactcacctatatgaacacatacacatggagaatgacaagttttttaaaaacaaaattcaaacgtgggcattcataacgtatgcacacacataccctattatactgaaaaaaataattagtcgtagaggcgagcatctgtacatcaagacaataattagtcgtaaatgcaaacacatgtgttgactctagaacttaattcggatggattaatttgaccataagaaaccaaactagttgaattacgccgtaatacagataaatcctaatagatctattttagaagatgataagttcataaataatatccaaattcggcatggttcacattaaaattagaaattatagacgaggaaggaaaccaatctgctgccgtgttacacggtaaccgcagtttgcaaccgtcaataggagaccctatccactacgaaatccgttggatccctcgtgctccgcaatctcagccgtccgtttccccctatagtcccccttacctccccttctacagttctacgaagtacgatccaaacaccagcggcgaaggcgacgaagacgagggcaaaaacaccagaaggggaaaacttttgctctcccggcgatctcgagatctctcaagatggtaatcccccatccaatttctctctacttttcctcggatttgcgccgcactcccgatcgatgtcttcgacgcggttaactgcgatggatttgcgcgagatcggatcctatggtctagaatttcgagtcgattaggcttttttttgggtggtgttttgcgttgggtgatttcagattggaagtagaacggggggacgaggattctgagaagaatctactggtctttgtcgtactgaatgctctcgatttcctcctgttttgatcgcgtctgtgtggtttggtctggtcaggtggtgctgcaaccagatccgtttctgagcgagttgacgagcatgtacgagcggagcacggagaagggatctgtctgggtcaccatgaagcgatgtgagtgcgcgctttcatctggcaatctggtttgtgatttgggtggctgaagaactgatgcttgagttgatgggggttgtttgatatgtgcagcatcgatgaagtgccaggcaaggttgaagaagatggcggcgaagggagaggcagtggagtaccggtgcctcgtccgtgccaccgatggcaagaagaacatctgcaccgcggtacagtgactgtcctattgtcctttgctgtgctgattttgaattattattttgcttatggttgttagttttgtgcataatggttaccgattatctggtattcgatgctaattatgccaccaggcggtaagtgaggaatgtgaatatgacattaggcgcttttggtattgcactaaaacctctcggatatgaaatttcggtactgagccagtttatttggtattcaagtcagcaaggtatattgttttaagagatagataaaagtatggaactgtagaagtgctgcaataagtatgatccaaactgtgaactgtatatatagtgaacatatattgtagattggtctatgtagaagatatacagtacgttggtttcttgcttaagcttctcacaagcatcctttcgcggtaacatgtgtaggcactcgtgaagcatgatcataaacagcgaggtaccgtagaatcagatgcttactcataggacatcttaactcgcatcctattgaagtagaatgtgtaacataatcataagttggaacagactatactatcacatgcttagttgtagcatggtaaattgataataaacatgaatgaactttgttcaatagacaaactagccaagaaaacgtttagtgccattcatggtgttaatattgcatgtttgcctgccctacactaccgcagtctcattttcatcctatgctaagataactctcaagttggtgtagatattgagtatgaaactcatttgtgtgctcttgccaagttttgattgcattaagtagtgaggtttctcattaattgcaccatcttgcattttctgaaagcgtcatcaagttgtttgagcttaaatttatatggtgaaagtattgtttctaatgataagactgtagtatcgatgggcatccactggccactttttcccatgtgattaatctttaccaccaaacagttgggtcgataatctttttccacaagagtaagaacgccatgataagttcagagtcccaagatctatgt

SEQ ID NO: 38583 - DNA, 116 bp, Oryza sativa
agcccttttttggccacaggcctgagtaagatgggtgtagtcaagacattatcctccattttactcttattcatgtctgcgagatgaagcatgtgaatacctttatagagctgtgc

SEQ ID NO: 38584 - DNA, 351 bp, Oryza sativa
atatggtgaaaatgttaggagaaagtcccacacaccttctgctattgttatcggcagtgggtttgcaggcattgctgcagccaacgctctcaggaatgcatcatttgaggtaatatgtgatgcagtttatggcctaattgtaatgatataggttcaatgatcccttgaagtgcatttcaaatgttgtgaaattcttccccactggttatctaatgtggtttctttccaggttgttcttctagaatctcgtgacaggataggtggtagaattcacactgattactcttttggctttcctgttgatctgggagcatcctggtgaggttcctctctgacaatattttctgaatt

SEQ ID NO: 38585 - DNA, 504 bp, Oryza sativa
tgtttcaatcgcatattattcatcccctttgtgaccatatgtttgtcattttttgcttccctacgatacttgttgaatactgctcagttgaaatatactagggactgtaatgcttggcctttttcttgttgccagctcccgttccatgtgttctgtgattctgtctgcttgctttttctatggaccagtttcgaacagcagtctgaaccagagagagaagaaatttagatgtctcggaggtaattcttttttcagatcttaagctacctattcccaattaccctgctctctccagtttgactggagtattaatagttctttttgtggatttaattgctggtaaaatatatttgaagatattgttcattgaacttttctgagtgtgttcctctgtttcaatttctgttttctatcatgtgcttctctgctccaaacccgataaattgcaaacatgttaatttcttgattatttccatgtatctatcgacgtttttttttaaaaaa

SEQ ID NO: 38586 - DNA, 1779 bp, Oryza sativa
tcctgcagccctgtgcacacaggaaagaggacaattatagatggtaagcttgctaagatggggcaaccatgacgacgtccgctcgatttcaaatttctggcaaatctcaaacaagggaaataccttcagtacagggcaattcttaattttcagaacctttaaactggagttcaagttcctgatggaagtgcaggagcatgtgttcaagcttggcaatgcaattaacacaagctcctccagtgaagggattgagagttctgttgcattcctcattttgatcaacacgagctttacaagtaaccctagcctttctaaaggaagtatttgccattttccacatttttctagatgaagtgtttgcagacaggtaagtgaagaaggaagccaagttggggaggtagatccattatacccagatatccgtagatacttgaggccgtgatgtggttcaagaccttcgagcacctcacttgaagcaagttcagagcttatattactgtgatgttgtaagctttgggcaccattggcatcaccaactgacagttcctccccttctgtttctatattcatatcactgccgtattcatcttcatagctttcgtcactgtcatatccattccatgcatccttccaggacaaatgtagcttttctaagtgttgtttgtctttcagttttgccccacatgcctcctcctgagttctaacattttcaagttgagacacactaagttgtacaagcttgttcatggatttcaattgtgtcacctcaaaaccacttaaattattctgaacaataaaattgcctagttcctgaagtgaggtcattttaccaatgttagcaatggaagaacacacttcatcatatgcaacaagatgccgcaggctgagaagattatttatatcattagatatacggggaattccaaatctatagccaatatctagtacttgaagatggtaatacttccttagagatcggggcaaagttctgccggattcttcagtcacaattttcagataccggagatgtgtagaatttaccaaactggagagaaatgaatcagaatcagcataagttgcagtgatctgcagcagtcgcagatgttgtgcttccttgaaagcatctttgaaatatttaaaaaaatgagaatcatattgcccaattaataccagtgacctcaacttactccttgacttaactttcatcaaccttttctcaaacacctcattacgagatatgtttctatatttctccttgcggtatgcagaatcagttactattgacaaatggcgtatacttggggctaactctgtgcactctgagccatctatagttgcatattctgtttgtgaaaccttttgcgctaaatcatgcataagatcgtgcacaacaaaatattctgatgaaaaccgtgtgctttcaacttgctgaaggaaacccgaatttaccaactcagctagatatttccatcctttctgctccaacttctcactggattcttccacaaatccttgagcaatccatatttgtattagttgtgctttgctgaaagaataacccttggggaaaagagaacaataagagacgcattgctgtaaggggttggatagatgatcatagcacaacttcagcgcttgcatgatgccataagcttgttgcagggatttccattcttcactctttataatgctatcccaatgatcgatggtaagattcgttcctaatagtgaacccacagtttttgctgccagtgggttgccttttaactcgctagcaat

SEQ ID NO: 38587 - DNA, 5009 bp, Oryza sativa
tggagacatgatccaaaatctgccttgtaatcttaactacatcaaatttatcagatacatacacccatatcttaacattaaactgacttttaattaccagatctttgcagaccagttgcgccaaagtggtttttcctatccctccattgcctacaattggcaggacggttatgccattagatctattgctcatgatcagctgtttgatggtttccatctctgcagccctcccatacactatgggctccggaagataagacgatgttgttgcatttgtggccggtggtgtaccctgtcgactctggtttgaacttgaggatcgacatagcctcataacctcatttacagcctcttctaactgatgagtcatgcattggatcctgttggaaagttcagccttgttccaagggtgcgtgctaactgcctcgtggtgtgttgaagtcccatccattctcatcctttttctgccaactgaattaccagttgcatttgatgcaccctcaccggcactggaagagcatgtgatcgtggttaggcgattagaaaggtcagcaatataacgcaatcttaagtagatgaagagcgaatcatttcacttatacttatgattatccttacgatttattaacaatttaaaaaataacttatgggtaaaatttttatatacgcattcttaactattcaaaatcaaatgttgtaaaataaaataggatgaaaagaaaaccacaaaatcaactccaaaattaagttttaaatttaaatttataaacataagtataaacgaaacaatgagctattttattggagactacaaagcgtttttatatttgacttatattaattggttgctttctgtaaaaaaaaaaaggcagcagattttgtcactcaattttgcatagtagatttttgaaagaattggatttgatacactactcatgttttagatataattatatttgatatatacaattgttcacttttgtttccttgcatctaattacatttggtgcaccatcaccggtactatatattaggaaaaaaaatgaccatgagttggctattagaagattagagacagaatgagatcttaagcagatgtaacgggccaaatttacacttcaacggatttacactaaattcagaactccattagcattaccttgatggatttaccggttggtcagtacttgttacacgtttcctcttgcaaacattgagatggttgcgcaaagctgatgtcccgttcttagatgtgcaacataggtccttgtggcagtacttgcaccgtgctttagaatccttcccgtcagcagtgaactctacggtagtaaagtgttcccatgccttggaccgtttcttgctgctgcctgccgccactgcctccggtacatcagtattgtccatcggaatatcgtcctcgtcctctgctccatctccgaccgtctcttcagcctcaaaccgtgtagtaactgtagcacaagcatggattggaaactgacgccaatacgccattgttgcaggcaacgcagcttgcaaacttaattaaaaggcacggatatatgcaaagacagtacctcctccctcgacctgctgctggagcctgaagtagtcgagctcgtcgaccgcatcgtcggcgtcgtacagcaaccccctgagacggccgagcgatcgggccagcgacctgttcccgatcgccctccccttcacggcagccaccaccccatccaccttctcgatctcagcccgtagcttctcggtgtcagcggcgagcctaatctggcgaatccattcatccagcttgtcggcgtccaggttatccaggatggtctccgccagccacctgatcccgccctccagccaaccggcttccacctcctccatcggaacaggagcagtccttggactgtggccaatggcgtgtgcaagagggctgcaacaagcgaggatgggaaggcagagtagtagctaggagaggagactgcagagtgaaaactaggtggaaaggagaagattcaccagtgcgtgtgggcgtgtggctcggggcagcgctcctggtcgtcgtggattaatcgtctgatgatgatcgattgcttcgcgcgacccgcgttttctcggattactactgccgcgttgacggtggactcgtcggcttccacttcgatgggctgtgggctagttggttatttggcccattagcacttcagcatccgaagagaagcctaagttgagcattccaaacttttggaagtttatgggaataagttcacttgccatccctcagctctgcgtcgagtcatgtatgacatccctaatccccactacgaaaaatgttgaccgacggttgttttatctgacgtggcatccgagtaaaaaaaaaatatggaaccaacatgtaagtgtccacgcacaccttcctctatcccttctcctatccgcgttggtggtggatgaataggaggggggaggggaggtgtgacgctgcgaattggagtgggcgaatcgagccctccctgccaaatcgtcatcgcctcggcagtgggggagctcctcagctcatcgatgctagaagcggctcggggacaggggacctcgatgaggccgcggcgtgagcttgcgaggctgctacggagcaggaggacaagggtgtcgtggcggcgtgagcatggcgagaggatgttgcaacagacggagctatgaggttcaccgtcccagctgtctcctcgccatcgccgcagcatggacgatgttgaggtggtggccgagctcgtcatcgcgaacaggccgaaaggactggacgtggcgatggttcaggtagtgggccctgatatatgccacatcaatggaaaccaggggaaatatggtctataccctcgaggaactactttgcatggttttgaagacttgaggggtcgacatctggtattgggaattagggccatcatacacactccatgtaaagttgagggaaggcaagtggacttattccagtttatgtcgatgttggcccaggcccatctctggcttaaaagtttgagttatgcttcgacgggccgctacacagtacgaaatgcggtccattaattacggttttttttgggtataaatgcataagtgtttcttttgttctactagtaatatgcccgtgctaacgctacggtgtcattatatttttctaatattccaagaaacctttatacataatattttcggtaaggtctatctctttcctagtttggtagtttggcaaaaatccctgttactgtttgccttacatactccttgacaaagcatagtaaagttgtccatgcgaggaatatatatattctcatttgaaaccatgaacatcatcactctatgttagcttacctgacaacgccgatgtaatatgtttcctaaaaacaacagtaattatctttcataaacatcctgaatgcctttggaattaagaaatatgtattcagtcccgtcttcctgaaataaatattatgtatacattaaggttcacaaataaggtacagaattacatcacttcctctgttcccattatgtcattttctcaataccttacttgcaaaggactaagatacaaatcatacaatcgattgttgttctggttgtccaacgaaatgggaaacaatctaccaaatagtgaacggagccaataataatatttgctgcacatagaacagctaaaagggaatcattatcttattatattattcaaagcactaagggttgcatctgtgaaacagttgcaagattgcacagtaatgtcacttgtaatgaatcaggaaaaaaaaaggggcatgggtttccagagtggaaagagaaaaaaaattacctccactgctatgatttcttatgccaagtgaacatcgttatatcaacaaattatttgcatggtttaaaaaaaataatagtcaataatatgacaaaattggagcaagattcagaaaaagaaaagttgttggataaatgaacaaagctcatttaatttgtcaacagaaagctctaatggtccattgaaccagttacaaacagaagattgatgtaatgtattagtagtaaattcatttagcatatcaaattgcataagtatgtaaatgtccaccaaaacactggtaacctgaatttttttgacaaactttccctcagaagtttcccacgctttgattgaagaatcttcagaactctacagtgcaacatattagtcatagaatattccatagcattgttttaagaactgtacagcagacacacattagttttagaatcttgatatttcaggttcccaattgtgaaaagtagaaacaatatgcattgttgtacatatacttatgtattcaggttcccaattgtgaaaagtagaaacaatatgcattgttgtacatatacttatgttgagaaagtgattacctaggcagtgtgttagcatttgaataattttctgaacaaatcaattatatttcctatattttcacgcttttactgttctacaaaattgagtgtgaactgaaaggtgtacatttgagtcccagtaatacctatacaaagaatttgcagtttttgaaatttaatggatgacacagcaagaggaaagtgcacccaacaactgctaggaaactcagcagatttcttgtttatagatcatagtaccactgcagtttcagtcattaaacttctagttttttcctttttagataaatagccattaaactgctataagtggtgtttacttgtgatcaatggtgattagttgcaaaactaatcaaatcatcaaactaaggaacttaatatctgacaacaattcaaaaatttccaagatcctagtcaatatatactcaatatacagaattagatgcagatgatatactcttgacaatggcaagatggaattaaggtgctcgccacaaatgaaatggtgaggctgcattagacaaagcaagtaatctggttaatccttacttaattatatgaaggctgtatatagatgcaaaaacgggggatcc

SEQ ID NO: 38588 - DNA, 1472 bp, Oryza sativa
acgtgcgacatgcaacggagttccggcgtcggagatcgatggcggggcaacggcgaaggagatcggcgacggagcgtgagagtagggggtggtaggcgcgaggagacgtcggcggcggggtaggtttcgcggctgccgccggcggagaaggcggggccgacgacagcgacggcaatggggtaggcgtgaggaggcgtcggcgctggtggagaaggcggcgggcgacggcggtggggtaggcgcaaggaggcggactggcggaggcggcagggtaggggagtgggagatggatcactaataacttcttcttttttctttttgtttgatgatcgctaattaatttttgtaaccgctacttacacgacgtggaatcgctaattgtagaggttgatccaactcttgatctgagccattggatgaatagatctaaaggtcagaaaatatttgggtttgatgaactggtgctttttatattagtgtagactagtgaaagctacagaagtttgcatgtggattgaaaattttcgactcgagggtgatcagttcgtgaaattttgagttaagtatgaacaaaatttgaagttgaaatcttggtggactggaaggggagaagtttcagcatgctgcagtgctggatatatttagaagaggctgaagtgctgaaccccattacaacttgtttgctgcatttgccttctgaacgcgagtgcaaatatgtgcagcgctatcggaagtagaatagaggcagcgtaagcacatgtcagaactgcgatcgtctgaaaagacaacgtaaatactagtagtactaattacacgaaaacagcccaaatcaaaagtacggtaaaaatcgtccaagaatttctgaaactacaaatgaaaatctcacacagtttgaatattacaatgaatatatttagacaacagtacaacacagttgaaaaataccacatactcacaaaggaatgctaaatcttgtacatacagcaaagaatgcaatcatctcacaagaacagagccccaaagagtgaccacgaagatcaggctgaagaggcaaaccaagagcatcgtcctgcccactgctcgccggtttgccagatcacctgccacccaaaacccgacagaagcctctacaaacccgacgagcaccacggtgacaaggcttccgtagtacagccagtggagtgccttaccatggttgccgaagactccgctcggagcgatgaagaagacgagggagagtgcagccgcggcttggaggacgccgcacgagataagcgccccgggaagcttgttgtcgtcgaggcaggcgtccgcgatcgcctgcaggatcttggcgaggaactcaggcagatccatgtttttgtgtagctccgatcctgcgaatgtatcgaacgattcgcggattcggagaaatgctctgttttttgagtggtgtttcagagagatgctctgtttgtgcttcgtgtaatggc

SEQ ID NO: 38589 - DNA, 1074 bp, Oryza sativa
aggaatattagaagaggagactagagttcatatagaaatacaatttagaaatagttgaaatttggaattaaaaaaaaggaatattagaagaggagactagagtccatatataaatacaattaggaaataactgaaattcgaaattaaaaataaggaatattagaagtagagtatagagtccatatagtaatacaattaggaaataatagaaatttggtattaaaaataaggaatattagaagtagagtatagagttcatatagaaatacaattgagaaaaaaaaatagaaattcggaataaaaaataaggaatattagaagtagagtatagagtccatataggaatttaaaactaactaaaattcagaataaacataataaaattaaaagtagagttttgagtccgcataaaaatacaatttacaaataactaaaattcgaaattaagaaaaatatgggaagaagagtttaaagtcaatataggaatacaatttagaagtaactaaatttcgaaattaaaattaaagaatattgaaagatgagtttagagtccacatagaaatacaattagaaataataaaaatttagaaataaaaataaataatattggaagaagagcctagagtatatagaaatacaatttacagaaaattcggaattaaaaaaatatattaaaagacgagtctagagtccatataggaatatatataatttacataactaaaatttgatattaaaaataattaatagctaacacgtatataaaatacaatatgaatattttagttttgtaaagttattgcaaaatttaaaattatgatgtcattttaatatattcgaataatataatgagaaaaacatatatgctattatatgagagaaaatataatgatgctagccgcacaatctgcgcgggccaccaatgctagtttaccagtattttgtgtcaaaagctgatccatgcagcacaacttttcacaagaaataattaaaattcagaaaaaatcaaacaacttaatgcgttagagtgcaatttataaagaattttcgttgttccattgcataggttattga

SEQ ID NO: 38590 - DNA, 767 bp, Oryza sativa
tctacggcagcaaggtagatttcgctggatttacctcccttgaggagttagtgatttcacgatgccccaagctggtgtcgttcttggcgcataacgacggaaatgatgaacagtcgaatggaagatggctcctaccgctatcacttggaaaacttgagattaactatgttgattccctaaaaacgctgcagctctgctttccggggaacctcacccgcctgaaaaaactagtagtgttgggaaaccaaagtttaacatctctgcagctccattcctgcacagcactccaagagttgataattcgaagctgtgagtcgcttaattctctggaaggcttgcaattgctcggcaatctcaggttgctgtgtgcacacagatgcctcagcggccatgaagaagatggaatgtgtatccttccgcaatcacttgaggaaatttacatctgcgagtactctcaagagaggctgcagctctgctttccaggaagcctcacccgcctgaaaaaactagtagtgttgggaaaccaaagtttaacatctctgcagctccattcctgcacagcactccaagagttgataattcaaagctgtgagtcgcttaattctctggaaggcttgcaatggctcggcaacctcaggttgctgcaggcacacagatgcctcagtggttatggagaaaatggaaggtgtatccttccacaatcacttgaggaactttacatcagagagtattctcaagaaacgctgcaaccctgcttttcaaggaac

SEQ ID NO: 38591 - DNA, 16142 bp, Oryza sativa
ggaacattaataattggactgcaccccgatgaagttgatgatgatgatggtttggaggattctgatcagctgaaaacgttggatgacaaagtactattattccataacctgaggttcctaactagcttggcaatatatggttgtcgaaatcttgcgactatttcaattgaaagtttaaggcaactcgtttgtttgaagagtttggaattatacggctgcccaaaacttttctcttcagatgttccaccagagcttacatgtgaatatatgtcaggagcaaatcacagcgccctcccatctctcgaatgtctctatattgaggattgtggaataacggggaagtggctgtctctgatgttgcaacatgtgcaggccctacaggaactgagtttagaggactgccagcagataacaaggctatcgataggagaggaagaaaacagtcaaccaaatcttatgtcagctatggaggatccgtcattaggatatccagatcgagacgaacttctgcgccttccgttaaatctcatctcttctctgaaaaaggtatctattacatattgctatgatttaacattctacggcagcaaggtagatttcgctggatttacctcccttgaggagttagtgatttcacgatgccccaagctggtgtcgttcttggcgcataacgacggaaatgatgaacagtcgaatggaagatggctcctaccgctatcacttggaaaacttgagattaactatgttgattccctaaaaacgctgcagctctgctttccggggaacctcacccgcctgaaaaaactagtagtgttgggaaaccaaagtttaacatctctgcagctccattcctgcacagcactccaagagttgataattcgaagctgtgagtcgcttaattctctggaaggcttgcaattgctcggcaatctcaggttgctgtgtgcacacagatgcctcagcggccatgaagaagatggaatgtgtatccttccgcaatcacttgaggaaatttacatctgcgagtactctcaagagaggctgcagctctgctttccaggaagcctcacccgcctgaaaaaactagtagtgttgggaaaccaaagtttaacatctctgcagctccattcctgcacagcactccaagagttgataattcaaagctgtgagtcgcttaattctctggaaggcttgcaatggctcggcaacctcaggttgctgcaggcacacagatgcctcagtggttatggagaaaatggaaggtgtatccttccacaatcacttgaggaactttacatcagagagtattctcaagaaacgctgcagccctgctttccagggaacctcaccagcttgaaaaaactagaagtacagggaagccaaaagttaatatctctgcagctgtattcctgcacagcactccaagagttgatgattgaaagttgtgtgtcgcttaattctctggaaggcctgcaatggctcgtcaacctcaggttgctgcgggcacacagatgcctcagtggttatggagaaaatggaaggtgtatccttccacaatcacttgagggactttacatcagagagtattctcaagaaattctacagccctgcttccagacgaatctcacttgcttaaaaagattagaggtatcaggcactggaagtttcaaatctctggagttgcaatcatgcactgcactcgaacatttgaagattgaaggttgttcatcacttgccacattagagggcttgcgattcctccacaccctcaggcatttgaaagtacacagatgtcccagattgcctccatattttgagagtttgtcaggacagggctatgagctatgcccacgactggaaaggctcgagatcaattatccctcaatccttaccacgtcgttttgcaagaacctcacctctctacaatacctagagctttgcaatcacggattggaaatggaaagactaacggacgaggaagagagagcgcttcaactcctcacttccctgcaagagctccgatttaactgttgctacaatctcgtagatcttcccacagggctccacaaccttccctccctcaagaggttggagatctggaattgcgggagcatcgcgaggccgctggaaaagggtctcccaccttcgttggaagaactggctatcgtagattgcagtaatgagctagctcagcagtgcagattgctagcaagcaagcggaaggtcaaaattaatcagagatatgtgaattgattactcggtggctttttccacctgcccaactggcatgggctcgttcaggcgttcaagctgctgtaaattccattgccgcaatgacgaccttcagaaccgttacacaatacaaaggacatatgatggctagatcaactgtcacatacaaattctataattctatctactgaaaaggatgattgctgttcattttcgtgattacagaaggaactgtgtatatcgtgctatttttgcattcacattgtgttccaggttgtgctcggatcagccaatttcggtggttaattcactttgctgtgtcctctgtgcagtgtgcactcaagaattgttcgcacatgcaattcagttgagcatcgcactacgcaagtttttttttttttgttaacaaaggagtggttgacagcattgcaggttgctaaaacagtgtcaaaaatttgctaacaaaagaattctcttcagaaatagtatgaaaataaatgccacataagtaatctgagtaaaacagacagaatcactagagaagactaacgacaaactcttctttttctatttctgtggtgaaaaactcagcatataatctcatgtatgcattggaggtgcataccatttcgatcatgtatgcatttagctgaacattatcaagaagcaaatttattgcacgggcaaccataagctaaactaattctcaagcaatttaataatcacaaaacagtctgcaataccaagatatataaaacttttgccagcatggagcaacaacactgaaacactacagtcaagacagctcccagaaaagattatatgttgctacttcaattgccacagttacaatcacccataatgacacatcaaattacataagagtattaagagtatatgacagttgtaacaaaacaactgcattgagaactagaagaacagacagccacatgaaccatattcacttcttcagatcagaaagcctggtgaactaccagtctaccaattgctaccgtagtctccatttttcacttatatgtacataggacacctgcgctatcagaatagccacaaagccagttcactcgctacaaattaatcttgactaaatccaaacagataccaactcctcttaatcaacttacaaaacacctacacttttgttgtctctacaccaccaatcacacaaaaggaaattaatcatccacctactcgtatcctactgttagaatggaggccttacaccagagaatgggcattgccagattctgagacactgtcctttgagctccctgaatctgaaccagtaacaaaaatcaaataagacacaacccaaaaccttccgttcatcaagaagttggatgttcaaattataaagtgacagttcgatcgtaccactggatgatgaggacccactgctcgcggcctcagtatccttctcaatctccactgattggtaagttgctgttggcatttcatccccgacatctacacaggggcggacccagggctggtgccgggtatgcaccggcatacccagaaaattcggaaaagatttagtaggcagtatgcatcagtgggctgaaactaagcaaaagcccaagaagtaaaagtctagctgttgcacagcccaccagaagatgatgttcccctttggctagcactcatgcggtagggtttggagcaggcgttggcggcgctgcgacagcgtggcgcgctgtggcactgtatcattgatcggcagcctcatggcaagcacgacgcatggacggtttgagcgtcgtggcgctgcggccggacagcgagcaccggtggcagaggctgccggtcactgggctaggcgctgactaaatcacctggtccagttccactcattatctgtccatgtccaagtatactcaaacttcttcagttctttgtctctctgatttttttttcttaacagatggagacatagattgattgaaaattgaaaactataatgagctaacaagtgaaatcaatgagagtacaaacttcaaaaattgaatacatgtttttgtgatttgtacgctgagatcaagttgaatcaatcagattagaatacgaagaagaatatgggtattctttttctttctttagcaaagcaccattagattctgcttcatcaggccatgccctatgcttcacatttctaatggtgatgggaaaccttagaacagggagggaaagtaactgaacaaagtgagttgtgttattttgttcttcaattcaccctcaggatacaccaatactttcctaaaattaagactatatttgtgtcatcatgtgcatatagtgtttgatttgcctctcttgatagctagcatgggcaaacccaggacaaaaattctgggtccgccactgcatctacatactcatccaactgctcggcctgtgtagtgatcttgtcaggatccttgctctcctgtaaacaacaaaacacatctattatacaattaaaggaatagaaaaaggagcctccacgttcgctctcatggcctagaaattctcacattaatcgaagaaaaagaaaaacagagtccatatatagaaatacaatttagaaatagttgaaattcgaaattaaaaaataaggaatattagaagatgagactagagtccatatagaaatacactttagaaatagttgaaattcggaattaaaaaataaggaatattagaagaggagtatagagtccatatagaaatacaattaggaaataatagaaattcggaattaaaaataaggaatattagaagtagagtatagagtccatatagaaatacaattaagaaaaaaaatagaaattcggaattaaaaaataagaaatattagaagtagagtatagagtccatataggaatttaaaactaactaaaattcggaaaaaaaaaagaagccaccacgttcgctctcatgacctagaaattctcacattaatcggagaaaaagaaaaggcagagtctatatagaaatacaattcagaaatagctgaaattcagaattaaaaaaataaggaatattaaaagaggagactagagtctatatagaaatacaatttagaaatagctaaaattcggaattaaaaaataaggaatattagaagaggagactagagtccatatagaaatatgattcagaaatagctgaaattcggaattaaaaaataaggaatattagaacaggagactagagtccatatagaaatacaattaggaaataacaaaaattcggaattaaaaataaggaatattagaagtagagtatagagtccatatagaaatacaattaagaaataaccgaaattcggaattaaaaataagaaatattagaagtagagtatagagtccatatagaaatacaattaagaaaaaaaatagaaatttgaaattaaaaaataaggaatactataagtagagtatagagttcatattggaatttaaaaccaactaaaattcggaataaaaagtagcctccacgttcgctctcatggtctagaaattctcacattaatcagaaaaaaagaaaaagcagagtccatatagaaatacaatttagaaatagctgaaattcagaattaaaaaataaggaatattagaagaggagactagagtagttattatacattagtagttttgaaaagttattgcaaaatttaaaattatgttgtcattgtaatatattttaataatataatgagaaaatatatatgatattatataagagaaaatataatgatgctagccgcgtaatctacgcggaccaccatgctagttaaccattataagagctcatttcacacataagctaatagcaaccaagaacaaagcatgctgctcactattgccatcgtcacatcaccgttgtccaccatcgtagcggtactgccattcaccagcatatcactatcattagccacggaagcatcaatgacatcggcattttcaccattaacaatggcagcccgtcgactcttgttgagcgccttcttgaatttgttgacgaatcgatcaagctcccactgtgtctcgacatccatctcatcaatatccagctcgatctcacccccaaccagctcaggattgccattcctcttccgcacaatctgcaacacattatgcatcttctcctctggcaagctctccaacccaaccctcaacaagttcttctcctccagggtcatctccctcttgttcggctcccttgccttcgttttccgcattttcacattccctgcccttggtttcacctgcgccggagctttcgccggtggcaattccggggcggcactggcatcggcggctcaaggatcttgagttcctgctcgaaccaagacaccgacgctttgtacatcttctcaaaggacgcgaggaggtcgccggcgaaggtgtggacctcgtgtccagcagggttgtaccgcagcgcgttgctgaacgtgagccggatgtcggcggcgaagtcgtcgtgcgaggggtaccttccggcggcgaggttcgccctcaccgtgccgagatccatggggcacttgatgacggcgtggtagtcttggagtccgaggcggtcgacctccacgggggcgttgaaccagatgctccgcttgtccttccgcagcttcgccaggatctggtcgcaccgcttccgcatcgccgccctgagcttcgccggcggcggggggaggccccggcgaggcgagccatgggcgcttcggcggcttctgctgttgctgaccccacgagccaatgcgggagatgaggcgcggaccaggccgaggcccaactcgcctgcgactccgcgaggcccatgagagttcgtttgggctatcagtccattacggacaagaagcccgagggcgcggcccacatccttccgtcttccccgcctttccttccctgcctcgtcgaccgcgttatcccgtctcaagtctcaactcccaacctgcgatgcgccgtagaaatttgatactcgtgtcactcgtcgtcttcctttgcttcactaatcactccaatgacgcgacacgcatctctctcaaaaagaaaaggattggtatgtaactgtctacaagtgatgaattcatcactcacgcagttcactgcacatcgtcccagtacgcgcactatcttggcagcaaaaagttgtaccagaatgatcttgcgttcttggcaggacatgatcgatcaaaataatctcaagcactttggctacacacaatgaacgaaattttgcagctcggcagctcaccaaggatgggcgcaactcaaccacgactgaaatcggtgctgacacttttagcagcatctttgtgattcagccgtggtttctccggcgcgtctccttctgttcagagaaaaccgaatagttcgggttcggattcagttcgaagcaagcatggcttaaaatcagttcatgcacacacagctgcccccttggcatttgtgtgcactgacacgatgccgtctgtcctacgcgggttggtagtatgatgaaagggtttggaaaccgatctaaaaaaccgttcggatcatcgggtttttgactagccatgaaagtgaaattgtccgaaaaggataaaagagcgaacgacgtcgtcggtccagcacaaagctcagcgctcaatcacgtcagagaaaccgatcacttcgggtccgggttcggttctggagagctaactaaggacttacggagtggtatgttcaactgttcagagtatttaacttcacggccaatacgttgtcgtccaccagagtgcatgtgagcgtcacgacgcatcggataatttgaccattcgtaggttgctgttggcgagcacggcgaaacccgagacgcgggttcggtttcggttaatccgtttcgcggtcgcgcgcggccacgggcacacggccatggcgccatgccgctgtctccccctcgctggctgcgacgcttgactatttttattcttcatctccatttgattgatttaatctctcgttgcagcagcaggcaacgtgcaatcggttcggttttgctactgttcgggttcccctggccctctcccccctataaatacacgcctccaaagtccaatccaatccgccatgaacactcggtgctcgagccatttccaattccaagcttacatcgaatcaccatccacgacaaagaagacgcatacgctggtgatggagctcatggcctccctcatcaacatcttggcgctgatctccgaggcatgccgcagcgcggagaagctgccggcggcgctgatcactggcggcgtcgtggaggccgcggcggcgatcttcgtcgccttcttcaagccgcccggtggcgtatttcagcaccacggcaaggcaccattctacctgtattacggcattataggaggcgtggccatcttcggcttcgcggaggcgtgggccgggttctgggtctccggcgacctgaacggccggcgcgccgtcggaaagacgatactgtgggtgtcgattttgcctcttgtcttggtagctgcgctcggagggttcgtcttcatgagatagttgcaaacctatgttaatttcctctgtttgtacgagtgggtgtaatctcctgtacctctgtgtgtagtagttgtagcgtgtatgcactagtttttgctttgtaatttttagcctggtgtatttatgatatttcagttattatgtgatgtaacagtatgattgttaacttttacaaggttttatgtaattatacataaggttattttttgtgtgatactccctccgttttttaatagtgacgccgttgactttttctcacatgtttaaccattcgtcttattcaaaaaatttatgtaattataatttattttgttatgagttattttatcactcatagtacttcaagtatgatttatatcatatacatttgcataaaatttttgaataagacgaatcatcaaacatgtgagaaaaagccaatggcgtcatatattaaaaaacggaggtagtatgtgattatgcgcgttttccttgcatttctttagctacggatgttgtacaggtgtacctcttttatgagtattcctccaatcttctgcttatatccttctcgaaatcatggcagtaatcaaccaatcataatcttaaaagaatcatggtagacgcagagcaaccagttagtacatatttgaaagaacaggcccttgcattgcagggccgtatcctgtaggctgcggtgtttcaaagcaggaaaaagtacaccgaaggtccctcaacttgttatcgagttacaaaatcgtccctcaaccgcaaaaccataccggacgtccctcaactaacaaaactgttcactttaacggtggttttgaccccggttttatttgaggtggcggctgagtcagcgtgggacccacgtgggccccacatgtcagaatgccaggtcgtctctctctcctcttctctcccttcctcgtctctccctctcacttctctcctctctgcagggcggctggcgggtggggaggaggtccggcagccagcggcggcgcgtgcgacctcggggtcggaccgtcggagaggcccgggaggcggctgcggcggcggcggcgacgcttgagaagggagaggcggccggtggcgccggcgcgggaagaagctgtcttcggcgtcgtgcccgctctgccctccaccgcctgcttcgcccgccgctgccccgcgctcacacactcccgccggcgacgccgctgacggcgcgggcgcgagaactgcggccatggatgacgacggcggcgacatcctcgctccccccgttccgctccccgtcggcgccatcttcctctcccgcagcgcgcctgcccgccgctcgtctgctccgtcggccggccgctccccgcgcagtcggcggtggcgaaggtgaccgtgccggcgtcgaggtcgtagccgacgtggatgttctgctgcgccaggttcccaaggatggacaccggctgctgcttcgtcgtcgccacgattgccaggcacagcgtcccctcctacaccgtcacggacgcgttctccggcttcagcgccaccgccgcgcggccgccgccaccgccgaactccagcgtcaagtccggactcgcttgttcggtttgcttcctgctggatgtacacatgaggtcattcaagatcagtaactcatactctattctagcaagctggctgttggtgagaattctgaattctcattgcatcgcctaacgaagatagaagatcggagtgttatacatcaatcaatttcttagctgggaatgttactcctgcattgctctacaatttatgggtcatgtaatttgatctctcacagaatctatagcgaggtaagaaagcgaaaccggcgccacaaaatatcttgaaattctgcttgttcatacactgttcttctgattaaagaacaacttagcttgagattgttctgttcacttgcaatttgcaggagtaacaaagcttatttttgcattgcccgagtccacaatgatgcgggagctcgccgccgatgccaccgtcttgttgccgaccctgacgaagtcgaggaccacggtgtagtacgtgtccacgtccccggcgacgagcggcgtgctcgctgcgccgagctcggtgacgttggcgagggtgccgaagttgaacgccgacgatgagttgacggagtgcgggacgaggctgtaggagaatctccggccgagcgacgcctcgccgccgagctgcgtcacgagggagaccgcgtcgccgctgagcccgaccagcccgtcggccgggaacgagccggccgtcgtggtggagcagccgaacttgacgctgcacacgccgcctcgtggtcgtgggcctcgtgggtggcggccggcgggggagcccgcgagccgctcctacccctgccgccctccaccactgcccgcccgcaggtcctccccccactgctgccgcgtcgcccgtcgccgccaccaccgcagccgcgtcgccatcgaatcggggagaagtcagaaagacatgaggaaaggagagaagaggggaggagagagatgacctggcatcctgatatgtggggcccacgtgggtcccacgctgactcaaccgtcacgtcacacaaaaccaggatcaaaaccaccggagaatctaaagtgaacggttttattagctgagggacgtccggtatctggttttgtggttaagggacgattttgtaactcgatgataagttgagggaccttcggtgtactttttcctttcaaagcataatgaagaaatcaaacttgtcaggtctcagatggctcgcaagcagttctccggaaaaggaggagagaagaagatatggacatacggggttaatactaatgcattagcataagctgttcagttccgggttcggttgtgacatgtactgatttctttgttaatagttaatcagcggaaatcatgtctttttcttattggtgggtccccgactgtggatctttttgcgcgcctctcttggtttggattgcaaagaagcctaccgacccggtttcgggttcgggttcgggttcgttgctcagcgcttgtgttgctttgctcaggcatactgcatacatatgctttcagaatgtctctatcaatccgggttgaaaaaagtggtcttgttgagatgaaattgcttatcggcaccattcgggttcggttcaagtcgtcggtttcctgtactactgctagtcagaaaaccgagctacgtggccgatcgggttcgggtttccgagagcaaacaacgtagcgtgtgctcgtcattttgcaatcgctccacttgctgcgagctcggcgaacggttaatctggacgccatccctacgaaaacccgagacgcggtctggcgggggtcggtgcttcggttcggttcatggtatagatggcctttcggcccgcccggcacggcccggcccaggaacggcccaccagccatcgggccggcacggcccgatcggcacttcgtgccgggccgtgccgacccatgggctgcacctcccgcccaggcacggcccaccagccgtcgggccgtgccgggccggcccgaaggcgcgggtggcccatcgtgcctttttatataagtctatattccatccctcctctttgggccgtgaaatatatatagcgaaaataagtctatttgccgtccctcttctttgggctgtggcatatatatagtgaaaataagtctattttctgtccctcctctttgggttgacatatatatatatatagctaaaataagactattttacgtctctattctttcgaccatggcatataatatgtctatttttactccctattgtttatgtgtcgggcctagcctgaggcccatcgtgccgtgccggcccggcacggccgggccggcccggtagtcgggccgggccagcacgggcccaacccctaacgggccgtgccgtgcttgggccgggccaaaacgccgtgccgtgggccgggccatcgagcgtcgggccttttggccatctatagttcatggtgtgtgggctgtgttccctatgggaccattcgggtgatttaattagcacgaaaaacggagtagttaattagcacgttgattaattaagtattatttaattttctttttaaaaatggatcaatataaattttttaaagaactttcatacagaaatttttttaaataaacatactgtttgtcagtttaaaaaacgtacacgcggaaaacgagaaaggagtgttaagaatttgctcttgcaaacacagccatggatggacacgatggatcatggatcgctgcgacttgcccgcgaatgaatctccgtcgagggctcgaggcagtcctgggtttggctttgtgcgtcgggtttcgccggtgtattaaacaggcacaagcataaaactccaagtcaccgagcagctccgatttttttatttttagtttttattaaaatatttacaaaactaattttgtgttttaaaaatttacaaaactagtcacccatcgcccgtggcagatggcagttgcctcatgcctaacgggcggcaaagaagggcgtgccattttgcagatggccccccttgctgcccttaggttataaataccaaagaggccgcttccaaaatgccaagccgtcctcgccgcccttttgcaggcggcccccgcacagtagaaaatcgccctctataagggtggcaagggggccgcctgcaaaaatgtccctacggacggcaggagggtagcctgcaaaatggcaggccttcctttgccggccgttagacatgaggcaacgatcgtctgccacgtcattaaaatcgatctttaggagggatttatggaccagtaagtccaacgtgtgcaaagtattccacccgaaaaatccgtcgggaaaccgatagagtatatgcgtggccgttcgggtttatcattttgtatttcttccgcttgcgcgcgttggcactgcactgctcactacgctctcggcgagtgattactctggtcgcgcgacaacccgtaacgcgatctcgcggtcgcgggttcggtttcggttgagctgtggtgtggatcgctgcaacttttgcttgaaaaatgaaaaacatgttcgtccgcgattttctgtccgtcgcctctcactgatcgagagatgcaacacagtctgagcgatcgggttcggtttttgtgctctgctttcaccatgaagtcatcaccaggctcactgcgtctgcctcctcgcaccattcagcattcaccgagttgaaaaaaccacaaactaaggcgttccccctgatgatacagcacgcgagctacgcacgcacagacatacggtacagacatgccggcgcccgcatcgacgtcgagaagctgctcactcatcccgtgccggcgtcttgcaagtcgcggcggcggcgctctgcctgggcttacggcccaaattcggcctgcaggcccgattttgagttgtcaagtcagagcccaccgacttggaggcagtcggcccaagcatttgaaagcccagaaacatctgctccgagtgctcaccttccgtgtagcttcctagtagttcctacactaccaaactaccgcattatttatatccctcacaaaaaaaaaataaaaaggactacccgcattttatattgctcatctgccctcctcgaatacctcccatattattcccatctctgccttttgcttaccactgaccactgtcttctcgcgaggctcgccactggtccattgtcgcccaagctccaaaggcttctcttccgccggatctgatggaggaggtggaggtcggtttgctggagggagggatcgggtggctggtgcagaccatcctggagaacctggacaccgataagctgggtgagtggattcgtcaggttgggctcaccgatgacaccgagaagctcaggtcagagatcgagagggtggggtggtgacggctgccgtgaaggggagggcgatcgggaacaggtcgcttgcccgatcgctcagccgtctcagggagctgctctacgacgccgacgacgcgatcgacgagctcgactactacaggctccaacagcaggttcaaggaggtaaagcttgtgtatgcaagatgtatccatttttgtgtccaaggaggtgcattcattcccctttttctgttgtttcagatgcatggcaaggtggcactggaagtttagatgaacctgaagcagagcaagcagagagaccgagtatcaacgctgctattgcgattagcagtggtagcaaaaagcggtccaaggcatgggggcactttgatatcactgaagaagaaaatggaaagcctgtgaaggcaaggtgtattcactgtcacacggtggtcaagtgcggttctgaaaaagggacatcagttttgcataatcacctcaagagtggcagctgtaacaagaagcgtgaggcaactgatcagcagccaaacccgtcatcaaggtacggtatatgatttatgtaacgtactttcccccgcagcaagccagcaactgtgaaaccgttctgtttttttttaaaaaatatttttattttgcagtactgctgatactgcagcaaatagcactcttgttgaactcggcggttcaggttcagacatcagaaaaaagatgaggattaatggtgagtcaacacacaacgatgcaccttatgcacacccttggaaaaaggctgaatgttccacaaggatacagcaaataactcgtgagttacaagatgcacggggggctgtgagtgaaattcttaagctacatggaccgtgctctgttggaaattcaaaccatcgtacgagtacaaccacaactctctgcagaagaacgtcaagtcttaatccacacaaaatatatggaagagacgcagagaagaacaccatcatgaagattattacagatgacagttatgacggagtaactgtagtccctattgtgggcatcggaggagttgggaagacagctctcgctcaacttgtatacaacgaaccaacggtgaaacgtgactttgagcggatatgggtttgggtgtctgataactatgatgaattgaggatcacaatggagattctagattttgtctctcaagaaagacacgaagaatctccctgtagaaaagaaatacggaaaggagtaagtagctttgcaaagcttcaggagattttgaatgggtatatggacatccagtcgaaaaagtttttgcttgttttagatgacgtatgggacagcatggatgattacagatggaatattttgttggatccattgaaatcaaatcatccaaaaggtaatatgatccttgtgacaactagacttttgtctctcgcacagaggataggcacagtcaaaccaatcgagttaggtgctttgtcaaaagaggatttttggttgtattttaaaacatgtacatttggtg

SEQ ID NO: 38592 - DNA, 761 bp, Oryza sativa
ctcctttagtaaaactctttgatcaacatgttaaacataatgcactataccactatatgaaattacttaatctaattcaaaatataaccacatgaaatgacatatataagttaaacagtacatagagatgcaatttttttatttttattttatttttttgatatttttttcacacttaggagaacataggaaccaaccgtataaaaaataaactcaaacggataaaatatgtgacatgcagaattttctaaaactctaccgaaacggacaaaatatgtcatctattaaaataggcgtaactttctcatacggactcggaatcaggcaaataatatatgcacggacatctacagaaaaagttacatccgattctccccgctttgtcgggttcggcgatattaaaacctccaaattccgcttgcaagattgtgttttcgaggagagaagtttttcggtggagctttggaaaattccacgtgccacatattttgtccgtttgagtttattttttacatggttggttcctgtgagttcctaagtgtgaaaaaaatatcaaaaaaataaaataaaaataaaaaagttgcacatctctctcctctgcactagttcggagagaggagaggagaggaaaaattctacatgtcatatattacgtccatttgagttcaatttttctatggttggtttttgtgtgtccctaagcgtgaaaaaaatatcaaacaaataaaacaaaaataaaaaatttcgggggggggggcgcc

SEQ ID NO: 38593 - DNA, 2889 bp, Oryza sativa
  unsure (1)..(2889): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccatagaatgatagaaatcaacactttcacagcatgacaatcattggccagtaatagtggcaaatgtttttactctgaacataaattgtattgttaatatccaaatttgactcctagagtatgaaaaagaaactacagccaaattcaaaaacaacccagacttgccacgcgaaggccggtctgatcgcagtcatcgggctggtcagaccgatgacagggggacgatctgatcggcggcatgtagctagtcagaccggcagagtccgactcgagtccgatttgttggttctcgggtttctgctaatgcctgagattttagagttttgattgatttctacacctaattggatgtgaaaaagaccctgggaagtaagtccacccctcctatataaatataagggggttaaggtcgattgaaataacaatcaatcaatcgtcaaaatcaatttatttatccaaaccctctatattctacatctccctctttcttgctacctatcccaaagtctattctcctcaaatcccctaattgctcgttgtctctcatctctacgacgttagagggcgtcctagctagcctgccgagtttaggacaaaccaatgcacgttcaccttaacgaggtccttcccggctgttcgttcggcggcatctacctactccctacggcggcgtgtctgcgcgtgtgtgtctccgtgttgcacatagcgtgcttaaggtgtggcggcacaattatacgtcaacactagcaaatgtatttttcctgaactgaagagtactactccgttccaacttagtttaaacttttttcccaaataacaaactcctaccttcttccgtaaattgagaaatttcattcctccatatctctcatatacgcatccaccaatataatttttctattaattaggggtatttttatcttttgtctttctgcttaagttctttttgggatgttactagttttaaaaaaatggacagagggagttggcagtagcaaacgataaccagcagtcaggttttacagtggaggtcacccttaatttagtccacatcatcaactcattaattaagaggcaatatatacaacaaattacctctagtacacttgccccaatacacaatattaattttactttatttgtttcctatcaattcattggtctcttgttctcatctctcttggagtttgtgtagaagttgctctttgcataagaggtggctcgttctctctcttctttcatatctctcatccacattatcgtgtgagcttaagcatggcacctaggggcaagtgcgtagaggtttatagtacttgcccttagagtgctagcagcaacagcgtcatgcatgtattatcatgcaatgtgccattctatttcttagagcaaatataataggaggctttaaaccgactaaatactgaggtggaggagagagaggagaagcgggctgtaaacttacagccggcttggacacaagaaccaagaaactatgtgagagagacaagtggtccctgtattaattataacgagttaactattatatgagtgggttgagagaatgttgcaaataaccttatagccaacaagtcagctatattattagccttgctctcaagggaagttgtaataggagaggttggagctagtagtcaaaagagatcattaacttaagcacatactccctccgtaaaaaaaaagtaaatctagaaatagatgttatatattatagtacaatgaatctggacagatgtatgtccatattcgtagtaataggatgtgccacatccagtactccctccgtactataatataagggaattcgactttctgtttgtatcgtttgaccactcgtcttatttaaaaaatttatgcaaatataaaaaacgaaaaattgtgcttaaagtactctggatgataaagtaagtcacaaataaaataaataataactttattttttttaaataagacgaatggtagtgcgagaaaaaatcaaaatatctgggacggagggaggcacatagggagtaggagtacagtactgctgtctactagtactggtggtatgatcaaaggctactactcctactactgtctactggtatgccagtcaggcagtggcatggcactggacaggtgactgacataactaaccatgggcaataaaatgcaggccattctctctgaagaaaactgccctgagcgacataaatatgtccgcagaagcaagcaagaagctcacctcgcatccgaggaagacttttttttcttttacatcaagtaaaagtcactagccttgcagattctatgtgataatttcacttggggcccaaccgatggttagctggccgcttggtatggatctgtcagaaaggtgcagctaactactcttacataattgcatggagagaggtgctggatttttcacattttggtccttttaaaaaacttatttcgcaagtagacccctagaaaaacttatcccaaaaatggtcctttttggggcgccagagtggctggcgccg

SEQ ID NO: 38594 - DNA, 4431 bp, Oryza sativa
cggcgccagccactctggcgccccaaaaaggaccatttctgggataagttttttcaggggtctatttgcgaaataagttttttaaaaggaccaaaatgtgaaaaatccaggagagaggtggtggaagcggtactagtgtttcgcggttaaggttttcttgaattcggcttgaaattacttcctctgttcctaaatacacatgattttggttgaatatgatttatccaagtacaacgaatttagacaggctttatgtctagattcgttgtattagaatgtgtcacattcaatcaaaatctcttatatttaaggagggatgctgtaacaagatagttccaattttgataggaatcgaaaatattcccatgttggaagcaacatggcatcagacgagatatgtgctcgagttgcattgaccatgactcagttggaacaaacagaacagaggatgcaaaattaaggttgatatatatccgagtaactttagtcagaaaatttactccggaatcgtagagtttggtgcccgacacgaagcataagttggcaggggccgggggaggcggcgtgcgtacgtttggacccccggcgagtgaacgatgtcaggcagggtaattaagcaagcatggcatgtactcgtgctcacgagtggagtgatggaccgcgatcctgcctctgcctctcccctgcgccggccgcgcagcttgtagaccccccctcctctgtggctgtctgcggcaggttgcacttgcacgcatcgcccacacaccactgacacccgcacctcgcaatgcaaccagtcgcatcatcgtgcatgcgcccgcgaagcgagacttgggtcatcggcgccgcggcccgcgggtgcagttgcacgcatcgcccacaagcggcagcggccacaccactggctcgatcgcaggtagtagtgtcgcgtgcatgtgggcgcacgactaattgtgcagagacggagcccaaccgatcgacctacctgcgctgtgagttgtgaggcttccgcggcaacggggcgtggtgcagcctagcttggcgcgacagatcgtacacgcgtgccaatgagctcgcggaattgacgaggacgccacacgcgtgcgcggcctggtgaggctagcgcaggaggtcaggcgcggccgccgctgttgccttcgagtcgtcgtggtctgtgcgcctggcctgggctgcagcgcgctatttgcccaattccgtgtagctggcagacttggtggcacaccgtaccggtggcacgagaatatctgaatatgccccgggcctgagtcgtggggtgcccgccctgattagggatggcaattgtgcccgtttgtccgtttactcgtgggtaaaaactctattagggttaggtttattctctattttatacccatgggtatcttattgggtcaaaagctatgcccgatgagtaaatgggcatgggtattggtaatcactacccatgcccgctttgcccgtttacccgcaaaatctaacttatatgtaggctaagagcaaaatccactagaatacataagccacgttctttgttttctacggtttcccttttatttcccttattatttctctcccccttactctatcgccgccagaggagagataccacaccgaggcggagaatatttgatgttttaagttcgattcgaacttagaagcttgtagactttttgttccactgcttttgttgtggtgggtaaacgggcatgaccgcgggcacaaggcgcccgcgggcgatgggcatgggcaaccatccttacccgtcatgtaataatgggtatacccacaggcacaaataatctcatgggcacacctacccatacccgtgcccgcagcgcccgattgccatccctagctctgatagtgacagtgcggcgttgaaagagcgcgcttcttcggttcttcccgggaggggaagaatcgtctcgcctaaacaatgatccggttcctctatagtaacctagagggggattgttgatgcgaggagaacagtgaataaatgcagtaaagtagtagcactttgatcccttcgccttaaaagctctaggtgtcttaagcagaaaaaactcgactacttgcccatttccttccttctccggtggccttctggtcatcgtgtggtgtgtgtgtgggtggaggagagagggttctggttccttcctcccactactagagataggtttaggtttagtcagatctttttcgttctcgggttcatcccattctttgtgtacctcaagagggtcaccgacgttcgatttttatgtctcagcttgatggacatggcgaacctcattgacgttcttgctagcgtcatctttctgcctagtgaatgttgggttcacctccaatgctttcaattgggagttttgctttgggttgaaagcttgtcctctagcatgtctaacaaaaggttgcatcggttgtttactccatattcagcaagtctcacatacttatagtggttgtctaattcgtctctgacggttgttttgcaaaatgtggctgatgatttctcctatgggccaaggtggcttcaacctctatcaagaggcctcgttcgggtatgctccttggctctacccattgcaactaaacatgtttcttttgctcctgccgtcgtcgtctgcgaggatcttgccatcgcctatgtggttgttgcaaggatttgattgctttttattttatctttgtaggtctttttttcgtatatgttattcttgaagtgtatttacccatcacttaggggcttttatgtaaaactagctattctctcaactttacccactagaaaatgtaactcatgtaattgtccttgattaataaacacagttttttttctgaaaagaaaagaatagtagcactttactccacagaataagtatatttttgctccctaaactctgtgggttatgcacatatagttggaaataagtctatttgtattcctcatgtctttgggcctcgccttatatggttaattaagtctattttacgttcctctactatttttttcgatcagtgacgtgccgggccagcccaccgtgccaagggagcggcccaagcatggtctggctgtcgggccgtgccgtacttgggccgggccaaattggcgtgccttggaccgggccatgggcctcatgccatatggccatctataatcacattcaaaaatacacaatacctctaatactccctcattccctaaatgtttgacgccgttgacttttttaaatatgtttgaccgttcgttttattcaaaaacttttgtgaaatatgtaaagctatatgtatacataaaagtatatttagcaatgaatcaaatggtaggaaaagaattaataattgcttaaattttttgaataagacgaacggtcaaacatgtttaaaaaatcaacgacgttaaacatttaggaaaggagggactactatatactatatacaatatactataactatctgttgtattacatgctacgacagaggatcccaatcccccaaacaacttaacaacccaaattgctgtgagctcgtgagcgtgactgcgtgaggtggggtgttcatgttgaaggcaatctggatcgctaccgttggtagctatccaacttttatgctctacgcatacagtgcagtacgagagttgctatgaaaagtcaccgccacgttactccgagtcccccaacataatatccaccgcctatgtgagatcggacggtatatggcgagaacgacatttggacatccaactttttggggacctagtagtgtaaagcaatacggtattgtatgagggtcccaatgcaaagacacctttacctctggttctccctcaatctcagccgcctaagtttaatcggacagtagacgaagaggaaggtaaaccttaggccctgtttagtaccccaaatttttttcctaaaaacatcacatcacatctttgaacacatgcatgaagcattaaatatagataaataaaaaaactaattacatagttaggggggaaatcgcgagacaaatcttttaagcctaattagttcatgattagctataagtgctacagtaacccacatgtgctaatgatggattaattaggctcaaaagattcgtctcgcagtttctagacgggttatgaaattatttttttcattcgtgtccaaaaagcccttccgacatctggtcaaagatctgatgtgacacccaaaaattttcttttcatgaactaaacagcccctttaaaccgatggcttgcttcactgacctgtggtgccatcaccagtaggcccggtcgcaacagttcagcagcttcttccctagagcttcttcagcctctcgctgaagtggaattatcatgctgacgcagaatcacccagatctatgaattggaaccgtgtccctgttttaatgcaagttcag

SEQ ID NO: 38595 - DNA, 1064 bp, Oryza sativa
gaagggcgctgtgattttctcctgacatatattcaccggtaagctctgatggaacatttgaagggagaagttttgggcagtcgtatatttttaaagtcttcaaacatctgagttgcctcaaaccatggaatgaaatagacgtcggattttggaaaccatatatttccaatccagttaggaaactcaggttatggaacgacataatgttatcatccaacgttatcagcttatcaggaacatcatcatcattgggaagccaaattgttaatgttccattggatgaccccttcaacgttggaagtgttgaaactttggcgatggataattccaaaacaatagtagaaggtggaagaggattgtgcacatgcaaatgaggacaatcatggatagtaagcttgctaaggtgggacaaccatgatttccgctcaatttcaaatttttggcagtcctcgaacaatggaaagaccttcagcacagggcactttttaaccttcagaacccttaaactgcagtttaagtccctcatggaagtgcaggagcatctctccaaatttggcatgtcaattaacatcagctcctccagcgaaggaactgtcatttctattattttctgcatactctccaacttcatctttttaagaaagggaagacgttccagtgatggaatcattttccattgtccacaacactctagacggagagtctgtaaagaggtaagtgaagtggcaagccatgttggaggggtagcaccattgtacgaatatatctctaggtgcttaagatttgtatgtggttcaagaccctcaagcactgctcttgcattttcacgttcatcccatggcacgttagtccccaaatgacccaatttatgtaaattagtccacgaaaggcgcagcttttctaagttctgtttgtctcttagttttgcaccacaagcctcagctctagttgtgacattttcaagttgagacacaccgagctgtacaagctggttcatggactggagttgtgctatctcccagccgctagaattttgaacaccaaagttatgtagttcctgaaga

SEQ ID NO: 38596 - DNA, 554 bp, Oryza sativa
cgagccgccgccggcgtgccggcgtggactcggatcgacggctagggtttgctcccttgctctgataccatgtcacttttggagagaagatagaaattggggatttcaactattgcaattgacttagctcaaagagcatataaatatgtacgagagaagtagaaatgtctataataccctcaatactcttaacacacacgtgctcctgcacttccatgggggacttgaattccagtttaagggtcctgaagattgaacagtgccctgttctgaaggtctttccactgtttcagaactcccagcaatttaaaatcgagcgaatgtcatggttgtctagtcttaccaagcttaccatcaatgattgtcctcatttgcatgtgcacaatcctcttccgccttcaactattgtttcggaattatttatcgctggagtttcaacacttccaagggtggaggggtcatcccacggaacattaagaattggacgtcatcctaatgatattttcagttttgattccgatgatattttagagctaatgatattggatgataaa

SEQ ID NO: 38597 - DNA, 656 bp, Oryza sativa
tcctgcagcccttttatggctaggttcgtccttagttataaaatattatgattttactatgtttttcatagattttataatagtaactaattataaaaccaatatttttagaggacttttacggtacattctactgcaagtatatattttggtatttgttaaaaatctggaaagacttgtttagtaatttgaaattgagactcgagatttattttattaggagtaattgtccatggatcttagtcatctgttcgcgctagcgttttttgtgatgccacttcctcttactattcatttgctgcttgctgcctgtcggctgccctttccttgctgctgccctgcctcctcctactgcctgctgccgccgcccggatgccatgcaccattgttgccgcctgtagtagctgcgcccgggtgccggaagccacgacccttgactgctccgcatcaccttgccgccgcgcgcctcgggacgagcccccagcggcccggcgcccttctgtgtcttcgactatccaccccctcccgcgcaaccgagccgtcgatggtggagttggagaattttgggcagacctagagttttgggtaaggaatgttagaagtcacaagaggaggaaaggaggacggtaactcgattcaatttccgttagcggcgg

SEQ ID NO: 38598 - DNA, 599 bp, Oryza sativa
ttggatccaaaatgtacatcccagatctccttgttacatttatgaaatgacccccgcaccagcctatgtacattttgcacatacaccatcttgtttttttcccaaccccacattggtacagctccttttgaatcatcagatccaatcgggagagggggaggggagagaggctaatcgatggagacaccggccaaccagtcgcgggattgagtgaggaggcgtggcggaggaggaggcagcgacgacggcgacgacaacaaatcgtttgctccgctagccagatggatattgtctgcaccagcgatcccgcggtgagcttctctaaaggcctccaaatccctttcctcgtcgatgccgaatgctgagcagcgatcatgagatgagtttctttcttctgtttgcggggttggggagtcgtttggagcgatttgttgcagaggctgctgttgtgctcttcgacggcaggaggaatgcacagattgctgctgcggcccttgctcttaattattaattatattcctatagaatgtcaggatgtaggatgtaattaataatcctccaagctgtgttcccttgctcttaattattcattatactag

SEQ ID NO: 38599 - DNA, 513 bp, Oryza sativa
tacgatgctgtttcttgaagaaagatgctcaatattcctacctttcctagctttgccatatcactgcacattaaattccatcatatgtcatttgtacttctacgtactaaaatattgtacctataattctctctacatgaaatgcttacttctaagcaactgcgaaagaacatttgtttactgtattaccgttttccgataatggaaaacagcattgtttttctatatcctagaaaactcagtttagaaaaattatctaaattgcttgatattttcttcaacaattttattacctacagtcatgtatagatttgtataattgctccattatctaagaaaagatatatcgaattatagaacgcatggtagctgtatataaataaataaataaataaataaataaataaataaatatatatatatatatatatatatatatatatatatatatatatatatatatatatatatatatatatatctcagctcgtttttttaattagatacaaaaat

SEQ ID NO: 38600 - DNA, 719 bp, Oryza sativa
atgaaaaccttagaaaattgcatttacgatattgcgaaagatctatcgtgtgattttttacctccaaaattatctctcttttttttacccaactgatgtgtagggtattctttggtctctaaaccatagatgtgtaaactcaccgatgtgtagggtactctttggtctctaaaccatagatgtgtaaacttgaggtgtataaactttagatgcataaatttactaaaataagaaagtaatgcagtgccaaaaaagaaaaccaggtggagggatgggggggggggcgggctacccgatcgctatgggcgagcgagggcgatccctcgctcagtagcatttccggtgtacccagatttgtgctaggtgggaaaaacaaaaaatcatgtcacgccaagattcatgctaagcggagaaaacaaaatcatgttgtagcccggggatcctcaagtcacgcacaaacacctctcactgagttacgggcgtacgtgaggtactaagaattaagctagttacattatacatttatatgtgatttcagtgaaaaaatatatcgactagtacatagatactccgttacacttactccgtaggttcaagtgaaactacttatgaaaaaaaaaagatgatcttggttatagaaccaaataagagatacggagtatataacacttgctcaagtacctaggtaacttggtactcatatcatagggctgcaggaa

SEQ ID NO: 38601 - DNA, 647 bp, Oryza sativa
ttcgtatgggcattttgctggcagctatggaaatagctgctctagctatagtttcggatactctgcccatttcataaagtattcgacttggtttaacaacggctacccaatattcgggggatccctttcccgaacccatacgtgtttccgtcggtcttattgtaaccggtttgtcgggaaatatacgtaccagatttttccaacacgacgtgcatatcgtgtcattgctcttcgtcctgcttctatctgcctcgccgtaatccaagtaggttcaagtgcttgaagagcatatctaccaaaacaaatacaattgcctcggtaggattttccctttattcttcctctatgttgtttacgaaatctggttcttttggggttatagtcgatggttctctcttagttccatctctactgcaaaactggacatgagagtttcttctcatccagctcctcgcgaatcaaatgagaaagtgtgcaaatttctctaattccacaatattctaaaatattacggatagatacacattaataggaaaggttagggtttttaatattaaatttattaaaatactaaaatatatagtcaagaaaagaggatctagaatatatctagatgtgtatgtttatttatctatattctatattta

SEQ ID NO: 38602 - DNA, 4507 bp, Oryza sativa
  unsure (1)..(4507): unsure at all n locations
atttttttcaagaaaatcctatccagtcataggttctgtcattcccactgcttctcctttaatggttaggtttgaatctcgcaatggagcttccaaaaaatttctttccgagtcaatttctcagtttattaactcaggacgctctttgttattccttgaaatttgtatttcttgtttcaatcaaattacgatttcgaattctttgttatttttattatattgatgctttatcacattgctttttatgatgtattcatagaccatacatattggaatcctatatctttcttttttctcttccttctttctatcatccttccttttatctacatcccctttagttttgcttcacaacttagaatcctatttttttaaagaaaaaattgcagttgctacacgtatatgatagatttacttatttatgatagatgtatttattcatatagtgactgtttcttagttaggatctcgacaatacgaagcaataggttggttattagttcattttctataattacatagtagggttcattctatttttttaatcccctttttgaaccctaaaaaaaactaacgagtcacacactaaacatagcaattttattaaaagatttctcaattttcattaaatcttatagaaagaggtagaatttcttctttttttcagggattttagggaaaataaggctcttgtcattttttattctattacttaacagaatgggaagacagggttggttattcttcatctacgaatatccaaattttaactcctaatactccatagatagttcgaattggatagcagcaataatcaattttagatcgaattgtttggaggggaagtctaccttttttgatgcattcggcacgcgcaatttcttttcccgcgagacggcctgcaatttttacttttactccctttatatatgttttttagttaattcaatgacccctgtacatttgtcgataaattttctcttaaaaatttgacagatgtaattatagtacaatcgtagtgtagttacactgtaactcatatgtaattacactgtaacttgcatgtaactacagtgtaacttatatgtaagtttcacgtaattttgaatcgttagatctattacaagatttgtactattacaagatttgtactagtgaggaagaaaacaaatcatagcacacacatatgtgaaaaaatttgttcccaaggtctccattttatcgaaataacaagttacggaaagatttttgaaaattacatacaacttacattatagttacagtgtaattacatgcaagttatagtgtaattacactacgattatactgtaattacatccgtcaaatttttgagggaaaatttatcgacaaatatatagcaaaattatatctcattcatatgatcaattgaccaccatatctggttctcttacccagtttcactttcatagcacgtatgagagcacgcttgtgctttgatgctttctcgcgttgacaactcgaaaacgtgtttatccatagttccatgcccgtatctccaaaacgtatttctgatttacgctttcaaggtgtgcagcgacatcaaaatatgtatatggttcagtgccttatttgaggcaaatatttttcatggaagaaagatcaaactgcaccacatctcattcacatgatcaaattaaccatgtctgaaaacacgcttgtgctttgatacttccccgctttgacagctggaaagcgtgtttctccatgaccgaaagggtccaatgtccgtatctcggaaacgtactttcgatttacgctttcaagaaatggaccaaataggagtccgggctcgagccactcgactcgaccgattcgacaccgacgaaagagggcgaaaaccatgggctcctcctcgagcaacggccggaccgcgcccgcgccgccgcctccggctgcgcctgcgccgccgcacccactccacgtgatggacgccgacgaggaggacgagaacgtgaagcagctcagcgagtgcgccgccctctacctctccctccaggcaccgattctctcccgctccctttcccctctccctcccctgcgtgttctcttccccgcctcgttcttagtagttgaggacttgaggaggcgaaggcgattcctgtcctgctgccgcgcgcaaatctcttcctgacttaacagtctctgatcttgctgttcgcttggatcctttgcaggattgcctcgtggagtccaaccgcagctggaaggcctgccaagcacgtaagcatcgcgacaaattcgtcattcctttctctctctctatagtaggccttggcgttcatattggtgaactgaatgagttgctgaaagttgctgattgcttgctcagattggaactgatcaactgaatttgttgtcaaatggtttggaattaggcaaaaccttggatttgtagtgttgtgttgaatacccaggataactgcctcatgttacatgtgaatggtttctggtttatcaagtgttaatgtaaactcaggaatgctacgaaattttcttcttcaaaagagagtgcttatggtatagctgaagtgaggctcacttgcttatcacattacactctcagagagaaaaggaaatgtggggaatttttcttgcttctttgggaattgaattgttttgtatgaaattcttgcatatagataggttcttaatggcatgatatggccttcaatagcttaaaacgtgctagaatgggagttagaatcatccaagataaatctacatgtgaatgtggtttagcttcatgtctttcctgaaactattctaaggcttcgtgaagttatgtctttcggcgcttctttacaaccatgcgcacttgtgcgatattactgggtaattttctagtaaaagaagttgctgatccatgaggcaatttgtacacatttggcttacctaacagctcgcaggcccttaacaagtaacaacagcaggcatgcagatccaactttgccatatagcactaatgtcctaggctcctagcactgcacaaagtttggtcacacatttgcatcctagttgctttccaaaatcgaataacttacagccacattttattttgtcttttggctgtacaattgctgtgatgaggttaatgtttgctcaagtcaaggggctagacctgagttgagatgttgcaattttaagatgccttgcattgtgatccgagctaaatgtagcatttctttgaggataaaagtatggtagctatgatagttacatccatatttgtttaaagttagtgctgtcttagttttccacaagctggattctggttttattatcgtaacattatctcactttgttctaacaatatctgtgttgcttcctttttatggcagatgttcaagccttgaaagcatgtgaggcaaagagaaacaaaagtgaaacaagataaaattattttgcaatatttggcactaataccaggcaagtagaaagttaatatggtttgaagagttttgaaatcaactgacttgtttcttcaaatattgcgttatggctgttgccatcagcatcgaactgaacactatgttttttcaccagtctgcttttggaaggtttatcatattcttcattgaggatggcgacaccataggcagcgtgtttagagctgttagctgatgatggagaaggtctacagcatcataacctggagttaacttgttaaaagaacctgtagttagatttcgaccgaaaggacacaggatgagctcgccacgttaactgaacttgcttgattgtttctggtggcagtcgctgtttcttcacattttcatgaaatgagacaatatcagcattacatgcgcctttggataactgctgatatgagttcatagcttaagattatcattgttgctgagatgcctttaggcttttccaatacctgttttggctttgttttggggcgcacatggttcgccacatcgtctatacaagtgacatcgtagcgacagaatcagcgtcttcagtgacgcaactgccattgcagaccgagaacaccaactcctgccattctcccggtggctttctccatcggatagtttcttccgtgttcaattatgtacggatatgaacttctctggttatcagaaaaaagtagaactggaagtgtaaataggttacagccaaaagttttcgacaatcatcagacttggtatttcgcattattgacaaaccgcagagtataaattgctttctgaaaaatccgatacttttttaataatcacaggtttactatgactgcgcagactgttctattgcgggcttatacttccatgctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 38603 - DNA, 678 bp, Oryza sativa
tcctgcagcccagaagcattaaaaaaaaaggaggccatacggcggcatgctgttgcctgttggtgcactgcataatcccagtttcctcgcctgttcagtgtccccggcccggaaagacggagcctcgcgccgcccagatccacacacatatgcctctgctgctgccttgcgaggcgcgatcaagcctagccacacgccgaggcgactcgacgcgaggcctcatccgggaggaacacgtacgggtccgcatccccttccgcgcgctcgcgctgcacagcacagcgcgtgcgccgagagcgacgagggaggaagccctccccacctcaccaccacacaaaacccgcgctaatccccccgtggcggatagcggataaccagaagaaagacaggaggactcgaggagaggagagcgtgcgcgggctgcgatgatggagggggaagtggtggaggaggaggaggaggaggaggtgacggcggcaccagcgccggcggcgatggtggcggcggcggagttcgggctgaccgcggaggtgatggcggtgctgccggaggacccgttcgagcagctggacgtggcgcggaagatcacctccatcgcgctggcgtcgcgcctcgggcggctcgaggccgagggcgcgcggctccgcgcgcagctcgccgagcgcgacgccgcggcgg

SEQ ID NO: 38604 - DNA, 7672 bp, Oryza sativa
taatacgctatgacgacaatgcagcggttatcattgatcaaaaaggaaatccaaaaggaactcgcgtttttggcacgatcgtcgaggaattgagagaattgaattttactaaactagtttcattagctcctgaagtattataaatactagtagacaagatatagatcaaataaaaattagtagattgtgtttcacgtatatgctttagaatccaaaacgaaaagaaaaaagagaacatgttgattatagaaaaattaggaggaacctagaattagagtcttatgggcaaggacactattgttgatttactaacctctataagaaacacagacatgaataaaaaaggaactattcgggtagtatctacaaatattaccgaaaacattgttaaaatacttctacgagagggttttattgaaagtgttcggaaacatcaggaaagtaatagatatttcttggtttcaactttgcgacatcaaaagagaaagactagaaagggaatatatagaactagaacctttttaaagcgtatcagccgacctggcttatgaatttatgccaactatcaaggaattcctaaggttttggctggaatgggaattgctattctttctacttctcgaggtataatgacagatcgagaagctcgactaaacaaaattggaggagaagtcttatgttatatatggtaatcgccccacctatagttatagtacccaaattctatcttgaacttcctatttttcaaacaaaaatacaacatttttttatttgaaaataaaaaaagaaaaataggagaaaaaaatatgacagaaaagaaaaataggagagaaaaaaaaaccccgagagaagcaaaaattactttcgagggtttagttatggaagccctacccaacggaatgttccgcgttcgcctagagaatgacaccatcatcctgggctatatttcaggaaagatccggtctagttctatgcgaatactgatgggggatagagtcaaaattgaagtaagtcgttatgattcaagcaaggggcgtataatttatagacttccccataaggattcgaagcgtaccgaagactcgaaggataccgaagatttgaaggataccaaagatttaaatggttaggtttttcttttttttttcagggtaaaaaattcaaagttctaaaattcaaacaaagagacttattttttccaaaagagtaaattcatagtttaagaaaggaatactccctatacatttgtcgacaaattttctttttgacaaattttctttttgacagatgtaattataatacaaccgtagtgtagttatactgtaactcatatgtaattacactgtaacttgcatgtaactacagtgtaacttatatgtaagtttcacgtaattttgaatcgttagatctattataagatttgttctggtgaggaagaaaaaaaatcacatcatacacatatgtgaaagaatttgttctcacaacctccattttaccgaaataaatgttatggagagatttttaaaagttacatacatgttacattataattacagtgtaattacatgcaagttacagtgtaattacactacgattgtactataattacatctgttaaatttttggtggaaaatttgtcgacaaatatatagcaaattcagttgcgaattgtagccccaagaacgaagcagatgcaattggcaaccgtttcatgccagcgcgcagacatatatgatctactgggaaaccataacaggttgagagatgcccagttcctagtcaacactaatgttgacaatttaaggtacatctacatagcaagcttctttacactccatggatgtacacgaaactaaatctaggaaaaattcatcgcatgtagcgtgccctccaaaattcacttaggcaaaatttgcagttcaaatgctccttcgttcaggaaattgttcactctgaccgttgcagccatccaagctgtgtagaaatgaatcttgttaaacatttgacaacaaaactggctgaatattgaaggagcagacaacatttgacatgaggaaataccttccaagcatacatcacaaagaatgcaaccgtatctgctgaccagacaacagcgaaggatttcacgaagaacgggataatgacgttgattagagggaccagtagaaacaagtagttgagagcctctttctccttacttgagcagtcacgggcccgaagagaaggtatagctgcagaagtaggtagttgatcagttacagcatcacagaaaatgtatctaattcattgcatccattgaatcttattaacctcaacagcgacacagcatctagagatcaaattatgttcattttatcgacagcctcagattaataattaatattgagagacagattcactgttaattactacttgatatgacaacctcaaggatttttgttaaaggttggcaaagagaaggatatttcatcatgtttttccagtcagcatatatgcatatatagaacagctaaacagacaccgtgctagaaagaaaataaattctcagttgctcttagaactattctttatctagaactggatgaactgcactataaagtttatggctagtgaagcacgaattaaccccttgtgccagttgattcaaaatgttgtagcacaagagcactttcaatacatttttagccattgctgcttacgaaaaaagagcaagggcttggttgatgcatggatagatcataatccttgctgctgatgggaacaatttacaaacgtataaacttactgcacaacgacaagtaccacaaatcaaattcttacttactgaacatccagatggaccacattcccatcagcctccaaatgtccggctcattcgacgggaacacgagattgaaggaaagggctccacccaacagcatggaggcatatccctggacctcaaagatagtgtacagagctgttccaggcactgcagggttctttgtggcagtggacgcccttggtgcaaacgttgctgcggtcttctgaactgcctgctcaagaacacagcatagttatttggtggtgacctcatgaagtcatgttgtttgctgtatcagcaaaaatctttagcatttctaccctttaaaataacattttgagtttctttgtgcatatgggcctacgaccaaaaactagatgtatgctaagagcaggtacaataccaggctataagccagctatacacatattttaaagagataaaagaggagagataagagtagcaggctacagatttgtagccagttacaatacggactccaagatacatatgtatatgacaggtgggactaaacattaatgatgtagtacatataggtaactattgtatgaattggctattaaattgactatatataatttggagccgatagttggctatactattaaacttgctctaaagttaaatcacctattagaagactacaacatttctgatggctcaaattagtttcttcctgcaattcattgtactaggtttctatcgaattgtgaagttttcaagtgtttcgaattcttacagttgcctagtattatttgcaacaacttatgaattatatcgaacaagctgaatgggaaactgttttaaacactcgggtggacgtccacccgagagattagataccatctcctgagctgaatgcttagttcttagaccaagggacaaagaaaagagccgaccttcttgagctccttctcaatcttgggatcaacaggagccggcttcttctccgccgacgactcagcggaagaacctccgccactggccacctccccttctttgctctctcccacagcggaagcctcggccgccactgcaccagcggcggcaccaccaccgtccgagccatccgagctcgcccacgcaagaaccagcctcgccggcctcctcctcctcctccccgcgaatatcccgccggggacggtggccggcgggaacgcggagctggccgcggccgcgaacgcgcagccgctgccgagagggctgtacattgttcgcgcgaggtttttcttgtggggagggagaggagagatggtggaagagatggggaatggagggtcgtcgtccgtcctcccgccttcggtttgtgccgacgtggccgcggctgcagcttccgtgtttcgcagagaagcgtggacgttggttggtcgcttcctatagcagatagtatctcagccgtccaatttatttagcggctcccttcttgtctcattaccgttagcacattttacgaactattaagctatatgttttgttttgtgtgaaaaaattctatataaaagttactttaaaatatcaaatatatatatttgttaagtttataataattaaaacttaattaatcatgtgcatgtaatgagaaagtttttgtacaaattaatttagctattagcacatgattatttaagttttaattattacaacattaacaaatggataaatttgatagtttaaatcaacttacatagaaaattttcgtatgaaacacaccatctagtagtttgaaaaacatgctatcgaaatcgagataaaatatgaatcttaatgagaaaataacatgtgaaaatatatcctctcttatgtccgcctctctcatattgtcatacatgagaacactctcattcaagttgtcacccttgtaagcttgttccacaaggaccacactctggttcaatttccgcttattctctcttcccccgcgcctctccttccctattctggacaaggcaacgctccatctatatatattgtccctatcgaccgcctctacattggcggcgcttcggattaatcccattctatcacacccagaaatttagcccaaatttctagactattttgtgtattaaatccctatccaggaccagccagggtacacaaaacgacaagtaataaacagttccaaacgtaaataaagcgtaaaatacttacaggagaggcacttagtcctcacaccgaaacaaaagcaacggcagcagaaaagacgatcctagcggggcttcagctccactccacaggcaaaactcaactggggtctgagtcttggtcctctaacttcgtcttcagctcagaagcactacacttctgaaaagggggaataatagcaaaggctgagtacaaccaccgtactcagcaagccacaccaatgatgcaaacgtgcaaggggaacacaaggacggtttgtggctatttgcataaaggcggttgtaaaacattttattgagcaaaaccgtaaaactattgagtaattaaagtaacattaaatcttcactgatcaacactacaccacgttgaacaggcccaaccaacccatctgaactacagtgcattgagtcgatttattaaggtgggactaatcacggtgaatctggtcgactgcccataaccgcaggcacggctactcgaatagttttactctgatcagaggtgtacaactgtacctacaagatacagccccacgacacgtttccgtgcgccgacatgccaccacgacataccggaaagaggtcgtgacaggacccttcacataaccccctctaaccaagcacaccacacctcaggtttcacccccactcctcgcaagatagcgggcagtcccctctcgtgcctaggtgaatccggaagccgcataggccgtcgcaggacccatccaaactccatcacgcccacccttgcctggatgcgtcagctagaggaaagctacactacaagcccagccgttgcccacgctggcttatggtaagcatgataaattcttccagggtttcccgcgaaccggtccttaatcgccatgggcacgactagcaaaaccatgcacccacagcccaccatgtagtcgcattttagttggataattacgaccatgaagtatggctagatgtcttgagcacgcagctcattctgatactaaaaagatctaatactgtaattatcccatcaactgagctagtggtaattaagcatgactaagtatatagttctagctaggtcacataagtaacatgagctagtctatttattacccaaggttgacaaatgacagatatcaagtaaatatggcacaagcaaacagataggtaatacccggatcccatgtaattagcaagacatgcaattttatttgcaaacaataaaacatttgtaaattaggatcaaaatgttcaaggggaatgtgtgacttgccttgcttcttcacttggatcttctgaactcttttcctcgtgaccgcgatcttccgaaacgacggattctacacgctggcacacaaaacgaggaaaaaatctaataaaaaccaaggaaacagtacataaaaagtaaacaaacatgtagatctcaattttagatgaattttgtaagttgaatggcccaatttggagttcgaatgaattagatatgaattttagaagttttgagccatttaaatgaatttctataattaataccaatttattgcacaattattaaatatttttccaaaggaaatgataagcgctaacgtcagcaagaggaagggcgccgacaggtgggccccacacgtcagcgggtcaaagggggtggctcatggtggactcggtccaccgcagcacaggcgcgcgggcacaccacgtggaagaccacgtggcggccacgacggcacggcggggcgaggtggcaaaggcatggcgccgaggtggcgccacatgggacaccggcgcggggcggcgccagagccacgtagacggcccggatcaccccaaaggggatcgggcggccacagctagcgggagcggcaaaactcgccggccgaccggccggggagcgacggcgagcagcccagaggtcgccggcgacgaccaccggcgcgacggcacgcgcgggaggcagcggagggaggcagaggagggagatggggagctcaccgagcgcacaaggcacggaggcggcgcgggagagcgaccgacgacgaggagaggcgacgacgcttcctcggggaggcacggctacggcggttcaatggcagtccgcgagcgaggagtggcggatgacgaccggaagagcctgaggaggacgaaggggagattagaagagggagaggacgggcttggcgaagggcaacagtggccaaaggccgaccgtgagtagaggagctcaccttgcgcggggaagatggggttcgagcgacgattgatggaggcggaggggtggccgggctgcgggcgacggccgcggtgccggggaggacacaagcgcagcatggggtggaccggagaggtggcgcgacgcggccggaggcagcaaaagcggtgccagcctcgggcttgcggtggaggtgatgattcggcggtggatcgaaggagcggtatggtggccgggcttgcccgcgcgacggcgaagctagcggtggcggcgacgcggcgcggtgacggctagagcggcgagaggcggcggctggaggcggtacaggcggcggtggctcggcctcgcggtgggacggcgtttcgggggtggaagagggaagggaaatggatgccggggtgaagcgtggggcggcgatgccgatggtggtgacggcgcagtgcggcgatggcgagagcggcggctagaggaggccggagctcgccggagagtggcgacggctcggttttgcgt

SEQ ID NO: 38605 - DNA, 22780 bp, Oryza sativa
atttgggccgagcccgaaagggaggaaggggaagattattttcttttctttttatttaaattgattaaatgaactttgtattattataattatttcttgagctccgaaaattcgcggaaaaatccggagagtattttagggcacaaagaatattacaaaatattctcggccaatgatttttaaaggaaaatttcaaattctcccattatttcacttgattgaattgacttaacttttatttaatttctagaaaatgcattatttaatgatttttaatcccgaacgaaaatcggggcgttacacattcccttcatcccttccttaataacccatccgttgttctccatgttgatagcgcaacgacccaattcccttttctctttctctctctctccctacgttcttccatgatatgttgtatcgtggtgattagatcaacaaaactaaccatatatgtaccagcaatgatatatgtgggtatcaactccgatacttatggaacaatactctaatagtaccacacattatacttgtaagggcagtaacagtgcaaggcacgcatagcgcgcttctagcccatttgtgcgataaaattggcccgaaggccagtaggccacacaccccacagtgctcgtgacccacaatacgctatcaagtcggaactcccagtcgaacgaaaacagagttaattttccccacctgccccttcatgcttatcctctacacagaaaaaaatcccgtcacttctccccatctccgcgccgctcccccgccccacccacccccctccgctaaaaaaaatccgcagcttctcctcctcattcaccacaccacgcgcttctcctcccagatctgccgcttctctccccaaatttgacacttctcctcccaaatccaccgcaccgtttctcccaatctgcgccacttctcctcgcccatccactgcaccgcttctcccccaaatccaagcgcgggaggcaagaatcggtggggtgggagggtgattttggggattcacttttcggggcggcgcgaggaagcgacgaatcggagcgacgacctccacgttgcaggggcggagggggtttcttgcgctgcgcgccctcgttgcaacgaagaaactcgtctcccagataaggggcgagcggctaagcagaggcgcgagcctcgtcgacacgtaagcgagtccaatatggcaggtgaaggtaacatgccatgtacacgcactgggaagggcctaaaggggctagcaataatacgtgagtactagggattgatgaaccatggtgaagactccaataaggtacaaaggtggaattttggaaatgatggcgccgacaaggtaccacctacccaaactcccaaaacgactgaggctgtgtttagatctaggggtaaaagtttttgtcgtgtcacatcggatatacggacacacatttgaagtattaaacatagtctaataacaaaacaaattacagaatccgtctgtaaactatgagacgaatttattaagtctaattaatccgtcattagtaaatatttactgtagcactacattgtcaaatcatggagcaattaggcttaaaagatttgtctcgcaaattaatcgcaatatgtgcaattagttattttttagcctatatttaatatttcatgcaggtgttcaaatgttcgatgtgatatggtgaaaatttttggagtgggacctaacaaggcctgagctgataaagtatcgaggtaacatcgtggatgaggctatgccaacaagataccaaggatgaattgagagggcaacaacgtcgacaaggtatcacatacttgaaccatggatacttgattgggacgaagacacgaggatctggtatgcatgctcgtggcagatgaggcaaagtaaaggtgtctcaaggaagccgcgaatacggatcgatctcctataatttataccatcccaaaattgatatgccttacattagcagttcttaaaataaaccgaacacaaaagacagaaacatatatattcatccaaatatttggacacgatatgaaacaaacatgaacatttacatgatactaatttgagaacatctctgttttatactgtgcagtgatttttttccccgatggttggtgcgaagcaatttttctcaaaaggaaatgaaacgattgaaagctttccttcctgacgcgtgtggcacgattttatccgccggtttattttcccaggaaagaattcaacatttcaacttctggaggactccgaccgccgtgcctcttcatcgtcggtgccctaggttctccacgcccattgcccattactaatccggcactgctagctcaggtatacgccacgaaacccactcctacgccaaggtatccaccactcgcgcgcggcgcgcgcacgctcgccggcgacggcagcgcggggtgctccttgtgttgggcgcgctcggcgaaggtgtggcggtgtggcgcatggaggttcagcgggagaccgggcgttcctggcacacgcggccgtgtttggcggagctcgcgcgcgctcatggcgttgtcatgggggtggttttctcgtgttcaggttcaggcacgaagggggcgccgcgtaactcgccgtgaaggtgttcgatcagatgcccctctcagggcgaaggtggctactctggcaacttatcaattcaactgtcgcaacaaacaactggttttttttttttacagaagatcgcataaattcttctggagaccaacctgtctactacttagatttgcattgtcgatgtttctacgactacgactcactgataacttttgctttttgaagttttgtgaagttgacacttcggcagatttgattaataacaagacaaatgcagctgttagaaggccacggttcatcagagttctgctccctggatccttcgcaaagatggtccacagatgcttgtatactactacatgttctgccgttctgaatttcgtagcgaattcttaacaagtttgcaaggacagtgccggtcaaattggccatggttttcagcctcgttggcaatttttggcacgttaagctgtattgaggatttgagatctactcttctttttaagagctattgagatctactttagggagtggcagaacagggtttgtgagggctcgtgatttttctgagggcaaacttctgctgctgttcagatacgaagatatcgtcaaatgctcgaccaaaaacagaagataattcagatgacgaactacctcaactctgaataaaatttggccgccttccttctttagcccggcgagaaaaaggatggaaagggcctgaatgacaggctatggaaggtaagcagttttcagagacctggtatttgagtcattgtccgtgaaaattggtcttgatcattgacaggattgtgcgttttatgacagagaaaaaagttgggaagtaggataagtcggaggaacagtgcagattgcactgcaagtctttgagatgagaatgacccaagagacaggccactgaaaagtatgatgttcatctgacctgaatacctgatggttttgaatcgattgacctggaatgatttctgctaacttttggaaccgtgcatatgattatgtttgattgtgcagagatgaagaagcggctttgaagttttgtggatcagtcaaaatgggaattgcgagaacggaactgcaagtcatgcaggagacaagaatccaaaaaaagccacattcaaagtctgatcacgatgagtgaagtgcttatgggcttagccacagatttgagcactccgtttcatgtaagacagcactatctgattccactgcttcttacacattgtattttttgatttgctgctaaagcctcatgcaataccatctcacaatgcaaaccaggacttgatgcatgcgcttccacgggcttcccacaagctgcacaatcacactaaaaacgaagagccatttcacaacatggaagaaggcgattttggtcacaggtatgtcagcacacctgctatcctttatatgttgttactgaacattcctgatctggaattagtttatgctaatgcttggtttctaatcttaaatggaaacctaacatattacatcaaatcaaatctcaaatgattattctggtagcaatacccatgtatagaaatctcaaatagaaacagctctcacatgatagcagctgacccaacttgtattagtactttgttgttgaattttcctatctggaaaatgaggatcaaggaattaccattttgtgccactgacatgtgtgggtcaggtgggtaaatcctagtttcaatctaaagggaggttatatgatcaaatttcacaacgtagaagtatgaaaagtaaacatgtgagatgtaacaaaagagcatgcctataactaaggttagttatggccaacatacccacaacccttctcaaccatctcaaagtttgccaagagttaatacataatgaagaagaaagaaaaggttcagcgcatcataacacacagatcacagagaccgaacagactaagtgcaaatataaacagatttgaccagcccacaaagtagatgagggtagcaccacaacctgagatgagcatcacctaagcataatataaagtcttttgaaagaaattaattgttattgctcaaagcatttatcttgtcctgcttcttagcctttccagacttccacacggagttgtgagaaacagtttcctcgacaatctttggtgttgtaaagctgaagctttcaactgaaaagcgatctttgtactgcgggttggcctcaaggaacttatccacctctgcagtgcatcttacacgcttcccatttggcatgacatagtaggtatccattttagacaaatcacctctcataatcactagtctctcagttcctgctggaggctttggtatgttaggcttgtcaaggacccatatacggctgctatcatattcgatgtcagcagggtcttcacacgagcagtcaggtcttctactgcagtgccatggctcctcagtgaaattctcacgaattgtctcaaattcatccttcgtcggaaccttgcgccatttgtgacactcacaacattgaactgcatacatgccaatggagtctgtggaggagcctcgttttctctattgaaataagaacgttaccattcattactattgtatatcaagcaaaataatttttctgatcctaaaatatgcatttggaatgtaaattttaattctatcaggcacaaactaatggaaaatggatgttaatgacatgatgtatacttctagtggataggataacagaacaacttcccaacgcacaaatagaaataataaagaccgctacattgtttttttctttacagtccataaaagctgcttcttagaagttggaagttatattttgcatagagtccatatggtaaggccacttttggtataatgcagatgccatgtagtataaggcacacttatgtttggctgcacaaaagcaaccatagaaaaagattctgcattcagtttttagaaggggcagaaatttaaaaaaatcgcgcagcattttgtgaagaaatctaaaattgtttcatagacccagtgatgtgaagaaatggttcagacagctctaagtagaaaagtcctcattttcctctttctcttataaccctctacagtctccattccctgcagccccccttcgctaatgtataaaatgtcatcagaacttaagaactgcaaaagtattaaatagtgtaatacattaactcttatgttctcaatctaaagtatatgcattttttgttattggacggattccattatccttcatgcttctaaattcctcttggatctcaaacaaaattttgagaaaccaatgcaagctgatcttttttatttctttacagcccataaactcccgttgctgacaaacaaacttcaggcttcatgtattcacagcagtacaaagcaacacgcctacaatttctatccaaaatggcacaatttcagctcatcagattaagttaaggctctaaatcgatccttccctcacctgttcttggcattgacgatactatttgattaaagatttcatcctacggaataacctagtggaataaccaaacccctattctgaactctgaaaccgcatccacgcatatagtcgcaacatgcaggcgccaccatttggcacaatttctcaagccaaacaaccagatgaaaccaacaaccgagcatgctatggccaccaccagatacaccaaaccggatcggggattcggaggaacagaccaaagaagctgcggggggaaataccagtacgaggaaacgtagatggcgacgtacgatcgaggaggcgaaagggcgagaggcggacctgtgtggagggcgccgaggggggcgagaccggtgacggggatgaggccatactcgacggtggggcggttggccgcccgtcgtcgtcggcggcggcggaggttgggcggagcggtcgcgaggcgaggagaggaagcctcgggccgcgttgctgggccggtgtgtggggggcggaaacgaggacggacagcgggagtgaatcccgagagtagagggacggcacggcaaagcgggccttttcacggggatagaccgacagggttttgacccttgcgggatgcgggccttgcccagccatccaaacggcatcacacggcaatcatatcaccggcacacatacggtgatgtgcagtgtgcacctaccttggaggttgtgttcgggacactttcccaactttactctcattttacacacacgcttcctaaactgtgaaaaatatgttttttcaaaaaaaaaatacaaaagttactttaaaagttatattaattcacttttaaatttttttaagctaatatttaattaattatcgttaatatgtatagttattaaaatagggacctacaacgagaagttccggatacatgcgaaacaaagcatatgtagaaaatatccaaaatcaccacatgaaaatagctccagaactttgcaggattcgacatgaggtagaatgaaaaggttcaacacacaaaagcacatgtagtgcaaaacataacataacttctggaggtaaacaaggaaggagaagtataggtttttaaggtggctgctccatattgtcttaagtttttggcatcacctaaagtaacgcgtatgtagattcagaggtcacaatggtaactacttgctgctggaacttggaacttcttttgcgtctagttgcatacactgctcttccctctcagacttcgccatcacccactttgcactatcggaaacagtctccttaactatcttaggtgttgagaagttgaagctcgaaagtggtaaagtagcagcatactctgggttttccttcagaaacctatctatatcaggtttgccctttgcacgcttcccatttggcaagacataataggcatccattttagatagatcattcctcatgatcagtagcctctctgtcttcggcggaggcttagggatgttgggcctatcaatggcccaaatacggctggtgtcatactggatatcttcagggtgctcacatgagcagtcgcgctttttgctgcagaaccatggcttcgcggggtagttctcacggattacctcgaactcttcttttgttggaatcgtacgccatttctcgcatttgcagcatgtgatggcgtacatggtaatgaaacctggtttcccctgtcaaatataaatttattgttgttgtcaataatatcatgcaagacataattggaacatcttcagtaaacattgaaaacatgaaatttaagtactttaaataaacaaagggatgctagttacaaatatgtgtgcttctatgaaataaagtaaccaaatatcttcacaattctacaagcaaatataaaaaatccaacattttgttcaaaactactccaggaaaaaatatttgacattgggaaaactaaactattaagtttgactggaaggagaacttagaagaaaaatattagttatatttcagaaaagaaaattgaagtagaacataaagtttatgatgtatatggaagctatccagggaaacctagtagagaataatttgttgaaatagtgcattttcttccttgcaataactctcctcaatcaaagatataagtataaatagggtgttcaattctatattgttgttatacagtatatcacggctcctagagaaccccctccccccccctcttatgtagctaatacatcatagctaatatatgtacgcacgcgcgtgcgtgtgtgtttgtgtgtgtcggtcttataatataaggtatttcgcccatgtaaccatggtagggttctaggatatgacactcaaaacattttacgacacgatttgccgctcgctatgtctcactgacacaagtaagttgtgctaccaatgaagaacgtgcatatcataggactaatgccaagagggacctcataaaaaatccctatcatggccactctgcctcctatgatttggataagttacatgttaaggaagtgatgattattagttgacatgaatgatcagaacagacggcatcaacactcttgatctgtgtcacctggacatggaaacttgttctgaattcgagtcggatttgtaatgtcataccccctatcacatagaagaaattatacatggaaatactacttggaattcgaaagggagttagaatccaaatccggctaaggacatggacacatgttaagaattggactcaaatttctcatgtcctatcccataaaagaaattttataaggggaaatactacttagagtttgaaagagggtcggaatccaaatcggacttagggtgtctgattcaagaaaggaaaaaggcgtggatgtatgaataacactacacacatcactaatccatgagagcgaaagcgaaacaaagtagaaattaaaaatcagatcacataattacctcaagagccatgatggtcacctctagggtcaggagggcagattgataaggtgggggaaagtgatggctgatgatagtttggagtactttctagaggttctcagtatttatagagatcgctggggcaagattttcatactatagacaaaataatatgctttgtttgcaacaacgtaaccatttcacgtcacgaaaaataaaaagtatggtggtatttgaggtgcttctaaggattcgctggtatttcttaaacggttttgctggtattacatttgagaggtttagctgctattacctgtgaattcatttgtttttttaaagcataatcgtattcgaaaactatgtgcgaaggctctagacagttttccaagttttcttttttttttccttctccatcgaatatgacaaattcacctactcccttcgtcctagatttagatttttttttatcttggatggagtatgtgacataaaaccctaaatttggcacctaaagcgaaaataggaaaatatagccaaatttgaaaaggacctagcttgctacgcgcgacaagtctgactatcgtcatagagccggtcagacagacagtgtggggccggtctaactgacggcatgtggccagatagactggcagagtctgactccgtgcctgattttgtcgtttctcaagttcccttgcttgggctaaggttttctttagtcctatttggtttgtacacctagtgggacgtggagagatacctatggaaggcaagaccaaccccaaaataagagccaactacaagaaaaatgctttgtggagacactttttaaatgtttttacaatactgtagaggcattttaaaataaaatacctaagaagtgttttatggtgaattgtgtctacaaacaagacattttataaaatgtctataagttggtagaggcacttatagtgaattgtctctacaagcaacgagacattttataaaatgtctataagatggtagaggcatgtactagagatacttatggtgaattgtctgtgtaaacaaagaggcattttataaaatgtctacaagatggtggagacatttttcacaacaaacaatgggaattttataaaatgtctataagtcggtagaggtattttccagaggcacttatggtgaattgtctttacaaacaaagaggcattttacaaaatgtctataagatagtagaggcatttttcaccacaaataagaggtattttataaaatgtccataagttggtagaggcattctatagagacacttatggtgaattgtctctacaaacaaagagacattttataaaatatataagatggtagaggcatttttcaccacagacaagaggtattttataaattgtctataagttggtagaggcgttttctatagacacttatggtgaattgtctctacaaacaaagaggtattttataaaatatctataagatggtagaggcattttctagtgacacttacggtgaattgtctgtacaaacaaagaggtattttataaaatatctataaaatggtatgggcattttctagagacattaaattattaaattataccacaaccatatgaaacgcaaagagacattttataaaatgtctataaaatggtagaggcattaaattattaaattgtaccacaaccctatgaaaccaatgtaaaaaaggagtaaaatatttttcccttgctattgcaaatccttgagctcaagatctcttggacaaatcatttttatcttcaatgcactagcgaactcaaccttatgtcgttacttgtatgtttgtgctttgagttatttatatttagttcttcagtttacattatcattctaaaaagtaagtgtttgtacaaagtttaaaatatctcaagaaatgcatttacatatcaggtacattttaaagtgtcgaaagaatacttctacaagatataatttaataaaatgtgctgaaaatatctctaaagtgtctctaaagtaaaagttttctacgcaattttcaaagtgtctgtgtaaagtgtctctacactacaaaacaccagatcttagaggcaatttgcagaacacctctacaaaagtgtctttatatgaggtttttgttgtagtcgccatggccagttcaattgaggcacacaatctacaacagcgcaattagccaattgaatcgttctttcaatatcacatatactttttgcctagttttcagcctagttcatccatcttcgttggtttgctttgaaagttgtccgtcttcgtcgcgagagtgcgagtcatctgtgtaggtttgtccctaaaacattcggttccgcccacaagacgggtgtttatccctatttgtctaaatcggctccgttagttgcttttgatctataaacccatcttgatcaggggcttctcaagatcaaggtggttggagactccatacgctgcaaaactttaggtggattccgatcgtgttgtggcgtgactaaaaaggtgtcaacaactagttgtacgcttgtctggtttttatctggcaacgtcatgccttaagcgatgtgcaaaggtccagtgtccagtcggtcttccttttttacactaggtaagtaagaattggcctattcatgtggcattggttggcattcgttgtccatttgtatggctttattggaaagtgcttagatgttgtagtcttgtaggggaaaggtggagttagttttcctcttttgtattgctagtaatcgtgcacatgcgatgcatgtttcgcgatatatatccgagaaatcaaagtttggtgaccatatttagaaacaacaagtaaaaatccagttgagatcttttaggccacatcgatcggcgaatagccctcgcgtcgccctcccccgggcggctcgggaggcgacgcgcgcgccgccgctttcctcctccccccgccccctcctccacctcgccgccgcccgagcgggtgccggcaaagccgcggagccgcaaggacggcggcggcggggtctcgcctcgcccttcccacgctcggcggctggcggagctgtccggggcggcggtggtggtggccagatccgcgccgtttccggccagatctgaagggggggtggccggcggcggggactgacggtgacggtggcgacgacggcggcggaccacggcgactgaaggcaacgtcggcggcggaccgcggcgcgtccaggccacctgtagacccccgtttttataacaggaatcattcgtgtaaacagtaccatttccctggatcaagtagtctggtacacacgagttcatagctgaaataccaaaagcacatacacgagagtctagtgctaattattacatcataagcccgcaggcattgtcttaaatcatcggaccgagcggtccggaatacatccaaaagcagaaatagataaggcagcggaattcaggcagcggcatgccattgccacaggcaacgaccgtactaagacctactgagcgccatcgtcttcatctccctcctggtagtaggcatagggatcctctgaagcttcatctcccgcttctgattaattttatatttgcaagggtgagtaccaaccgtactcagcaagccatcacagcaacaatgcacatgataggtgtatttaaaggatggctatggttcctttgcacaaagccagttttgtaattcttttcacaagcctaagatctagcacagactgatcaaattttagtaccagtgttcatattaaacaatgacggttctgtccaccatccattgtgatcccaagaatagcttcccgccattgagtcgttatggttttctgaggacgtccacattcccgcctctcaggaagtggctccatcagcataaaaaaaatcatcatgcaatatcccatcccacacaagttaaagaatttaaagtctagccaagtgtaatacatgtcccggtgctcaataaccgcgagcacgactattcgaatagatttggtttactcacactgcagtggatgcacactttacccgcactccgcgactgcccaacacatgagcctcgtcccaacacatgagacgcgtcacggcaaagcttttcgataacctcgcattggcagtacccgctccatgaacttaaatcctcatgcaatctaggcgtccatgtttctagcagtgagaggagttctggcgctcccgggaaagagaagtctcacacacatattaaattatggttcaagttaagttctctctcacacacactcatggtagtcctaccaatggcgacaccgatgtagggcacgcctctcggccctacctcaacggctgtcccaccgtagcgcacctgcctcactcaggggtgaaccatctatgcagggatactgcctccgctcggctatctaatccgctaggtctatacccatacgagaagtgcggttgtacgggggtcgtttcatgcttaacttcatggctcagtccttaattgaccggggacgatactagccttttccagataccacccaaatcctccgtccgccccagtcgaaaacagttgtttaattttatttctcctttcacaaattatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcatagttgactagggactcatacgtaaacatggttacaaagatttaagggtaaacaataatcaaggcatggcataatcacaagtaggatgttcatcattgcatgcaattttatttgtaaacaaaacaatttcgcaattgggatcaacatattcaaggaatagtgatgacttgccttgctcaaagtcttgggggtcttggccttcacttggatccgcaactccctcgggctctatagttacgtgcgaaaattgatttggattcgattagaattcaaataaaaatccaaataaatccaaatggaagtcgaacgcgaaagtcgattcttttgtattaactttactattcgcgtactagggcaaacccaatttcgattcaaactattttgcaggtataaatgttttgttctcataagtttttaatttaatctacccgagcattatatccatataataggttagagatttctatcgcgagctaaatatcggacgaaatcctagaaatattatatgatttaatttagtctatgactaaatgattaaatataatacacggctaaaatccctagtaattaaatccgaatttctaccgtgaatcgattacttatagggattacccaaaaataatctataataatctataagaattcctctatttgtttagttattaattacatctaaattactaccgcgaattgatttcttatagaaattaccaagaataatccataatttatattaaatttcgcaattctacgactataactaatctataactaaattctaattattttaaattttctaaacttccctaatctccctctaatttcctatttatttccttttcctttttctttcctttctttttctttcctttttctctttttccctcttttccttttcttttttttctctcctccctcccggcttctttctctcttcctcggcttctccctttctctctctctcggctccctgctacccggggtggcgacggcgaccgaggaaggggagaaggcggcggcttaccaacggcggtggcggcgacggcggcgcgacgatggcgcacggcgcacagcgcggcggcacgaaggcggcggtgcggcggcgcaagggcggcgcgacggcgacggcggcgcaaggcggcgacgcacggcgcggcggctccggggcgacggcgcggcggcttcgaaggtggcggcgcggcggcacgacaacggcggcgcgtggagaaggggaagagggagaggaagggggagatggagtggggaaaatggggagggggtggagttttataggggagaggaggggaaaagaaagggaagggaaggggcgacgcgacggcggcgcggggcgcgaggcggcgatgggacgcgcggcgacgggatgtcgacggcggcggcgacagcggtggcgcgcggctcggggcgggacgcgacgggcggcaacgcgacggtagtgcgacgcgacggcgacggggcgagacgacgggcgagcggcgatgggacgggcggcggctcggggcgcgaggcagcgcggcacggggcgcgtcgcggggcgacggggcggcgcgcggcgcggggcgcaaggccggctagggcggcgcggcagcgatagcgacggcgacaggcggcgatggcgacgtcggcgcggcggcaggcgatggcgcgacgggacggtgacggcgaccgcgcggcagcggcggcgcggggctcggggcatggccgggcgcgtggcagagaagggtctagggctagggaccgaaatcgaacacctatgaggcaatgaacagtgacttttcctatttatcccgattttagtgtattttccatataaatttgattccacaattcctaattttgcatatatgcattttactcaatatttgtcttatcttaactaatgaattcaccctagattaatattactcatattttatttttatataatttatttgagttttaattagggttaattcttattccatcgtatttaaatttaattgatccaaatatggtcgcgataatattttatttatttctatccacacctaatctttattttaatttgtatttattttaccaatttgtttttaaggtttattcctaattaactattctttactcacgattaataatcttcgagatcaaatccagataaaatagacgaataagatcggcatgatgcaattaatttaaaaagtttttgaaaatccgtatttttagagttttgattttgtcggtcgaattttcagggtgttacaccaccacaacagggacctctgccgtgccgtcatggttgtctcgctccagcctggtgctgagtggcgcgctccgtcccccggacccgcgccaccccggccggatctggatgggcggcggctgctagcggcgaccggtgatagtggcggctggcggcggcggctggtgatggtggcgtggagatgaccggcggaccacggcggctgacggccgtggtggtgatggctggcgatggtggcgccgtgcagcagacgacgcgtcgacgccagcggcagcatatgaaggcggggaaggagttgggcggcaggaaaggaggagaccgggagcgggcgtggcgtgggcggcggttgcgtgtagcggtgttgcatggctcgggagggctccggcgagctcggtggctatgcggagtcgaggcgggctccagcagggttgctcgctggtggtgagcctcctgctcgcgatgtgtggatgtggatgcgctgacgtgtttggtcacgtcgaggtatgattgcttgtgagacgtcacggtctattccatggtcgtcgacgtggggtgcttgtctgagtaatgtgaagacgctggcaaaagccttgccgtgcctttggccggttcgaccacgacgacgctcttgggcgccgttaaccttcttgaaggcgtcgtcatggcgttctttcatattccccacaaatctccgggtgaaaaccttgttccgatttcggacgagcagcgacgacgttacgcgtcgtgtcctccttgggggcgtcgcttcggagaagttcctatgcatcaacgaccgtggatggtctttttcggttctaaagctttcataccttgacgttcggcgaggccttcgcctccttgggtccgcttcgttcttgtggtgggcgacaggctcttcggttgcttctgctgatgaagtcggagctgctcgctgatggggtgcggcgatgcttggcaacgatgacaagttgtagtctcttccaaggagttggtgctgaccgtgtgaaggaagtgtctctttggtggcttggctgatgtccattgttggatgtcggagctgcttttcgctctggcgactttcgcggattcagtgtcgctgcggttgtgaagtcggcgctgctgggtcgtttgggcagctagctcggcaacgataacacctcttctgtgatgttggagctgtttgggccacttttgtgttttagcttggcaatggtgttctacatttggactccgctgttgtttgctagttgtgtagctagatctcttgctttcttctgtgtggtgggttttagccggtttcccgtaattaaccgtgcagttgtatggttttcgggtccggtttttcttataaactgggtcaattctcttcttctaaatataaaagtgaaacaaagttccgccttaggtttcaaaaaaaaatccagttgagacaatacttcaataaaaaaaaactccaaaatgcatataacaatggccttctttccaagaaagaaacaaagagccaacaatgtggaatcaacagaggcgatagaaagaggaattggcagctttgcccgtctagtttggtcttatatcttatccgtgcctacacctgcaacctttgagttctgcatgccatgcacatcggtgccacttcggagttttgcatgctattgctctgcagcatttgttactgatcagtccatcactcgatcactcgcccaccacaccccactgccaatgcagggaagagaaaaagtgcatgataagtgcctactccatctgtcccgaaataaacggatttctaaaatgccatacaaatttagggcccctttgaatcgtagggtagaaaaaacggaggaataggaaaaacacatgattctgacaggaattgaagtataaaacagaggattgcaaaacacaggaaaaacacaggaatggtcgtttgattggagcgcataaaaaacgcaaggatcggatgagagagatagactcaaaggaaattttccaataggttagagctcttgctaaatttcctccaaaatccacatgcaagatgccattccataggaatttcataggatttggaaagcttcaatcctttaaatcaaagagacaaataggaaaatttcctataggatttgaatcctatgaaattcctatataaatcctttgattcaaaggggccctaagtagtgagagaaaattactaaaagtgttctaggtagtattagtgactggtgagtgggcaggtaagaggtggtgagtgtgccagtaagaggtattactgggataaaacccttttagatgatggtaggttataagaggaaaaaaattgatttattttgaaacaaagtttgaactctaggtgagtaggaagttgcaagtttaatggggatgggtcaaagcactctacagagaagtctgtagtatatgtggtacgtacgatcactgaagggagaaagttccatgggtgggtccaccttttttttttaaaaaaaaacaagaatacagtcttgaactgatctctctataaaggggacacaccagcagcaaacacgtacaatcctttgaaattcctatggaatggacaatcctatggagattttggaggaaacttagcaagagctcaaagctcttggaaaatttccttttaagtctatttctctcatatgattcctacgtttttcctacggtccaattaaacggtcatttctgtgtttttcctgtgttatttcaatcctctgttttacacttccattcctgttacaatcttatgttttccctattccttcgtttttcattcctgtgattcaaaggggccctaaatttcctccaaaacttgtatgggaaaatgcattctataggaattttgtaagatttattccttttattcaaatggttatataggaaaaaaatcctataggaaggaaatccttttgaaattcctatgaatttcctttgaatcaaaggggccttaagagcctgtttggttggtgctctcacctccgtgcctgagaaatttgtaagcctgagtggcattcaagtttgtaatgtaggttgcctggtcaggcagcctgagcctgtgcttgtttggttgtcacttgtgcctgagaaaaaaattcaattagatgtttgattattatgccgctaagtcaagtattaatatccgacacaattttttgcatttaattgcatctgacctacaaccaaattcatctagcgcaacagatccctacacaaatcaatcataaagcaaacaaaggaaaaaataatctaaaaacaaggggaacaaacaagggaaaaaaggaaaaaaagaaagcaaagattgcacccagattgtaaagtcaatctgcttactcaaccacgggcggaagaaatccttgcctggcgacacgacggcggcgctactttgcgtagacaccaggatcaacaaggaaatcatcaagaagagaaaaaagagagaagaacaggagcaaagagatccccagatccatgtcgcatccatcagaatagaattgcaaaatccatgcatccatcatagaagagcatttgcatgtgaagcatgacgcagcactccggaggggtcttcgtgtggctgcgatggcttcgcacgacggcaacggcggcagcctcggcggctttgtgtggagttatcatggcggggatgaggggattatggtgctaatgtgtaacgcgctgctgcgcctggagcccaggcgaccaggctaattccgcgcctgagttacatcaggccaggcaaggtggaaggagcctcagggtagcaaccaaacactcacaaattagtctcaggcatgtcttcggccaggcaacttgttgtcagggcagcaaccaaacaagctctaagtgactcataggaattattccattggattggattcctctgcttttcctccaaaaattccttcaatcctaaggaccagccagtcagctagctttgattgaagtgtccttcctccttcaatgaagatggatgtgatctatctttgactcatgtcattcctctccagtatgaagatgatgatgatctagctttcaactcgtgattaattcaccaaggacacacacctgagcatctccattggatatgatcaatcaactgctggttttcaacaacttggcttactatgttgtaggatgaaatgctaccatttcacatttcaactcaggagaagagcgatcgaaagaagaagatgcagggacttggattataggtaatcaccacctttattcgattcttcgtcgtcatcgctgtttggtacattaccatggcagttcaagcgaaattttcagaaaactaccaccacataggcttacatgcgaacatgcatactacatacaacggcgcctttgacaggcagcagagtttccaccattccatggctatgtatttattattcttcaccaggtgcaccaacagcaggcgatctggttgccggtaaagagaagggcgtcatcatcagaggagcacctgagctgcagctagcctagcaattgggaccctgccaaagagagttaataacagttagtgattgttctgtgaatttatgagtagagttctcgattttcatcactcaaccgacctgaaaggcgaacaagaaacatagtccagcccagccttcgcaaagaaagcgactgacagaggctctccaccatgttcaccacagatgcccacctgtttacaaaaaaagaaaaacatttcaatataagaaaccatggattctatacaaggtgatgtcctcagctccagtgaaaggctaaccttcaagttaggcctagctttgcggcctctctctgtagccagcttaaccagctccccaactcccctctgatcaagcacctaatatattcatcaacaggtatgttacatgatagaaattggtcagattgcaccaaatcagaagtcaggactcgagagttgggaaaagaatatgcagatgagttgctcacatctgtaaatgttgggaaataggggtgtttatcaagggaggccattttggctgtacaaatttacctcaaaggggtcatgctggaggataccctgagacagatagatgggaaggaacttccccacatcatccctactgtaaccaaatgtcatctgtgttaggtcgtttgttccaaaggagaagaactcagcctgctctgctatctgtcaataaatgtgcagccaacacagcactgtcagcttataggtttaaagaaaacataaactcatcatttgaactttgaatatttttataatcattcactatttcaagatcaaaatatcctttagggtaatatccaagattctattactagccatgttgcatgtacagttctgtctacatgttgaatgacaataaccatactgaagattttcaaaaaagaagggagctatcagttgtttcttacctcatcagccactaaagctgccctgggaatttcaatcatagttccaactttgtagccaatagtttttcccatgtctgtgaacaccttgttggcaatttgacggataacatccacttgatgccccaattcctgtcacagcaaaatactcaaatgtcaattgtttgaaaaccaaccgaaaagaacaatgtaatcaaatatattagaacatcaaagaaggtaaatatgaagaaatggaatgaaccatttcccggatgaagtcaatgttccattcacacgtgatttaatacttgcatgattctagaaattggaattcatgtaaatataagttatcatctaaattgcagcaccttcacagacagtcaattacacaagtcaggtactatgaatgaaaagaagaaagcaaacacatacctgaggagttccaacaaggggaaccattatctccggaaagacttgaataccctggttggtcatggttatagcagcttcaaagatggcacgggcttgcatttcagtcaattcagggtatgatataccaagcctgaaattgagtggtcccagcattagtaaaggaaaatgatgcaaatgtagattgttgctgcaacctcaaataaagtaggacaataaccaagtaaatgctctggaaaaggaaagacctaattcaacactgaatagcaaagtgcaaaaaccaacctgcacccacggaaaccaagcattggatttacttcggaaagtttttctactcttgcaaggacatcatcctgagctgctccagtttcagagcatagctcacgcaccatatcctcaacatggccttctggaaggaactcatgaagtggaggatccaagagtctaatagttaccggaagccctggaatgcaacaaaaaaccatttttaaacgcctgtatgaccaagcatgttgtgtgcaagatgcaatgaattaagactatgttgaatgaatcatacatccatcaatgtacccctttccataaaagaagaatcatagcagaatcgtgcccattaacttacatgatgcataatatgttaagataatataggcaatcttctaaaagtatattgcatcccttttgcaaatttataacgttgcatctacactagaacaatcaattaacttatatttaagaaagcaaaactgtttttgtttccttcaattaaacactagtgcatctaaattcattaagacatatatattattatggtaaaaatttcgcataccatccattgcacggaagatgccttcaaagtcagacctctgataaggcaaaaggcgatctagtgctttctgcctcagttcaagacttgaagccataatcatctgcctgacagccttaatcctctcgtctgaagcgaagaactatgaagagaagaaaaagagaagagggcatgaaattatctgcattgactagaagagaa

SEQ ID NO: 38606 - DNA, 10506 bp, Oryza sativa
acctagaacatggaacatactcacaataagcatttttgattgatgctggtgcaacagaactaggtagccttgaccttagtgagtaaataaaactaatgtccctttttcagctgacttcaacttgaaacatattttgcttaccttgagtttcctaacttcatccacccaagacatgaaagtttccaaatcaccactaagggctggtgggcagagtggctgcttgccaatgatcacttcaccagttgatccattcaacgatagccactcaccttcatgcagcgccttgtcttcaatcactacaatctgtagagacacagcaaattaagcaactatctgcagtataaaatggtaattgcaaactcgatgtgtgaaaggcagcctttgtacataagagaactcttaaatgtttgtgtggtgcaagaatctagtataatcaccttggacgcatcatttacacggacgcttgagcatcctgacacacaacatttgccccatccgcgcgcaacaacagcagcgtgagaggtcataccacctcttgctgtaagaattccaacagctgcatgcatgccaccaacatcctctgggctggtctctgtcctcacctttacattcataatggacaggaaaatgtcaagatacaccaaatgcaacgatgcaatgtggagttttcaagtgcagcttgaataaagctgtgataaatctattttttttcctataagcagctgtttaatattctaacatggacgaaacaaacaaatttgtcctagaaagacagatgatcaggacgtaccagaataacatctttcccttgggcatgccatgcttcagcatcctcggcagtgaatacaatttggcccacagcagccccaggtgatgcaggtaagcccgtggcaataactttgtctttataccctgatgggttctcaaactggttttcataacaaaagattaaaagtgagatatcaataactgccattaatttagttgtgaactgaaactcaagtacgcaatgtccaagacctgtgcagaaactagcaggcaacaaaattttaaaacaacagttaccaacatcaatacttgtgtgattatgtttgatatttgttagttatgataatagtattatactttactacacaagacgtaatgagataatctctgttgtttgctaaaactcattccaaataattcaaaatgctcagagttcaagtaacaaacactctacctattttgtggaaaaatataacataaagattttgatgttcagaattaaagcagacatgcgtatcaaatttcactaatagatcgcaaacacacatttaatctttgattattctagcttactattaagtattaactgatttattctaagcacgcaatcgatgtggtaacttctatgacatcaatacaccaacccaacaaaattgttctaaaagagcaacacggcattttgggataacagaggtattatgaaattgtacgtgtccatttatgtggtgcatgagtttatagaccattagagcctcttagttatacaatacctgaggatgaagaagctgatccaggtgacctggttctaccatcttaagtgctgtgcggcgctcaacaaggccctcgttaaccatgtctacagcaatctttacagcaccttttcctgtgcgctttcctgttctgcactgaagcatccaaagcctattttcctgaacagtaaattcaatatcctgcattatacatgaaaattaagttagtctcccaaaaaaaaataatggaggcacattacctagttgctaaaccaagagcatgatcaagacgtttcaaatcacttatttctgtgtgcaagctattggaggtaatgagatatcaccaagacaatgctcgagtatatgatcagacgatcgtgcttccttttaagtttcagtttgagggaaaagtaggacacttatgcctctagaactgccttaatcccattatctaataaggtattgatgcataaagcaaattagaatattgtaccatcatttctttatagtgactctccaaaattttgcagttctcaacgagctcttcataaggctccggcatgtggtccctcatagcatcaagatcctctggagttctgattccagcaaccacatcttcaccctgcagaagaaataatattgcattataagaaatcgttcgggtatatatgaattatcgccgcttgcataacccaatacgatcagcaggaaacatattgctcatacattgattcatacacacaaaccacaggtgtgcaacagttagcagctagatgcaaataggagcaacagggtgtgagccatacctgagcattcacaaggaattcgccgtaaagcttcttctctccagtgcttgggttcctagtgaagagcacacccgtgccagaggtgttccccatgtttccaaacaccatggtctgcacgtttacagcagtgcccttcagcccagtgatcttgtttatgcttctgtacttgattgctcttgggctatcccatgagttgaacacggccaacacggccagctgcagttgcttcttgggatctatggcaagcaaacaacacagtacattagcattcagacgccaaaagaaaaggctcagtttcatcaaaacactaattaatttcagatatcacgaagagtgaaactttatgggcataccagagggaaatggctctcccttagcttcaacatagacatccttgtactgtgccactagttctttgaggtcagtggcagtcaggtcagtgtcgttgtgcagccccttgactgctttcatggcttcgagcttctcctcgaacagtgcatgaggaatgtccatgacctggaaaagagagagaaaaaaattctaagaactgatctctgtagcattcaagaaccaggaagcattcatgacctgtaaccaatttttgggctgaataaaggcaaaattcccctctattgagtaacaactaacacccatcacaaattcacgattctgcggctcatccttgcgacatcctaccgaaaccctctggccttatcttaccagcgaatcgcggccaaggcaatcgaagctggtataggtctagcatccatgatgggctcaggcgcggtccgcagggcgctctcctccgcgccgccgtcgccgccgccgccgccgccgcggcggcgcttgtgatgagtcgaaccatggctgggattggtaggaggagggaggtggtcgagggctcgggacgcagtggagttcgaaccacttcgactccagcgaccggaccggtccggtccggtgcaaggtgaccgaccgaccggttgcgcaccccaagcaaagggcaaaagttgtgcagaccgccgagaccggtgtggtgaacggtgcgcttgaaaaatataataaaacttactgttttttactctaaattaaatttgctaaaaaagaataaaattaagaacattttttccaaaaaaaataagctttgatgaatataggtgaaaaaaaagtaattggttgtatgactggagtagcaaccaacttgtctttgaacttctaggaagacagatatttccatattgcagatgttatcaggtactatgttggaggaccctgtactgattaatttaattattacatgaaataggagtatatgtgagctgagctagtaaggagtgtcaaattgtactgctaaccacccatcgccttcaccagtcatcctttccaataaaattaaagaactatggtcaaaatacggcaatagtgccgtacaggtctcctaagaaaacatcttgtattctttgtacgaggagatcaaatattgacagcaagttccatgttaatcccttgctagcacataatcgcatatacgatcgagagggacatactatctcttgtttttttttccttttttttcttgacacaatactaaaatattctccttgtaacttttctaaagtcaaatactactaaaattattccctattttctaatagtaaaatagagccacaaaagaacaataagctttgggaagttggagtgactctagtgcggacaaattccccccacataggatgagacggaagaaccgggccccacccaacgcacaaaagtatgcgcatccgcagccaccaccgtcgcgtcgctgacgcagcataaataacttacccaccacgtcgatgcagccgtggcagtgttgacgcacacgaaagtagcagagaaaaagtaaaattaagctcgtgagctccgacgagctaggcagctagctgccgagtcagcgagccgggcgagtgtgatctgatgaggagtacgtaccacgttgccgaacatgtcgaggaaacggcggtaggagtcgtacgcgaagcggtcgccgctcttggccgccagtcccgccgccacctcgtcgttcagccccaggttcagcaccgtgtccatcatccccggcatcgacacctgcacacacacgcacgcacggatcgatcagcaacggagatcaatcgatctgtcacatcgccggcgtggcagagaggaagagagagagagagtaaatataagtaagtgatacgcacggcggcgccggagcggacggagaggaggagagggcgggcggggtcgccgaggcgcgccgccatgtactcctccacccactggagcccctcgacgatctcctcccacagccccgccggcagcgtcttccccgccgcctggtactgctggcacgcctccgtcgacaccgtgaaccccggcggcaccgacagcccgatgctcgccatctccgccaagttcgcccccttccctcccagctgtacacccccccccccccccaaccaaccaaaaccagtgtaaaaaacaatcaaaattccaagttcataacatcatcatctcgtatcaacagcgattatttttaccaggtccttcatggccttgttgccctcgctcttgcccttgccgaagtggaacaccctctgcacacgagcacattgagccggagccattagtgaccggtgcaagtgcagtgaggcactgaggctttgtgcaaagcgaagctggtgaagtgtggtgctcatggcggagaggccaagcccccctatttatagcacggtgtgtgacggtgtgacccaccgggagacgtcatcgcacgggcggctcatgcggggggaggaggaccagcccggcaaaaaattggttgggtaggtggatttttgtgttaaaaaaaggtctaataatgtaatgtaaaagtagtataaaaagtctaatactgcaatgtaaagtacagcatggatagcttcttctgtggatgtgaacaagaaatttgttagacgtgtggtgattaaaatgggagcttttttgagcttttaagtgtgagtgaattttggatacgcctgtatcaaaaccaggggaatatgtgcagtgcccacaagaaattagacgtgttatagataaaatgcaagctttgttagttttaagcgggaataaaattggacttgtctgtatcaaaaccaggggagtttgtgcagagcccatcgttaattagcactagagagaaattaacatgtacaggaggtgtgcacgaaattgagcagatcatgaaaatgtaaaatggttagtgtgacttataataggtcgaaaatgcaacgtaatgtgctccaacaaactagagaagagccaaatatctttacaccaaagttacttttgctcgtgtgagcaacgtacgcttcatcggttgtatgtttctggtgctcaccgcttaagcagtgtacatatgacatgggcacatagtaacactagtgttgacacaaacatttttgtccttaaaaaaagttggggtcaacaacaaattatgtcaccaaaggcatccaagaataccactaccacgcataatatcccagataaaactccaaaattggtttgatggtgttgttttgtttagcttcgaccactgcttttacggctcaaacttatcaccacaaaacacacgcatcaaggatcagtagcaatgtactggacagtaacgtatccattattctgattcactgttcattattgctcgagtgatctctcttagctcgatttgagccagtcacgccacttcatcactgatgtattctttatactcaaatttgttatataaatctttgcaaatgcaaatggaaaatcaactcgaaaaggaaagcactatacaataagtaccaggttgtcttgccaccacggaaactctctagaaattggtgtcgccaaattggcattcaaatattcagaaacaaataaagagagcttttgcagcagaaatggccaaataaaatggcgctgggcagtagcctttctgtttcctttgctcagcgattgcgttatgtacactgtctgatagcggtgcaggttcagttgagaaccaacacgtccagcccaaaataaagtagttgtgcatttacatcatttcatcatttgccacttgttgaggtgtttggtgccatgaacttcatgagactagggaaggggactaaaaggcttattaaagcaaaaaagcacaggccatataagccttgcttgcttgcattaggatggccccaaaaaagtgctaatctgtttttccttggagttttatcactctttatatgagaaaggtgtgtacaaactatagcatcgatccagctcacgtttgtcacaacatatctcacctagcctatcctagtaaaagatgctttgcgaaagatttgaagattgctttagttcattcaaatgtaaggttaaccatgtaatatgtttctaatttgaaataaatttggtgagttaaaaaaacagaaaataatcagggatcacatggccggtttgattaagctaaaaataatagttctgccggtgtgaacgcgcaaaattctccaagcaagcggacactttgggctacctgcaagagagataagacgagtccgaggcgagcacacgccatggccacgcacgacacggatagccacgtccgccgtggcaggatgggtttcccgacccgtcttgcttgtgccgttgtgcgtgtgactgcgcgtatcgcgggatggatttgcagctcagctacacgtctggtccgtccctgctggtcgccgtgaggatatgattctctactactcctgtaaccctcttgcgacagtgaacgatcgtttcgtgaccgtgacaccacattcgagcgtgccttttgggggaaaaggagttggcaattcgctgtgctgcaggtgcctcgtttttcagagtgacaggtagactatactacgccgcacatacttaggatcgtgttacacgtagtactcaacaggcaaatatcgtagataattgtgtcaccgaaaatatatccatggctagcatcggttgtccaattagtgataattcgtcaaatagcgtattagcgtataaaaaaattatggttaaaactttgagtgatgtttcggtgctctttattggtattgtactaccggtagaaatgtttggatagttcgttattaagagtaaattagtattttactaatatagtgattaggtaactttgtcatttatgttttttggtctagatggatatgtggtcatccattgcattgacatcgcttatattccatcaaaaagcaaagaaaaaaagagaaaaaaaggtttagtcattactaaataatgattataccccatcatacctattgttttacaataatgcccctccgtattaaatctgaatcacttcaattaaaagaaatcaacgattctgattgtttttgactatcagtagagagcgccgtagtagggctttaaaacttttataaatgtgcttttagtgatttaaatattaatgtaaaaatacaataaaatacctcaaaatcaactataaaagtaaattttaagatttaaattttggcatcggtatgttgtagggtaaaagatgcagtccatgtatgtataattttctcgacgaggagttgtgcttctcccaaaggccttgatgcaaacgtaaggtgaaaattgcgggcgtcgtcagagtatgtgcgtaggttgccgctcgtcaaacggcgacgatgaggctgctgctgggtgaggtcgtggaacaccgcgagacgacaagccggagccgagctagtgccgtgtgccgagaggcgccggccacctgcatctggtggcctttttgatagtacgttgttcagttctgccgcgcggccgggctggctcgacgcgtggccgcgcgcgacggcatcaccaccgttcacccactgcaccatcgatcaacgcgcgcccggcccggcgcggctgcgcgcaacgcatcgcgtcgcgtcgcggccccgcgcgcgcgtcatgggctttggacggacgcagcgcggaaggggaaaaaaagtggaaaacccgcgggcgcggaggctggtattccgcttccactccacggcggcggcgcagctagcgcacgcacgcgcgcgcacggcgttagcgcgacagggcaccgcgcggcgcggcacgtgcaaccgcacgagtgcgcgagccggcctcacgcagccacgctagctatagccgctatatcgtggcgcagcatgtgcgggtagtgaaaactaaagacgatcggcgcgacaaagaaagaagaaaaaatagcacaagcagtaaattcttttttttaagactcaaacacaaacagtaaattttttttaacgactaacacaagcagtaaattcgttctacgtagtagagctggaagatatgtcaacgacataggctgcgtttgagcgcaggagaaagagagaaagatagttttgtttttcgcgcgcacgttttctgaactactaaacggtgtgttttttataaaaaatttctatagaaaagttgctttaaataatcatattaatccatttttgaagtttaaaataattaatactcaattaatcatgtgttaatggctcacctcgttttacgtatcttcccaatcttctcaatccactccttctcaaacacacccataatctcttcttacaaatgaacaatgaaaaagacgcttgtttgttgaaaattaagctatcggatcatgtcaaaattttgccaaggggaaaatttccataagaaacgtgttgcatgtttttcattacctgggcaactccaagtgcacttctaggttagaagatggtaagggataggatcataggattatccattgcctcagccacagccagtttgcattgccacgtttgaaccacccatttccccccattattggaatttagtagtataactaaagcaaaatcaaactagactactttttatataaaaaaaatcaattgcctagccttttgtactcctaactcgtattgtttgctaatacctttttcctaagtcagcaggaaacctagagtaatcaaactttaacatttacttttacgaatttgctatatatttattgataaattttcctccaaaaaattaactgatgtaattacagtacattcgtagtgtaattacactgtaacttacatgtaacttgtatataactttcaaaaatctctcagtaacatgttatttcgataaaatagaggtcgtgggaacaaatcctttcacacatgtgtgtgctgtgatttttttcttcctcaccagaacaaatcttgtaatagatctaaccattcaaaattacatgaaacttacataaaagttacactgtagttacatgcaagttacagtgtaattacatacaagttacagtgtaatcacactacggttgtactataattatatctgtcaaatttttaggagaaaatttatcgacaaatgtataggtagtcccttacttttaaagcaacataaaaacgactaccttaattaaactaggtgggaggcccacgtaattatacggctaacacccatataaaattatctaaattggtttacacattatttttttagaaaaattgttagaattttaaaaaattgaaccttactatcatcgggttcctaattttatatttttttaaaagtcacaccaaccatcacctccttactcctttgtctgctcgatctgtcatgacttctttaaaaatcttgattaccttgtaatttttaagtttattatcttattgagttttgttttatagtttatagaagtcacatcaaacactatctatgtactctttacagcccgttcattgttccttctctttattctcactagtatttgaaaagctaaaccaattcattgttggattattcttttacatcctagaagtcatgtcagccgctgtgatcctaactatctgccacaactcttaatcattattaggattctaaaaatcaaatataatcattattggggctttgttttataatttttatattatatgtcccattagacgatatcatcctactcctttacggttcacctgctatctcttatttattgtcatttgccaccgttgtattttagatggaatgtttttcaatatttctttttaatttcaattttataaattatattcctacttaaacttaaattttattttctaattttggaatttattttattaattttgaat

SEQ ID NO: 38607 - DNA, 9345 bp, Oryza sativa
  unsure (1)..(9345): unsure at all n locations
agtatgggaggggtgcccaggaacttggtcaagaaaaatttttaagttataactcacatattttcatcatgtgtgcacccccctcaatacaaacttaggcacacgcatcaatttacacttgatctaaagtagagtaaattaagcaagatgtacgtccttcatttcgttctagctccgccactacgttgaaagtatatgatttataaataacaagtgtttattaatattaatatactctagataaatcttttgagctagcttagccagtttgttgatcgagtggctttttgattggtactagttcaattagaccgatacccacatcaagttagtggctactcggttattgtattttgcagcaaagttttacatgtcgtgtgactacataatttgaaggcatttttagaactagttaaatatatataaatagtcacacgtgtagattattcttagagaatattaatccatccatactttaatatgttagctaggcaggctatgtgatttgtaaaatggaaagtaatatatacttcgggcttgttaatattgataccatttcaaaccatattattttttagcagaattgctaaatatgtgcatccttttagtttattgtcaaactttagtaaatacataagaaatcctatcaaaattttaccaaattaccaaaatttagtaagatttattttgtttacaatctgaacaggtcctttcgttccaaaatataaatatttttaactatatatatggataattgtgtgtctaaattaatgcatgcagctaagagttactatattttagcggaggtactacgtgtttatcatcaaatacaggtgcagtgtggatgtgggcagcccgatcggcttcatcactacttgcccgattggggaggcctccatcatccacgctcgcctgacggctgctgccactgccagcccgccccgccgcccattaatgccctgcagctaccgacccacagcgaggccggccggcgatcgataaaaaggcgcaccggccagctagctaagctcatcctcctcttcctcctcctcctgctgctgctgtgtgcatgtctcccgcggagaaggcgaagaggagagccaagatgtggaggacggcggcgacggcggccgccgtgctgctcctggtggcggtgggcgccgcgcccgctgcctccggcgtggcggccggcggcgcgggccgcgccacggcggcggcggcggcggcggcggcggcggcgaagccgaggaggatcctggtggacacggacatggacaccgacgacctcttcgcgctgctctacctcctcaagcagaaccgctccgagttcgacgtcaaggtaatacgtgcgttaacgctgatggccatcgagttgcatactccatacgatactgcctgcgtctagctaatttgtttcatgaattttcccaaagatacgatcattttaccactaatcatcttcttattggaggtaataatagacatatgaagcgtttaatcactgtcaaaacagacggtctctcgctccagataattctggagtataccgtaaaaaatatccatacatagccttttttacaaaggcctctggctcaatctcttgaaaagacgatgacgatctcgatcatttcgatcgtatctattatctccccaactcggagtaaatggtccatctccggtggtgatatcgtcgcacgcgtgtggctctcctcctcacctacactgtcatttcatcattaagttggtaaataattaattaattaaacgttgacgtagacagcacaccctgcagagagagacgaccggcctttgaccagcgctgctcctacctgcatgtttcaacgccatttgtccacaggataagccgtcttgtcgatgctctctgcgttgcgtttgtgtgctgagtgatcgatcgatcgatgtgatgtgacacgggcgcttcttctttgcacgtacacaatgcgctgcgcgtgcgcgtgcgcaggccatcaccatcaacgccaacgagtggagcgacgccgggcacgccgtcaaccacctctacgacctcctccacatgatgggccgcgacgacatccccgtcggcgtcggcggcgacggcggcgtctccgactccggcgccctccggggccccgacgtcggcggctacctcccactcatcgaccaggtactacaaaactcatagtagtactgtgtgttgctgtgtgtcacttacctctgacggaccgtagagttctagctcgtcagagttgactatcattgtgtcgggtggagtcattgtgacggttctccacccgttaaatgtgactgatcctcaccagtgatcattagtttgtaaccaagcttaaacccgttaaagataagggtttggaacaggtgacctagtccggtgtagtgtgtccaagaaagctgcagatcgatgccagcgatgtgtgtactgcagggcacgtcgacggccggcggctgcaggtacaggcaggcggtcccggcggggcgcggcgggcggctggacgtcgacacgaactccggcgtgaggagggggttcctgccgcaggggcggcggcggtacaggccggtgacgcagccgacggcgcagcgggtgatggccgacacggtgtcgggggggcccaccaccgtgctcctcttcggggcgcacaccaacctggcgctcctgctcatgggcacccgcgcctggctcggaacatcgaccgcgtctacgtctccggcggcgccgtcagggcggcggaccccgccggcaacctgttcaccgccttcgccaccaacccgttcnnnnnnnnnnnnnnnnnnnnnnnnnncttcgctgcttatcaggtattcaggtcaccttaattgtatttgcaataataatgtagtatcaactgttcgctgcctctagcagcaataatataggtgtaaactgtttctttcccatggttaattttaattttgctgcatatgatccagcaattatctcgtgatttattgcattcaacaatgtggttaataagctacgacaggtagaggcaaccaaagataatttatgagtaaacttttgtattagtattattacagtttaaaagtaaggctggaaaatagatcacgatgaaaaaccataaaatcaactctgaaattcaaattttagttgtaggctgtagatgataagtcaacaagcagacgatgaaatgcatgaactttagctacttcagtgcatgtcttgacttcactgattatatcaatcgaaaaaaaaaagacttaactgattatattgagtaatagtgccgactctacgtttctatatcttcaggtcatacattccgggattccaatcacgatgattcctcttgatgcgaccaacacaatttcggtcaccgaggaattcgtttctgaattccaacagcatcagcaaacttacgaggcacagtactgtttccagtcacttgataaggtcttgatgaggctgaggggacgatccaacggccatggcaacacggcaagtccaaagctcaaatctcccttttctttcacaattgtaaaaaaaaacaacacaacttttatttggtaccgaaatttcgcctaaaaaaagtcccaatttctcatggtgttctttcattactcagagctactacatgtgggattcctttgctgctggtgtggctctctctagcatgcgcaatggcgaggttgatggtgaaaatgaattttctgagcttgaatatatgaacattacagtgataacttcaaacaaaccgtatggtaaacgtgacggctcgaacccctttttcgatggccgtgctactcctaaacttggcctgaaagagggtggagttcacagtggccatgttcagactggaataagagatagcttctgcctggtaccgggaagcaacagagggagatgcgaggtaatgtgcatgtgttattgaatgaaaaaaaaaaatcgtacttttcgagttgttgtaacaatgtatatattgatattgatcttatatccatttagttcactgagaatttgaaagtgaggaagttaaaatttcctgttgcgaacatctccatcgctatgttgttgattgaaaaatgttgttatacttttggaatgttctttaacaatatagatatgcttattagaaaaaaaaaagtatttatggatattgttcttatatccatttagttcactgataattagaaagtgagcaagttaaaatttcctgttctgaacatctccatcgctgatctcccagttgctatgatatgatctcacatttttaatactcaacatgcaaaattctgtctatgcatgagacaagatacattttgatatttttctgaaatcctcttaggatggatacactagagaagtgtctggtccagaaggagttcgggttcgtgttgcaacaagagcaaagcctaacacggataaaaatagttcactagaaaaggaattttccaagagcttcttagaggtaagcatgcatgtcattccttgctcatctttgagaaggttgaattcttatttttagggaatgacaaggttatgacatgaatattttcattgttttgtctaataaagttactgttattgacgaaattgcttcctgcaggtcttaaatcgtcccgaacaaactgggcttttcaacatcaatacgcagttcccatattatagagaagttctttacaagccggttttcagaaatgtgagcagggggaagccagtcatttttgacatggacatgagccctggagattttgtttccctaatatacctcttgaagacaccaatagaagtaatagatctaaaggtaaggaaacaaaaaaatgtatggcaaatgcattaagtgaacaaaatcatgttgtcatttctcatatgtacaacaatggattagcatttgttttgaatcattgttgacaacatcaagcaaaactcactgtcttaaaaattgttttaggctgttttggtcaatggcaatggctgggcaaatattgcgagcatcgatatcgtttacgacattctacatatgatgggccgcgacgacattccagtaggcctaggcaataccactgcattgggaattccaacccttggctgcaacaattcttatgctatcccccatggaagtggtggttttattgattcagatacactgtatggactagccaggtcactgccaagaagtcctagaaggtaaccttctgcttctgcagcatgctctgaatatatagtccacactaatctgtgggtacagtaaaggaactctctcataggaataattaattgaagattgtcctaaattttttttacattgttaattacacgatcagatatgctcctgaaagtttagatcacccagaagatcggcagcctttggctcttgaagtttggcaatctgtcaggaagcagcttgatccaggcgaaaagatcactgttcttactaatggacctctcaccaatatggccaacatttcactctctgacagggatgcaagttctgtaatagaggtcaattagttctcgatcttccaaaataagttttagtttgtgatgagttcatcagtggtcgtcaatctcaataaacaaccttttccaatgcagagagtctatgttgttggtggactcatcaaagatggaggcgatgagaatggaaatttgttcacggttccatcaaacaaacatgcagagtttaacatatttcttgatccactagctgcaaaaacagtcctggaatctgatctgaaaatcgcactcattcctcttacggcgcaacgaaaggctgcatcatttcgggctgtccttgcggctttggaagacatccagcatacccatgaatcaaaatttgtccatgaattgttgtcgttgctgcaagaacttcagatcaaacagaagctgtatcatcatttggtaattgactagtgactacaatccatctctatcttatttttttctcactttgataccgttttgtcacataacttctttgtgtaaattttcatgatatcaggacatatttctgggagaaattcttggagcagtttacatggttgaaggatcaggactgaaaccttcagtggaactcaagccagtaagtgttattgccaacacaaacaaaagcacggacgggcagattgtcatcagcaagaatagtgcaaagctggtaagggtattgagcgatttcgatggtgaaatatatagcaaacaattggcaaattctttagcaaacaagagacagtctgccgttattgggagttttgaagaacaaaaggcaatttggagcaggccggtaaatagttcagggaatataaaaaaacaaaagtgaacttttgtagtagcattagcgtgctaaaaaaatatattaaagattacatagcacaggtaataagaaagctgacatgataatgcttgaagtggctgaagaacgggtgtcactgggtgctgaagaatcgctccatgagtcgcgaagtaacctggagaattaatcatttatcttttttcttttgattacacaaaaaggaaaattatgtttctttctgaattttgtaccgtagttgagcattgatgtgaccagcaaatctgggatacgtttttcagtttgtgctctgaaccactgaatcattcaagcagtataaataattacagtctgaaattatttacctctgcggcaaatcaagccgtttttaccaaaagaatattcaatagagctacacttgtatgaaagggcactggtgctatttaatttatcttcttcaaagtggtttgattgactgatacatgcgaggaaagtttgctcttgttttcaactgcattttatctgtggttattagaaacattttgaatttaataaaaagaaaaacacattggctcttattccaatttttttcatttgtattacatatataaccataccttacagattctacattaacatcaagaataaattttaaaaactatacaccagaaatctgaaattagtagccactgaaatacaaaaagtaccaaacgtatttttctcataattcctgtaaaaaaacctggaccgcttttaattacaagaaatgttccagttttgacttttcaggattctagtgaatattgcgagtaattaggccctcaaagatggtgtataggtccttgttatctggaccaaatatttcgtcagccttccttagtgtatcctgtagggcatcacagaagcttcaataagcgccaaaagagaagaaaaacctaggacaaaaagggagatacagattcacatatagtagaacatacagtaagtgcagtttctatagttttatacctctctggtctgtttgtgtgagttcaactcctttacattggctagaaatgcactgaactgctcataagacaaacggtttctgcatgcacacaaaaatttaagtcaaaaggaatgtggaggttaactgtgcaccatgacggtttctgcatgcacacaaaaatttaagtcaaaaggaatgtggaggttaactgtgcaccatgactattgcaataaaaggttgcttttctggtggttaagcaacaagacagccataattttgtttttgcaatttatgaaaaaaggatcttcagggaccggggttaatacaattcctatagcgcaatattgtgtggttcttcaagtacattataatgtcaagctttttgggaaaaaaaaacacaacagggcagaccttaagcaactttacaagtggactaggagaaggtagggaattacaataactcctaagcaaatgttccatccttttctaaaggaaagttacacaacataaagggcacagctagaggtactctccaaagtcatgttcatctaaaaccacatacctgacttgacggaagaactcttttccatcaactcgtgttcgtcctggaaaacaaacgcgcaaacaataaacatagagaactactaaattcatggaaatgatcagcatgctcagtcagaaatcaaaccctaagctacactggagactggtaccagtctatctgaccaattaatccttttcatttgtcctaaaatgctggtgcttcaagcagattatctatttcagctctctactatcagtgcaacagaatggatggttaatggagtttgctagttcttcacaaaggtagactgactgtttggaatctagattgcattttgacattcattaattcataaaaagatattatcgatattttttgcatgcaaatactcaagagacttgatagaagcctttatcacatatggatggtcattgaatcatatgaccaggcaatttgttaggtttcctccttttatatatattataagttctaaattacgaaaacacagaactctattagcagaatactagccaattttcagtggtatattttgattgagtcagctttttgtccttgaagaatctcagcctcactaatttactcacaaaatttatattaatacatcctacatatgaaggttccttatttcacacaaaagtattagcaaattacaatgcaaacaagaacatagatatttagttcgagctagcacagctaacctgtgtgacttcctgcatcaaatggagatgtcactgaactatgaccagaataggccgaggacctgtcatcaaacaaattccttgatgtaattgaaattgaatgccgccttggaggtgatattgacgcgaaactccttggaggtgagtctgggggagtaacccttggtgtactgttgtacgatggcaaaaatacatgtggacggggtggcctgggtactgcaagtataaaaaggtgctttatgtaaattatcaccaaaaggagttgcacattgaacaacgtgaatcaactgagatggaatggaatgtaccatctggctcaacatgactactttcctctgagactgaacttgcggtttctgataattgtgacgatttggaaactggaaatgcagaatcttcatctgatagaaacagactgtcaaggttactctagtggttacatatggcacaatgcaaatcgatgcaattagcaaccaccaaattcctcccaaaatatttggagtacctccaacagatgttgcagaggagaaatttgaagtttcgctgacccttgccttaggagtagtgttctgcagcaaagtatttttaacaagaaaaatcacttccaatcaaaaagaattacaaataaaattagggcaaaagttccaaattccaatgctctagtcactgttgggttcttgaagtaaatacaacacaaacatgcaaacgcagagtcgtggataacttacagcaggatcttcatcttcctggagtgactgcataagcgtcttcttgaacacttccaactggacagcaaagcgaaaaacagatgacaaa

SEQ ID NO: 38608 - DNA, 1893 bp, Oryza sativa
cttctgcctatcttaaaattaatttttaaccttaaatttagagttagattttatagttttttccatcgaagtttatttttttttgcctttgcatttagatcgccaaaaacacgtatataaaagttttattcacaaattacttctcgtttgtaaatatacagtttggcttattccgcgaataagtgaaacgatggctccgatagtttgtcatctctattggttgcctacgcttgatatatactctccgtcctaaaataaaccaacattataatagaatatagcacatcctaatacaatgaatttgatcataccatatattcaaatttgttgtattaagatgcgtttacgagaatgacttattttgggacggaacgagtacttcctatatatcccataaaaacaaatatagtacagcacatcctactactataaaatctaattaggaataaaaagcaaacatgtatgtatgtgatataagataaaatagtagtatgtgttatatcccatgatggtttttttttaagaatagaggaggtaaaccttcaacgattttataagtgatatataaaaagtaaaataaaataatttgtggaaagaaacttttacatattgtgcaatatgcttagcgacttaaaagctagtattaaaaagaaactatgttgaaaatatattaaaactaactttaaattaaaatttgatagtggtttataagtcattgggtaagtgatgaggttttatctttcctagggcggctgtttagtttaactagtttgatttggtggagtgcattagtaaaatctcacgttccaaacatgcctaactctcaattacgagtgttctcggaactctaaactgatgtccccttggaaaaaaaaatggtgagtaatcccctggtgttattttcccatttgtacgcgttaatagtgttgatcaaaccttagcaaacaaaaaaacgcacatctgtagtactccagtagcagtagtagcattgatttttagcgtacgttggtacagtaccatctttttttcagatattggtacaatatccaatcgctttttcagtgagtgtagtacgttggtagtaccatccgcttagtagcattgattcagtgaatcagtgtacgttggtagtaccctccttcagatgttggtacctggtacaatatccaaacactgaatgcactttgatagtaccatcaaacgttcttcagtcaataccacaggcacgcaaatcgatgggagaagcaagggaaacaattaacatttcttcgtaaacggaaattctttactgaatgtttatacagttatgtcacattaatccttgctagattttctttttccttaatgaaacagaaaagactgtacaaataaacaaggaacattaacaggccttggcaggaagcagtcaacaaatatggctgccaaggaagttggaccgtccaatgttccagagacgtatttcacaaaacaaatggtcttttacagtatgtacaaagcaacggaaaaggggcagtgttgcggcaggcagcagcaacttctcgacaacaccaagctccccttaacgtggatccgtggattagttaatggcccggaaggaaggatcttgatctcaattcctgagtaaaacttctcacaaatggatatcgagcacaagcttcacctttctaatatgtaccaaatagtagattatcatctcagcaccaatttattccacgaaagcctaatggaaatccaccattttctaggtaatatcacgggcactgttttccattctctatgtaaaagcagagtatattattaggttcaacctgccaccagaaagaagagagataggtcagcacaacgcaaaaatatgcaacgccctcatagaacttgcatcacagacagtacctt

SEQ ID NO: 38609 - DNA, 5180 bp, Oryza sativa
attcctgcagcccttggaaatactgggtaaactccactgagttgtgagaatcagatgcttcattctgtccagaattgatgctcgtgagacacccatttgagatgtcagtcattgtaccattgcttactgaagaattgttggttatctgaggcctgaatgatacattacttgcaggtgatggtaatccatcatcaagagatccatccaagagggagtagctgctcaatggtctgatggttgaaggtaaagtgtccactgttgtgactgatgtggttgctccagttgctgttgaaacatggttcatgctctcattatctacattgtgaagggcagtaaaatttgccactttaggagattgaacagaattgcatttttccattggttgtaaatcattagtgataggttccaacaataactgcccctctaaaccattcatgttctgcattttcctcatatctgcaaaagaaaggcttttcaattaactatgacacataactgggatgaagtattacaaatgacatcatacgctcatatgcttaccactgtaaaatccagatatagggaaccccgccttggatccatgagcaccattatccttgtcgatgtatgtcaatgcattctgaaaccgtcctattgcaagattcctgaatctttgaatattgttaacttcgcatttgaatgaagtcacattaaaaatcataattagacatgcattggttcatttgcactaaaagaaaactatcaaaatattggacagctcaattctaaaataatcaagtataggcactagcatctgctacttcaaaaaaacatgtaataacaccgatgtatatggtaccaaactaccaaaccaaggttaaaaaaggctcaattaattgcaatactactagctagtatcataccaccttctattttacttctacacacaaatgacaattaattggaatcttaaaattatgtgatactgaaattctctcgttttcaaaaattttatacattcacattgcccgcaagaagtctatccatttcctaccagaagtttattacaatatacgcaatccccagatagatccactctcgcattatttcggcaactacttaggatcatgtaaatctgttccctcaaaacaactcacaagaatgacaacttttcaacatgtagcagccaccataatgtggccaaaaagaaatctttgccagaaagtgtggcaaatccagactagatttagccaagtctgcataacaatcatcaaccttagtccatatactttttgaaatttgacatttgcagaattagtccatgcacaccatgcacctgagacaatgatgtacccaaactataaaatacacattagaccatccagattcagaaacctgtctgttactgccagtgttcagttaaaccagtccagaatgggaaatgccatataatttagattttaagctgacttaaccagcttctgttttggggaaaatattatctaaaatgaatggcattgaaagcatatctttactacagataaaagaaacaaaaatttaccagccaaaatttgctgacattacctgtcactgaagttctgttcagaatagtggaactgcttgaatacagggagcaattccctcctccgaagttcaacctcatgcagaggcagcttctcaatctcaatctctcccccactagagctaagagattcccctgattttgcaggtggttgatctatcacatagaagaaaatctacacaaacatgaaaacaatattcaatattcattgcacacaactgagcacaacgttatctcaaaaaagaagaagaaagaagctgagcacaatgttgagacaaggaggcacaacctttgatttctgccaaatgggaatcctccatgaacttatctgtacctctgcatttgagaggtaccaacttgatctttctcgagatctcatcatctctttcccagaaataccatctgatggaacggaatctgaatgctcactatcacagtcagaagcatccattgccatcatactatttcgttgattatggaagactatgtttgcaatgttttcgtccctttctggccagtttgtcctacggcatacatcccaccactgagtcggttcagcagtaacatgcaactcatcatcttggatctgcaaggaaccaggcccaactattggactgctatcagaggattcagaacctgaaggcagtagttcatgttgaataacatggccagatggtgaatacaccaatagatgctccatggcattagcctttgatggaactggcaatgaaccttcatagttggaattgtggaaaacagcagtaacagcgccagatggtacagatagtttcccacttgcagaagcagccacattactaacagtatttagccaaccagaagaactgttttttatcctactgactacagaattagttacagttgaaggagctggatgaagctgatgatccataaggaatgatggctttgaccaccatggccttgattgacatggggcaaggggtagcccatcactgtgagaattctgtggcagcagactcgcatcaccgccaaaaggagacaatgtaaaaatatggcaagtacctcgggatgaaacaatagatatccactggctaaaatggctaaaagagatatcctggatgacctgcaagcagatgcaatataatcagaaataaacccaagataacaagtttaaattgaacttttattttcttttgaacatacagctgctgtcatgccacgatacagtttgtaaaggtggacatgagatgctgtccaatcatagcgtatagagcctgagctgttagctattacggttggcatgatcctgaaaacatttatgttatggccatgaacggaggctgtgaccaacagagttccactagggtcaaaacaaagagcagatatgggacttgtgtgagccctaaactgagatatgatttctttcgagataaaatccttgatgacaacctgcaagagttcaagaggattacactattaggaaacagaaatgtgagcatgtgacaaagtgaaggcttgctcaagcctcaactaaccattccagcattgtcagcttccagcggatgcacgctagagggaagtttgccagatcttctgccaggacttgatgacaagggggagccagaaccatctggcagaaattcttggcagtactttgacagtgtcttgtatcccatatcaccaagattaataataccagcagctatctgcttacttgattccattgcataccgagcaactaaacttccactactaggggaggtagatgggctaactcctggagatggtgtaaggttctgtggacttagacggcctgtgcttgataataaagggctattggaagcataagctaaccaccttgggccaacagccattgggccatacccaatatttatcccaggtgccccttgcaaaggatatgtcaagacactgaacttattctcaagggtcacagcatcaaagcagtatacctggaatgtagttaaaacatataagtacaccgaagtaaattaaaagcatgtactcctctatgtcatttaacaataaataagagcaccaagagaaacttacttgtgctgcaagagctacagctacaatccgggggctgcagcgaactatatatacggcagaccgaaatctcagaacatgtacatatgagtgagacttcaaagagtagaagcgaacaactgttggagtagaaatgcaatttccatttggagtttcactgctattatctctgatcagtgcacttaagcgaccaccttgaaccatacccgacccatttgtctcatcaccggcaacaaccagaagcatgggatgtgatgttctgaatccttcagtaccatcagagtaaactggtgtgggttgcatttgtaaaaatgtaactggaccatcacgttttgagaccaattcgcaaacatttgcagcatcctcaacatcaagcacttggaacccatttgaataaccaacaagcaaaacatgcttgaaagatgatggatgaagctctaatttatcaaatccagcccacaatacctgtttatataatgaagcatcaagactacggttatgttcaaatttgcataatatactagagctacatgtacacattggtttaaagaacagaagtaaatggttagtgaaaattaaattggttgcacaaacaataccactaaccggtcaacagaaaaaagaaaatgctcttctgatgaatacattccaaaatggaagcatagcacacggaaaactaaattggtctatttactaaatggaagcatagcacaatgagaactgaaccaaaataacaaaagcactatttactaattggtctcaaaaacacacatcagaaaagtatgatgtaataaagcagaaagtcagcttccaggctcccaacaaagttgagatatagttacaatagtgaaaccgtggcaaagaaagaaaattttgagttatggaacagaccaattgttttttggttcttgctttacttgaaaaatattgttttgcccaccatgtagataactagaatttcaaccattgttgaattggataagagtacccattcaactcccgcatgttgtagatttaccaattctgtatatccattttagctttatggtagtcaactggcctcctccaaatgtactacttgcgcacagaattttgaatctacaagaacataagatctaccacgcgggactaaatcacaacgtactaccgcaaaatgccgtgattgaagtccacgattgcaaccatattacatcaggactaaacttagctactcccacagctagcttcaatagtgagaaaaccaacatatatttgaatagttgggaggggcggggagggcagtagcgtgtgggaggagcggacctggtccttctcgtcctcggcctggggggcgatggaggcggcgacggaggcgccggccgagcgcaccgtggacgcgacggagccggcgttggacgacaccgtcttgaggcacgacgagatgatcctcagcgagctcggcagcagcccgttcctcccgcccttcccgcgcctcatccctcctcctcctcctccccactcctcccccagcacgagcaccgccgccccctccccaaactctataaccgcccctccttctccttcacctacaacc

SEQ ID NO: 38610 - DNA, 12949 bp, Oryza sativa
cccctcctcgcttcgctttgcttgcacacatcgtgtgccattgtgccctcacaccgtaggcttggaagacacgagtgcgaccgaggaaaaccggtggatggtccgggctaacatggtattggtagccgcggcgtttgcttgcttgcctggccgtgccaaagggggacttgcttgacaagctcggtacgtagattcagatccgttgcttcggcagagggttcgttcggttgaaagcttcagaaaagaccctaggccgtggcgagggtgtgtgctcatctttgggataatctagtttttaggtttttattaaatctgaaagtgatgtcactttatagatgactagagtttttacggtcatgccttgttgccccatttggttgagctcgacagtacgggttggagcaaaagaaaaagaaaggaatgccgtttggtacaaatcctagtgtcatggacaagaacaggctagcttgtgtgaaaagaataactagtattgctctatgctagtatcataatccaagatcttgtaaaaaaatatgtctttcatcctaaaatatacttcagtaactactactactactgtatgataccattaactttgtcttattcaaaaatattatgtaatataatttattttttgagttgttttatcatttaaaactttaagcatgatttatatcttatacattatataaaatttttaaataagacgaatggtcaaacatgttttcaaaagccaacagcgttatgtattgaaaaatggagggagtagattagatataactactacaaatatgagaacaatgcgtagctgagctagcagggagctatcgggaatacaggttttttcacagttttcttctctcttaaaactgaatgctaagctcctccttagtgttccaacaaaagtactatgaatctagataggggtatgtccatattcatagtattaggttgtgtctcagtatctcaacataagtactacaatctagataagagatatgtctagattcatattattagattgtctaatataggatggagggaatatcttagaccatgcatttgcatgggttgttgatattaaatgcattgaattaaatttctgctgaaaattatatgtgaataaaaagaaaatggttagacacagggctgttcggctgcccgagctgcggctgcaccgcagccggcacgaacagtgccgcactcactgtgcgcagccgcaactgttgctatcggcctgccgaacaggcccacagttgcgtacataaaaaaaacttagaagccgtagtccctaggtactccatacttagccaagcgagcacttcgtgcagtgtaaaataggagtatgattattaccctctggaatcctaaacatgggtaattcgcgtgtgtttgtaggattgttcagagctaaagctatgcggtcatagccttataatcacttttgctgaacaccaggttccggggcccagatcttgttttgccaactgttacatgttgacagtgagataatgaatgtgtttggttgctggtcatactttgccacaactaacgttagggcaaaaatgacaagaaatttgagtctatgacatatgggacatgttattgaaaaaagtatggcaaaccacaaatgtagcagtgaaccaaacacatacctaacaaactgtaacagccaaaagtgtggccatgaaccaaacaccctcgaagtgtgtgatctgtgttaagctatagttaatacagaatgtttagcattggaaatacattgatgatccttattaagcatggaagtgatctatggttcttgttttttatatgaggtggcttgatagatgttgaactttgttttaataattgtgtacaaatactagtagataacattgcatattgaaacatgatatcgatgtatgtgaaatggcatgtgcaaaatttatatgcatagatatagatatgaccaagaatagcccccccccccccccaaaaaaaaacacacacaaagggtgtcaaagatgagaaatgacgtgatttttgtggtggcttcttaatagcaatgacgaataaaattgagttatctagtgattaatgagaagcaatagcagcatatatctaataatgtaaattagatgattgtaatttgatgaagcataggagtgattcagtctcttgtcttatggttgatgtggtttaatgcatgttcaacttttggtttttaactatataggacatatatatcgatgagctatacccatatatagtatttgtagagtatgttgatcgttaaaactagggtatacatgagatcaaagtaaaagagatggaagacaaggattattgcacaagttcgagccctttaagtaatagcactatttctgttggtcaaagccggtgttgactttatatatcagtatcacgcgagtataatatttaggaaaaagtacatattaccagacattgttcaccttaaacttctaataccggacgaattaccctctcgacccaatccagagcggtttgtcctacgtggcgtatgcatggcaatccagtcagcatttactttaaataaaacggtgggacccccatgtcattagtcctcttcccctctttctctctctcgggggagcgtggatgagcagtgggtggcagcggcggcgacgtgcggggagcgttggaggaggcgggctacaccgacgagtccgtcgccctctcgagctccgcgccaacagcgacgaggcgacggaagcggcggcgttgctgatgctcccttccccggcgcgcgcagtggggagggcaaggcgagcggcagaaggcgctgaagaccccaagggcagcggcgggcgtggcgtctcgagctccctcggcttcttccttcttctttgtggccagcggcgggcgacgagtctaaggggtgggcaaggcggacggcacgcgtggtagggagtgcgaggcaagcggcgctgaggaccccgaggccgttgcgcctgctcactgtcggtcggagtcactaccgaggaccccgaggcccgaggcgtgcttggcgtctcgaacaccctcggcttcttccttcttctccgtggctggcacgcggtggggagtgtgaggtgggcagcgggcggcgctgaggaccctgaggccgccacatcgatgtcctccgccgcgcctgcgtccgctcgcctccaagtacagagagaaagaggacgaagccacccagccatggtacccgccgccgttcgccgctgactagtcccctctccccgctgcgcttgcttgctgtcgaccggagtcaccgccgcggcccgcactcgcgtccgctcgcctctaggctccaagcacagaaagggtggtttaatatgacatgtgggccttaattttcttttatttctttttgctaattggatttccatgtcagcgccacgcgtacgccacatagcacaaaacctctctagattgagttgagggggtaattcgtccggtattaaaagttcagggtgtacaatgtttgttttttttggtttagggggataattcggttgactgtgatagttcggaggggagaggtaattcgtactttttcctaatatttaagatgtcctagtatagtatcaatcggcttggcggcatggagccctcacacgtagtcaacagctagtgtggtcttctttctcgaatataaacttgacaaaattgaatgtctagaactatattgacttgtcttccgatggtgtgtccctcttctcttagagggtattgtatttatagagaagatcattttcctctcaaagtagaactctgagaaatagaacatgatacgaagtaaggataccttatcttttctgactagaactccaacaccttctattccgggaagataatttctttctttatccaccatattttcttaatcaaaggataccttctcgtataccattaggtctatggtatctccgtgtatcgtaaacccatgtataggcggtatgccttatccttacattgacaatatggatataaagttgtatcatgcttaaactctccattaccgtgctctcataatgcacccctaacaaatttttaaagagacataaaccaatagcatatccctgatcttacaagggtgtgtttgagagaaaataaaagaagagaaaaaaagagaaatacacaaaatgagatgagtcattaacacataattaattgagtaataattattttaaacttgaaaaatatattaatatgattttacatcaacttttctatagattttttttaaaaaaaatacatcgtttagtagttcgggaagtgtgcgcgtgaaaaaaaaacaagacaaatcttctccctagctttcatacgttgtcggatgcttctttaattcctattaaaaaacacttgtttaatattcgtggacaccaatacttttaaaacctggtcatcctcactccacctctagaccatcatacgtgaagggtgggtaacgatttgtttgagcttgttaccttaatgagttaacttagagtgttaatcttaacgagccaaaacgctagctcggctcgactgactatctagcttgttaatgagttctatctcatttacatcaacctttataattttgaattcacaattttatcatatgttaacgtactaataaatagaaattaataaaggaattactaaaatagtttccacgtaattagaagactatgctagttaatacaaactaaggatatagacatatgataacgttttgtagtaacgagctaactcattaaactcagcttcgcttggcttgttatgaatgcgagttcgagccgatccgaaccatgagctttgatgtttttccttcaccccaaccggtactccattaatttgataatataaaaatttaaactttataattattaagttatgcattgatatgaactattttcatctgaaccggtacacgattcatgcacagattttccagggtgtctaattagtacatagaagactagagttatcataactaatgactaataaatataatttatttttaatggactagatctaattagatttattggttataggatatctgttgatctctaagtgcaccctagattccatccatataatttgcaatcaatatacgtacataaacatacgtcgaaaaacattaaacttttttctatataaaaaaacatggagccttactatggttgacaagcctggccgctcaccacagttagtggcgaaccacgaagtacaacgtcccagctccgttgtgtggtcacctaaatttcgtcatcaattaataatgaagaggccgattagcctaacatggctgacccattatttcggcaacctcgcgacctgcatgcagccgatcgcacgatcgggtcagtagattagcacccgagcttaaaattcataaatcgcgacgcctccgccttcgctgttacggctgttcgttcggtaggtgcccccaccacatcaacgacaagtcgacagctgcgctgtgcaagccaaccccgcgaggctgcgaccgatgcgggggcaatacgctgccccgcaacgcgcgcgacgggcgcgcgcgcggcccagatcggtgggcatctcacatctgggcctcgctcgaggttgctgccggggcgcgcgcggcggtaggtgtgggaggaatttttttatttatacatttttttattaaaatatttaaaaaataattttttgttttgaaaatttacaaatctaatcacctgccgctctttggaagggcgacttttaaaaatcgctcttacagtgggtggcaagggatctaattgcaaaatttttatttgtgttcagaccctttccactagttttaattgcttaaaaactaataatgcttattcgatactccaaatgattttaaatagaaaagtgataaactataaagttatagatctcatcaagatctacaacttttatataaattttatctccatctaatatcgtttgaaatgtagatctgagattttttttaaatgtgttttatattttgtaacaaatatttggatatctaaaacagcttaaatgaaaaagttgttaactacgaagttgtagatctccttgagctctacaattttgatataaagttttatttcatctgaatttatataatataattttaaactgtaaaatcataaagctaacaaattgtgctggaaaatttgcatttaggtccaaagggcggcaagcgattagatttgtaaattttcgaaacaaaaaattatattttaaatattttaataaaaaatgtataaataaaaaaaattcggtgtggtagcccggtgctgtggatgtcatggtggtggactggtgggccggagggcgacgggcgcctctgcgctctgcggacggtgtggtcgcgggttgggagtcgggcgacgcggaacgagacggagcacgacgtcctccgcggccggactgcactgcacgtcgccgtattgtttttttccccttttttttacttcataagttcagttttcagtaagagcaactccaacaacatcttcaaatctcactctctagatgtgcatctagccagcttgacaaaaaaaaatggatagtcaattctgcctttcactccaacaacctctctattacagttctccactccacctgtgggtcccacgtgtcagtctccttaattatttttcacccttcttctccgcccctcctctctctcttcttctcctctcatctccgctggccaaacccatgcgacggtggaggcgttgtggagcccgcgcaacggagatgggaaggcggcgacgagggaggcggttggccggcgggagcagccggtgcggcgagggaggcaatcggctggcgggagcgacgcttgcggcggaggccggcggcaatgacgacgcggcggagggacggcgctggcggcgcgcagaaggacgacgcttgaggagatggcggacggagagagaaatgggtaggcccatgtgtggggcccacgattggcaaggcaattttggctggccatctttggccagcgaggggagctgtttagccagccggatggtcaagtcatctagttggcaaggttgttggagtgtgtttttcagccaaaattgctaaattttaacttgaagagtgagatagccactctcttggagatgctctaactagaatatacttagagtaataagtaccggatcctacattaaagcaagctgaaaatttcacattttggtccttttagaaaacttattatacgaatagacccctaaaaaaacttattctataaatgatccttttcgcgactccaatgtctttggcgccgtagtccaacatgacggtgccaatgatgttggcgccgctcccctagtctctcaggtgaaagttaagttacaaatgtgaaggggacatcgccaatatcattgacgccgaggaccaaattgtatttttttaaaaaaaaaatttgacctatttgtgaatgaaaaatatttacaaatgggttctcagcgccagcttcattagcatcgagaacttatttgtaaatatttttcatttacaaataggtccttttcaaatttttttataaactggtcctcggtgccaatgtcattgccgctgtcctccttcacatttgtgacttaactttcacctgggggcggaggggacgacgctaacttcattggcgccatcatgttggaccacggcgccaacgtcattggtgtcgtcatgttggaccacggtgccaacgacattggcaccgcgaaaaagattatttctagaataagtttttttaggagtctatttgtaggataagttttttaaaaacactaaaatgtgaaaaagccagtcagcggctaatttgttatcaaccttatatatattggctacttggctaggacgccatgtcgccaggaagaattcttttttctgtactgcttgcattattcaaaaccgtggtcaactagtcattcaaaatttagttaaaacagcaagcaactacaaatgacacgatgccatggaagaaaatagttgacctacacaaggaaataaacaaaagatattatcgcggaaaaatgaatagtcaagaatgacatgagttgctgggtagtttaggctctgttctttgtatagctagtactagtattattgtgggcacgtttttcaagcctttttgaaatacaaatttgtatgtatattttgttaggaaactataggcaaataaacgataaaaaacaatagattaatcacagaagatgcgagatttaacgtggaaaaccctcccaaagtaggagagaaaaaaccacgaacaccagccagcaaaatatcttctatatatcggggtgaggttacaacgccaaacggcggcttacaagaggtgtatatatatatgaggtggaaccctaaaagggataacaaagttggcctttattaagtgcaaataaatttggatcacaactcaacatatgtttcttaaacaaaactcaaataaatctatttttaaatttataatagttaatactaaattgtggctttctttggtaagcaaacatggaccatgtgtaactgcagtgcagttagtggactgtaatttcttctcagggccgcttatttcctgggctttttttatttgttgtgttatgggctgcttctttgtaggtcattcactttgggagtaagttcactagacgtccctcaactttacgtcgagtttgtttcacatccttccatctcttgccagacagaccgtaagagagggggtgggggtgggttggggggggggggggggaatgacgggggctctggcctctggctcacgatggtcgtcctaagcctcagggtcgcaatctcatcagagcaaaggtaaacggtgatggagcttgttgggcctttgaacaaaattttcggcacagctgtagttgccaaactcgaacgaattatgtagggatatttaactttttatcactttcaagatggcgatagctaagaatttacactccagtatatgatatatggatcattatgtgtctatgatgtttgggttcaataataaatactccatccgtttcagcttataagacgttttgactttagtcaaactcaaattattttaaatttgactaagtttatagataaatataataatattcataatactaaattaggtttatcaaatcaataattgaatatattttcataataaatttattttgggttgaaaatgttactacttttttctataaatttgatcaaattaaagcaaatttgatttttactaagtcaaaacagccttaaagtcaaaaccgctctattgctgcttataagagtagcaaatatagttaaatacctcagttatgtcacgcggttcagcactgggcattggcagcaaccgagggaaatcaaaagttccggcgtcgaagctgcgcggctcacggatctgcttatatctgcggcctctgctgtaaaaatactcagaaaactcggcgaatccacgagcagaagcgcgggcagaacgtgctaaacaatggtcgcctcacctcacctgctccaattgtcaacgccactccccttcttccgcccgagctcaagtcccaatccgagagagtcgatcagcggcagctagagcagagcgatggccgcgctgctgggcatcctcctcgcggccttcctcgccgccgccgccgtcctttttgcgctccgcctgctccactccttcctgtgggtcccgcgccgcctggagcgccggttccgccggcagggcatccggggcccgccgcgccgcccgctctccggcaacgccgccggctaccgcgacctgctcgccgccgcccagtccgcgccgctcgcgtccttccaccacgccgtcgtggcccgcgtcgcgccgcaccaccgcgagtggcccgagcggtacggccgcccgttcgtgttctggctcgggccccgcccgcggctggtggtctccgacccggaggtcgtgaaggccgtgctgaccgacaccacggggaccttcggaaaggctggccccggcggcaacaacccgctcgcgcggcagctcttcagcgaggggctggtggggctcaccggggaggcgtgggcgcgccaccgccgtgtgatcgcgccggcgttcaacatggagagggtcaaggtaagaaggtgtagattgtgttagaaaaacgtgtcattaatcgtgatgcttatacatcatgttggcaacttatcgatctcgataaattacaatggatagattctcaaacataagtccatatgtaattatgtcagccttgctaaaatgttcattactcatttcttatatgtaagttgtgtcatatgtgaactcagctactctccaaggctaggatcctgtatagaactgccaaatttgctttctaacttctttctacaattctactaactttgatctaaatttctatggatgtatttacaatggaatggaatttatccctttctttacaaatacgatgtgcttacgtattgatttattttggaaatgaaaccgttttcttatacttatttatttacgacgcttaaatggcactacctgtcaacctgtcatttgtaaatggtagttttttttttaaacgaatacgatgtgttgtagactgttatcttggcgaataaaccttccctttctacgggtaatattctgatgtgatcaatacttcaagagttgcaatatgaataatgcattaataaaatggtttcccactaagataaaatttttattcttttcaggcttggattccagaaataacatctatcacctcatccatgctggataaatgggaactacaagatgaagtacgcactgagtttgagattgatgtaaacaaagaattccacactttgattgcagatgtaatttcctgtgtggcatttggaagtagctatgaggaaggaaagcgagttttccaattgcaagaggagcagctaaaacttgttattcttgcaatgaggactgtgtatatccctggcttcaggtgaggtacctctgtctcttagcatgcttttcaaacaccatgattgagggagaaaattgcgacatctttctctaataggtttgtcccaactaagaagaaccagagaaggaagatcgtaaaccaggaaatccggaattcgttgcgcaaattgattgagatcaatggaaggaagtgtgaggattccaacaatttgcttgggatgatgttatccgctagtaaaattgacagtgaattcaaaatgggaattgaagaaataattgatgaatgcaagactttttactttgcggggaaagaaacaacagctaccttgttgacatgggcaactcttcttctagctttacatcaagaatggcaaaacaaggctcgcgatgaagtccttcaagtgtgcggcaagtatgagcacccaaaagcagaaaacctgagtgaacttaaaattgtgagtccatctattttatacttcttatgttatctcatttattgaatgcagcaagtaatactttgtttaatgtttgaatgcaaccaggtaaatatggtgttaaaagaaaccctgaggttgtatcctccggccgtgtttctcaataagatagccaaccgggatgtcaaactgggcaaacttgacattccggctggcacgcagctccagttgcctattcttgacattcatcatgatgttagcatatggggtgccgatgcagatgagtttgatccatcaaggtttgcagagggcaagagctatcaccttggcgcatacttccccttcgggattggccctaccatctgtgtcggccagaatcttgcaatggttgaagcaaaggtggcccttgcaatgatccttcagcgcttcgcgcttgttgtctcaccatcttatgttcatgcaccaatgcttgtagtcacactccaaccccagtatggtgctcaagttcttgtccataagatttgagacttcgatggacctgtgtgtggatttctgggtttttgcagtaagtatggtgaacgatttggaaggatgtttccagctcgtctgaactttctatcagaagtggaatctgctggagccatgggagcattttccgtgtacaaacaacacttagtacctgcagaaatgtacagaaaataaaatggtttgcaactcttcatgtttttgccatgtacaaataggtcttacttgctgaaatgtagtaatacacaaaataaaatggttcggaattgttagtattccagtttttctctgccttatttttggatcatctactgcatatgttgtacattttagttgttgggaattgtttgtccggctgatcaggcatccccactatttgggctggtgaaatccatatatcttagtttttttagaactatatatctttagttaaaaccatttatccataagctccacctcatcctagtttccaagacaaatcaaaccaaaggatcttaagagttaatcaagcttttaaaagggaagggaagggaggatattacattcattcaagcatctaaataattagcacgaaccagcagcacataagcacatctaaagaattttccttcgaagtcagattcgattaaccacatctagatcacatcaaatcttccggacaatggtcttgtttggatcctccgggctaataattagccctctaaaatcttactatttagaattattaaacgtagagtactaacaaaacccattccataacctcttggctaatttacgagacgaatctaacgaggtatattaatccatgattaacggatgattactgtagcatcactgtagcaaatcatagattaatatacctcgttagattcgtcttgcaaattagcccgggggttatggaatgagttttctcattaatctacgtttaatactcctaaataacaagattacagagagcccggaggatccaaacaaggccaatgtcattctctctttgattgatctcctctcttacgaccggctccagatcacgggcacg

SEQ ID NO: 38611 - DNA, 18501 bp, Oryza sativa
tttttttttaaaaaaattgccctttcagagaacgttaaaggacgtaaatgtaagtttttccatataaattattaactttatgattttgcaattttaaaatatatcatataaaatcggatgaaatcgaaatctatattaaaattgtagaaatcaatgatatatacaattttatagttgataacttttttatttaaagtcttttaggtgttcaaatattcgttacaaaatttataacctattttaacaaaacctcataactatatttcaaacgacatcggatgaagagaaactttatataaaagttgagatctacaaaactgtagtttattacttttccatctaaaataatttagagtgccaaataagcattactaatttttgtgcaattaaaactaacggaaatgatttgaatacgaataaaacatttacatttagatccgctaacactctctggaaggaagatttttaaaaatgccctcatgtaaagcgtgaggcgtctagatttataaattggcgtctagatttataaattttaaataaaaaatttaataaaaaataaaaataaaaaaatccgaagcgcgacgtttttcgcagccagatggactgcacgtcgtcgtcttgttcttttttttccctttcaaggtccgactgatgcagtattgaagctggttcaaccaccaacattttagaaagatcctaggcgaactccataacataggctctcaaaactaagtataaacttgtacttgtattatatacttatataaatcatatatcgttgaaaatgatatgaatacacattgtaaacacctaaagttacgatgtaaatttatcaacaagaacaaaacaaactcatagctcaatttccagactaaatagatgcaaatgagaagatcataagacctcactctaaaccctagccacaataaaataagatgtggccacatgagagtcagacgtgagaacacagccagccggtttaggcactaagcaatcacacaaccagctggtttgggcactaagcgatcacacagctagccggtttgggcactaagcgatcacacaaccagcctaaggccctaagacgatcctgccaacccgttcataaggatcagatcctacataaaaacaagagtaaactgcactcacgatacacgaacttacgtggtgggtgtaaatagatataataacttgtaaattattagatcctacataaaaacaagagtaaattgcactcacgatacacgaaattatgtggtgggtgtaaatagatacaataacttgtaaattatgtattttagtataacaacttgtctagtccgtgagaaccaggccaaaacaatccatgcattcaaaataatttgatgtggcgttgacacggatgccatgtcgctttccttcttggctcgtttcagttcatgtttgcatctttttgcacaaaagttataaaatcgtaagcatggaaattttgtttcgtgcactctattacactcacccatccctgaaatagttcaatgcaacatggacctaaatcgctgactagctacaagtgctcagagatattggtggagggtcgattggccattacactaccgttttaatacgtggcaattagtatgagatattgctaacaacttgtatgagatgaagctggcagctacacttctgtcgttgatcagtctgatcaccagccactctagttgtttcagtcttagaaactactactccacggggtattacaggatatgtgcttcttccactactgcaacctccatcttcttgccattacagcggcgtgcaactaattgtctcctcaaccgcatagttccggtgccacatcatgttattttcaaatacacggactattttggccttaatttatatggactacacgagttgttgtactgaaatacacattttgtaagttgttgtatctatttgcacccactatacaagttcatgtaccatgaatacaaatatacaatttactctaaaaacaaggataatctgttgcgtggttgtccccgatgttaaatcgactacgatctaacgccggggctcgctctgtcttcttctgtataaatcatgcttgtttacggtttacataatgccctgacatttacatctgctcgttatatcctgataatactagaagatccatgcagttttttgagtacatactcgatattatctgctatatgtcttgccttctagaaaatatttttcaggaacaattatgcactcgagtaggttgtggtcgagtacactctattatcaagaacattctcgacaaatgcggagttatcgcacccgacctaccaacgaagaccgacgacctatctcatagcaccgaccctggctggactactcgagaaaaggttgttaacggatagttcctcgcaaacgccgtcggtttgatcacccgacatgattgcgagcggacatccggatatgctataagttgggtgtgtgagtcatgctggccacatgatatgcacatgtaataaaccaactttagcacccctataggtgattaaaagactcctacttctggttctcgaaccagtaaaacgtagtgatctctctcgcctcacttttaagtggtcgagttacaactactgcttggtcctcgaccagcgatgcagcgtttctcccactacttccactttaagtggtcgagttacgactactgcctggtcctcgaccagtgatgtagtgtttcttccactactttcacttcaagtggtcgagttacgactactgcctggtccttgaccagcgatgtaacgtttctcccactacttccacttcaagtggtcgaattacgactactacctggtcctcgactagcaatatagcgtttctcccactatttccacttaagtggtcgagttacgactcgaccactgcctggtcctcgaccacgatatagcgtttctcccactacttccactttaagtggtcgagtcacgactactgtctggtcctcgaccagcgatgtagcgtttctcccactacttccacttcaagtggtcaagttacgactactgcctggtcctcgaccagcgatgtagcgattctctcattacccctgcttcaacaaagttgatatcaggtgcacaagatcgccaagtgttttacccagagatcccttacccagatgactcctagcgttgaaacctatcctactgtccctttacgccgtcttgacaaggcctccgaggaacccgagagaacttcggctggggacgcccagagccgataaggccttgtcggatccttcagagatgaaagaccatgtaagatctggtcatgtaagagttctcgccgtgcgtattaaccaagccgtataatcggaaatggattttccaacttcacggctgggggctaggatcagtgcttgttcaatcgaggcaggtcaaaggtccaagagccttatcttctgagaacgattctccgacgacaaggctgggagctagggagagtgtatgactctacaaactgactgatcggagtcggtaagagagaggacgctcatatacaaagcaatggtctgtacattcaattcactagtctgtcatattataacatgtcaccctttgagcattcgctcgggggctatttctatctaatattttttatgagtattgatttcaggaaaattctatttgacattatcgaagactccatgtctctatggttctgcaccaagattgactaaggcgagtacgacaaatgtcgacaaggctccgttgcagactctacgctttctcgatcactcgagaacggttgctggatcttgacaaggaatacggaatgaagagatggtgtacccgccgagataaaatttcttgacttcaatccaaattctcaattacagcaagacaggagacttagtcgacgctctgtactttctcggttgacatcagagattgacttagacaaaccctttcggtgcccacacgaggctgataaaggaagtctaacgttatctctaaactcaccgagaacggtcacgtgagctcgataacagttcctccaaagtctgcggttgagaatatgaactcgttcatttgcatcgaagtcgggggctactgtcagggttatggataccacatacctaatagtagttgactaaatctcggcaggatccaccacataccatgttttatatggaaactgacctcgagggagttccggataaggaaagacaaccagagttctacatggaaacgacaaggactactcggattgcatccatattggtttccctagttctacttggacaaggggacacctatgggtataaatacagggccccctgggaggagaggggacaacaatcatgggacaagacaatcaacacctaacgggatcaacacccaacacaatcaacatagaagcctatatacaccaagacacgccgccggatatcgacttcagggataagcaaggctaataccctacggtgcctccggatactgtcaggagaaacgaaagcgctatctctgatctcgccggacacggattcgaggaggaaggctaccctgttgtcgactacgagtcaaatcgtcagaccgccatgtcgacaacagttagattggctaccccaaatattgtactcgtgtgattatggtgaataagagcaataccggcctcggccaacaggatgtagagttattacctgacaattcaggggcccgaacttgtataaaaatcactgtctccatctcttttacctcagtcttgcgtatatcctaacaccgacgatccccataccatgcaaataccaaaattgcgacatcaaacgtcgatagctataagtcagctgcaaacatattttaagataaatgaggagagagaaaagcagcgggctacagatttgtatccagctgtagcacagactctaagacacagcgtgtgtatgacaggtgggaccatgtattaatagtgtagtatataactattgtataaataagctattagattagctatagataaattggagctagtagttgactatattattaaacttgctcttatggcagctgtattaccttcgtctgacttccggctcacggatctgtccatatctggagccgcctctgctgtaaagatactcagataactcgccgaatccacgagcagaagcgccggcggaacgagctgaacaacatattgccgcctcaccagtcactagctcctattgtgaacgccatgccctttcttccgctcgagctgaagtcccaatccgaggagaaaaaaaaaacaaattaatttttagagatgcaggcaaagatggaacccgggcaatcacctcaatgaatgcgctgaaaaatccttcatccaacgcttaaaaacagggccagtatgggtggaggagctacatgtgttcacaaagaaactattgccaacgttctaaaatacttatcactttgagtttttattagtaactagctgggtggcccgcgcaattgcacggctagcatctatataaaattatatattttttaagtatgattttacttaaaatttattaaatagttatctcgttgttttaagattttgaaaaaccaaaccttatcatcgtcgtgtttctaattttgtagtttttaaaagacacatcagttgctaccccttacttatgtcatattattttttattagcttgctcgatctaccgctgtttctatttattctccttggaacttttaaaaattggatctaaaaactattagagttcattgtcctgttgggcttatttttaataatttctagaagtctcgtcaaacgctgctattatattcctctacaactgtccactgcatcttctctttattatcattgctattttaaaaattgaacataagtatcatttaggttctttttttactttctagaagttccgccaaaatatcaactcctttgtcactgtactcctctacggctcgcccgctgtcgcccttctttattgtcattgagattttaaaatcaaacatgattatcattggggattttttttactttttagaagcccgtacatttgaaaattgaaccttatagtttttagagttttgttgtctcgttgggttttatgttttttataatttttagaaatcctatcaaacactaccatatactcctctacgacccgtccgccgcataatctttattgtcattgggattgtaaaaatcgaacataactatcgttggaattcattttttactttctataagaccgaccaaccatcaacggctctaccattgcactcttatacgacccgtccgttgcctcttatttttattgtaattgagattttaaaaatcaaatataattatcatagaagtttatttttttactttctagaagtccccgccaaccgccttgactgattacttcacgacctgcccgtcatatttccttttaatcatcaataggattctatttggtgttttattagtagtttttagatgtctcatcaaccgccaccactctgctcctctataagcatattacttaattaatctcatcatgtgttttagatggtcttttcttttaatagtcttatttttttatcaccaatttcagttatttataaattgtattcctagttgaaatcttttttttcctaatttcagaatttattttatttattattatgttattttgatttttgattttttattttcaattcagttgtttcaaaattatattcctattttttattccgaatattatttaatctactattgggttcttatatgtacttttatttcaatattgcttaaatttaattcctaatttaagttaattttaaattgtattcctacgtgaactcttattttcttttattttttctaattttgattttttatttttttattatgaattttaattaatcttgtattggattcttatatggactcttctttcaatattttttatttttaattccgaattttaattatttataaattttattcgtactccaactcttcttttttctttttctaattttgaaatttattttattattatttcgaattttaattaatttctatatggactcctctttccatattacatatttttaattccgaatttcagctatttttagattgtatttctacttgaagtcttcttttctttttctccgattaatgtgggaatttttagcccctaaacgaacgtggtgcctccttttaaagctgttttaataatataatagatgtttcatcattagttttattcagaaaactataaaattattatttattttctttgtggcttattattattaaaattactttaagtataatttgttttatatactccctccgtttttaatagatgacaccattgattttttctcacatgtttgaccattcgtcttattcaaaaattctatacaaatgtgtaagatataaatcacacttaaagtactatgagtgataaaacaactcataataaaataaattataattacgtaaattttttaaataagacgaatggtcaaacgcgtgagaaaaagtcaactgcgacatatattaaaaaacggaggtagtatttgtactaatttttataagatgaatggtgatacttcctccatactcataaagaaagttattttggacagcgacacggtctccaaaatataattttgacttcttgtttctataaaaaaatatatttattgaaaagtgatatatgtattgaaaagtttatatattttttttatactagagggagtacgataaaaaaaaagcgataactaatttatgaggaggtagttcaatccaactttttgaagaatttaatccgagagagtcagcggcagcctgcagcagctagagcagagcgatggccgcgcttctgggcatcctcctcgtggccttcctcgccgccgccgtccctttcgcgctccgcctgctccactccttcctgtgggtcccgcgccgcctggagcgccggttccgccggcagggcatccggggcccgccgcgccgcccgctctccggcaacgccgccggctaccgcgacctgctcgccgccgcccagtccgcgccgctcgcgtccttccatcacgccgtcgtggcccgcgtcgcgccgcactaccgcgagtggcccgagcggtacggccgcccgttcgtgttctggctcgggccccgcccgcggctggtggtctccgacccggaggtcgtgaaggccgtgctgaccgaccccacggggaccttcgataaggctggctccggcggcggcaacccgctcgcccggcagctttttggcgagggtttggtggggctcaccggggagaagtgggcgcgccaccgtcgcgtgatcgcgccggcgttcaacatggagaggatcaaggtaaagaggcgttttcttgaaaatgaccttagaaacatgaaaatggatgattatcgtgcttgtagatcatgttgggtacttcccgctctcaaaacaaacgacttgaaattattgtaactctaaaacatatgtatgtaagccttgctaaaatgttcattatttcagttcttagatgtaagttgtgtcacatgtgaaatcagggagtcagggactcctaggctttgtgtctgttacttcttttctactgacgttgatttaaaattttatttacacatctacaatggaatgggattcagactttcttatataacaatacgatgtgtattggttgatttttgaaaaattaacctttttatgcatcttttgtaagacataaattgtaagactctcggagtaagttcatcaccttcctgtagactatattcatggtgaattaacctttctttctgttagtaataatatatatatgatgatgtgatcaaaagttgtgctctggatatttctactaatcaaatgaattgccaataagaccaaagttttgttcctttcagggttggatttcagaaataacagctatcacctcatccatgctggataaatgggaagttcaagatgaagcacgcgctgagtttgagatcgatgtacataaagaatttcacactttgattgcagatgtcatttccagtgtggcatttggaagtagctatgaggaaggaaagcgcgttttcgaattgcaggaggaacagctaaaacttgcaattcttgcaatgacgacagtctatattcctggcttcaggtgaggttgcctctgcctcttagcttgcttggaacccataattttcaaatgccacagttaagggagaaaattgtgacgtctttctctcataggtttgtgccaacaaagaagaaccgacgacggcatatgctaaaccaggaagtcaggaattccttgcgcaaattgattgagatcaatggaaggaagtgtgaggattcgaacaatctgcttgggatgatgttatcggccagtaaacttggtagtgaattcagaatgggaattgaagaaataattgatgagtgcaagacattttactttaccgggaaagaaacaacagctaacttattgacatgggcaactcttctcctagctttacatcaagagtggcaaaacaaagctcgcgatgaagtccttcaagcttgtggcaagtctgagcacccaaacgcggaaaacctgagtaatctcaaaattgtgagtccaagttttgtatactttggttttcatctcttttataattttattgaatacaggcatacagcaagtgacacttttttaatgtttgaatgcaatcaggtaaatatggtgctaaaagaaaccctcaggttgtatcctcctgctatgtttctcaataggatggtcaacagggatgtcaagctgggcaaactcgacattccagctggcacgcagctccattttcccattcttgacattcaccatgatgttaacatatggggcaccaatgcagatgagtttgatccatcaaggtttgcagagggcaagagctatcaccttggtgcatactttccctttgggattggccctactatctgtgtcggccagaatcttacgatggttgaagaaaaggtggcccttgcaatgatccttcagcgtttcgcgcttgttgtctcgcgtcctatgttcatgcgccaatgcatggagtcacactccaaccccagtacggtgctcaagttcttgcccataagatttgagacttcgatggatttgtgtgtggatttctgggtctttgcagtaaatatggtgaatgcagcagacgtacatcgtgtattatatatctttgtgaacaattttggaaggatgtttccagctcgtctgaactttctatcaaaagtggaatttgctggagccatgggagcattttccatgtacaaacaactcttaatacctgcagaaatgtacagaaaataaaatggtttgcgattgtaaatattccagttctctcctttttatttttggatatccactgcatttgttgacatatttagtttacccgtttgataaggcacccatttttgctggtgaaatctatatatcttaaaaccatttgtgcatgagctccatctcatcctagcttaaaggatacagcacctctggtttacgcgatggcaaaaaagaagagtgcaaacctgcagcaagcatcgcattccgaccaatgattggcggaccttgacttgcctgctgtctcagggtggacgacggatctaattagccaactcgtcgacgtctggggtgttgttcatagcttacaattaatggagaacaaagaagacaagatcacatggaagctaaccagccacgacgaatacacggcgagatcggcttacaaagcgcaacttcttggcacaacaacgtccaatttcaatgccatcatctggaagtcctgggggccgcgcaaatgtaaaacttttgcttggctcgtcatccaaaatagaatttagacctccgacagattagcgatccgtgggtggccgaataactccatttgcctcctatgtcgaaggaatccagaaacaaccctccacctcctggcgggatgcagatatgtgagaagagtttgggcggcacttgcggactggacgctatgtgaacagataaaatcaacacagtggcatcaagcctcaacactcttcgagtggtgggaggtcaccgcatgctcaaatgaagcaccaaagaaccccctatgccgaaggaatccggaaacaacccttcacctcctggcgggatgcagatatgtgagaatagtttgggcggcacttgcggactggacggcatgtgaatagataaaaccaacacaatggcatcaagcctcaacactctccgagtggtgggaggtcaccacatgctcaaatgaagcgccaaagaagaccttgcattcgctaatgctgctagttgcctaggagatttggaatgaaaggaaccgcaaagtcttcccgcatcaggagctcccggcgaacagtctagtagccaaaattaaggagaagaccagaacatgggtcttggcagatggcttgcattctaggccgtgtttagttgcaaagtttgaaccccaaaaagtcacatcgaacttttctacacacataaacttccaacttttacgtcacatcgttccaattttcttcaaactttcaattttggcgtggaactaaacacacccctagctttttcgggccaaaggccttgaatctgtattttttttcttttgcgcttgcgcatgtacagttttacttcttctctatttaatgaaattggcagctcgccggttcgttcaaaaaaaattctcatcctagcttccaacacaaatcaaaccaaaggatcttaagacttaaccgagcttttaaaagggaagggaggatattacattcattcaagcatctaattaattagcacgaaccagcagcacacgagcacatctaaagaattttcctttgaagtcaagattcgattaacaacatctagatcacatcaaatcttcccgacaatgccattctctccctctccgacgaccggctccagatcacgggcacgcgccctcgcttcgcgccaagctttgcccttacaaaaacggcagggaaggcaggcggatcgaagcagaggtatgtacgtgcgcgggccatggccttgacggcgccattggagagggagggagagctagaggacgagatgaatcgatggaagagtcgtagagagacagccgcacatgctaatccccttcttgctgaatgcgtcgcgcgatcgcttcttgctcgaatggtgttcttttggctcctcgtcgtcgatcagtggaggcccagcaggcgccggagctcccgcgtcgccgagtcgtccacccctgccgccgccgcagcggcagccctagaggacgacgaggaggaggagaaccgcggcaacggaagcgcccgcggcgacggcgacatggacccgaacgccggccccgcgtacgcgtccgcgcccgcgcccgccgccgccaccttgacccggaccacccgcgtcacggctggcgccgcctgcccgccccgcggccgcgcgtcgcgccgccgggccgcctgctggcgcggagaccgcctggtggcgtggggacgggcgcggacgcggtcgaggcagtcgtgcaggcggagcacctccgtccccatggcgcgcgcgacgcgatcgcgagctcgcttgggtttgggttgggtcgtagcctacgaagcggttaaacggtggtggaggaggagggtggggttgggtgaagcgtggtggcttccaccctctctcccggcggcgtccccgcgcgctgatcggtcgcttcctctacgatcgcctggtttccacggcgtgcaacggtggcccccgcttttaagtcaccccccgctttcttcccgcacaaggcggccgccctacccccgaacggacgaaggcgcgggcgtcgtggaggcagccatgggaagaaaataaacgcggttgcgtcggacgcggggagatcatgcccggctgcccgcgtctcgtcgcaggtcgcaactcccgtgcgcgtgcgggccgcgagcgcgaggtccagactgttcggcgcgaaccgggccgtgtttcactgtttcccaatgtctgtgaagttcaatttaagtctctaaatttcatatctagtttaaattgtgtcgttgagaatcgaaatactactagatatacctcgtccgtaaacttgcaaaaccggtgtactcgacgccctaagctgtatagtgctcggttctagtcaacgtggcgagttgactacggtcaaccatgctaagctagcatgggatccacatgggggcatgttagtagccagctcttcttcctcctctttccccccttccttctaggctgggaggctggcggtggccgagaggagaatggcagcggtcgcgacgccctggaaggatggcggacgacagggagaggggcggtggctgcggcggactagaaaggctcaagcttgaactggagccatgcctaccctcgcggagctcatcggcaagccgcatcatctttctctccttgtcgagctcctcctacgcaatcttagcctcccgtatcatcttcaccgcctcgccacccctgccatccatgccgccggtggcaacgaggccgctcctcacaagctcgtcggacagttgctgcgaccctactagtccgccatgaccgttgcccctctcctcgtggggttaggtcacttaggagtatgtctctctccctgtccggcttgcagcatacacgtatccgcgctttgctcgcctgcgtgcactcgccaagcgatgactcgccctccctcgttgaggccacgggtgctaaagcatatggtgacgccttcttcgcacacctatgtcaccaccattttcgtctccacctcaccactaagcacatccacctctgttggttgcatcgacgtcgcttccctagctcccgtctctagtccggatcctattcctccttggagaccgaagctaccgcaaccattgctcggtggttagcgagcgtggagctgtcctccccactttcgcgtcctcgttcgccaccacagccatacttcgcatggtgatgtcttctccttcactcaccgctaaactcagtgcaaccgtttctaccctagccccggccgccgctctcatagaggtgaaagttcatttacatgtaggtcccacatgttttatgttttttatttttcttttactgattagcatgccacgtaaatcaaaacaacaatccatagtgttttaagtatttttatttaatacgtgagatggagtacaaaaacgagagatgcaaagtgaacttgctaaaacacattttctggttgattacagtcgcttgttgagccattggatcggtcataggattcgtgctagcatacttaattacgcgtaactagttgtgctttataggttacaggtcgctaattagcggtctactggagaactttgctactatttttttcttcactgcatgcactcgatcaagtatgagtatttgtaccgaccagcgaaacacatatgtaattaaagtataaatatgtaattagtatatattagtagtatatttagacagtagttacaccctacatacacaccacttacatatataattagtatgtaattttgtaacttacatatgtaattttagtacttacatatgtaattttgagacttacattgtaaatacactaaaattacatatgtaatttagtaacctacaatgtaaatacatgccgactaacttttgatgaaaaatatggtgttataaatatagctactcccgaactttattccttctctgtgagatatcagtggaaacgctcggtggaatcgggggagtatttgggagcacgcgccgacgcgcgcgtcgtgcgtgccgtcgtctttgtcgcggtggagcggagcgcgcccacttgcgcgcctgggccggaggcgggcgcgccgggggttcgggaatcccctggagccacacgtaaaggcgcgggcgggagggagggaggggccagctaggataaggcacgcgcggccgctgcgattggggcgcttgtgaacaccggggcgccacgtggagaggacgttacactccagccgccaaatttccactcccacacccgcgctcccctcccctctcttttccgtgatcgcacctcgcccacgcgccccccgccacacacaatctctgcagctctccagcttcgttggaactcgcgaatctctctccgatcccaggtaaagcagcgaacgacgtcacgcacgacgctgctcggtggatttcgttccttgctggggaaaaccatgcagagacgaaggtgaatgatctgcttttgtgtacttgcgtttaccaggtgaagcgcgagcttggagttggaggggagatcgatcagggccaggatgccgtcggtttcgagggccgtgtgcgtgcagagggcgagcgggaataacggcaggaggtgcagagatggggcggccgccgccggccgccgatccgtcgtggcgcagagagcgcggcacggcaagccggaggtcgccatccgctcggggtccggcggctcggcgcggggcgggcattgctcgcctctcagggcagtggcggcgccgatcccgactaccaaaaaggtaaaccgtgcatgccgcagctcctcgttcgttcgttggctcgcgcgcgcgattgctgtgtttgacacaccgttgactctcgatcgtgcgagcatctatcactcactggttcgactcgcatgcgtattgacgtataggagctcggaacacaccatcgtatagctcacgaggtagcactgtagcggggatatgcgtggttggccagcccattgagccacataaggcccatttttttctacacacttgaattcaatccggccctatggttggcactgtctctcatttatttatttactcctttatttagaggatgcgcagatgcatgcgttcaacatcttttagggacggagtacatatttagattcacacgtgtgatattggaagtgcgggcttgtgtgacgctgtatccttgcactataaaaaaacatctctgctactagtaggtcataaccggcatcattgttggtttttaaactggcagtgtgctaccgacaatgatacgattggtttagggtgtgaaccaatagtgatatatggagcataactgttaattctacttacaaacaaacatacagtgattttgaacgctccaaaaatatatatgcaatgccaatagatttgttgatttgcattcaccgatccaacaaacaacttcatttcattcatcaatctaacaatcaaaagtttgtaacaaattcacttcatttcaccaatccaacaatgtggtttcattgattgatcaacaatagaataaagtgtaactttggtgtgatgaacaacagctagcagaacaatttctttccagaaaatttttattgcatcatgcagcttctaaaaatagataaaagattgctcatgcatctcttctcctcatcaccttcaaagatgtagaaggtagcagaggagcacatcggttgataataatgtagatggcactgttagttgatgttgttgagcttgtgtccctgttggcaaatcaagtaagcacaacccccctcccccccaccctccataggatttggtccaagcttgggatgaccagatataattccacatagcctcatctctatcgcatgttgttgttaaacataccatgcgacgtccgcctccattgctttgtaggtatttgccgcgttggacagggaccgatgtcatcgagatccactcttaatcctgagagtatgaaggcatggaagggggcctccaccaccacctgcctaacgagattgaggtggtggcctatgggctagatccccctccccccttccaagcagcaagctcgtggcatgctatccgatcaaaggggagcaaggcggtggccccttgttcggagagtaaggaagtgacggcacatcagttggagggtagagagacggcacactgtgcatgaggagagagggagggaaaataccaacagtggtactatcattatcaatttatatcctaaattatttgtaaaaagagtacaactacatgttctaaatgagataaacctgcagatattggaaatgatgcatttaggtccacatgatgtgatgatagttgttctttgttcagtttggttagcatacagatagatatcgacaatatttttttaaagataatgaaagctacagccaattatacatacagaagttgctagtcaaatcaccgcaaattacaagatcacagcttgacaaaaacaagaaagcaacttagaatatcaacctaaggacatacacataaaacacctattgctaaaattcatttatgattaacaagaatctgtataaccaagggtagagatgggagaagactgctagggctgcaaccctactcttaagtctaaatatccattagaattgcactataaaattaaaaaaaaaatgggacaaagttatgtaaattatattagctgagccctaagcttagaagaattctggttctaccatagcataaccatttgttttggctaccaatgactgtttataaagattatcatcgattagggaaaaaggaaacaaaagtatgcaaataaatgataataaatcaactctctagttgagtagctaggctcataggtgcaaactgctgaaagcttaatcattccatcatttggaatcttgggggtaagacaaactgtaatgactctatctatatagagctagtgactcccaatcaatttggtaggctttctagttaccttagatatttctactttttatcatgcacttcacagaggcatctcagattctggattgccaagcccatggtttcaccaaaaccagaaaaacagatacagttatatgcaaagattttttttttcatcagtcccagactcccagtacatcaagaatgtgaacggaatcgagcctggaatccatggtgagacagggaccgaattcatcttagcaatctagcaacttgattaagcatttaagccggtaagctcgaccattaggcaagtggacaaggttgtgatcacgcaagtaaataaaaactataggatttaagtacttttcgccgcggctaaatccaagtgatcacgggccctttgacagcaatctagccaattagcacggaggtgtatcaacacatgcatgaatggaatatatttctccctggtgcagagaggttcatttcacttggcatcatcacggacctaagcaaacattaggggcatatgctacgaaattcttgtctgtccatcaaatgtttggtagcaataatattcccatgttcactcgtgcatattgctaattttgttgttttgttgacgtttaactcaaatcatggtttctataagttacttcatggtattttgaggaactaccaaatcatggtgaatcatatatgatcgaactaccaaatcggccgacagtgcaatatacatggttctgttctctggttttgcccctagttcagcccatttctagttagggcataaggtgttttcttttaaaagaactaggtgattctccg

SEQ ID NO: 38612 - DNA, 6744 bp, Oryza sativa
  unsure (1)..(6744): unsure at all n locations
ctgatgctgaactaataacccctatctaccaggtactcttacactgctgtggttctcaattttagtcagtcatgggccttgtattgtctggttcagttctatgctgccataaaggatgaactagcccatataaagcctctgcaaagtttctgacattcaagtctatagtcttcttaacatggtggcaaggtgtggtgattgcattgctgtacaattggggcttgctaagaggtcctattgctcaagagttgcagttcaagtccagtattcaggacttcattatctgcatagaggttgtcgattcctattttaccgtgacagtgaaggatttcctgtttattcatttagtcatgcttgtgtcttttttgttgtccatttgaaacaaaccctaactagttgttttgtcatccaatacagatgggagttgcttctattgcccacctgtatgtgttccctgccaagccatatgagatgatgggtgatcgtttcattggaggggtttcagttctcggagactatgcttcagttgattgccctctagatccagatgaagttaaggacagtgagcgaccaaccaagactaggcttccccagccaggcgatcgtgtcagatgctccactggcataaaagaaagtgttcgtgacgtcgtacttggaggaggagaatatgtaagataaagatgctagctcctcattgctgtctcccatcaattttacttcaaaatatgtttcttactgtaacattgactgaatcttgcagattgtgaatgacctgaagttcaccgtcaatcatgctgtggaaccaatcaatgaaaagctgcacaggatatcacagaacatcaaaaagcatgagaaagaaaagaagaaaacaaatgacgatagctgcataaattcacaacaatccttgagcagggtaatcagcggtattgacgatcctctcctgaatgggagcttaagtgataatagtggtcagaagaaatcacggaagcatcgcaggaaatctgggtacgggagcgcagagagtggaggagagagcagtgatcaaggattaggtgggtatgaaatccgagggcacagatggattactagggagtaaggattaatgctctgaaacatgaatttcttggtctggatcttccttggaggctaaatgcttactaccacgcaaacagatgacagagactcgaattaggttgaaacctaggatctctttgtgaggacactgcaatgctgcagattgagctagcagatgacattatctccaggttgttcaactgacatttcagatgctagggtcttgatgataaacattgcaggcatgcatgcatcaaattgtgaagcatggcaggttaactaattcatgcttgcattatcagttgtaaaggacagttttttccacaaaagtatataagattctgatttgaggaagaaatgtcttgcaagctttgtttttggtgttgtcaagtttttgttatatgtacttacagtatattgttcattctttcattcaaataaattataaaggagggcgtccttttacctccctggcattagatgaatgatttgcaccgtaggtaaatccaatcattgggatataccgcatttgagttgagttgcgtcagatcatgacagaatgataactgctctgagcttgcaatttctgtaacatcccagttaacgcaaatacatttcaagtggctactttttatcaagaagacaataaatttcaagcagattaaagttgaagaggaaaataaatatgcagttcttttcttatcttttcttcaaggtttcatccagatgtccttgaatcctttttttttttctttttgacaagaaaacatatgcctttgtgccgggaattaatggaaaaagaaccttagttaagctgatcacgcgacagatttggcacaatcacgttgtgctacataacacgcatacaaagtgattatcctcctaggatgctatgagtcaccaaaagcaactgataacaagacgtgagagtaggccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggatctaaacaccaccaagctgatcgagcaacaaatacgttttattcccccactgctttagctatcaaaaaggccacataattacacattttgacagaaatcaaagctgcttttaccttgtatgcatttgctttactgacagctaacagcagcaagcaacctcatttggatgaaacaagcaacagtgtcagcatagaaatctcattacctttcgcttttgtcttgtattatgatttacaggaattcggtttgtatttatttgcgtctggaaaaagaaaaggaaggagagacacgtgaaggcccatggccaattggcccaaaggctcctgggcacctcctggccgtccacgtggcaggtgtccacgtcagcactttggctttgttttctcctttttttttctcccaattttcactccactgctgcacaagcttttccgtgcttcctcgccgcctccggcctccgctccggcgctataaatcgccgccgatttcgaagctgtggaaatgggagtcgcctccacggccaccgacatccgccgcaatgctgtgtctcacctcctcttcctcctccgcgcccgctccgctccttccctctctcgctgatcgaccgagcccgggaatcgcggtcagtcaatatatagaaacttctatatatgatatgattagttttccctctctctcttgttttgttaggtgtttgggttattgatggtgtggtggtccgcagggcgggggtggcaatgttcgcctgagcgtggtttcttcgccgcgccggtcgtggcctggaaaggtaagatactgttgcaggatatctatcgaattaggaatttgatgatggtgataattaattgtggggaaaacaagtaagtctgaatttctttggccacaggcgacagccccaaaaccccgacaccccaccgccgaccacctcgccgccggcggcaccgctcccctttgccgccgtcggctctacctccttcccactctcccgtccttctcctagcctccctcctctctctctctctctcaatacttttttctacctttcatactaccttccatgttcttgttccgaatctgggttcccaagccgctgatgcgccccttccctgattcttctgatggaactaggggaggctgtgtggccatttttcccgttggagggtttcgtctagatctgtcgggtgtgggacatgcggattgcaggtgctgtcggttgtgttggcggcggcgggtcctgccgggatagttggccgccgacggccgcttggctgttgggttgcacggtgtgtgctggctggtagcgaggatggttttagggtgttgggcgaaagctctgtccgactcatagccggcctgacggcgatgaacgtccttggacatcatgcaatgcccctcctggaggcgtcgtcgcaagagcatctccagtagagaccctaaatacaattcctaaacagtttttaggtgctaaggacaaaaaataaactccagcaaaacccatactacaggtcctaaaataggaaggacctcaaatacccctccgcagtccctaggcctgggggctgtagaccgaggccctatcgccgtttttctacgcgggaggaaatttcctgacgtgtggtgtctgtcttccctcccgcggaatcgctgccacggcgccgatcttcgccagctcgctggttccgccgctcgtggccgacggtgcgaccatccagtacctccaccggccactgcttgtcgtccgcgtgcccgcttgcttgttttttcgtggtccttgatcagttcgcacactgatgcactatatggtagacaagaatgttctgaaattcatgaccatcagaaacatgttctaaacaatcctgctctcgattggtttatggctaactgtggttctaaacgatcatggcataaaaattattgttctgttcctttaaagtttgtggtgcttggtaggttgagacaattaggctgcttgcaattatgcagtagttccttcaaagattattctgcagtgttgttcttttgtgtcagttgtgagttgaagtttaacttcaaggttttttttttctaggaggatttaagctctttctgaagtttctcagatagattagattggaaaaggtatagagttaattttatctattgattatagttcttatttaattgaactacgtagtgtcttgaatacttgccggtaggatttcactcccatgtttgagaattttgaatttgaattatggtatttaaaattatggatttgaatacaattgaattctatacattagaaatattcgtatttgaattattactatgttaaactaggtgtaagcatagagtataatcagaaatacaagagaaaaagaaatgggggctaagaaatagggtctgctggtagagttggaggtaatttttgaattcttagaaaatagggacagccctcattcaacctttgaggactctaaaatagggactactgctggagatgctctaacaccctgttcccccttgctgctgggtgaaaaccctttccagtctcctgtttatgcgatggtggcgtcctttccgacgtcgtcaccttcttcaaggcatcgtttttggagaaaccctgcaaccagtccccctgctttcccatccttctcccctattccatcccctcctcctccccttttcttctgtcaagggctcctatgcttggaaactctcatgtatctcttctctgtaatatattcaggtggggaaatgttggatttttattgattggaatactgtattgggtcatctcggtgacaccaaagctgtactttggtggagtagcaatctttgcccttattgaccggataggattttggttaaatttatctacgtttttgtttgcggttcatcttttttcctaccagtcttatacaagatggtacagtttagcaactgattgttacattgcaatatataaatcgaagtgatagaagccacctcaagtaaatctaactattgttcataattcaaaggtcaagaccaatttctcagttcctgcgactgcgcgaaaaaacaaaaccatggtgactgttgtggaggaggtcgaccaccttcctatatatgatctggaccctaagttggaggaattcaaggatcacttcaactataggataaaaagatacctcgaccagaaatgcctgattgaaaaacatgaggggggccttgaagaattttctaaaggttaagttcactacttcaatttaatgcacaaatactccttcatacaagagtcggcatatgctattttctttgcatcttttaactctttatggttctctcattccatcttttgtaggctatttgaagtttgggattaatacagttgatggtgccacaatatatcgtgaatgggcgcctgctgcacagtaagttctaatgtagtcatccagctattcgctaatgtttatgtgttgtaggaaatatggatcactgatcaagttgtttaagtaccacttcttcattttattttcaatactatgctttgtctggtagcagctagcagaaagttaattttacaacataagatagctcctcaccgccggtaatagagatgttttgagttttcactcatagcacgtcttggctgtttaaggtaagtatcgggggtagaacataatgccatgaagagagaaaattatgttatctgtgtccgattgtagttggttctgaacttgtgaggctgtgatttcttaattgtcgtttttgttaagaccttaccagtatttgcaatatttaatgcatttttttgcggggaaatattcaatgcatttaacttggaggtttttcttcatgcatatagagaagcacagctcattggtgagttcaataactggaatggtgcaaaacacaagatggagaaggataaatttggcatttggtcaatcaagatttcacatgtcaatgggaagcctgccatccctcacaattccaaggttaaatttcgctttaggcatgggggtggagcatgggttgatcgtattcccgcatggattcgttatgcaacttttgatgcctctaaatttggagctccatatgatggtgtacactgggatcctccagcctgtgaaaggtcctctacttgtgccttgaactacaatgtaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 38613 - DNA, 670 bp, Oryza sativa
aataaactttggtcaaagcctaacaaaatggaatattaatgacttttgggagttgtgttttgaaaaaaaaaaaggaagatccccgcaaaaaaaaaaggaagatgcttaacagtcataacatgacaaaaaaaaacaaacaaacaagacagtataagtggacaaacttatcccaggaatcctaaaatggattaaaagcaaaccaactaaccatcaaccctatataaatatgaccaagagggcataagtattctaacaggttactgcacaaatgtatactgcatttgaaatggtgagagtaaaataactccaaacatcatggctaattctcaccgaagaacatgcgaagccattaacagttctggttcacctccccacacatgtggcttcctaatccgagagacatatgcatcgaagtccccctcaacaaacctgtgaattaatgtcatagcgaagcataagaatgcgtaactcaacaatatttagatgcagagtaactaacagaataatgaggacaggtagaactaaccattcatctctgcccgtctcttgataaattcatcggcgacctaacagtgacaccatttaaatagatcttttacatgataaattcaccagaaatggctgcgttgcttccagagcaacatttagcatctaagaacagaatggatca

SEQ ID NO: 38614 - DNA, 500 bp, Oryza sativa
tttcggttcgtcgagcactcttttttccatgctttcagtgaaacaagatattttatcaattatcgtgtgttttgctcttgttgatttgtttgtgcccttgttgtgttgttgatcaaaattccctttgcttgtaaacagaaatgccacgtgaagaacaaggatatcaggaagttcttggatggtatctacgtgagcgacaagggtaccatcacagaggatgcgtaaactcctatcttcacctagtatcatgaagtgctgtttcttgtctcccgtgtctgatcatcctctgagttgcaattttctgagagactgaattttgtaatggtgggttatttaggatgtaatggagcatggtatcttatcctacatattgtttctgtttgcgattatgaagtctatttatcatcccctaaagacagtttactggaagcattcgtggttagataaacagcataatgctacttaaaagtgtgagctggtatgttttcccctgcgtatga

SEQ ID NO: 38615 - DNA, 695 bp, Oryza sativa
tagctcatcacatgggatcacaacctgataaccgcaagttcgcaacaagtacttttcagttttacaaacagtttctctgtttctgttcccgcgccggctataaaagcgccaagctttttgggacgctgcagctggagaagacgagaacgcaaaaccaatcagtcgcggcgaacgcggcgggcggaagaggcgaatcgcgtaacgatttttgttaaatttgtaaccggccatggatccgaggcgcagccactgggagagctcgtcggaggacgtgacgaggccgctgctcccgctgcacgacgacgacggcgcggcgggccggcgctcctgcgccgcgctgaggtcgctgctcgccaacaagtacctggcggtcgcgtcgggccccgtggcgtgcgcgctgatctgcggcctcgtcgacctcggcggccaccgcgccgcgcgcaacatgctcggggtgctcgcctgggtgttcctgtggtggattaccgacgccgtgccgctcgccgtcgcgtccatggcgccgctgttcctcttccccgtgttcggcatctcctcctccgacgccgtcgccaaggcctacatggacgacgtcatctccctcgtcctcgggagcttcatcctcgcgctcgccatcgagcactacaacatccaccgtcggctcgctctcaacgtacgtgatccgcgccgcgagcccg

SEQ ID NO: 38616 - DNA, 26109 bp, Oryza sativa
  unsure (1)..(26109): unsure at all n locations
acaatttctggagatgcgtcgacgtaagttcatactgctagcttattagctgcaaacactggcgatctctacattcagatcgatgtacactgaaataatgtactgcttaatttaaaaaaatcgatcgaatcatgcattcattcatatatatattggcaaagcaggagcctgaagagcatataggcgtcgtggatgcgcagttcgttgtccatcgcggtgtcccaacgctcataagccaagtaactaaaaacaatatctattatcccataatgcaactagctttggttaaattatacactactcctaccatatttaattgtgtttttctctccacatatatacagggcaacggagaacaagaagggagcagtgccaaggtaagtcgtacaattaactgtattattctaagtagctactctcttaactcctcaaatactatttgatacggcatgcacactgtttttaagtttaaacttcaatcttaccttcttttaagaatatatgaatattttaaaatatgttatattatcgaagtgtgtatatatagcatcataaatataatcgtacaacttttattcatagtatatattactctttccgtattttaatgtatgacgccgttgacttttcgaccaacgtttgaccattcgttttattcaaaatttttatgcaaatatgaaaatatttatggcatgcttaaagaacattcgataacgaatcaagtcataataaaataaatgataattacataaattttttgaataagacaaatggtcaaacgttggacaaaaagtcancggcgtcatacattaaaatatggagatagtataatctatactcttaaaatggtaaggatggtggtgtctattttgaccgtacatctccttgatacctgggacccaaaatgttggtgaagggatgacgctccagtctggatcaatcggcctctctctctctctgtgcgcacgcgcttcctccgctactggctgccgctactaggggtggacagggagctcgtggctcgttagctcgctcggctcgtgacaagctcggctcggctcagctcagctcgtttgatttttctaatgagccgagctagaagtttagctcgttagagataacatgaggtacttgagaaggtaccatgaggtaccattttttctattgtaaatttggtacctcatgagatacttgaggaggtaccataaggtaccattttttctattgtaaatttggtacctaggtaccatgaggtacaaaattttacactaaatttttggtacctcgtggtacatcctcaaggatcgtagaattgctcctctctctctctctctctctctctctctctctctctctctctctctctctctccgcgcgcgcttcctccgctactggctaccgctaccaagccttcatatacttctcacgtagcctactctctctagcccccttcctcaacccgtgcacctactccctccgtcccaaaacaattcaacctaggatgggatgtgaccctttctacgacaacgaatctagataagcctttattcagcttcgttatcctaagatgggttattttgagatggagggagtatttcagatatgcaagaaaaaaatccaaaaaaaaagttgggtttaggtgccacctactgagcttattgggtctatgaggcaaatttggtctctttggctaggaataagttcactataggtccctcaatctatcgccgagtttgcaattcatccctgaaccaaataccagatataatgggtccctaaacttacaaaatcgaatcactcgaggtcctaagcaatattatattcggtttgttttttttttcttaagggctcattagatatgccatcttttacaagagggcccaggtaaattaaaaaaaaattgagggttatgtaaccaatcaattcaatgtatttacaataaggaaaattatataaaatttactatagttggattaaatatgtgttcaattgttttgataagctaggaatttggcttttgactagttattaaaaagtaatttgtgtactagttattaaatatattaatgtataaaaaaacttgacgtaatatatatattcctgtagatgttaattaatacatatctggtgtgtaaatacgtaggtgagatcccggcagtttgacgagatgcgcaccttctaccgcagaatcgccgacgccgaaaaggctcaagccgacgccacggcagctgcagcagatcatcatcgctgagttattaattaacaattaacgtcagcctagacctctacatcatatatatcgtctcggatgatcaaattaaccagatttagttacaaagaggcaggttctttggggggcaaaattaactaggctcacgagagcacatatgaactagtttagtatacatggcatggttaatttgaaagttaaaaaaacatttgacagccaaagagataatgtgagcactttaattgagaaatcgaatatgggatcatggggttaaaactgcaccctacagtaccaaatatacatctcaagccaaatagtactaaaaacgacttcaattgatttgcattgattgcctcaaaagaaatttgtgttgattcaattcttcctctagctaccttctctttttctcctcttttaatttgactcattgcgtacgtgttgactttatgttgattaagctaggtctcgtttaatttctgtaataaatcagttgaacttctggtgtagtaatatatagtatctacacaatattggtcggttcataatataatattatattgtttgttgttgtcaataacatactccctccgtcccaaaaaaagacaaaccctagtttccgtgtccaacgtttgactgtccgtcttatttaaaaaaattatgaaaaaaattaaaaagacaagtcacgcataaaatattaatcatgttttatcatctaacaataatgaaaatacgaattataaaaaaatttcatataagacggacagtcaaagttgaacatgaaaacctagggtttatctttttttttttgggacgaagggagtatggagtatggcttaatttgtcaacatgtacatgcatggctacgtgtcgagagaaaggaaaagcatgcttgtggagagaaattgcttctgctatagctagcacttcatatttgacttcagagcatatatagtaatcttcaggtttatagactaaagtatagttaaattcatggctttctaggcgacggctgactaattaaactaggccggccggtttccgaaccaggcaagttgtgtactatatatactagtagtactaattgaccgattaattcattggttcacagagattgagtacatatatatgcttgataccgatgaaatcgatggtatatagcagcagactcaacggccggattcaattataaaatcgacattatgttcattgtatttcatgctgagatcgatgatggctttttccaataatcaatcatatatgtgtgtatgttgaccttggagcctgtgctggtcaatgccaacgatatggttgatcggactggatttaatttgtcgcttgcttaatttcaccctaattaaacgaaaccctcatatatagtttcatcatcaaaatccgcaagtgcgtgcagcatgcatgttaagacacagagaaatcaacgtctgagtgcattgattgagtctaacctactccctccgttccgaaaaacccaacctagaaagagatgtaagagatgtaacctttatagtacaacgaatctggacaaactatagtaggaggggtcggttgggtttttttggacagagtactctcttcttcttaaatatgttctataatctagtatgaaatgtgacacattctataggcttctatctagatttgcaatatcataatttgtatcacattttatattagattaatttattctgtgacagaagtagtacaaatgactagatcttaattaatgtgcacatttgcgagtggtgacctatctaatcaatttaaccaccttggcaccttcacatgaaaaaaattaaccaccttggtttatctgaaaaataagcattataccctagctatagatggccaaatgggccgcctacatggtccggcccaaacacaactaaggcacggttcaagatcagttgagcccgcatggcccgactgacacgtcgtgttatgcccgctcatgggctgcacctatgttctaggcatgacgagcaaaacccactgtgctcgtccttggaataattatatttcgcctccctcatctctttatgccgtgccttatatatgactggaataagtctatttacctcccttatctctttgagtcggccgccaacggactacagcctgcaggagcgggggatgtcgggctgcggttgtgctgatcgttgggtcatgccgtgccgaggaagagtcccaggtacaatccaacggccgggttgggccgtgctgtgtttgggttgggccaaatctctgtgtcggacgtaagtcgggccgtcggggtacgagcctttggcgaactggctttaatttgtatgcatttttcctaagctaataaagtcaatcttacctgaaaatttaatttaacaaagaaaaccctgatacacagtaggttccattcgctgcggctggcgggctgcagcagcaagctagcacatacggtttttcttttctttttcttttttttcatttgctgctgcagcatagccacagcgctgtcaaagattgggctcccaacaaacgcataaatacccacactgccacacagacgcaaaaacaaatatactacatttgtcctaagttcaacatttcaatatttataaattcatatagtttaacatcataagttttatattctcaaaacttgtcgtgagaaatgctttcttaatattcagttcatatgttgttaaactatacaagtttctaagaattaatggtttggtatagaaatatttgatttgggataaacctaaaatgatgtactaccataataaaaatgtccagtaccattaggttggaaagaaagtgagcttagagcacaaccaaattaatctaactagtgttgatttttttttaaaaaaaattgctagtgttactaaatttctagtgtgtactatagtagtatatactaacagttagcagaagcaatagttaaactgctcacagttgtgtacatcaaatttgtattagtgtacattaaatctcacgctagtacttgatggactctcattctgtcgtgcttaatacagcaacaaataaagtcaataagcgtaagcgatgaagaaaatggatggtgtggcagagatattaagcaggaagaacacacaacggctcttcttcaattcggagatgagaatcagacagacaccaccgagatcgacgcgatgaagacgatcgatcgccgacggcagccgtagccgccgccgccccctaagccggccgccggagcagccgcctccatcccctcgcgaaccgccggccgtacgtgcaaccttcggtatccaaatttacagttttaaaaaacctacgcacttttttattcaacagttatatactctcaattttaattagcacaccactgcttaagtcgttggtaggactaggagatccttttcattaaactagtggatttcccgcgtaaatttcttggagccttgattttcaaagcagaataggattcgatatacaacttttagtttatgtttttcgtttgtacagttgtagccttttatatacagtaggattttaaagatatacatgtattgggtgtacaatactttttttttcctcatatgtagtgtgcaactgtattttatatacaactttatcaatcaatttgtacggttataatctaaactcacaatgaccaaatggtgtatatcttttttattctctgatatgattaacctggtaatttctacacctccaaaacagagatggcggcttctttttttagctatcttagtaatacagtataatataagagaaattttacagtacttaagaaagtaactggaggtatcaacttttacactacaaatgtcatacattctcaaggatgataaaaattacccataacataagtatgataatagatacaaggtagataaaactaggtggtgtttggatccagagactaattagaagtattaaacgtcggatgtttgaacactaattagaagtattaaacgtagactaataataaaactaattgcataaatgtgagctaattcgcgagacaaattttttaagcctaattaatccataattagcacatgtttactgtagcatcacataggctaatcatgtattaattaggctcaatagattcgtctcgcgaattagttcagggttgtggaatgagttttgtcattagtctacgtttaatacttctaattagtgtccaaacatccgatatgacagggaataaaattttagtccctgatccaaacaccattgtttctgttactggtagggaccgctgtaaccattgtcaaaagttaatctagagaagtataataatataatacgtgcagaccttgagagcaatgctggccttactttgtgtgcaaacttgctagctagcataccttatgaaacaagttgcagagtagctagattgtaggatcgggagtcagctgctttgagtgcaagtgtaaggaactcaactccatacttcccctgcataagttagccggattctactctatcaatcatgttattttagttatccctttatttcacaaccaaatcaaggctaaacagcagtccaagcagagtagcttagccagccagcataacaagtcatatataggtcagtcggtgcttaattttcatcctctttgcatacctgcacccgtgtacaggacgtcaattctgtttgtgcctgtaagtctgcagctccttcttgttttccttcttgtgtgtactgctgccattgcctgaatgttgtttggttgctcctctgaaacatgggttttttacagttcagttgggtcactgaagagtaaaagaccttgttagcagacagcgaacgcaaactgcgctgtttaatttacttgcagttctcaagagaaataatgtgagctcttaccactctcttttcttgatgttttcatcttttcctaaggactaactaggtgtactaactaacatttgagatgatcttgttagtaaacagtgagaatgagagcaaaccccattgtgaccgcattatctgcggcggtatttggattcttcattggcatttcttttccagtacagatcacaccacaggtaatagatagatacagtatgtactatttatgatatctgtttttgcccatgaaatttgagagatgatctttatctgatgaatcaatgagtctccttttgtgtgatgcatgcagcttcagtgtggcttattaccttgcagcagtggtgatggtgcgaactacagctttagtggcagcagcatgataggcatactgtggtcaccattcagaaacaccactatcctgtcaaatggcacttcagaggtaaaatttgagagcttctagtttctcagctggtagtagataaactcattatcttctgttgtttgatggttttagaatcctgcgttgacaaagccgaaaggtgcagagaagctaccaccaggattagtagttacagagtctgatcttcacatgagacggctgtggggatcaccaagggaggtaggcagctctctgaactctgattctggtttgttaacttaaatatggacagtaaagttgatataagagcttcatatatgtgtttgtgcactgatcgatcatcaggacgtggcgactggcaagtaccttttggcactcgcggtgggatactctgagaaagccaatgtgaatgcaactgttctcaaggtaaaaggaattaagattcaggaagaggcaggaaatcatctctctgaatgtttttcttgcttctggtagctagcactgcatctctgaactgaacatgtggcgtttggatgttcagtttctgaactttaccatatgtcgtcagctgtaaactttaatctcagaagtgaacaatgtgcagttctctgataagttcgacgtggttctgttccactacgacgggcgcacgactgaatgggatgacttggagtggtcgaagcaggctgttcacgtcagcgccaagaagcagaccaaatggtgagcactgagcagcagcattatgcttacagtagtactccaatctgtagctgatgggctaatgacaaatgattgatcgaaggtggtttgcaaagaggttcctgcatccgagcatcgtggcgccatacgaatacatcttcttgtgggacgaggatctgggagtcgacaacttcaccgcggaagagtacgtgtgtgtctggtttctgaactctgaattttgcttattggagctgatcaagtaatgtgttgtggcctttgaacaaccaaccaaccaacaaatcgatcggaaacacataggtacgtgaaggtggcgaagaagaatgggttggagatatcgcagccaggattggacagcacaagagggaagaagacgtatgaagtcaccgttcgaagaaacgacggccgggaaatgcacaagtaagtaaagcagctgaaaacgaaccatggaaatcgatctgaagaaattcaggctcttgttacttcagtagagacactgactgacgcagacagtttgtgtgtggtaaaatttggaacaggacgaatgagggagggcgttgccctgatgtgcaccaacgaccctgcagcgggtgacatgaatttcctcttactccactactactgtcttatttggtctctgaaactcctcgagtctgaaagacataacgatcgacacgcaggttcgtggaggtgatggcgcccgtcttctccagggaagcctggacatgcgtctggcacatgattcaggcaagtatatattaattcattcacaattatttctcactaacacttaatttcaaccaaaagtaaacgagccaatggaactgtatatgcttataaatatgcagaatgacttggttcatggctggggtctggacttcaatttctggagatgcgtcgacgtaagtactagtacactagtgttcattcagatggtactactactcaaatagcttgctgaagaaataaggttaaacacatgatcatcatgcatgaatggcagaatcctgaagagcagatcggcatcgtggacgcgcagtacgtgtcccatcatggagttcccacgctcattgcccaggttaataaataatttcttcttaactgtaatttgcttgctcgttactgaattcagggtctcctttgtttgtttgtttgtgttactaatcaatttctcgatctctttcttcagggtaacggtgaacaacaaggaagcagcgaaaaggtaactcagtaattctttagttcaatatgaaatgaagcccattctttgcaccaatatgaaatgatacagtaattactactgttgtagtacatagtgcatgcatgttaactgaagaagcattctattagtgtgtgattaattaagtattatctaaagtgttcagttgaagacgtactccctctggttctatattaattgacgttttagacaaggttgaggttaaacttttataactttgaccatcaataattttaaaaatatttagtttaaagaaactagaaaaacatatatagatttgtctttcaaaacactataataaaaataaacatgcatttatttattgtatatattataatagaaaaacaatgtcaaaggtatatcttgtagagcgtgttattgttcaaagcatcaattaaaatgaaaccggagggagtaatcgatgatgttaattacgtgcgtgcgtgcaggttcgagcccgacaatgggcggagatgcgcaccttccacgacagaatttccaacgccgaaaagaagcttggggattcgtcgcaggcactagaagagtatcacccttgaacttggacatatgcaaccaccaacacttaattgtttgcatagttcagcactggcatcacatgcatctttttttcccaaatgaaattaagcgagaatatatatatatagagagagagagagatggaggcatatatccctagctatatatatacgcgtacatgctgaagactgcgtgaagaattgaagagatattaccaaattaactgcacacacttccttttcatcattgattcttcccgccatttttttttgtgaattatctatggtcactgaccgatcatgtatgaattatcacgcgtttgtatacttttcatggtcaatttctctgaaagagatacacacagatatcttaaagatggtgaaattgttgtatttttatgtgtcgacgtttgagaccataactacagtatttacatggtatgagaatcgttggtactagggtatatataagattgagataaaagagacaaagaaaaggattttttttatatatgttcggaccccttcatcggaaggtaataacctaatcctgttggccgaagccagtattggtcttatttatcagaatcacacaagtacaatacttaggataatcaatctagtcatcatcgacttggcgacatagaacaccaacacgtagtcaacaatggggtaatcttccttctcgaatacgtactcggcgatatcagagatagcgttagatccatcttatcggcatgacaccagattggatctgtctagggtaatctaatatctgatgtcaatgtctggtggcgtgtattggtatctattctaactgagcttgttgatttattcgggtttgtcctcccctccctaaagggtcttgtatttatacccatatatatcaccttgtccaaatagaattagagagacaagtataaatacaattcgagtagtatttataattttcatgtggaactctgcttgtcatttcttatccgaaacttcttctatatacgaggtatgattctgtataaaacttggtatataatgggtcctgccgagcttaattgattattattgtatatgtgttattcataaccctaacaatggggagcccattaattgaagaaattaaggtgataaatgttgagcctttaatcctactgctttgtagtattgtgtagtgtgagtagcgtggcatcacattcacaaaccatcagctagctgattagaattttagggcccctttgaatcaaaggaattacgaagaaatttcataggattgaaatcctataggaaatttcctatgtagctctttgattcaaaggattgaagttttccaaatcctacaaaattcatatggaatggcttatagcatataggttttggaggaaacttagcaagagttccaacctcttggaaaaaatccttcgattctatctcatccgattcctatgtttttcctatggtccaatcaaacgatcattcctgtgtttttcctgtgtttttgtagcgcccgttccgtcgtggcgcctagcgggaaaactatctcttaaaaaccctaattgcgaaatctgtttctttgcttgttgtctagtgtccgtgtcatctcagatctcaaatccccgatctatcgtcaagttcaatcccgaatccaaatccttcccaaatcaaatccctccccaaaagtctattttgcctccctcgggttcgatgggccgaactcctctcggcccatctctccctccctccccatctctccctctctctctctccccgctctgcccgcgcgccgcgcgtgcgtgcgcgtgagccgcgccgagccgagccctccctctccgctctcgctgcccgagccgcgccgcccattgcttcccgcgcacgcgtgccgtggtggccgaccgcctagtcgtcgccgccgtcaccctctgccgcgcctgtccgcgcctgccgtccgtgtcgccgctccgctccacaccgcccggccgtcatcgccgtcgtcatcgactcgaccccgcctctccccgcgcgtgcttccaaggaaaggaggcagggctcctcctcatcgccctctctccctcctccttttcccaaagtggcaagggggcaagccccctttctctcccccctttctcccttttctctcccgccggcgtcatcctcctccccccctgtcgccgtttgggccgcgaccgccgagcgctagccctctcccttgaccgccctaggtcggttcccaaaccgacattgtcgcccctataaacccaagctcctccctcctccatttcctcccccccccctcgttttcatctctcgccgccacaccctgtcgcccctgttccgtcgtcgccgttcgtcgtcgtgcgtgtcggaggagccggcacgagcaaggacgcggaagcggactccgggcgtgccctcttcttcctcttccccggcccgaggccggagagatcactcccgtgccgtcggcctctcgtcactgcgccccgtcccgcatggtagtgcatccctccgttctccctcctcgctccatctcttccccttagctttgagtagccgctcgagtagtaccccagtagctagctggcgccgccccgactgctgccgtcgctcgccgtgtgctcgccgccgtcgccgcccgagctcggaagcgtctctcgtcgccggcctccctcgatgcgtttcctcctaatccggcgcaagagatgggttcccgtatccgcgtagatgctctcaccgccgggaatcggcccctcgtgacctcgtcgccgtttcccccttttctctccgtcggttgccaccgccgcaatccgccgccgacgaactcccttcggcgaatccaagccgttggcttgctccctctcgttctccctcgtcatcccggtgtacaccccgtcgcccctcgtcgtcgcacggcgttccggagaaaccgccgccgcccgccgtccattcgcggccggcaccttcgtcttcctccagccggcctgcgtggcagccacgtaggcgccacatcggagccacctcgacacgaccggatcggctgacccggccagccgctccctccgttcccccccggtgcgcatggtccgcagtgagccgtgaggctgcgcatgggcccgccgcaccgcgtcctccgcgaaccgtgcgcatgcgccgcgcctccctccccaaaccctagcacgccccgcgtgcacctcgctcacgatgagccgagtcgccgacaagcgggtcccacccgagaccacgcgggatggacccggcccaccggctctctctctctctctcctccccgcccgcgcgcgcgctttgggccgccttcttgggccggccggcccattaagctcggccgggccgcccctttctctcgggccgcgccctagccgcccgaggaaagtctaatttccctccctccttcttttcttttcttttctttttcaaaaaggatttaaataaatccttttcctttagaccaaaaatccaataatcttagaaattcaatatcttcccaaccgtaagtccgtttgactccgttcaacttccaaaattcctcaaatctcgagatctatttaatggcacacttagaggtcaataatagggctttattttcgccgttggcttagttgtcccgtttcgcgtgtagtttcggagcccgaagacccgcagtgcgaggatttcgaggatcaagctcaagatctcgagcgaggcaagccacctttgaacatcttgagcctatatttgaacttaattatgttgcttgaaaaatattatgcattgataggattgcacttaatctgcttgtcccgtctgcaaggcagattggcggacctacctaacttgttgcatttgacccttccattgtaattgttataccatgttcccttgtaaccgcctagttgcgcctcagtaatcgtgcactctgcacgagtatcgacggtcgccttcaaacttaaaatctgagaaacatcttgggtaaaacttgggttttacaaaagatttggaaaacccgacacctgggtcggtgcttgcgaacctaaatgaatttccaaaatcgcggaccggggaacgtaccgggtgtatggtttcccgctcttgcacttaaggaccgtttccttggaatttcatccgaacataagacaagtacgaccacatgggtggaatgggacacccctggctgagtaactagctaatcgggggagccatgatgccaagagacatgtggattcaacgggatggtgtcggggaggacccccgggtttcctggcacagtatggtctgggacctaatctggtgttggtctgggacccctctcattggcatatggtgaacctgtgtcggcttttgaaatgccttgtcataaaagccttaaggtctctagtcgtggctgttctgcacgggctggatgatccgggttagtaatgtcgtgtgggtaaagtgtaccctctctgcagaggttattaaactgttcgaacagccgtgcccacggtcatgggcggatgtgaggtgattcctagcgtagttttgtttgactactgcttgtgaaatttgctgatgtggtttgggttcgatgtttggaaaacctgcggctgatgggatcagccaggcccgggtggccgtttaaaagccgttggccgggtgccaaccttgatcaattcaaaagactgataccttgcacatactccgaccggacaagacgcactgtctcatccgtgtcgtttgagaagcactcacttagttgtttcagaaaagagtttaaataaaatcaattgcaaaaacaacagcctttccttgaagcctgcattaaacacttatttcccatggcttgctgagtactcccgtgctcacccttgctctatataaataatcccccccagttgctgaagaagatgaagcggatcccgctgacgaggagttcttccaggagtaagccggctacgatgagttttagggtttcggcctagttcccaagtcgcgcctgtgatgtctggcccaagtcttggcttccgctttccttttgtaatgcagttgtgagctcgggatctgtccgcagcccaacatgactgtaatcctactctataataaagagacctctattgctgtgatattctgtcttcctgtgataccagcactgttacctgggactggtatcgattaacaggttaatttggagcgtcatgggctagttccgctcgggactagttcggaacgtgacagttttgcaatcctctgttttacacttacatttctatcagaatcctatgttttttctattcctctgtttttttattcctataattcaaagagacccttagtgcctgtttgtttcctcttcgcctttgcatggaggaatacttttaccacccttgcagacaacgtaccacagattccacacaatattgatcatctctctctctctctctctctctctctctctctctctctttctctttagttaattatattaggacctacctggattaattagtttgataaagtcgtaattgtaatacagcatgcatgcagctgctggtatatatatatcgcccccatagatcatattgataacgcacaacaaaacaaagatagaaacaaagtgctgttgaattaattgataaaagagtactagcacgcagtaacaatataacgacgtggaatagctcctgttctacgaagaccacactaacttgctctgaccatgactgccgtgtcctacacattaatccaagctataattacttgattcttaatttgcttacaattccttcaactactaattaagtatatcaatatattgccggcacaattcgcacatatactatatatctagtctaatggaattagtggagtatagaaatgcttgggaactttctcaagtctttcatgcatgcagatatatattctctatagataatatgctccggatatgcaatggagtccggaccaaaagtgtggatgcatgcttaattggttcgttagttagttatcttcaatcgtatcgatcgatcgcatcaaaatagggatatcatatatcgatcggatcgatcttgatttttttttcctctcttcatccatcgccgccatgcaggcgcgccggcggcacgccaggcagtgccgtctggtcgtcgccggcctcatcatcgtcaccacgctcctcttcttcaccggcgacgcccctcgcgtcttcatcgacgcgcccacgcagaaccagctgccgcgccgcctgccgctcagcctcgccgccgtccgggaggccgccacatggcccgccgacgccgtcctgctcccggactgggaggtcctcctgctcctgcatcccaacgccaccgccatcgcccacaacgccacctgcgcgttccagggcgccgcgtcgtcccccgcgcgcgcgctcgggaggctgccgtcctcgggccgccacgcctacacctgcgccatgccggagccggcgcgccgccaccagccgttccacgcgccgcggatcgtggctatggacgccgtccatgcctcaccgcatgatgatgatgagctggtgatgatggtcaagtggagcggccgcctcgtgtacgactcggtcgtggtcgacggcggcgacgtgctcgtcttcgccaagggcgtcaacccacgccagggagtcaaccgcccggcctcggacgtaaggtgcgtctactaccgcggccgcggcggcagcgccgacgacgtggtggcgtcgctccccgcagccacgtcggcgcagcaggtgttccggtgcccgcctccgccaccagcagcgttgctacgcgtgacgctcgccctcgccggcgaggaggagcccatcccctcggtggcgacctacagtctgcctccagcatcggcggcggcgacgcacaagagacgacataaaatctgcgcgtgcaccatggtgcgcgacgtgggcaagttcgtgcgggagtgggtggcgtaccacgcggcggtgggcgtgggccgattcatcctctacgacaacggcagcgaggacgacctagacgagcaggtgcggcgtctcacggcggagggcatggacgtcaccacgctggcctggccgtggcccaagacgcaggaggccggcttctcccacagcgcggcggtgcaccgagacgcgtgcgagtggatggcgttcatcgacgtggacgagttcatcttctcccccaactgggccaccgccgcctccccatccagctccatgctccggtcgatcgtcgccgtgaagccggacgtgggacaggtgtcgctcgggtgcgtggacttcgggccgtcggggagaaccacccacccgccggagggggtgacgcaggggtacacgtgccggcggcgagcggtggagcggcacaagtcgctgctccggctggaggcggcggagaggtcgctggtgaactcggtgcaccacttcgagctccgggaggggaagcgcggcgagtggaatcggcgggcgcgggtgaaccactacaagttccaggcgtgggacgagttccgcctcaagttccgccgccgggtctctgcctacgtggcagactggacccaccgggtcaacctccagtcaaaggaccggacgcccggtctgggcttcgacccggtccaaccggccggttgggccgccaagttctgcgaggtgaacgacacgctgctccgggacgtcacgcggcggtggttcgccgccgccggcgagagtcagctccaagcagcccgttgatcgatcgtgcgcgattaggagatcgatgatgatgcttcattattagcgcgctacaggtatattacatgcatacaacagacaattaattaaagattgattaggtttgagttgatcgaacaactcaatcgttgattcgttcatccatttttcctttttgttggttgtttttggcatgtatatatacagttggctaaaaaaattttcttcccaaaggaaataatatatatgtagcttagctgtagagattaaattaacacgcatggttatgaactgtatgcgttacagcaggctgaattcttttcttgctgcaacaggcaagttaagtatagacgcagggtacaaaaggtctctcaaacgttgaatatacacttcattcatttgtttatatgctcaaatctcatccgctatatatgtatatatatatacgtatacgtatatacatatatacgtatacgcgtgtgtgtatgtatatgtatgtatgtatgtatacatagatatacatatatatatatatatatatatatatatatatatatatatatatatattctattaatcctagtggacttaggaacaggaaagagaaaaagatatggagaaggtactgtgaaaaacgaaggagaaagagaaagaccagctagggcagcaggaaaatgcccccctgatagagaagaattttcatataactatataccaggacaatataggcacatgggtactaagagaagagactttgagaagcctgttaaatttcaaaaccagaggagtgatggtgctatattaaatttagccgcacatgaccctattgattggcctaatattattaatatttggaaatgtttaatagttcaaaaatatatacaaaaccagcacaatataggaagtaaagttgaagatatgataacctacttagaaacatttttaggtgaatctgctaaggttctatgggaacaattggttgaaaagaatcctaataattatgaagaattgaaaagagctggtagcaatccgcataattttgcaaatgttatatctaacattattatagctgaagatccggaattaggttatacaactttgtagaatgaaagattaaaagaaatagaaaaattaacgttaacaagttggaaaggcataaaagaattctcccaacattatttatataatgctacaactgctaaacaaggatataacaggggaatagttgaacgttatttcaataaattacctgacccactaggaagtatgatatttgaagaatataaaaaggaaactgaaggagctgaaatcaacatctcgcaagccataacttttgtgtttaagcaactaagaaaaatatgcacgggtatccaagtctaaagatctatgaaacactcggattacaatttctgcaataaaatagttcaaatacccttgtcatatggagaagacaagcctagaagtaaaatgatttataaacatcaaaatagaaacaacaacaacgaagacaccattcagagcaaagcttccaagcgcgctctcaccctccattccaccgttcttagtagtagtgactttagcctaccttgcatagtatattgaagcaaggagttgtgttataacgctgtgtaaggtaagaacagcttgcttgtacttaccttcgggtttcccgaaagggaaaaccgtatgtaagcttatctgtttaatatgaagtaattttccttaagtattcctgcacgtttgttctaaacaagtgtttatgctaaggaccctataggagaaacctctttggtttgttctcgtttttagtctgcatcttgcataggcgtctggagaatcggtatccgtagagaagtgttcccttctggtggaactgcctggggagacgataaactcttagctagaacaagtgtgacttggaatatctttttaagttgcttctaaaaagacagataggtaaggcatacggtgagtaccgagtaggactttacatcatctgaaacaagcttctgaggctgtctaagtaggattcgccaccctgcaaagatcctaaagttaaaatatctctcgaagtgaacagtattgaacagtaatttgaacagtaaactgaatagtaatcagccgaataaatagtgttcttgaaatattgtatattgtctgaagtatagttatatatatatatgtgtgtgtgtgtatgtatatgtgtatgtgtatgtatatatatatatgtatatgtgtatgtgtatatatatatatatatatgtatatgtgtgtgtgtatatatatatatgtatatatatatatatatgtatatatatatatatatgtatatatatatatgtatatatgtatgtatgtatatatatatatatatatgatacccatatgggactccatggtgcccaggctccaaggtataaaacacacaaattctctcaaatttttaaaaattttcaaattgtgagtatatacctaggtatatgaatttgattcatacatatacctaacaacaaaacaactcaaactcaactttatttcacaattcattattacatacctaacgaattatatgtttgaatgttatatacctagaaccaaaatctaaccaaaaaaagttcaaactcagttcaaacttgtttgaacttgttagtaaagaagttaatgttcatatctaaatattttttaaaaaattcatgctcattcaaattgggtatatactcaatttgaatcttggagcccatactccatgtagcaccagttaatttacctatatatatatatatatatatatatatatgtgtgtgtgtgtgtgtgtgtgcgcgcgcgcgcgcgcgcgcgcgcttgtacctcgtgctttggtttaggatgagttgtactaatttggcagcaaataatttgggaatttttgtgttgtggtgtagttatactgtaatcacattaaaaatctcttacatgtgaatatgtttctatctctcctgctccctctgttccaatatacttgcattcaacctttttaatcaaaatgtatgatttctacattctaaagcaattttagaggtgactatgtattactccacaatacaacttttatgtttgatttgaaaaaatattgctacaccttatttgccacgagattttctacagtgccaagtaaatttaaaagtaaaataaaacctgtaggggtgatatgaattactaggtccttaaaaatattgcacgtttatggcctgttcagattgtagccaaaataaaccttaccgaattttggataccaaaatttttccgatttggcaatattgccaagatttcttatttatttatcagaatttggtaagaaaataaatagatggacatatttggtaactttactcaaaaaataatatagtttaaaatgacattaatctgaacaagcccttagatctgtaaactcaaaaagggccatataagtgcaaaaaggcaactgaaaagtgaaaaggtccatatgtagagcccgattatactagactggtccaagtgtgcgtgttccgatgaagagaggagcccacacgataccggcctgttttaagtctaatattgggcctagtagccttatgctaggatggaatataatatgggcttttcggcctgcaacatttgttggtaatcgtaggcccatcccattggactgacagacatatagacatatcagtaatcagtagtctactagagtattaatttggatttgtttgccaacaaaactttgtggtaattcttgagaggcttatttgtgttgtttttttgttgagtgtgcttaattgatatatgatgcacacaggccggattaagtcatcttatttttacaacaatgaaagatgtactactgtctgtgcttttgatgcagacttcttgacgtgtgaatgagagattaggaagaccattccatgacaacattgctgaaggatacaaatagaagccgtgtatatgaaaaaatgacagtatgtacattgattagtatagcaaaaacgtagcattgtgctatggtttttgtgtttcatgcggctaatgtagatgctcactgcgctagtagtaaggtactccagtacattatggaatatacaaagctgtaatactcgtatcagcaagagagaggcacacaagttgtagcagtagcacaggattagaaaaacgggacgacaaatagtaatggaaaaacaaaaaaaaacaaggaaacacatggcaatataaatggagaaatcacaagaggaacagaatccgggcaatacgctgcgaaagtactcgtacgtaaaaaaaagaggcgcattcatgtgtggacagcgtgcagcagaagcagggatttgaaaccactcaaatccaccactgcaaaccttcaaacgaggccatggtttgaagcatagaaagcacaggtaagaagcacaacgccctcgctctccaccctcccacccaatcgcgacgcacctcgcggatcggtgacgtggcctcgccccccaaaaatatcccgcggcgtgaagctgacaccccgggcccacccacctgtcacgttggcacatgttggttatggttcccggccgcaccaaaatatcaacgcggcgcggcccaaaatttccaaaatcccgcccaagcccctggcgcgtgccgctcttccacccaggtccctctcgtaatccataatggcgtgtgtaccctcggctggttgtacgtgggcgggttaccctgggggtgtgggtggatgacgggtgggcccggaggaggtccggccccgcgcgtcatcgcggggcggggtgtagcgggtgcgaaaaggaggcgatcggtacgaaaattcaaattaggaggtggggggcggggcccttggagaataagcggaatcgcagatatgcccctgacttggcttggctcctcttcttcttatcccttgtcctcgcaaccccgcttccttctctcctctcctcttctcttctcttctctggtggtgtgggtgtgtccctgtctcccctctccttcctcctctcctttcccctcctctcttcccccctctcacaagagagagagcgccagactctccccaggtgaggtgagaccagtctttttgctcgattcgacgcgcctttcacgccgcctcgcgcggatctgaccgcttccctcgcccttctcgcaggattcagccatgaagggggccaaatccaagggcgccgccaagcccgacgccaagtaataatcaatctattctcatctccctttaacatctctattctatgttcacgccgtcgcagatctgttgattttcgccgccgcagattagattttgacttgatttttgttggttgcaggttggctgtgaagagtaagggcgcggagaagcccgccgccaagggcaggaaggggaaggccggcaaggaccccaacaagcccaagagggctccctccgctttcttcgtttttatgtcagaccacttccccgattttcttctgccttcttttttttttttggaggggattttcgtttgatcttgtttcgctcagggaggagttccgtaaggagttcaaggagaagaaccccaagaataaatctgtcgctgctgtaagtttttcttttttgtttcccctctcgttcgtaaataaaaactccactactagagtctctggcttacaattacaattattattattagttgcaccgcttattagatgttgtatcatgattcgtggattttattttttcaaaacaaaaaattcaggtaggaaaagcagccggtgataggtggaaatccctgaccgaagcggtgagtttcgtctcgtcgcacatagagatagtatgatttatttaagtgttagattccttgtgcccaagcttatatgtagccatggctgtttgattctaggacaaggctccctatgtagccaaggccaacaagctcaaggccgagtacaacaaggccattgctgcctacaacaagggcgaggtataaacaactagattaccttgtatgcttgccaccgcgtccaatttgtttattgttctaaacatatgctctggtttgtttgttcagagcactgccaagaaggcacccgccaaggaggaagaggaggacgacgaggaggaatctgacaagtccaagtccgaggtcaatgatgaggatgacgacgagggcagcgaagaggtactacatacataatccttgtgatcaattcagaaaatagtatcgcattagttcgttgtgtgaagcttagctgactatgcctgaggcttgtacgattaggagtacgattcacactttgattaggctaatgcctcatgggtagatatagaacaatagttagtttgagagatgtatacaaataggctaatgtctcatgggtagacagaagaacaaataggtagtttgaaagatgtattttcaagtgtgacattctcaaaacggaaactgatgaaattaaaaatggttttggggattgcaggatgaagacgatgacgagtgagccttccagtggacaagatgggagcagcaagacgctaagggcggcgggcgtcctaaggagcctatccatcatcatcatcgtctactagaattattcagtttcacttcacatcgtgatgttttactttttctctcgtcctataacggatagcgctccttgttggcgccactggtgggtgttgtggtgcagccaatgtcttgtctccaccgtcaatgatccgcttgtacctagattactctttccattgtcatcggctaacattgtgataatatcagtttgcgtatgttagattaaattgtttctaattccgtcgttttcttcttccttgcacttagcttgtgataaaattgctttgcggtaggtaggtactccgctagctaattgtggtcgatcgattgcttgtttgattgcggatcacactagccagtgttgattttaagatttgtttttcttgatgctccttgtctgtgcgcatgttgcctacagtattaataggctttgaaggattagtctgactgaccctccttgagaaaatgagatgagatgagatgtgtatgaacaaggcaacgttgctgtttgtgcattatagtgggggctaccacacgggtttaactccatctttcgagtgagatggagttggttgatgattattgcaaagagagtattgcaagtaatagtagtaatgaaaatgcagtggttgggattttccattttcttaatcggtggttgtggtgttttggtgaaataatagtgagtgaggtacaccagtagaagaggtttcggcaggtctgtgtcctacggattgccgacgtcttctttggtatgatatggtttggcctcgacgaagttgatgctgcctcctactatagatagttgcaggatggttttgaagttgatgtctcctggtccctccctggcctgtgtgttgcatttgcaattttgcattgacgatgcatagcacagcacggaacggaggaggcaatgctgcaggtaggagtaacaacgtagtagggcctctggctggtgatggagtgagcgtccttttgctgctcgaaatttacatcgactgtctggattggtcagcacaggaaggagccgttagatatgtgaaagtgattatgatgagtgaggggactactatacgctcctacggcggattcatttcgtttcgttggccttgtctccatgcaccaatcaatttgacgccgatgtttaaaatactcgtctatttattcaatactccctccgtcccataatttacaaccgaccctagaactacgaatctggacataagggaagtagtaacattatgggacggagggagtagtaccagtacatattactactccctccgtcccataaaaaacgaatctgtcttcgtccgttttctaaccaggatttgaatctaaataaaaagagttaattgaattcatatatcatatcataaatttacatgttttaaaaatactcttattatgtactcgctctctctagtcctaatattgttgacgttttgaaatgagaaaaatcccctgtgtacccttgaaagttcacctaatcccttacgtacccatgaattttagtttggaccccttccatgccctttccgctagttgaccgttaaattcttatgaaaaagtctattttgccctttggtataaacaagcgtataaattaatggagtatattgttggagcatagaaatttgttatatgagactattatgtttataagatagttatgcaccatactatttgcgataaacatacttttagatatgaaataaaaaaataatacttatttattagttattaaaagatttttttagcatatatgttctgaagtaataacaaatctgttatattactatgaaaacacatatgctacataaaagaacttttaataactaataaataagtatcaacctttttatatcatatgtaaaagtaaatctgtcacaaatgatatggtgcatcacatactcataaatatgggctgcagga

SEQ ID NO: 38617 - DNA, 52 bp, Oryza sativa
ggaggatgatgttccactgcagcctccggcacttgccccagtccatgagctt

SEQ ID NO: 38618 - DNA, 478 bp, Oryza sativa
tttgttttatgcggtccctctgatctatatttgtggtctctgtttaattatggtataatcgtgaaccttttttttatttgtctttgtctcattgtgcctttcattttgagggcagctagcccacgggataccgtggaaaagtgatgtcacgggataattaaaacacacgacaaaataaaaatatagcgtcctgcgtccctgttgtcaacgtgaagaggcatgatacctagccggctcctcatggtatcgcacgcttcccttgccggtgttgtgttgcctttgcagctggagaagcacacacctcctcgtcggcgtcggcgccccagagcagcgggagcagcagacaactcccccgctaaatcctcctctttgcccccaccgacagcaacaacaacagaaggagaagagaaacgttgatgagaggaactaaggaagggagaatagaagaggaggcaacgaacgtgtggccaccggtcag

SEQ ID NO: 38619 - DNA, 397 bp, Oryza sativa
taattaggcaaccgtctcgcgggtttagcccggccccctactaccagcttattatatctcgcctccacgtcctcgtcgctcacaacgcgacacactcccaagcacacacacagagcgcgcgcgcgcgcgcccatgcagcagcagcagcagccgcgcatggcggacattgacctcgacgccgtgcgcgccgtccgcgtgctcggccgcggcgccatgggcaccgtgttcctcgtcgccgcggcggcggacgacgccgccggcggcggggcgtgctactacgcgctcaaggtcttcgacaagaggtccgtcgtcgcgtcggcggcgaggcagggggacgcggcgcggcgggcgaggtgggaggtgtcggtgctgtccgggctcgcgcacccgcacctcc

SEQ ID NO: 38620 - DNA, 5565 bp, Oryza sativa
  unsure (1)..(5565): unsure at all n locations
aaaattgtctcatccgacattgtgattgtaatattataaaaaagacatagcatagcaccttaccgactcgaccgcatagcatgggaccatgagaataacaccgacaagaaacttctgctcctgtaaaaagaacacaaatatggcaccaatgagccaaaatagcaagtcaaacacagctccagatatatgaacacaatgcttcaaattgtaaatgttgattgcacctctgggttcttgtaggctgacagatgattgaacagcaagaacagagatagtgaaagcgaggtgatgacaaaaatgccagcggtgattgaagcccaaatagggggcgcatagctcctgaaaactgagtacagctgctctgccaattccattgttctctcttgtctccctcaattctactcaaagtacgccactattagagctaccaatatattgacagcctcctcctgtttcacaatatggttcataaagtatcataattcacaagccccaactgatactggagtcctttattaggaggcagacaccaagaggtaggattatgttcttccaccaaatgcacggtagtattcaactgcaagcacaaaaaagactgaaatttttatgggcaaatcccagatcagaaggaccagcagcaaggacatgccctccatagaaaggagtaccagccgaatttaaatctggagaaaacgaggctcataaattaagcaaaacaaaaatcgcatctttccaatcaaactcctaactttgatgccgccgtgaatcagaaacaaaaaaaaaacgcaaatttctgccgaatttccatcgaaaccaatctattttactgctaatagccctatagagtgccccactgaggagcaaaaggagaatccgcccaaggaggggcaatgaatcgaagaacagatattacggtctgaaacaacacaaacctggaggatcagatttgtgccgcaagagaggagagccaatttatgaagtgaagggaataaaagaaggaagaagccgaagaatccaacgatcaaagttgcgtctggatttggaatatgggatttgggatttggagaggagcaggagttaggagaagaatgtgttgcattctaattatgatctaattagaatttggagaggagcaggagttaggagaagaatatatttggagaggagctttatgatctaattatgcaacacacaatgtgttgcataattagatcattgttgatgagactagaagggtaggtggtggggcggaatcgtagttagcaggcgatttgtgacgagaaattgaagttcagaagtgagaaatctcgtcatgagagaagagagcacttggttccaacattttggagtctatgctgatctgggcccatctttcctttcttgtcccccccccctttttttttcttgctaatctaggtctctaactaactttttccccttatcttactagttacaagcccgtgctaacgctacggtgataattaaaagtgaaacaaccgagtacagaagctttctttctcacaatataatgcaatataaatttctatatatcaagtgcgctgcacaactctaattatgcaacacattgtgagctagtggctgaacaaagaagtaaaaattgcaacaaggtgcacacatctaaatgtaaaacattccacaacatatattttttgcacataaatatttggaaaatgagtggaaacaaaaagaaagagagcagaataaacaccgcgtgctaaaaaatgttgagcttaatggttaagaatatttagctccagaaaaaaatctctacaaagaaccaaaccatagaacaagtcataaaccattttatctgattttaaacttctttcacttcctagaatacatgaagctcctatggtataaatctgattgttctaattgctcctctgtttaagaaatgtatctaaagaacaagatgcaatgtggtgagggacactcaactttcaaatcctggtagtacatctccggaaattagaacaatagtaaaagctcggaaattcagcaatgaactttcaagtctttacagggcatatttcataaattcatagtgatgataaaaaattcagcatatgagcttcatgtattctgggcagaaattcagcactgaacactcatggtataacatttgatatgttcagattgcataatttccatgtacatcaaaattattattaaaggggtaaaaaaaggatccaacaaaatagaaaagaactgctacctgtggcaagtaattttctgttaagatatcagtaagatgtggcaggtaaatgttaaaattgcaaattgtcagttcttgtagcattattgaatagaagtttgtttattgcaaaagtttgagtgagctacttatgagatgtacgaggggaaacatgaaaacaattgttgcttgtactacatcatttcctcgtgcttttagagggtgatgtcaagttgattgttatttgcataagtgaaatgaaattgaagggcattagtggttgagggatatatttgaacaaaccgtaccactctataatctatatattaatcaaacactaatgggatttctgcatatatccttgactttaaatggcagaattcccaatgaaaagaattacaatgcatgaatcaaacaggcaagcctagcacattcatacttttttctattttcgagaaatacgcagaacctacattcagttttgtatgggcgagaagattcaatcctggatataagaaacaatgcatattatgagacaaaactagagtgaagtagacaaatagaatggagaatatgtggatcaggttatttatttattcgggcaaaactgtgtacatggaatattattttagatttggttcctacaggttcaaaagagctcacatagtcaatgatcattctaaatctaaagaacacaatggatctaaacctagggaactgatcacagatgcacgccaattatcagatatgtatgtactccaataagcaggaatatagggtcactgatacactgcaaactagtatttatttcttataaaaaaaccaaagagattgatttgttaggaggatgtatattgtacctgcttggaactggactctgcaagctgaggaatgagacgagggcatggcctgacgaggcttcgcttgatcctgcagcaattccaacctcgaaaaatgatctgaaacctgagtatttttttgtagctggaaacattttaactggtaaattttgtttctcaaactatctaatataaaatatcataaactaaaaagaagtgaaattggggactataaaagtcacaacaagattatgtatgcatgaaaagacacggaagcatattgaaagacttccacagctatgatttgtgtcatgccaacataaatcaacattattaataaaactagtgaatcatcagcacgcaaatacacagatccaaaaagaaaaaaaaagaataccatcgatcaatcaacactcaagttagcattcaccttgagggagatgtgaagatgggcagctaaggagcggaaccacgggcggcggagggaatcgaagatgcaggcaggacgacgatttgcggtgcggggtcccggcggcgagcggcgggagatggaggcgggggaaatcgacgatttgcgctgaaagggggcggcggcagcagggctgaggggatcgacgacggcgattggatttggatggatggggggcggaggaggaggaaccctcccgcgtaggcgtagcgtgctctcgatctgatacgttcgatgattttaatactactttgaactgaactataagaattttctaatatattttacgatattcttataaaaaaatttggtgagtgtttgggaccgaaacaattttatatatctactcttattttttctatgaatctttcatacttaagattgattattattattttactgcacggatagtattgcgagttcaaggtgaaaaatacctatncnncgcggtagggaatagggaatagncntncacgccatataaaattgaatctttaaaaaacatgaagggggattaaaggtgtgtttagtacatgttaaaattggaagtttggttaaaattgaaacggtgtgatggaaaagttgaaagtttatgtgtaggaaaattttcatgtgatggaaaaattggaagtttgaagaaaaagtttggaactaaataaggcctaaaataaaaaataaaaaagatgaattcctgaagcaaaaaattcaagttgaaatatagtgcaaaaggaataatttgaagagaaaaaaaatgacaagaaaaaaaaactgaaaacaagaaactagaaacttcacagtactagtagtacaaaacaaaaaaaatcagagaaaggtgttaataaatcaagagagagatataattcctgaccggcgttggactggcgcagccgcggcgattggagtggaggggcgttcccctccggcgacgattgcttggggagacggagattaatcgatccaagtattgtttattaactcgtgttgtgccgtgtttttttttccctttaataaattggcctaattgtactgtacctttcgttctcttacctaaatctgatggcctgttccagaactctccagttctctcattcatcttcttgtttttcttttctcatagccatggccatttatgaattatgacagaaaattaatcagattatccattggattggattgtttatcacattaaagaaaagtaatcagatccgcagttaacttatcccatcatatcagttcttctggcaaagtgcgtgtaccgaatgtcagctataccggatagtcaacttcagagctcattcacatacttcagttcaggaactaatacagttattacaagtcccataaaaacaccaacaggcgtcaggccgcttcattcagttcattacactgatcggcaaatggtcagaaagttttgcaaaatgaaagtgcttctgccaaacttcatatgttttcctgccttttctggttgatcagacattcaaactcatcaggatacaccaacaaaattgtgtcctaaactcctcaagttactgttctgggtttcaactgtctagagcttaggaaaatgttcaggtttgttatgctccacattgaatcaagaaaagtacccccaatcatttttagtgcaaatctgagcatcggtagaatatagtggagcattttatgtgaatccaattgacaacactgcatattgtcatcaattgaaaaccatgcctgcttcaacctcaagcagctttctccaagccaaaagcaaggcaaattttgggcacaaagagttcagaattgaatttctctaacaaactggtgcaaagagaagtttactcatagaacataaccaaaaacatggtaaaatggcacagaccacagtagaggtagactcaactcaagatgattgaacaggcaattcaattaatgtttattggcaaattgcatgtgccacagaacaaatgaagaataattctcttaaatacaacatgaaatcaagttccaacagatttaattggaagcaacctaaaacatccaaacgcagatcaatgtct

SEQ ID NO: 38621 - DNA, 2201 bp, Oryza sativa
atttcatcaaagcagccggcctctatatatacacccctcattccctctttccatggaagtagttagagtgtgtatagtgagccaatcagttacagtgccacgctcttgagcaagaagacggcgggctccgattttgcggcgcaaccatacctaaatgtgctgtactttctatgaactccagtaagcttcccatgtcctgctttttggtggagctcaaccatcatcttggagcactccctgcaaggcaaagataacaaaataactgtcagtacaagaggacagttttagtttatatggtactgaaatgcaggaattggggacagttttggtacatcagctgttcttcagagtattttgtatgcagctcacagcatttgttccaggacttgaacccattaatggtgcactgagcagtgtagatggcagcagccgccagcattgacggctggaatttgagcatctcatactcgacaaggctcagctcaattatgaagaaagacatgagctcaagctgtttcagtaggcacttgggtcagacaatgcactcacatagcaaagctactgtatatcaatacaaagatggatgcaccagtgtgtttttgtcctaccttcttgtcagattgtgcagccttgaggaaccttctcatgaaacagtatggagttggaactgacatatcaaactgaagagtgtttacaatcatcctctcctgcacaaatacaaatgacactttcacttctctgaacatatatcgatcgctctggaaaaaaacaggtacagtattcttcttaccatttcgagaatatctgttcttgtgtaggcgcggtcgcagattaggataagatcctccactacaggaacgctcacttcttcatacttgcaggcgagcagcatggcagtcacgccaaccaactgaagcttctttcgcaccacattttcgcgagccaagaatcggtctatgatattcacagtaaggaagagggtctcatccaatagctctaacttgtaatgcacctgcattggtcaagttattgtcagaaactaagaattcccaaaccacatgatgaatatgctgaatgaaatacttgcctctatcagccaatcgatgagaatgccgcgcatcttctcatttatgtcattttggctcaacatgtaattaggagagacacagctcaaaccctgtgcacacagaatttgcaatgagattgattacccaggtaacacatcaaaacaacttctcaggttccacaaaaaagttacctcactcctcctgtagaagctgtaaatttcatcaacatattcaactactgcaagggagttatttgcatcacagctgtcaatatcaggtgctgcctcctcaatgtcttccatctcaatttctttcagttcagaacccatctgaaataacaagttggactgctgattagtgatgaatcctacctaccaagtgctaattgctaaataatgcattccaagtatatcatgtcatttaccacttcgtccatctcagacatcattggcaatggcaaatcatcagatgtgatcttggtgcactccatatctgctggaccatgaaatgcagaatctgctgtccttttttgcctctcacttccaatgggtgcctgccacaataaagacagcttcttcagactactagtatttgttcaaagcagctcacagaattgttgttctgctatgcatctgtaaatttactagttatggaatatgtaaatagaagtcagaaaactgtaggcgttaagtcctagagctgtcattcgaactaaattctacatcactggattaaattagaagatgcagtgtacaggcaacattaatatctcatttgcaactttccgatttaccatttcgagtttctgcatgtaaatctgaataaccacatgtactaattcaaagttaaacaaaatcaaatagaaagagcacagcattttcagagcatatcaaaacaacagcaaacctaaagaacaattaggaaagcattggatatatgatggggaagttgacatatcagaacagcagcagtatcaatatagcaacaactttaatatggctttcatgagtaattaccaggggagcactggagggttggtttgccagtgttgcagcaaatttcctgtcaaaaaatcaaacttatcacaaaacatttcacttaattcagtacagaacggtaagatcaagaacagct

SEQ ID NO: 38622 - DNA, 877 bp, Oryza sativa
ttaatcaaatctaaagaggattgacttaaaaaagttaaaataacttgtaatttaaaacagaggtaaattttctataaatttaattgacttaaaaaagttaaaataacttgcaatttgaaacagaggtagtatatttaaagatattttcagaatatatagggttacgtttattggattcgcctaatagcggcaacgaaacataattttggatacgacttttgtatttctacaattagtgatttcaaattaagttcagaaattaaaattaaaaagcacctataataatttaaaattaagtttaaaattttaaattttagctttgacttaggctgcaaattgctttagcctttcggatggaagtaattaggatatgattaattgagtaataaatgttatacacttgaaaaatatatttatttattttccaaaaaaccttcatatatatatatatatatatatatatatatatatatatatatatatatatatatatatatatatatatatatatatatattcatttgtttagatatatatataaagattgatccatcgagtaggtttagacatatatactgtacatgtatgtatggaatatatttactcacctttggtgtgatttctacaggaaaagaaataccaatgaagaagccgaacacggccgcggataatgccgtaaagatcgaacttgctgctttcatcttcgacctgcttttgctaagctaataaacttatcaaccaacaattaagctgttcgatcgatcgcccagctagctgctagcagaagctcgatcgatcattagcatgcttagctagcttgattgtcgctgtgctttgctcctggatcgactagctatagcctatagctgcgcattca

SEQ ID NO: 38623 - DNA, 556 bp, Oryza sativa
ttgatcattcaggggaagcttaattgcgcacgctgccgacaacgggtcgaccggcagccggccggccggccgcccaatcgatcgaccggcaaccaactcgaccaatgatttgtcctgccgatatatatacacgtaattgttcggctaatatgagctacgaacgaaccgggctgttgacgaacacatgttatatatacctacatcataattcgatgttaattgagcttaattcggtccctcaaaaataacctaagatgcttaatgcttaatccttcatggtttccattgaattagctgttccctggaaaattgaagtcggcgtggaataatatccatgatataaaggcatcgaaaggctggaccattgctcaaaaggatgaggtcgagtaccgctcaagtgactgacaggacaatgagctagtaccagaaaactagctgcaggtataacttttgaaagccgccttggctggctgtaccaatcctttaccggaagcacgacaaccaggaaaaccacatccaaccgaagatatcaacaggactgtatattactgccgca

SEQ ID NO: 38624 - DNA, 1120 bp, Oryza sativa
aagaggccaccgctgcctcgcctatggacttatgggcctcaccgtcatcgtccaccgtcgctagctgtgagtcgaggatgagagaagagggtggagatcgatggagtacttgcgatgttgacttaaggcctggtttctcttattaattagtcgtactagctagctaggcacgtggatgagtggaaaatcgttcctatcaataccggtttttggctaaaccggcactaataaagcgtatatataattgggccattctattgtagtagtagtgtatgattttattcttaactgatcatatatggagtatgtatgtacgtaatgtgtatacaggacgttgcgagtggcaagcagtaccttgtgacgctgacggtggggtacactgagaaagacaacatcaatgcaactgttcacaaggtcgctcgctcattaacttattactcgatcctatatatttgcagacttaatgaataataataggaatataatacatgcagttatcggacaagtttgacatagtgctgttccattacgacggtcggacgactgaatgggaggagttcgagtggtccaagaaggttgttcatgtcagcgccaagaagcagaccaaatggtaattaactacctactccaattaatccaactgttaattaattagctgaattgattgatcatcatatcgatcagtatatagtaaatgcatatgaattgaattgaaattgaataggtggtttgcgaagagattcatgcatccgagcatcgtggcgccatacgagtacatattcctgtgggatgaggatctgggagtggacaacttcagtgcggaggagtacatcagcatcgccaggaagcatggcctggggatctcgcagccggggctcgacgccaccaaagggaagagatcacgctacacggccaccgccaggaggcccgccggcgacatgcacacctccggcaggttcgtcgaggtcatggcgcccgtcttctccagagacgcctgggcatgcgtctggcacatgatcccggcaagtgtcctatccatcgcattcattatattaattctgacttacagtagtattggttagtatttcagtcagacataaacgaactaacgatcaatata

SEQ ID NO: 38625 - DNA, 674 bp, Oryza sativa
tacagtagctcatcaatgcaaaacaaacagatatagtttgattagccttaaaatattacacgcttaattgtgtaatgcgtatatcaagctagggtttgatattaacccgtgcatatcagttgatcaacacatgcacgtgaagcactcagtcgctgttgatcccatggactgaattgccccgtgtcgtatgaaggttacgccggcacctgtacagatcgtaccaggcgacgagcagacacaccgggacttcgtctcgatctcagccggtgcgtgaaaacaagaaaaagaaaagtaatagaagattagtctgcagttagagaatgatctaactagtgaaaacgacaaagccaatgatattaattggagatcgaatcgatgaaattgccgagattgatcccttcgactggattgaatccgagacgaaaaagacatgcttgatgaatccggcgatgtcggagattggttccatcacacttgtgataggaaactcgacgaacccctacctggcgcgccaactgtcgaaacatgaattcggcaataataaaagggggtagcgcacgagacctaaaagtggatggatgcagagacaaaggatttagacaggttcaggccctctcaatgagaggtaataccctactcctgtttggggatttgaatccgccaggtgaattata

SEQ ID NO: 38626 - DNA, 551 bp, Oryza sativa
atcaatgaagaaactcggggatatgaaaaggatcagataaattctacaacatagaaagggttagtaatatatttaggaggtatacaaagaatttctccatatgtgtaccttgccagttacttgaggtttaatttgaacccgcaactagcttggttgattaaacgctagttcatcaataattgtctttctcttgacaaatagggcaatggagaacaagatggaagtagtgccaaggtatgtaaaatacaactatctatctgtttggacaaattttgtagtccttacaaagtacttgcatgtaccaaagagctatattaaaaattttgttaatttacctcgagataccttagaggtattaaattttacattgcacataccgatatctactcaagaagggtaaaatcattttactgtttacgtatatgtctatacttacaacattctgagaaaatctctcacgttaacgagaaagataagctggacgttaatgagcagaacaaattatcactgtatatagtgaaatttaattgaaaccctaaataagcacaact

SEQ ID NO: 38627 - DNA, 616 bp, Oryza sativa
cccttgcgacggtacaaacacgaactccagctccagcagtgacagcaacaacaacatgctcaacttctgggcaccatccgtcagaaacagcactagtgccccgtcgaatgccactatttcaggggtacactactactactactactactactactactactactactactactttgtgttcgatcgtgatatatacactagctagctacctcatatcatacggatttttacctgcagctggatcgtacctagcggttcttctttctcggacagtacactagtaaaggcagtagtttgtctgaatttacatatatatgaacgatcgatctgtctcgtaaccaatttacatatcgatcgatcgggctgtgcttgcagaacggtacaacgacagcagcagctgcagtggcgaaaaaaccgcaaggagcggagaggctgcctccgggtattgttgtccgggactctgatcttcatctacaccgcctctggggccacccaacatcggtacatgctacagctatatatatgcattatgtctgtctatcttctcatcgatcacttggtgcacaggccgcttgtatctatactactttagaaggtagtagtactttagagctgg

SEQ ID NO: 38628 - DNA, 2870 bp, Oryza sativa
  unsure (1)..(2870): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggattacgtcacctgctgccacacatcgacgagcagcttcctccccggcgacacgccggtgctgtcgacgacccaccgccacagcgacgacccggtcttcgtgctacccatcatggtgatctcaagcgcttcgttcgccaggtcgaacagcatcctgtgatcagctgcatcttcttcagtgttgtaggtctcctctacctcgtcgaagacgtagtcgcagatcggccttcttgccattgagtccacccgggcattgttcatcatcgatggagacgagtacgacgacccgtcttcgtatagtcccacggcaatgaggacttgctttatgtacgccatctcagtatagctctcctcggtttcagttgcgttcgtcctgttcttgcatgatgatgattcattgctggctatgggtgttgtatcaaatttgaccaacttttcgggctcagttctgcacaacattggactcattgttttacacttcaggtctcagtgaaactctgaaatgtaacgaacgacagagagagggccgtagttttttcatacctggcaagttgcagttcagatcgctgaagaaatggcgggaactgctgcctttaacctccaacggggacaccgggctaggaggcagctcggtgaaattctcctgaaacaaatgcagcaaaggaagtgaatccattgtacaaaagaaagttattctgatcctctcaaggtcaggcctgaaatacagatttgattttgacaaatgtagtacagtgcttgcctgtgcaacgatgaaagggctcaaaatttcaggaggtgacggtggtaacatgccgatcgccatcttgtgtgggtggaactcgcccaacgatggcttcagtgaccaatgcgtcttcttcccgaacagcttgttggctctcgatctcaagctgttccgcagatttgacactgtccctctcaaactgaagctgctgctgttcttgctcgctgctactgctgcaccttcagaaaccgcgtctgaattcccatgcctaccgctgtccacattattgtcctctgcaaacaggcgacctcgagagatccctgacgccggtgcagagaatgaccggactagtgcccgtggcgacacgacgttggcgtcagcaaacttgcattctcctgtgtagctttggtcatcaaagccagaagctggaactgactctgacactgacactgacagaggcatatctgtcaacgaccttattcttcctctgcttcttctgattattggaggagaacaatcattggacccttgattggttccactggttcttgaggtgacactcgtcggactgacgtgctccggagatgcatttcttgcagcagtagcagcagcgttgcgcttgcggtcactcctgaatgctctgaatgattctgatcgggagtacagcctcttaccaagatcctgccttctcactgtctctctgatctgcttcgcgatgtctcgagcgatttgcttcgggtcagtagtaccccagcttctcctgacaacctcacttttggacttgagcttgagctctttcttgagcctctccttcacctcctcaagaaactcctccatgttcccttccctcttcaccttggatgaactgaacaacgattcttggtcactggcaacaatgtcacaagtactaggcttgaggagcactatccgtttctgggaacgtggtttcgcagacgtgcttatactgttattatgttcatcctccaaatctctgaacttgtccggcatcgttgcacagtggctcacccttaaaacctttatgaccttatctccaggagatatgttagattctgctgcagcttttgctgaagtaatctctgtatcactactattatctgtagcattcttcagggtgtctttctctgccatggaaatcgtgcagcttccatagccaaatttggccatcttttccttgtgcaggttctcctgtgcaagaatctgaatgtacctaccttcttccatgcggtgtctactactagtaatagtaggacaccctgaagctgtaaaaacggttcttgcattctccagtgctttggatgtttgccatgcctggaaatcctccctgatcttctcaagcagctcctcctgtggatgatgctgacgcgaacgacttcttcgcggtctcattttcttgagacaatgcctgtaagtgtaatcaacactgctgctaccgtaggagatcaggctgcatttggattgcctgaatgttgcagaacggggtgatgtgacagtgatcatttccagtttacttggcagcttcaggttgctgacttcttctgcatggatcatcacttcatccctttttgcagataccgggattgtgccgatgcccatcagacgtgcaatgacactcggctggctgggaaaaatatccttgtggatcacattctttgcagtggttctgtcttgaggggtgcttcccttgggtggcttctgcctcatctaaatatttttattaaagaaaaacagtaaatacgatggtactaattgattgcattaacaagaaacttgagcattaagcataggagcaattaagtacaacatacagtactagtcatggtgatggtggtatggtcgtacagtggagagtcaaggctattccggggagcttcagggcctacaacaacaactagtagagtctccattaaccattcagaggtctgcagataatccataggattgctatctaaatacgcactgtttccatgtattcgggctgcagga

SEQ ID NO: 38629 - DNA, 987 bp, Oryza sativa
atttttggtgtggtcaagattgctaactgctcaaaatcattagacagaaagtgatggtggatttttgccttccgctgttgcagattgacagcggaagctaactatactaacctagagggctccaaaataatgtgcatgcgcactctctttttcatttttgcttctagtgggaactccactactgacaaagctttagcttatgaagcacgaagttgtggtgggaatgcggaattaatttcagaaatgatattcaaggcactaatcggatcaaatggggggattttatgccgtagggtttaggcctccatctcggcatgcatggatatataggatgcatgctccactttgcgatacgatttggtcaaaaaggttgtactcctatcttggttggagctaaacctacctgtgtatgtcatcaaggtagaaagcaagtgtgctccaaatccaatctttctactatgtgtcgatgtccctaacctgattggctaaagttttcctttctttgtttttttgagatgtttgcctaagttatgtctacaatgttatctcatctgcccttccttttgaatcctttaaatctagttaggatcaaataaaagtgttaactaatgtgtgtaaaggttggcaaagaaaaggggagagagagagaaacattcttgtacttcttctgtacagttccttttggttaattcaattcaggtagagagagagagagagacgtggggttgtccatgtcatgtttctcgtacaaaatattacttaaagtaaggctgtaaaatacataggtttgtccttgaacttcgcttgaagtctgtttttcattctaaactacaaaaccggttgtgctttcactgtaacttttaaaattagacaaataacacctagtaacatagttcttttaaagtagtttgtttgaaatggacgtgtttttccttgttcatatactcttccttggtattcttataatgtagatgtcagttcataatt

SEQ ID NO: 38630 - DNA, 1769 bp, Oryza sativa
atttcttatttttcttatatcataattataaatgatgatggatatttttacctgtatgttatgttcttttttataattcctgtttgattaactcttcgccatcttactgtatccaatataccattatggttcctgtaggtattccgacgcaaaagaaaggaggataggacccaggagttgcttcaggtggacagggaggctgaactcaacatgagaaatgtggccacagacagatcaaggaacttcagtaataaagtaagagccagctacaacatatggaggccggggtttcaccatactaacacagattcaaccctcagactcatgaaagatcagattataatggccaaggtgtatgccacaattgcacattcccagaagcaacctgacctgtacgtgttgctcatgacatgcataaaacaaagccaagaaggtattggggatgcacacatggattacaaacttgatttgaggtactttattctacgcctttgaagacttaccagttcagttgcttgtttgctgtgactctaaaggttcagttatttattgctgtgactctgaaggttcaattatttatcacccacatttcttatgcagtgctttagagcgagcaaaagcaatggggcatgccctgtcttcagctagagatgttctgtacaactctggtgaagtatccagacgattgcgtgttatgctacagtctacagaactaaatatcgatagtgttaagaagcagaactcattcctggtgcagcatgctgcaaagacagtccccatgcctttgcactgtctgcatatgcagctgacaaccgattatcattttcgtgatggtgtggtcaaggaatattttcgtgatgctgctttgaaggaggaagaagataaggcaaagcgtgaggatcggtctctataccactacgctatattttcagataacgtccttgcagcctcagtagttgttagatcaacggtgacacatgccaaggaaccagagaagcatgtattccacattgtcactgatagacttaattttgcagctatgacaatgtggttcataagcaatcctcctctacctgctactgtccatgtggaaaacattgacaacttcaagtggctcaattcgtcatactgttcagttctacgacaacttgagtcagctcggctcaaagagtactatttcaaagcacatgatccatcgtcactctctgatggaaatgaaaatctgaagtacaggaaccccaaatatctgtctatgcttaaccatctaaggttctacatgccagaaatacaccccaagcttgacaagatactgtttctcgatgacgatgttgttgtgcgaaggacttgacaccgctatgggatgttgatcttaaagggatagtaaatggtgcagttgaaacctgcaaagaaagtttccatcgcttcaacacatacctcaatttctcacacccaaagatctcagagaactttgatccacatgcttgtgggtgggcttttgggatgaacatgtttgacctgaaagagtggaagaagcaaaatatcactggaatataccattattggcaagatctggtaagtagtggaacaagaaagctgtgcttgattatattgttcgaatacatttatcccaccatgcattctgtctatgaactgaaggtcatgcaactgcaacaattggtatttatcttttgtttgtttcatttgataagagaatgtgtttttgcagaatgaggatcgtaagctgtggaagctggatacattgcctccag

SEQ ID NO: 38631 - DNA, 1537 bp, Oryza sativa
ttctgcaaagaagttatcaatgtttttgttcaggaccagtccgtccaactggctgcagggggatgatatcctctggccatgtcttggtgacatcaagaggatcgaagtcaaatctgtcctcatgatcaggatcaatagtctggatgtaaagcttccactctgggtaattccctgctgcaatagaatcagtcaagtccttcgtggcatggctgtggcaggtgccgccaacagtcacagcttcatcatccaacaggcatttgacaccacaggtaggcttccagtggaatttgacaaggtgaggctttccatccttattgattagggtgtaggtgttgacaccaaaaccctccatgtgcctgtagttgagtgggatgcctacatcgtcaaagaggaaggagaacatgtgcaggctctctgggtggtgtgaaaagaaatcaactattctccagttctcctgcatattggtctttggacttggcttgaaagcatggaccatgtcagggaatttcatcccatctcggataaaaaagacaggcatattgttcccaacaagatcaaaattaccctgaaaagcattgactcagaaaatatcaaaatatggcagcactgaatgcaaatcagtaaataaacagtaagacaaagttgtaggtgacactggttagatatatgtccaatgtgtgagacttttgagatatataagaccaaattaccctcatttgctttagtagatataagattaagcaatgcactggacctatggagtgtggaggtaaaggacaaccaatctttcatgttctacttaaccaactgagaacaactagacatttgattctacagccttatgcttgaagaatacattatactgaatgtctccctcctacaatcctatgaaagaaagaagcgaaagagcaagtacctctctagtgtaaaacttgacagcaaaccacgtggatccctcaatgtctcagggcttccacgctcatgcacgactgtggagaaccgaacaataactggggtctgaacaccaggagcacggagaaaatcagcacatgtgaggtgagaaatatcatgagtaacctcaaaaaatcccttggcactggctccccttgcatgaacgacacgttcagggatacgctccctgtcaaactgtgcaagcttttcaatcagatgatagtcctcaaggaggatagggcctgtcgattgaagaattcatcatgtcaaaccacaaaacagccatgattacagattgcaaaaatacaggagttgctgagtataaataaagggaaaacactagaaagaaaacttcacagatcgatgatagaagcacttagttctagatgcaaatacatctttgtcagagtttggtacttttagtgaccatgacatttggaacatgacttccagtcactttcgaaacttgagtcatgttggatatatgtatgaaatagacttgtgcttctctggtactccagtaaatttgatcgtcatcagattactttgtaaagtgaaccgataatggtaaaaaacccccaaaaaa

SEQ ID NO: 38632 - DNA, 23630 bp, Oryza sativa
gatcgatctagaagataagaaaatcaggaaaagaaggcaccttgtagggacccatggcgtgatttgttgtgggagagatgagaatcgaactggatgtggggaagaagagaagagaagagaagaggatcggattggtggtgataaggacgaggagagaagaaaggggcggccttttttgtagtgcaatttggggacgaagagaaggggggtttcgtagcgtgctagtatgcttcttgccggcctcccttctcttcgtccacgtcgtgtttgtttattaatggccgtcttggggtgtgtggggcccacaggcagcgacacaggtacctgcttcggttggtgcgcgtgcttgtcacgtactacgaacatggatcgatccaaaaaaagggatcacgaggagataagacttttttaacgcgaaccaaacggattattattatccggactctaggattatacgtacgtactctattttgttttggagcttactagctcgctcatcgtgatcgatcggatcactgcttttttcgtttttgtttaaaaagaaagccagagactgggaaatcaggaatccggccggcatcccaaatgctaaatcctgtataatttctatatgtgttttctcaatctcaaaatataagatgcaaccattcctaataaaagaaaaacattatagttgctcttagtttacatggtaagttgagaccattgctaggagcgatcttcaatgcttgttgcagtgatcttgtgctcgagcgagtaggtacatacttatatctacatattattctctttgctttaaaatatacaaatctaatgtaagatatttagatttatagtatttttttttaaaaaaaaatgggatgggtagagtagccttcgcgatggatgcggcaaactaaactgaactgacgtcgccgtcagtcgtcgtgtagtatagcagtgctagaatattatgcaagtggcaaagaatcacggtgtgttcatacgacgtgcatgcatgtgggccatgtcccatgtggctgacttgctactaatactgtactcgctccggttcgatattaatcgacattttggacgagtttgatatcaaacttttataactttaaccattaataactttaataatatttagtttaaaggaactagaacaacatatatagatttatcttttaaagtactataataaaagtaaacatatatttatttattatatatattataatggaaaaataagatcaaagatgtatcttgtagaccgtgtcattgtccaaaacgttaattaaaatgaaactggagggagtactattcaaccattgcaaatttaccaacaacatactccctccatccaaaaaaaagacaaaccctggtttccgtgcctaacgtttgaccgaccatcttatttgaaaaaattatgaaaaaaataaaaaagaaaagtcacacacaaagtattaatcatgttttatcatctaacaataataaaaatacgaattataaaaaaaattcatataagacggacagtcaaagttagacatggaaacccagggtttgtcttttttggacggtgggagtaagttagcccaataactaattaaggctcacctctccagccttcattgatcaactttttagcccaaaactataatagtaatatatcatccaattaattttatttacaagcatgaatataaaaatattagaatagaaaaaacacatagggcttgtttgatttgataccaatttattgccctaccaaaactttggtaacttcaattgtagcaagtgtatgtttattttgctaccaggttttgcccacaatagttcaaatttaacactacccaatttagtagtgctaaaacttaccaatattttggagctaccaagattttggtatggcaaaaattggctccaaaccaaacaaccccaaaaatataataagattatatataaaaacatagtattggaaagcacagaataaatactatagcatgttgtctggaataagggaatagagcaaaacacatgatttttgctatttaagtattaaaaatagtttttattgcttgatgagtgcttaaatatgctcatttaaggtcacatatattgatttgtctcggagttctcaaaggaaaatgaaacagtggttgctatggaattcctataaaagcattgggtgaaagaaaaaaaaaccttcatttttctcatatgatatcatgcacatttcctccaataatccaaatgagtgaataatatttatatccaggaggaattgaatccttcaattttcctctaaagttcctacgctccgagaaagccttaaagccatccgtgtaatgttacactatttgcctgctcctagttttatgggcttatataattaggttgtttttagttcacgtcaaaattagaagtttgattgaaattggaacgatgtgatggaaaagttggaagtttatgtgtgtaggaaagttttgatatgatgaaaaagttagaggtttgaagaaaaagttgggaactaaaccaagccttagtccgggccgttcctatgtacactattcattctttgtttagtagccacttgagtccatcatgccctccctctctctctcttgaatgtcaggctgtgttcttctcttctttctcaacttctactcgctcatttttatccacatattttttaaactacttaacggtatgtttttattaaatttttatatatgagagttgctttaaaagaaatcacattaatctatttatcatgtttttagctaataattaatcaatcatgcgctaataaagtcacctcattttttgtgttaggagaaaaatttccaaacactggttcaaacacagccttaatatgttatattactagctactatcactatgtgaatgccacatcaaaattttagtaaatttactatgtgcatgttgccatagcaatttttacatgtacatgttataggaaattcagtttattagacctatgtcatggcaaattacaactgtaagggtttgtttgtaaatatgtttacaaaatatttatttctatataaatttacataagggtctactataatcagttgtacttaaggtgtaaaccataagatgttcacttattcctttgttgcttacacatatctttctttaggttctttttgaattgtaggaatgaaaaaaaaaggaggaatatgaaaaaaacacatgattctgtcacgtatgcaagtgcaaaacggatgattgcaaaacacatgaataatcgtttgattggaccgtaggaaaaatatagaaattgaatgagaaaaataaacacatgaattatcatgttggcatgcaattaatgcaaaataaaaatattatttgtaacagaaatgcacattcattttgaacatgcaattaatgcaaaataaaatattatttgtaacagaaatgcatattcattttgaacgaaaaaattccggtctgatatgttaatttacagtagtgcatatatacaacacgtaaaattataaataaacatatgcaattgaacataaatactacaaaacattactagttagtattcacatgagtatatattttgcaatttacacagcaatataggcaaaataatgtgaataacctgggagcgggcctttccagcctttcggcctatttggcgtggacatgatggatagggccatcgtccttaactttcagccaccagcccacttcatcagcgcccgccagcccatgggaaagagaaggcccaccatcccaacaatggtcttttgacatttcggccgtaaagctacagctgcaggtacgtacgtgtacaccacgacgacgacgacgactatacgtacgccattacaccagcatagccggagtgacgacgcagatggatagatagatgagatagatgtgaagctcatgggttgacctgcttagagctagctaaaacaaaataagccgttgattagagatgtactccctctatcccatataaaatctaatcctaacatcccaatgcaaaaatagtgaagggtgaaaatggctaaaatgctccccattattaaaaaagtagtggtggtgataggtagttaaagggtattgaaggaataaaatttctcgttttatgtactgagggtaggtagaaagatagaagttagttttttatggaacaaaatttaaactctagaagttgattattattatttttgggacggagtgagtatatggcaaagaaagcctttgactgcgtacctccattgcatgcccctccgacgacggacaatcgatcctctcgtatgcatctgtctcaagcttttctatggttgtgttcgttcctccaggttgggacggacaattctaccctagagagcgaggtcatgatgggcaggttccgcagagtgtacgagaagataaatatggcactggactggatgttgtacggtgagctgggagtctccacccctcgcttccactggtggagaaaccatctttgatcggtccggcaaaatccacaatagtcttggatccaaaaaaaaccaggagtaaagattgtttttagtcccggttataaaatttttgatctttagtcccggttcatcccctgtcagatgtatgtcagggggccgaggatctttaatcccggttggtgtcaataaccgggactaaagatcaccactttagtcatggttggtactatcaaccgggatgatctttagtcccggttgatatcaaccgggactaaaattaaacacgtagtatataatccctatcccttatcctctcctccacagttacaacttaacagatcgaatctcaccccctctcctcagatctatcctctctaactctcttctccaactcctccccttccacctatcctcccccttctctccccttcctcctccccttcccggccagcctccccttcccatctggcgggccggcgggcggcagggccgcgtgctacggcggccggcggcggccggcggggcggcgcccagcggggtcgtgcccggcggagggcggcggggcttcgggcggcggggccgcggcggcggcgggcggcggggccacgcccggcgaccggcggccggtggggccgcgcctgtcgttcgtggcgaccggcggcggcagcggcattctttttttttttaatttgtgatgattcactgagatgtatttgactaagaagttacaaatttgtgattcattgtttggatctgtgatgtatttgagtaatttcttaggatattgtgatgtatttatttgtgtgtataagtaactttgatttgtgatgtagatttgagatgttacttcgatttgtggattgggggtttgatttgggatatgtatcccacttgatttgggagaaaataaaaaaaaagaaaaaggggatcatctcactgccgtaaccctctctttagtcccggttggtgttactaaccgagactaaagatctatttttagtcccggatatttaaaccgggactaaagatagcgaactttagtcccggattggtaatcgggggttacgaaccgtgactaaaaagtatttctccaccagtgtccctccctacccccacccccacctcaccgcgtacacacacccatctcccgcacacccacacacatgctcgcccccttcacactaaaatattaggcacacattgtagaatcttttataggttaatctaaaagtgttgagcacacaatttaaaatttttcttaggatcatgtgtcagaggcgttatatgtatgattgtattttctaccgattaaaatcttactttaccatatattatatacatattaatgccgcatgaacaaaagtgtagtttgatagaaatgtatggatggccgtcctctcgtagagttgcaacgttcatatttatggtaaggtgcctaatcaaaacgttaaaaataaacaaagaaagccataagtggcaatgatatcggtaaggcaaatatacgatgaaggctacacaaccctacctacgtaaaaccgttttagaccattgaattgagtggatgttccctcgtttatatacgctcaattagttatgaatttttttaaaaaaataacaacattcatacatcatatatatagcacttcataaaattccagatccaaactcaactcacacattgagatataaatcatacctagattttttttattgtttttcagtgtgtagatcgaatttgaagttaatttttagtagagtgctaaatatcaatatgctctatattgtcaagtttttataattatttgtaattgaatttaaaaggaaaaggaatcagaatacaatccctacttgtagtctgtagacgacgatgattatacgccatttaacaccagcatatatagctggagtgacgctcgctagctatacacagatggacgtgaggctggggtttggggagactatgaccgggaaggagactaattagtacgtagtgacaacaaccacctagctagtactagtaattaggagtagtaatcagctagcttacaagtgtagctggagtgacgcgcgcctagctagcatgctgccgcaggccggcacaatgcttatctcttgtgagttgtgacttgcttaattagagccaactcttaccctgctgtgaaaagaaaagaaagggtaacgttggacgagaggactcacatgtaatgtaagcaacaaatacacttgcttcgtcttgctcttgcgtgtttggcattgtgcgaattcatatctatctatctagcttggaatttacataggcggggtagatatgtgttgcaaatttggttatttagttgtatataatttttttttcatttcactgaaaatgtcagctatatgtgacacttttatatcttgtattcttgtgcatgactctgctagctagtgtagtgtttattttggacgacctgtgtcaagctgttgacattattgaaagtgcatatgcatgccatcttagtatacctcacggtagttcttgttttttttaataatgaaatagatatatcccggcctttactcaacagagttacagccaattattacaatatgtcactcaacaaagagtgtagttcaaataaaattaaacacacccaagcataatagaaagtgaccacactaggataagaagaacacaattatttaagtctatttgttaatctccatccatagttggcaaaaagttgcataaccgtcgtttcaagcttacaacatacaactttcagaaactctccatcattatcacatccgtgcagctgtgcccaaggccaaagtcaataagttgccctgaaaattacttgtatatataagatatatggtgaattgtcaaaaaccaaatcatttctactcaaccacagagcccatcatattgtagatgctcctacgagaattacgcggtagttcttgtgcatagttggttcaattcgggacgatgaaatgaatcttgtatgtttttttttcttgaaaacgtaactagctagttatatatctatggcatatacataaactaatctagccttaataagctccatgctcgtactcgatcgagcgagctaatagagagcccggtctgcagccatgagctcgccggacgtcgtcgccggcggtggcaggcagcggtcaaagggatggatcgacggccggggcgcgagtggactcatgtagcgcatgtacattttggcatcacatcgatcggctggtagctagctgcagcttggtgtacacgtgtgatgagtagtacgccattacagcagcatagctggagtgacgctactcagctgtacccaccggcgctgcgccgcgctatataacaccggtacccccctccgtgcacatccatccatcaggtcttccacatacattttgctgtctcgccaccggagacaggtagtatagctatggccggtcaggtgttcgtccatcacctcggcggcggctccggcggcgacgaccccacccacccatggctgtccctcaagtcgtcccatgagatggacgacgccgtggcgagctggcgcgagaagctggcggacatggccgccgccgacgaacgcgccggcaggtacccgtgcccgctgtgcgaccgccacttccccacggagaaggccgtgcacgggcacatgcgcagccacccggggcgcggctggcgcggcatggagccgccccgcgagccgtcccccggcgacctcgccctcgccgccgacgggaagcggtaccgctacgtgtgcgaccgatgcaaggcgccgttcgagacgcggcaggcgctgggtgggcaccgtgccagccacagcaccaagaagggctgctcctggcacgccaagcagctcgccatggccaagccgcccaagaacgacttcgacctcaaccatctctcacttgaggccatccaggcggcggcgcaagaggaacaagctgctcaagaggggaacaaggatgaggagcctaagaattaattaattaggaataattgaacttgcttagggttcgttcggtcggtcgatcgatcgacttcttgtgcttgcgttgcgtcggtctgggcttgtgttggttcgtagctagccaactccatggctcatgcagcatatgcacatatgtctctttctcttctttttcttttttagtttttgtttctctttgattttttgtaagctcgatcgatcgacaagaaaaataaacaaatattgcaacctggatgatatatgtgcatatatgttcatcatttgtgggtgatttgggggaatgtgtgtttcccacattttatatgaatgtctacacaatttgaggtatatcgattggacctgtttgacaagaacagttcaagctatatatgtcctgcgttttcagtccggcctgttttacaagaacagttcaactatattggtgcaaagatcgatcgatcgtatcaaacaaaaaattgctactctaggtgatgcacttctcatttaccatctcaaaaatttatgcctcctacattgtttttcaccctgaatggtccctgactccatgccactagaagaactaacatcatcacggccgttcaaccgatgaacaaacgttccggatttgtggttgtacccacggttttgtagaaaccatcctggttttcagtttcacctttgagaaaataatttacttttttaatatattttttcgtcttagcgtgagtcaatagagcattgcacaggtgtgctgtacattgtcgtccctagcacttcccagtgtttgttcttggtggtcgaccggcatgactcaacttttgaactcgatgtcaagagaaatagagtttactacgagtcttagtttatcttttgacttttgggtagagaatcgacatgaattttcttgttaaactatgcgtacacaccttccccattcaagcaacaaaaatcttcaccattcttgtgagactgtttttgcccttaaactagctaagtctttcatgtacttagaccttaattttacaatagttatttatcttctttgaataaaaaactatcatttactcatgcctgtaaatggctacttggaaaaaaaatctagttagctacatgtgtagtatatgcttttttatatagacatgaacgaaaataccatgtaaaatgctattaattagtaagttatagttgtcagtcactaacaaaggcaactgataccgcctaataccctaacgtacgtgtggcgcttatgagggcgcgaaagatcacgtgcatgcatgcatgcacattcggctagccttcgtaacgtccatgtgcataggcgcgctcagcctatattaattaattcttgttggtatggagaaaggtggacttaactttctttttgccaatgaaattttccacccaataaatttctattcatactacaaatttttccatgttacttcctactggcatagtgtctaccagtagaaaatagtagaaaactctgctcgaagctgttaatagtacaaactttatatggagaattttatgcggcggcaaaaaaaaaaaaaccttctatacttcaaaacttgttataggagcaaatatttctgttttgctcagaaactttccagtccggattaattctttttttatacaaaatatggaattttgagttacaagctactatattctagtgtgctacaactatcacgaattttcgtgactgatccaatgaggaatggaagtgtagtaaattaaaccaaaatcattttagatattcatattcacgcatctgcaattgtggtattctgttgggttagaacctcaaaatgccaaggaacaagtggtataccatcaaaataatattgattggattaatttatactatactaattggggaagcatcaatgatgtggtggaataatatgtcccgatacctataaatattacatatatacaattaagtgaactttcagtatgaatttaataagattataaatgtgccgttggttttttttagcatataagtttgtcatataatttaaacaaaatatactaccggtcactactaataatatcatgcatttatgcataatggacgttagcatgggagttactccagtatatggtttttggagaggctctttcgaaacccacagctttctacaaaaccacactggttttcagtttccctttgcaaggaaaatagaatttttgtttttcgtatcttgcagtgacgacacaattacagagtcaaagagtcctactagcgctgggaccggagtcaaccttcctcctgcgatatacatcagcgaagaacagcccagaatttaataccatcatgattcttcttcttttctttgttagagaattgatattcttttctgaaactacaccataacgctaggtggatgtatgagatatttgttgagatttactagcaaggaagcatgcatgatgccacagttatgtatagtataatatgaaaactatcgtgggataaagaaatggacatctgagatttgtctacatcattatgagtaaaatttttactcgcaaattaatcatgagtaaaagttttactcaggataacgtgcataaatatcatacgtttattttagctatgtacctacccactgagaaggcagggtaggtacgtgcttcaaatttgtttatttagctatttttatttttcactaaaaagacaatctatatatgacatgtgatgcagactctactggtgtaatgtagtgttaatttggaatgatacgcgttcagccgttgacattggaagcgaatgcatgtcatcctctagctagcactccatatctcagcagtttctcatatattctgctcatgttgtctctactagctaattaactgactaagaccagtatctgaagattgaaaacgatgattttctttttccttcgaaatgatatgaatcactcatatataagaatccttttggaaaaaaaacgtaacaatatactccagtataagccacacatacagttcattgcgcttgcttgcttcttgcaatctaatcgaggcgatcgaatgatatgaatatatatatagcgcatatataggttttctttttgaaaagaaaaggtaacataataactaccttagctagctagcatggcatgtatcaataatctagcctttaattaattaaactccagtgaatgacaagctgagcaagcgagtacgagatatctcatgagctcgccggccgatatcgagtgatcgacgtcgtcgtcgccggcgctggccgcggccagacatggccggctctagctaggggactcatgtaaggcattatgcttatatacggtagctagctagagcgaacaatacagggtaggtgtacacgtacgacgacgactatacgtacgccggccattaattaacaccggccagcatatagctggagtgacgctagctagtttttttttaagtaaatttcaaaaaactacaaatgcttcaattaaattatcccaaaactatatatttaactaaagtgatgtattacaaaactatagattttaacaataaatttatttcaaaattatatgtttaatgctaagtatcgtaaaactacatatttaacaataagattatcacaaaactatatatcttggggtttaaattcttagtactaacacctactatgtttgagttataaatgtccaaattttgttattaaattgacgctaaacatgtatatgtacgtagtttcatgataagtttgttactaaatctgttgtttaatttgcgatacttcaccttaaatataaaatttagtgataagtttggtgttaaatctgtagttttttttatacatcatcttaaatatatatatatagttttgtgataatattctaattaagtaaagtatacacagtttcataaaatttactcttttatttacagacgctagctacacagatagatgtgaggctggggagccggccggtgactgggaaggggatcgactaattagtacgtactgacaacaaccacctgctaattaggccctgtttgattcagtttagaattattataatctgaattattaagagtaagctgaaataaacaagtagattattatgatagattattataatttataagccagattattataatctaataatctcctctggaggagctttttttagattattgggtggctaaagacccattacccttagataccttcaataatccagataaacaaacagctcgcagtttattctatgttagcttattataatccagcttaaaataatctgatttaataatctagattataataattttaagctgaaacaaacaggaccttactctagtaaccagcttatgttgctggagtgacgcctagcatgcttgctgccgtaagtatatatctcttgtgacttgcttagagccaacaaggccgttgattagagatgtagcaaaagcaatattcctttgaccacctacctgtaatggcccttcctccttacgcatatgcatcttctcaagcttctatccaagtgtcacatactcggccctttgttaattcagcctgatgacccccttccatttttcttaattgattcgaccgggtgctgaataacattttattccttgacgtgatcagcttaattattttggttaattaattctcaaaacttacaccttgggttaattattagttcttgattgtaaattttacgatcaaggtagcatttaattgattacgtaccaacttttcatgacttgtaaacaattgtgtacatcgttatgaactagcactgaaatatatacatttacctttttcttataaaaacaatcaaattttgaaccaataaacttctatggaaccgtcaaagtattcgccttattaattttctatacataccccccctcccctcccacacacgtatctcccgcaccccccaagccccacacacatgtacgcgtgtgcacggacgccacacagcaccgcgtgtgtcctctttcacactaaaaatgttaggcacacaacgtaaaatttttcatagattaatctaaaatattggacatataatttaatgtttcttttattcatgtgccgtaggcattgtatgtacatcgtattttctttcgattaaagccttattctactttattttatattaatgccgcatgaacaaaagtgtagtttgatggaaatatatggataaccgtcctctcagggagttgcaacgttcatatttatggtgcttaacgaaaacgtcctggggtctttcgactagctccataaggtggtgggctagacgacctgggtttaaagcatcaccccttctaattatttgatattaggtcctttctaatattcgccttttttaagttgatttttgatagagtgctaagctagatgtcactatactctataatattatagaaaagttgatttttggtcgacttcgatctcaacgatcactggtggagaaacactttgttgtcccagttggtaaccctttatagtcccggttcaaataaccgggactaaaatcgatttttagtcccggttggtgactaaaaatatggtcccggttgttgttaccaaccgggactaaaaagttttggtttttttttcttttcctttcatcccgttggtcttttcccttttttattgttttttagctttcgctcgtggatcgaatgaataaaatcaacaacaaagcctaaatcaatcatagatcgaatgaataaaatcaaacaacaaagcatccatattgtttacacttgttcagatctacaacatctcatcacagagagcattcatcacagagaacaaagaaaggaaaaagaaagttcgcatctacaacatcttcagcattcatcagatagcacaaagaagagaaaaaaaaaattctcctgtcgccgccttccgatcggcgtcggctgccgccatcccgaccggcgccggccgccgccatcccgaccggcgccggccgccgcctcccgcccggcgccggccgctgccctctcgaccggcgccagccgccccatcttgtcgccccgcgcccaacacagccggccgccgccgcccccgacgcagcccgccgccgcctccatctcgccgccccgcgtcgggtcgccggcggcggcctccatcccgtcgccccgcccggggccgccgcggccggcctccatcccgccgccccgccggaggggaagggaggggaggagggggaggagagaggggaggaggagatagggtgagagaagaaggaagagaaggatgggaggagaggagagaagaagataagatggagatggctgaatgggagaggaggagataaggatggaattaataggagactttgcatgcgcgtgtggatagaggttttgtttttcctaactttagttccggttggtaacaccaaccggaagtaaagatcaccgctgacaacatacgaaccgggactaaagatgatctttagtccaaagatcaaatatgcccactgtagctaccaaccaggactaaagatttttagtcatctttagtcccagtttttagtggaaccgggactattgtggattttggtcgaccgaccaaagatggtttctccactagtggatctgtcactgaagatccaggcaacacaggagtgaagaagctgttgctgctgaagaggggaagaaagatgatgagacgaagaattagagagagagatcaacaagtgaagtgttttagggttcgttcggtcggttgatcgtcttgctggtgtccatgtgcgttgtgtgttggtttgtactccctccgtatcctaatatgatattttatttgcactatttgaccacttgtcttattaaaaaaaattgtgcaaatataaaaaatgagaagttgtgcttaaaatactttggataataaagcaagtcaaaaaaaataataattctaaatttttttgaataagacgaatagccaaacagtgcaagtaaaatattaaaattccttatattacgggacggagggagtagctagctagcttcctactccatggctccatgcatgcagcgcgcctatgtgcacatgcccttttctctttcttctttttattagtttttgtttctctttgacacttttggtcctgtcgggactttgtaagctcgatcgattgacaagaaaaataaacaaacattacaacctagatcatatgtatgcatgtttgggctccgcaatttaaattcttctctcctgagtttcttatctgtttccatatctctctctctatatatatgttcttaatttgtgtgtagctagtgttggggaatgtgtgtttcccacattatttatgaatgtctaattttttaggcatattgaacctgtttgacaataacagttcaagctatgtccagcttaattttttcagttatattttataacagcagttcaagtatatcggttgccctaaaaaaggtatattggtgcaaagatcgatcgtatcaaaatggaactatatgtgattttctaaatctccactttataatttaccatctcaaaaattttcaacctcctacattgttattcacctgaatattggtccctgcttcccgaagaactagcttcatcatggccgttcaacgggtaaacatacgttcaggatttgtcatttgtggttgtacccatagtttttatagaaaccatgtggctttcagtttctaatttgagaaaatattttttcatcgtaccgtgaataaatagagcattaatgcacacgtgagcggtatattaccgaccctgttagagcttgtatcagatatgtgtataaaattggtgacggtttagagaattgtaattataatatgtgcagaatagaattagagtcgaactttactctaggctcttttttaaataaagagacacgtataaccatatgacgacagtagtatagatatgggtacgattagccggtggttagctgtagatcgagggtcatactacctggatacacagtaagttgttgttgttgttgaggaggggaagaaagatcaagaggcgaagaattaattagctagagatcaataagctagcttagggttcttttggggtgtgtttagttcacaccaaaattgaaagtttggttaaaattggaatgatgtgacggaaaagttggaagtttgtgctataagaaagttttaatgtgatgaaaaagttggaagtttgaagaaaaaacttggaactaaactcggccttggtcgattgacgtgttggtgtccgtgcacatctcaaaggcttcatttttaggtttttttttctaacgtttgaccatccgtcttatttgaaaattttatacaaaagtaaaaaaaatagtcacgtataaaatactattcatattttatcatctaataataataaaaacactaatcatagaaaatttttaaataaaacgaagagtcaaacgttatatcaaaaactgaaaaatgaagctgtgggacggcatctctctctgtgcgtgtgtgttatttctctttggcttttagtctgaacttcatttaagtttcttagctcgatcgatcgacaagacaaatgatataattaaatatttataaactgctaagctcatatatatacatgtttgtgttaattccttgatttcaactcttctcttctcctgattttcatatatgttgcctatctatatatgttcttaattaatttgtgggtacctagacttggggaatgtgtatttcccacattttgtatatatatgactgcacgcagtcaaaaaaaataataatttgaagcatatgggcctgtttttataacagtacgttcaatgcatgtttccctaattaatcctcagtgttcactacttcgtgcataaatcgtccccatatatatgaggctaacaattcatagatttcatctagaaagtacagctccagagagctattgcaagagcatcaaaattttgatcgagtagagcaaacggcacgcgacgaaattaaacaaagtaccctagctagaaaaacatcgagagggaagggcgcgaggatcttgcgagagaggaggctggagccgaggtggagaagcgtatgtctccctctccaccgtcggtgcgcgcgtcgcggcgattccgatccggccgggagaggagacggaagggaagtccctcccggtggtcggacatcagaggagaggatggcaacgacggtgagatagagctgggccggcctgtgcgagtaaggaggttttctacttgtagttgggctgatgtgttgttagttgggcttctttttttcagtaacctcacaaagggtctgtttgggagagctttagattctgagaagcagctgtttggtagccagcttctgataatctggaaaatctctgaaacccagcttctggcttcttagttcattttttagaatctgtaactacagattctcagaagctgtggactgtttggggcagcttctaacagaagcagcttttggaaaaagctgcagctgggacaagctcccccaaatagggccaaagtcactgtcaatgtactgcgaaactagtactaataatttaacctgaataagatactagtaaattaattttgcttggtttcctattaaaacaccaacaacgacttctcttatacatttaccatagcatagtatagagacttaattacaacaaaaattgcagtaatgccaacaaacaattaatctttgtaatttctcacttacatgttagttgttgtacgtgtgtgtgtgaacatgacagattagctatctactattgatccaaaactagtggagtatataaaagaataattactgttgcggtttctgacagttggttcgtattaactcgatcttcttcttctcatgaacacttgcgagctagctggatgagagaattggccttcctctgcgctctgctggtgccgttcttggcaatgtcggccagatggtcatggagatcgaagccgagggcgtgcgccatgagggcgttgttgctggagcccagctcgagaagaaccgagaccgcgcactccttgttcttgggagtcccttccttgatgatctgcaccagcttctccacgaaatgctccgtcccaacctcgccccggcacgtagggttggaggccagcaggaggaagatggagagcgcctcgtcgaccatggcggccttcttgtcgtcgagcagcttgagcagcgtgggcaggatgccggcctcgatggctctcagcttgttgccattgttgagcatgaggttgaagatggccgtggaggcgtccttcttgcctctgacggtgccgttctgcaggaggtccaccagcggaggtatgcctcccagggtcccaatggcgaccttgttctcgtccaccatggacaggctgaagagcgccgccgcggagttctcctgcccctccacgctgccgttcctgagcacgtcgatgatcaaggggatggccccgcccctggcgatgaggagcttgttggcctcgtcgatggagaggttgagcagcgaggtgacggtgttctcctgcatcttcttgtcggggtaagggaggaggccgatgagcgccgggatgccggcgttgtcggtgacgagcagcctgttctcggggttctccttggacagcgtccggatcttcttgacggccttgcgctgcacgtcgaggttgggcgaggagaggtccttgaccagcgtggggatgaccaccttggggtcctcgggtggctccggcggcgggtcgccggagtggatctccaccttgttcttgtcgcaccattgcatgatgaggttcttgagggcgtagttgggcgccagggagagatggcccagcggctgctgcgtcttggggcacgtcctctgccctgcgtccagccatttctggatgctgcggcgttcataggtctgcattatttgaatccatcagataattgatatccatggatggatcgaggaagaagatgatgatgatgaatagaatacttgcccttccggtggcgatgatgacgggatcggtcatgatctcgagggagatggggcagaggaagtcgttggggatcatgagggaggggcacttctcgaggtacttggggatgaagacgtcgccgaggatgttcttctcgtcgacgccggcgatggccttgaggcggtggaggaggtcgacaatctggttggtggagtcggactggtggtcgttgatgagcttcttgatggccatggtctcggcgcggaggtcggcgaggctctggagctggaggcgcttggcgaggcggtccaggatggggcggtcggcgttgttggcgtcctgctccttgctctgcaggatcatcatcaggtccatggccagctccatgtcctgcgtctccgtccgcttcttgctccgcttcttcagctgcgcgctgatcagctccacctgctccttcacctcgtccgacacccccagctccgcgtacggcatcccctccagcgccatgttcatcttctcgtacacccccctgaacctccccatcaccgcctcgctctccagcgtcaggtagatcttgctcccgtcgtggcagcaccggaggagccgccgcgccgcctggaacgcccgccccagcagggccagccgccggtacgcgtcgtccgacagcgccggcgccgactcccggagctcctggaccagcgggaggaggagctgcagccaccgcagcaggttgaagcactccttccgctgcgactgccggaactcgtggaacgcgcgcgctgcgttcgccgtcgacaggagctcctcaagcaggtcgccgtcggacagctgccgccccgacggctccgcctccgccaccgccgcgcccatccgcagcatatccttcgatcttcgacccttgcctgtacgtgcttgatggatcgtcgttggagatgagattcatttcattgtccctgccaccatgcaatacttctgcatgcaacaaactaacttaattgccggcttcacctcaattccaggatcatctacctctatttagcatttcactacatgcatatgcacttcaacctcatactacatgttggtattctttgagtttgtgcctttgtggtgatctcaattttttttcttttactaaaaaaaattttattttcgtccttttcagcactagcccaatatgctacctcttttcaacccaacccacaagtgaagctgtaggtccagttggcacatcctactaccgtcttcaacctttgttggtagttttgtgcccatgagatgccggagttgatcctcccaaatccggctgaatttttctcgatcttccaaaattgataaaggacttttgatcactaatctactctttccattttcccaaaatcggagcgaatcaagctcaccgattgggcatcatcggcggctgttaaatagagattaaattcagcgaattaaagccgaattgaaataataaatcatggataaaatgatgatggaggagtggggaatagatatttatgcaatcaattggaggaggaaatgtacgggcgaattgaaataatacatcatgggtaaaataatgatggaggagtggggaatagatttttacaatcaattggaggaggaaatgtacggggaggtagattgtagtggcaacgatgctaggatttggcccgatagcggctgcggcgtgcggatcataccggaggaaattgaaaaaaaccagacttaccacatgcgcgcataaaaaaccgttctaccaaaaaaagaaaacggcgaaaaaaacggaatggaccagacggactttggtccgatggcggctgaggtgtacgaattggactagaggagattgaaaaatatggacttaatgcatgagggtaggaaaaaaccgttcggtctaaaaaaaatggcaaaaaaaacagatggactaaaaacaaaatcagaagccttacttttttttttaattattaggtatagacttacctagtgcgcgcaggaaaaaaccgttcagcctgaaaaaaaggcaaaaaatcatatggaccaaaatcaaaatggaatctggccttacttattttttaattagatatagacttatcgcgtgcacgcagaaaaaaaaatcaatcggcctagaaaaaaaaggcgaaaaaattgttcggcctagaaaacaaaggcgaaaaaccagatagacacaaacaaaatcgaaagccttacttatgttttaattaggtatacagatatagttgtacttgtatacatatctctctttttggtacagcacgatactactgacacactaacgattgcaggcaaaaatgttgttctggtgtcccagtaaaattaccaaacagtaagtatagcctgaacttttactgtgaccgtgatgcttctctacctaggaaaacaaataaaaatggtggagacataacggtaaggactggactgaacaggaggaccatgtggacccaaaaagcaacaagaaaccaacggcattattaagccgtcactaggaaaaggacggcatgtagcatgtccctcaaacattcattcattcgtttttcccaatcccacgatatctatactccttaaaaaaaaagtaaaaaatatattttcttcattcaaatataagtggcagcataatatagatgtgatatatctaaaactatgaatttgaataacagtctattcagatttatagtcgtagaatatgtcatatttgtagtatgttgcatttatattggaacggagatagtagtaatttatcccacaatatttatattcctttaaaaaacagtgatggttacagtaaatatgttatcctacctactctcattttaaattttgcaaataaacccctaaactttaaatcaaatccaaatggctagccccataaaaaattagagcaagacgaatattcctatacatattaataaattttcttttatccatagcaaagaagggcatttagctagtgatcatgatttctcagtcattttcctttgatttacttcaagctatgaaactatactgcatacagtatgtgttaagtgttaacgataatttaatttgcctcatcttttatatttcactcattctctccatgacgcatgggcccgattctccttttcgtatagacaatatttgagggatttccaaattttagtggcagaaatcgatccaaaatacatctgccttgtgcctacacgtgcatgagtgtctatcagtctaattgtttggcctacgtacagctaatgtaaaatgttttatcggtaaaaaaaattatgggtaaaacttgtgtacacgtcaacaaagtcaatgttgaaatatatagtatgataaaaagaaactctaaaattaactccaaaatcaaaattttaaaacttaaattttagcagcgccttataagcaaaaggcacacgatgggaggctatattttcaccccattgccacacaaagcaagtattagtttccatgaaaataaatggcaagtattacttttcaaatattttatttcctgatatgatttatcccattaaacttggccacctcatattgaacaaaatgaaaaaaaaaatcaagctatgatttaaaccatttgggccaacctggtgtatacttaaaaaataattaaaaagcttccttctatgatttaggtcattaagtcagccacctcatattgaacaaaatcaaaaaaaaaaatccagctatggtttaaaccatttgggccacctagcatatattaaaagtaattaattacagaattccttctatagtgtaggtcattaagagtcagccacctcatattaaacaaaatgaaaaaaaaagaatcttgcagttaatggtgtagcccactaaatcacacattaaacaaaaatgaaaaggatatacacaaacaggccgacgccaaccaccgttgtttttgccgattccgctagcaatcttcctagtcgtcgaccaagatcctttcatcaactccatctacttattcatccaagtaaattgcaccaccatcacattggttggtgttgaaataccctagggagatagctatgccaaccacaaccctatgtgttgttgccggtttcgctagatccaacagtcttcttagtcgttgaccatggtcctcccatcgctccctcaaaataccatagccaccattgagaggtggccatgccaatcgccattgttgtttgctgattccactggatctagcggctttcctagtcatcgaccacccctacatatgccaccgccacatc

SEQ ID NO: 38633 - DNA, 510 bp, Oryza sativa
tatatatatatatatatatatatatatatatatatatatatatatatatatatatatatatatatatatatatatatatatatatatatatatatatatatatatatatatatatatatatatatatatatatatatattctattaatcctagtggacttaggaacaggaaagagaaaaagatatggagaaggtactgtgaaaaacgaaggagaaagagaaagaccagctagggcagcaggaaaatgcccccctgatagagaagaattttcatataactatataccaggacaatataggcacatgggtactaagagaagagactttgagaagcctgttaaatttcaaaaccagaggagtgatggtgctatattaaatttagccgcacatgaccctattgattggcctaatattattaatatttggaaatgtttaatagttcaaaaatatatacaaaaccagcacaatataggaagtaaagttgaagatatgataacctacttagaaacat

SEQ ID NO: 38634 - DNA, 1191 bp, Oryza sativa
gagagtgtacagggaacggagcaatgggaggtgattatcatgtcccaccaattgcttatctaaacatatttcttttgttaatttcattataaattgcttaattgattctcaggaagattctattttttcttgaaatcagggggctaaggcagccagtgttcaatattctcaaaccattggtagatttagttttgaaaaatactgtcatatagtttggaattgctcaagctgcaatcaccattttcatgctcatgacagggtggagcttgctggccctttgcattacttgccactcttgtcatgatctgataatattgcactacttatgtgatgtcttctctgtgccttgttaactgttatgtcggttgattctattaataaccagcaataaaaatctctggtggctctagtttgtttttcttgcctacatcatttcatactctatttacttacttttagagcataatccagtaccgttctcccatgagttgctgatggtaaaagtggtactactttccatgcttttctgttacgtgcttctctcaaaaggaactatgtgtttccgatcagtctgaagtgaatttccttgggaggatttcacaccccaaccttgtcaaactcttgggctattgcaaggataatgacgaactacttcttgtgtacgagttcatggcaaaggggagtttggagaatcatctgttccgcagtgagtcttttcttggattccctttttttaatgataatatctgaaacatttctttttatgtcaatttgtttacctctctttatgcctactctctatacaatgcatcactttgcagatgttggtgcaattgcaacatcgttttcatcatgtattatatattaagcaccatattccatagtgctatacaactaatgaaacggactttttgaggacatcagcatcaacgaaattgtctggacctagacagttccttgttgctgctaccttcaattattctttccttgttatgttaatgtttcaatataatatgaaaattattactctaatttttttgctagggtgtcaagggaatttatgatcaaacatcctattttcctagttctgatgctaattcttcatcatcaggaggagcagtttacgagccactgccttggagcctcacactgaagattctcattggtgcagctcgtggccttgccttcctt

SEQ ID NO: 38635 - DNA, 731 bp, Oryza sativa
gataactgcgcgtatattgcatttactaggtgttaattttgaatatatcaatcaattaatggacctggcatatatatcttgtaagtattaattactgatcagttagttaatgaccttgtgaatagttgcattgacattggctttctcggtgtaacccaccgacatggtcagaaggtactgcttgccactcgccacgtcctgtacgtacattcatacaaacatgcatgtaagagatcgatcgatcgatacatagaagctagctacactgacatcgatatgtgatggaggcctgtgcatggcgcaagcagagatgaagatcagatcgatcatacggatgttgggtttccccagaggcggcggagatgaagatcagattcccggacgacgatgcccggaggcagcctctcctctgctgctttcttcctcgacacctgtactgcttctgcttctatcttgctcttctccttctgcaagcatcatcaatatatataattgcgcacgtttttgtattacttaaattggttattagtattaattagttcgacacagttacgttgtatatatatcactatatatatatagtagctagacgagatatatattataccggccctgaaatagtggcgtttgacgaaaagttggcagtggcgctgctacggacggaaaatggtgccgcccacaacgacatgtacttgttgagtatgttgatgttgctggccgggggtgcagga

SEQ ID NO: 38636 - DNA, 2175 bp, Oryza sativa
  unsure (1)..(2175): unsure at all n locations
aaactgtaaaagcagattagaaatcaaagttgaaacaaaggctcggcggaattactctagcaaacccctcttgctcacagccatgtgctggtgaggtctccgatgatgttcttgatgtcccgcagagccctcctgttggtgtttgccatctcgggcgcatgcttgacgccctccattgaaacaccttcgcccaaatttacatgttagagcagcaaacaaaggccacacagaacaagcctgaattccagatgcggataaagttggtaccttggttaaagttctcagatctcatgttctccattgctgacgttctactgtagaaaaaccaaaccgaaattttgtcagaacacgaacgctttttttgtcagaaatcgaaaaacaggcagcgatatgaacatgtagcattacgagccacgcggatctacaaaaggcaagacattattatttgaattcgctcctgatatttcgctagatgtcttaaaaattccagttttgaccacgaaacgacccccaagaagtcaaatatggcagaaaccaagagaagaaacagattagaaccctcgtaattccaactcgagagacttgctgtgcttgaactctctcgtcagggtggagagatcgaagaaattccacagcagaaaataaaagaaaagaaaaaacacccacaaaaaaaggaaggctgtccaagaagttgctgaacatgccttccaagaagcggaatcatctccctgtcgagtttcctccgttcttggtagaaaaaaccaggaggaagaacccatcaaaaacatcaaagatctaatcttgaaccaatcctacaggctagagtaccgacgattcgatttcagctagctgctaatctttttccctgaattactcgtccacgtctccatccaagcggagatccaagggaaaacgagctcagggaaccaaatcgaacgcaaaaccacatcaaaaaaaacccctcaaaatgaaaatctcctcctctagcccaaatttccgaccaagaacgcatcaatctaccgcaagaaggagccttacacgatctagaagacgagagaggaggaagaagattgntgccctgccacctctctccccctctctctctctctctctctcgatgctccagaagaagaagaagcagcagaggggagaggcctagctgcgagtgcgagctgcggtggttggaggagcggaggagaggggagacaaaggagagataaaataggggaggtaggaaggcgtaatttggccgaaaaggcaagggctcacccggcctctcctgtttaaacgcaacggtcgtgggatctgggccgtcggatctgcatcctgcggcggaggagtcaccccgcggccttaacggctacccgcaccccacaaggcccgattcccacatgtgctttcaaattagaagctggtctcacttgtttccttctcccctcctcatctcatcgccagccaacaccttttaggggtctatttttagtcacttgcttcacaattctcctttaaatgcaccccccctactgtcatgtcaggttttattaacaaatattgcttgattcgaatgcaacagattttgcaaaaactatcttccctgttacaaagataattatatatcatggccccactcaatatatcgcacaatacaaatcatggtagtaacttgtacaatttggttagcccttgaatcttaggttttcaatatattcttataattttctgtttaccaacacgcagaataccgggggaaatatgtgtgctctttcgacaatagacccactgttttactttgcagctgataagccgtgaaaaaatgaacgaagcaaccaaaaataatttatagttaaaaagtttatatttatgttcttagcaattcaaaagccaatgatagaaaagaaactacgatgaaaaaaaactccaaaaccaactctaaaattaggtttaaaaaaattcaaaattttgtagtggctagtaagccaattagaaaacaataggtgtgaatgaccttttttttttgccaaagatctaactttacaaaactatgccatgtttatatcatgtgtaatttaattagttgagttcataaagctttcattatctttgaaacaactaaggacataaggaacgtgattaggttgtgttcttatgagtcttcctcttggcacgcaaatggag

SEQ ID NO: 38637 - DNA, 13741 bp, Oryza sativa
  unsure (1)..(13741): unsure at all n locations
ccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagataccactggtaataccaacatcatggaatgttaatgatgagaagtacagaacgccatttatgccagcaaactgttgcagaaagaaaagggaccctccaatcagtgcaactgcatatacatcagaaattaagctattaatatcatggaaataaagatcataataatgcaaagggaaggaacaaatagaaacaagtatacagacattaagtcgccaccccctgctccccgctaccagcctggtcggcgcccggctcaccaccgatgactgtcgctgcccgccgcctgcgcattcaacgacaagggcgggagttcgccgcagccgcagccaccgctcccgtcgtcgtcgtcgttgccagcggccggatcaacggctgacggatccgctgacccgtgaccttcggccgctggggtcgaagaagacgaaggagagagggaggagaggcggcgggatccgcgagcaggccgcagtcgccgatgtccccatcgccgcatccgtagccattcccgacggcagtggagccagctctcccgagggtggcgccgccggatccgaggaccaccgttgccgctaactcccaacgccaccgcctgccgcttccgaggtcggggatggcggatccgcaagccgtcgccgctccagagttcggcggcggcggatccaacctctgccgccgcaactctcgaggtctggagcggcgggcgcgcgtcggagctccgcatctggccgccgccgccaccgccatcccccctcccggcggagccgcctccaaaactgccttcaccctcccctccaccctcctcccctccttatccaatctagccagcagccccttcaccacgtaaccggcacgcatgcacaccaccacagcgcccaaatttgaattttttttaaaagcaatatgattttaatgaaaaatcgcaaaactatatgtcagttaggcgaaatcgcaagtttagcaccctgtcgaacaaccgcggttcgacagggatacctatcgaacaaccacagttcgacaggtacatgtcgaactgcgtcagttcgacagggtaggtggtccaaaaacaaataaaaaattacatgaacagtatcactacaatgctaggcagggacatatcgaacagccaaagttcgatagggttgcgtgaacnnnncgnnacnnngatgctacagtgctcgcagtcacatatcgaactgccttagttcgatagggtactgtgaacagtgtgcaacagtgatttttctctttttttaatttttttaatcacctgttgaactaccgcagttcgacaggtaccctatcgaactgtggttgttcgataggtaccttgtcgaaccacggttttttctctttttttaatttttttaatcacctgttgaactaccgcagttcgacaggtaccctatcgaactgtggttgttcgataggtaccttgtcgaaccacggttgttcgatagagtgctaaacttgcgatttcgactaactgacctatagttttgcgattttccattaaaatcatattacttttaaaaaaatttccccaaattttgatcaaccagcgcaccgcttatgggcggttgcccccttacgcgcaaggagcaagagggattagcagcgacgtgtaaaacaatataagatagcctaaaaagaatttaaaaaaatgagaaaaacagtggggttaggagagttattgattgatgattagcgttggggaaacgcatataagagcacccgtaatagtaaagtaaggtgctctctataaaacatgtacatctcagcaatagactagattaatagtaaatcacctcaatagtatgtctacatgggtatctatagctctctcatgtattgcctcgtttttctctatagactatctctaagttagtaaacagttttgctctctctctttatttaatatcttccaagtagaaaaatatgctgatatgaatctcctgtagagagtttataaataaccattgtgggtgccctaaaaagcatatcagtagtagaaggtacagtaaaaagcgtcgataaaaagcacactactcggtactcacattctcaatagcatcaggaattcaggaccattacagccgcgctggagagatctgcgcttctgtaattgtgtttgccattccacaggagtgagtggcagacaaatcgaatgaacgcaacaaaaattgggcacaacccgacgctgcccgacaaaaacacagccggccacagcttctgtacaaaattatgtagcatcaacggcgagagccgctctgttaccacagcaggttgccgacgaggcagagagcgaacgccccaagaacgtcgccgacgacgtgccggccggccggaggagggccggagctcgccgccggggtgctcgtcggcgccatgccggccatgacgcctccttcggatgccatcggcgtcggcgaagggccgaggtacgtctcgaagaaggacgacgtcggcggcggaatcagcggaggatactgatgcggacctgcacgaaaagcaagagctgcataaagtctcggtttttcaaggcagaaatggtgaactgagacataattgagcacgaattttatacctgggcattgaggcttgagtgctgtggttaacctgaaagatgcacaaaatgtatcgctacggtgagacaacggtttctgaatagcaaaatgcgagatggatttgggacacacacacacacaaaaaaaaaaaagctgatcaattacgtggtgagaattgtgccgttcacgaatccgccgtagctgcaggacgtgacgctgcagccggagctggtcatgaggagagtgaagttgccgagcatcatgctgctgttggcgcactgcatgctggagcacgtcgagtcggcgagcggcgccggcacgcagaacaggctgcaacagcagagcaaaagcaagcaaagcaacgggcaacggcagcgtcagaaacaggagagaaatctctcggttcgcgtaagatctggagcagattgaagatgggagggtgaaatcgatcggtgcctactccaagttgcctgggccacagctgcactggacacaccggttggcagtaactgcgtaggtcccgttcgccaccgccaggccgtagtccgccgtgaacgccgggaatgatgatgtgcacgctgcatgttcgagagaaaaaaaatggtactccgtcatgattaattgcatgtgagataaatgaagcagaaaacggtatagggataacagtgacgacgaggacgaaatggaccaatcatgtactaactgtagctaggtactggctattgtagtggccactgattaattatgatagaatcctgtttgtccgtgatctgacagaacatctgggtatggaggggattgaaacttttggccacttcccttcagaaattatcggaactacaattcggtctagaaactcagagcagagtgtttagtttgtttaccaacctccttttaggaaacaggaaaacagcacagcttttcagtgctgaatctatgtgcacaaatgaaaatcgttaattttttcaatgcatcacacatggatcgcacttaagaactctagaagacctttcagctattcacaacagagaaaacgacacaacactttctttctcacaatagtgaaattaaagtctctctaagtttgtgttgaacattcttaattgtcaaatttatgtcgtgcaatcgtgctgcatgctacaccttttttttcatctccttttcttgggtgtcagcttaattgacagcaaatgatcaaaaggagcagtggaaaggtaaagtttcatgcatggacccttttattttaaagctgagagcgccagtacgtgcagatacacaaacagagcatccgaactggcactagtaaacaatttgagcagacaagcagtgatgcgctgcattgctggcactcatgtttcacctcacgaatcttgaagcattttggccctgtttagttacaggatgaaaagttttggcgtgttacatcggatatatggacatagacttaaagtattaaacgtaatctaataaaaaaataaattatagattccgcctgtaaactgcgagacaaatttattaagcctaattaattcatcattagcacatatttactgtagcaccacattatcaaatcatagcgcaattaggcttaaaagattcatctcacaattacacgcaatctgtgtaattagtttttttatctatatttaattctccatgtatatgtctaaatattcgatatgacaggataaaaagtttttgcataggaactaaacatggcctttctgatatcaaagctagatactccctccgtcccaaaatatagcaacttaggatcggattagacgcattctagtactacaaatctgcacatgcccgtatccagaattcggagtaaatctcatgctcgcagtagcaaggcttgtggccagtgcggttactgcattgcactaaattaccaaggacacactagactaatcacattactgtcagtatagtactcctactgctacttcttactgagtatggagtaaaattaccaaccaaatttgtcggttaaccacccatggccatggatctaattaccaacgaaccacgcaatacatctcggtagcacaaagcaacaaaaccaaaaactaccagatccaagaagaagctatgaattgaagctagaaaagggctcacctggcagcgggacgacgatgatgtcaccggcggcgagctcgggggtggccatgtcgttgacgctcatgaggtcggtggccgtggtccggtacctctgcgcgactgcggcgacggtgtcccccttcccggcgacgtacgtgaggtacaccgcggggaggccgttgtcgacgccgccgaagcaggcgcagtgcagcggcacgaacagagtcgtcccggcgtcgacggcggcgtcgggcttggcgccgaggatgccgttggagtcgctgatccagtccggggtggtgaggccgccgtagacggaggaggcgacggaggcgagcgtgtcgcccgggcgcgcaacgtagcgcacggtggtgaccctgcggatgccgtcggagcaggcgcaggggacgggcacgcggagcgggagccccgcggggaggatgcggtcggcggggtccgggacggcgaagtcgatggagttggcggcgaggatggcgagcgggtcggcggagaagagcgcggccagctcggcgagcttgaggtcggcgtagagcgtgtaggagagcagcgctgggcaggcggtggaagaggagcaggactccagcgtcgacttggaccgcgcgggcgcgacggcggcggcggcggcggcgaggaggaggaggaggagcaagggtggtggcatgatgatggcgacggtggtcgggagcgcggaggcgtgggagtgtgtgcgactgcgagccagtgagagtggagactgttgacctggagtggggcgatgtcgagagagtgctttgctttggaaagcgtgcggggggttttggatcttgtgttcggctgtgcagaactgcagacctgggatcacatgaggtgtgagtacgggagggtgaggtttttacgagggtgcttgcgagtatctgcgagactgcaaatgcagaggatccagatctgcgagaagctggtgttggttcgttcgaattttgttttgtgccgtttgtattctgatccaatctgattttgatcagatcaacggagttgcttggcatcttggcagtgtacggttgcgtcttttcctttttgtcctgaagagcgtgctgattaggagaaattgtcctattcatactcctctactagtacccctacctccgttcgtataatataagggcatccacaatgtaagacacttctagagtgtcctcactaactgaggagacttgtaggaaactcagctcgcaataggaggtatctctggatgggctcctcaaaatctgaagcaacccgatgaagatactacagcccacaatgggtatcttggcccaaagtaaccccagatgaaaaatccccaaataaccctcccagcccattcttcttttttccttctcttttcttccaccctctcttctcacgtcttctttcttcttcttctcgccctcctcgtcgaccattcgccgcccccgcctcccagcctgccgccgccacctccctcctctctcccccgccgctcgccgccaccgcttccctcctcgccctccccagccgccgccgcgcctccctcctcgccctctctagcagccgccttcctcttccctccgcctccaccagccgtgtcccaccgtcgtcgcagaagtggttccagcgccggcggcggcggatccggcaccgaggcgggcagatctggtgggcggacgcggccgtcgaggtggcgggtgcagtcgtcgccgggtcatcgtcatcctctccgtcgcggaagccgagcccgtcgccggttggtggccgccggctgccgcggcggtggccggatctggtcgtcaccgtcgcggatcctcgtcgtcgtcgcctctctcttctctctctctcgttgccatgccgccggtgaggggcaagaaagggaaacgccaggagagaaggtaggagatggggcaccgggtcgccacaacgcgtagcctcgagggagtgtctctggaaaaagtgagctggggagctagaggggcgcgttccccgcgtgagggtcgcacctccctctagagacacgccgcgcggacggacggcggacggcatgagcggggggacgacccagggacaccgactgtggatggcctaagaaattttgtttctataatttgtcccgcaatataagttactatttggaatcccaagataacacaatccctttcccattcatcaatttttttgctccctcatccataaatataaaagattttggttagatgtgatgtatcatagtactaaatcctttacatttagggacaaggagagtattactttattcttccacctatcaactctttgctaatttattccacatatatcaaatcttgtacaattttatcctcctatctaccacaatttgtattattttatcctcctatggtacaattgtgttaactaaggataatttggtgaaggaattagaatgatagtttaagatgttgttttttatgaaaaatgaaaccatctaccatctattcattgaatgtcattttttgagatttctttggagatatgtacacatttcttttgatttacatcctccacaaagtatgtctcatatattcgggaattggcttgttggtgttgataaaagaattaagaatcttattcttgttggagcatccgctttatgttgggctctctggcttagtaggaatgacatggtttttgataaatcaccatcaaaatcttatttacaggtacttttgagggcaacgtattggctctggtgttggacccaattacaaaggtgtaaagaagatatcagcctaattaatgatgcatgtcctaaacttgagtcaacgattatgcagctcttccccaacttcggatggaggttctcaaatagaattcaatagttgtgtgatctttatcttgttggtgtctattagtttgtgcttgtttaaaattttcattctgtggttctagactcactgtgtgagtttgttattgtgtgaactatgtaataattggctgtaactcgtttgagcaaaggccgaaatattttattccattatcttaaaaaaatatgttgctacttccttaatttatgttaaaaactgtataatctcttgtattatgggatggatggagtactttcatcattttaaaataagtggtattttaatattagaaaatactacagaacaagttctgtgagtggggcaatgtgtcagtacttcttcggtagtgtaggatgggaactaatccttcatgcacgcaaaacggagtggtttattagcacatgattaattaagtattagctttttttaaaaaaaaagattaatatgaatttttaaagtaacttttgtatagaaaatttttacaaaaaacacacactgtttagtagttcgaaaaaagtgcgcgcaaaaaacaaaagacgtgagttgggaacatgaagtgccaaactcagcatggacaattatgcatacacgcttttcaaactattaaacagtgtgtcttttacagaaattttaaaacgatgctattactacgacggcggtgcccctccccgtcgaccgcctccagatcgatgccgccgacgcgatggcgcccttgccctcccactacgtcacgagagagaaggtgaagagaaggggggagaaagagaagggatagggagggaggaggaagaagagaaagacagaggatgacatgtgggcccacatttttttcgagtaaatgacatatgggacctacgaatattttctaatgccacataaacgtcatgtgggatgaagccaacaacgccacgtcagcaaaaccgccctccaaaaccactgagggggatcaaattgcactggtttgaatagttcggggagtcgtcctatccggtttttgcgattgagggtcacggatcagattcaggttactttttaagggagccaaagtggacttattcctagtctgatagtaaccgactaaccgttgctttctgggccgtgttgtactggagcacaggttatgacgtgcggaggcccaaagagttttgggccgtgggggttgcttatcttgccatccttgacgcgcgctgagctggcccagacgcccccagttccccttctctgatgctttttttttaacgactcgcacgagacggtgcgaagttctaattacaagattataaccctggagggtcgtaaccaggaaaaagaaaaaaacaacaccacccacacaccgacatcgccaacacacaagcccaggagaaggctagcaccggaccggccgccgctaagcgtgaccagccgccactagactaacaaagggacacagctgagatcgctccctaggggatgccaaaacgacgtcttcaagaagagaagcgacggaaaaaccgccactgccgtccgtcgggactcaaaggagccaagactaggctttcgcccggcaatcgcccttgaggggtgagacctacggctgacacaccgatgctccaccaccacacaagctctgccgacatgtgggaccctgcaccggcgtcccctgccgaccagccttcgtgcgccgaagatcgcgccacacccaccagcagctcctcctcacacctaggtcgcctcctctaccgccagccgcgcctctcgtgctaagccggccgcctccaccggacgcgcctctcgcgccaatccggcctccctccatcggctgcacctcttgcgccaagccggcctccaactctgccgcccgcgcctctcgcgccgagccggcctccactgccatcggctgcgcctctctgcgccaagccggtctccgacccttccaccaaacgatgccgcgtcggccaaatgcagccatctcccacgccctcagctagccgtccagggccgccatgcctccggtgactgctgtcgcggccaccagccaccgcctccgtgagccgccgccactgccagcagccgcttcgttgtcgccattcgccatgctgccgccaagtccttcgccggcgtcgtcggccgacgccgtcgctgccaactgccgcggccacaccgccgccgtcgccaactgccgttgccagccgtcgcaagtcggccaacgtctccgaccaccacagccggctaccctccaaatccggccgagaggcgcggatctgggggcaccgccgccgtcgccgcgcagggaccaataccgccgccttcgcgccctcggccgacgccatccccgccgccttgaaccaccatgacgccgtcaccaccaccaccagaaccaccgccgcccagctcaaccccgtcaccagccgccagctcgccggcactatctccgccgtggcggccttgccgttgccagccagccacggccgtcgtgtcgcgctgccagccacagctgcccaccggccagccacggccgtcgcgccactgcgcctgctgcggccgcccgctcccccagccgtagcgcttgccgccgatgccgcgtctccccgccgacgccacgcttccgcaccactgctgaccagccacggccgtcgcgccatcggcgtcgccgcatctgccgtgctcccgcaccaccacggctcagatccggcagcggagacgtcggatccagccgccactcgcctcgtggccgatgctgggcgccggatccggtggtggcggcgccggatccgctgctcttcgccacaccgccgccgcggccttcccgaagctccgcgccgcctgggttggagcctcgccgccgccatcccagcggccgcacgttttccggcgacgtgctccgacggcggcgaggccagagagaggaggggtgtggcggcggtgctagggttcacccccggttgcccgcgcgaggacgacagggagcccagttgactccccttctctgatgctcagttgacgtgtgcgtgtttacaatgttaacacaagcattaacctcgaaaaccactgtataatagtagtatgtatttcatcctaaaaacgacaaaaacatgtggcttgtctagttgtctagctagttaggcatgaatctacaagctagcatcattctcgtcagccggtcagttataatcttcaattaacgtattcccagagtgatccagtcttattttttccagttcttatcacgcaggaaattacaggacacaatatctgctgcaatttgatggtgatgttgttgaattaagatttaggaacattaattggtttgagttatctagctaggcagaaatttggggtcgacaaggacaactagtgatgatcattgcgttgatctttctgtcttccagagattaccaaagcatcgatcaatgtcaacgcatgtgctcgtcagtttcacgaacagagtcatcgattgctccaagtctgcatactgtacaccaaattgatctcatcaacgacatgaaccttggattctacctcaagtggaggcgctaagctagcatgcatccttctgaaaccatcataggcatcgacatttgacgtaccaatgttcatcattgtactcgatcaagacaacatatgattagtagtactgctgcaattacatatctgaagatttttctgaaaatgcaatgtcagtatgcagcgcactagtaaactgcagtctgcagaagaacacacatggaacataaatcccagagagaaaacgatctggcgccttgaagtggtgcaacttgtggtagtagtttttcgccgtgtaaatggcatcgtcgatcaattcacagctgctgcgtgagcgaagtaatgaggctagctatagccgtgtccctgcttaaatgcgtcggcagttacgttcatgtcctccggtcctccccttgttctgactgtcagagtgacagtgctcacgtttactaccaccctgaacccagtgaatactagcattattgctacgtacagtactagcatagtaccacgatgcagtgcttcacaaatcacaatatgcatgcacgtacagtttctgaatttcatctccaagatctgcatgcatggctgttgatataagttttcagagaagaacacctgcagcaattaaatccgtgcaatgcatgggtgtgatatcattttcatgtaaacatagttaagaacttgatgagatcgagatttgatgccaatgcagaaatgcaaggtgttgaggtgcataaaactgcagggtagcagttgattcagagtcagtgagaactgagaaaatgagaagctcgcagcatgcgtttccccgcatgagcagcatgcctgacacacatatacactgctcactgtctacaaaaacacatatacactatatagagtaactggtccttagctatccagggtttccttctagatagaaccaaaaccttggattcttgatgagcaaacctagatctttgttaaactttgcttgttcatatgctgataaaacaaagcaagagctactccagttacagctaaaagcaaatgaaaatttccgggttaatacttaatacacaagaacaagaactggaggtgataaacatataacataccagtgcaccacactcggatgagagacatattgtgcagatgctggttaaagggattgaagcctggtccgagatcaccaagcatcctgtgcctccatgaatgaacattttgcacaatgtggagaccttgaaccagacaacaatccccttaacctaacttcagcctggacatgccatgcactccaaaacaagaactcctatcaaaatcaaactgattcagagatgccaagatggagtccaccatggacagtggggaagaggaagaagaagaagaagacacgccaagagaggtagctactgatcgagccatcagtgcagtagagcgctggtgtttttgaagagggagaggagggcagttggcgcagctccttgggatgggccgcgcgagctgaattgccatttattgaggggctagcttaccaattaccattgggcacgagctgctctgatggctgctgcaaatgggacttttatgacctgtggtgtactggtacagcgtatgagagggaggaggacattgtatgttcataccttcagactcagtcatgtgtggagtgcagaggggggagctggtgatagcattacactcgagtcacaaatatgtggggtttttggccatcttcgtaattgtccctgtcacaaatactagatatggacctgtttggttggttggatgcctaggcaaaataggagaggagaggaggattatttggatggagcaacttagctagaaacgattgattcttttggaaattcagaaaattatagattgaatgtgccacatccaacccgaatcccttatattttggaacggaggattataaacataacaaatagcttagaaaaagtggttcaaattaatcattttattagaagcgtggcataaataatcttagtccaataatccatttggaacatggttatatgacaaacattttgattagtgccatacattcaccggttggcacaaaaactaagcccaatttgtatctgcatagttattccctccatcccaaaatataatcacttatcgagctttttcaaagattagggagagaggtgaaattaaattggaatggttgttggttgatactactaggaagtagtttgcaaaattaaatgagagatcattgccatttgctgagacgaggaagtaaatggagaagttgctatattcaagcatgcagtttaaatgctagaagttactatattttgatagggagtgagtacaaatttttgctaaacatgtgtatgtatgatttccgagccctaaaaatggcatactccctccgtttcaaaatgtttgacaccgtttactttttagtacgtgtttg

SEQ ID NO: 38638 - DNA, 7274 bp, Oryza sativa
agggttttttttttttttgtcacaccatggtgaatggggtggcactttgttgcacacgctgacaactcaccaacatatctactagctttttttttgttctaaatgtttaaattttaattttaccaaaatgcctcattttacaaaattgaatttgtccagagccagaggtacgcccatgtgagcagtcatttgtgtcctgctcagccaggctgtgaatggaccgagctggaggccctgccattatctttgacgtggttgaacctcattggttgcagcaattatggagtcatgatgcggtagtgattgagatggagaggaacaggaacgcagcaaaagctgatatctcgataaacgggagcatcacagctctccatgtactacgcattcaagactacagtacgggatggttggagtagttccgcatgggtctttctttttttttcccttcattttgtttaaaccgtctagagcaagtataatagtaagtacaatagtagagtattagccagctataaacatatttaaatgagataaaagatgagagagaagagtagcaggctacagatcggtagccagctgcagtacagactccaaaatgcaatatgtgtatgacatgtgagaccatatattaatagtatagtaagcaactatggtatgaattgtctattagattagctataaatgaattagagctagtagtgggctatactattaaacttgctcttatgtgatgatgcatgatgcacttgcagagttcaactaaagttgaacgagaaagaaaaatgctaatagcaacataaacataaaacagatggagaaaatagacaaaacaaaaattaagtttacattttatatggcgtatgaagcacaggaataaactgcctcaaaaacttagtacatgaatagacaaacaaagaagagtatggagaagatatccttacccctgcattccaaatgacagtataacatttatactacattcgttcctaattaagtactgcacttccataagtactgcacttccactattttaaaggcaaattaccggagcagaaaaataacttaaatgccatttattaaatgagcgatggttggaacggcggggatgattggtactaagatagaaagaaattaaaatgatgagtggttggattaaaaaaaattagaaatatagtactagtacacttgtgagtaaattgtaatagcggtatataaacttgtcagatgtgtgcaatctagtgcataaacttataaaatatttattttggtgcacgaacttatttggtgcatgcgatcaagaccaaaatcacttgacaaggataatcttgctgattttgttgttgatttgaatgctatgtaaacatgtgtctcagaaaaatatcacatagataaagatctgtttagcaatacatataattaggtatattgattgcataaagaaagttcggtcctgttcactttgatgtcatttttaaccttatcaaattttggtaaagttggcaaaaaaaaagtggctacatttagtttgctacaaaattttggtaactatatagaaaatcctgccaaaattttaataagttgccaaaattttcgcatttttgacattaccaaaattgggtaagattaaaaatagcatcaaagtgaacatgcacgaagtgtgagccgtacatggccgttgtatgctcggttgccccgttccaaaatacatgggccttttgggggtgaagtgtgaaccatgcatgggccgctgtgtgctcggcctgctccggcccatcatttactgggccggtttacccgcccacgtcgccacgagcggcgaaccaccaacccaaaatccggcgacttcgcagcagccggggggacgaggagaggagagagaacggggaggcgtctcaaaacgccaccgccgcgcgcgccctaaaaccccagcaaccaacctctcgtctccgccgcttcgccctcctccggccgcccgtgcaggcggtgcagcctcccctcccccgtctcctccctacctcggggggaaacggggccccgcggtggtgagtctctttcgatctctgctgttcaaatcgagcccctctcgagctggtagtatcccccccgcgccgccttcccgtgttccgggcggatttgcttgtgtgggttgtttcttttgctttttaggttcttgattagacttcttgatctgggaactgtgcacttgatgcttcgtggaggtgccgggagccgtatgtggggtagtctctcctcaaatttaggttttggaattcggttatgcccctgatggcaatggcacgcccaagttttaccacgtgacgttccctgtaccaaaattattataggtcgtgctctgttagtgcaaaggtaaagatttggaaaatttttggacatatattttttgacagaaaatgatcttgttgtgtgcaaacgtttgtaaactgttcataaaaacttacatgtcacgggttatgagttcaattgaatgaactatcttgttgatacacacccttccaatcaaagttaggattgatggactgatagacttaatatttcattgcttcttgtatctagatgctatatgcctgccagttggtatttagaaccttgattgctatgtttctgtatttctggcaatgttgatgatagtgcagatttttttagtgaagtcatggtattgcaaatctgcaattatgctgaagaattttctagaagttctggttgctggcaactttacatcaccatcagtgttttctgtgcatatatgggcctgtttattttgatgtcattttcaaccataccatttttttttggcaaagttgccaaaaaatgtctacgtttagtttgttgccaaatttggtcaatacataagaaatcctgctaaaatttattttggcaatattgccatcttgccaaaattttggaattgctaaaacttggtaaggtttattttggctacaaactgaacaggccctatgatttcggacataccgttatctcttgatgggagggtttgcccacatcttataattggtctggctgttgaaataccacttgttttgcagtaccaatgacaagcatcaaagctatccattttctttgccattaggatcatcataatttgttttttttaatctttgtggttgaaaaagaaaaccatgtatctctggcataaacagatcaattatctctgatattatgtccagttgtctgtttgatctgactgtttccatctggtgtccagtaggaattgtgctaaattaaatcaaaggttcaaagtttagcagtaacttttgttcccatagaatttgtcatcaccatatgatgaatttgtcaatgagtgaatattgaacgcatgatttatgtgatgggtcgattagctagaatcagactgcattgtttccaatgcacactgataaaactgtagcagcagttgacatcaagcatgtgatttgttatcttttgaccgtcgagcaggcttataatgtattcatttttagagataaggagagtgaacaaggaaattatctgaagtagagtcggctaatggatacaaatgtattgaccccctccggaccaacttcagatcaatatacagttagataagccccttttgtttttttaattctgtgatgtggacagtatgaaattatgtaattatcttttgacggactcaaaatcttatattctgaatgtatgcatcttgcagctattaccaagatgactaaaagtataaggggcaagaaatgttcatctcgtcagctcagatcacataatcggaggctcttcagccaatgcaatttcaagagagttgctaacaaggaattggcagcaacagagaaatgtgcgtggaaagattcaatctgtccagtttgcttggaatgcccacataatgctgtccttctactttgttcgtctcatgataaaggttgtcgtccatatatatgtgcaaccaattaccaccattcaaactgtcttgatcaactcatagattcgcggagaagctcaaaagattgtgaggacctagactccatagagcttacatgccccctttgccgtggtgaggttaagggatatacattggttgaacctgctcgggaacagttgaaccaaaacaagaggagctgtatgcaagatggttgctcatacatgggtagttatggagagctctgcaagcatgtaagaaagaagcatccttcagtgaagcctcattctgtggaccctgtacatacttacagatggaggcgacttttattccggagttcactgcaagatatgatctgtgcaacgagttcaccaatggtgcggagggttttgtatgttatgttgcagtttgaggagttgatggcatctgtttggcacgaaggtcctcatggagctatgcaaatcaatgaaatgaacttggctgatccatgatctcaacctcactgaaatgtgagaatatcttatgctgttctcgcaatggggtcagtgatttgagccatgctgatccatcatgtgtgacctgacacagaaagatatagcttttttagttttctgttcttgagggaatatttgtcaccatcttcagaagaaacagatcctatcctatgctgccatgaattcaagaaacctggtcaaattgtgggtggaatgtggaatggcgttgaaggcttttgttgatactatctcattgtagtcccccctttgtgtcgtgtgatgaattgatcctgtgcatcccttttgcactgtattgacattacattctattcggaaatgcagagttcacttgctcctgtatgttttattgttcctacctcctcagaaggtacccatatatgtttgttgtttatgtcgcgtgacagattggtgtatactgaagatgaaatttgcttaaaggcctcaccgccaagctacgcgtggcaaataattattcgggacagataattattgtactggtctctccgatcggtttgtcgagatggtttagattagcacgaagaatatgctttctgatctgaaatagttccatcagatggtcgctgtgcagttctacaggcagtcaagcaacacttgcacttcgaatttcgacgcaccagttcacgtaaatggcaaggcctttagagtttagaggaactttggaggaaatgaatcgtttcatacgaaaatcctgtaaaactcctgcgttccaagaggagacctaaacttcgttgatcctcccaacgttcggatcactatcagaatcgtcctgtcgctgtgcagtgtggcgccaatggcaattgcaagcttggagttataagtcaggactaacataacttccagtcaatatgatgaaagttcaggggatcaaaccgtaagacgagtgaaatgacggttcaactaatcaaaggagtgaaactaagctaaagaatatgagctcgagcaaaaacgcaaacactagtcatgcactcagacacgtcatgatctgaagaatatttagcgcaaacgaagttccgcgtgcaaagaagggattttaaaagaaacatacggttcaaaatcaattcagatattcactggtacgcacatgcaacaccaatgatatagccttgtagcattaaggatgatccagctaggttcatatatatcataatatcaatacctgcacaactgcataagcatgtcaacggctgccggccgcatgtcatactctcactggaaccaaatgggacaacttgacaatcatcagtccaggaaactattggtctggacaagtgacaaagtttacagcataaatatcaaaccaaggtttctctccaaggttaacttaaaaatgatagttaaactcagggaggtatatatgctcttcacacaaatcataagtttagatgatgatagagacatcacatttggtaaatcatatctccccctcaaaaccatgtctgaatcatggtagccctataatgtgttgataaagcatacaccaattttttgttatcaagtaaagatagaggatgtaattcaccgtccttctgatttgttgaggtacctctgaactgcttaatgcatatggcttcgcccattacttgaaaggaatttgtaatatctccactaataatatgtactccttttctactcgttgaagtttcaattgtactagaaaatcgctaccaagtcaaatagtggttttgccattaatgcaagtcaaaagctgaatgaagagacataacaaaaaggtacatgcatttagttgtaattaagaaaacaaaaacatactgtattatttaacttaatgccgtgttaacatctggtcttggttgcgaaacacgctactccaatttgctgatgtgattgagaaaccaaaagagaaggtaaacatattttaactgcgattaagaaaaaaacacacggtaacagatgacctttttgcaggtgtgaaccaaacatctgcttctgatacataacatcataattcagttagccgatttgattgaaaaggttaacacacagaaagattgaaaaaaaacactaacaaagatgcattggcgcacatttaaacaaacaacagaaatgttatagtatatagcacaaagttagcacctaagcatcataaaatacattggttcagaataacaaggagaacaccataacttgttctatccctaacttttgactgaggaatgtgcaaccttgtccataaaggtaagtaattaaccacagagattctatctagaaaagaaaaagacactaatttcccccttttaacaatgcactactcaccagatatcacccatggactcagtcagccatctccagggcatcaagcaccatactcagtgtgtccttcatcaggtccatccgacgcaactgctgtctcatctcagtcagcctgaacttccgcagcttttcctccatcacctgtgctttcgatccttcaagcaactcaaacgccttcttgaacactgctccagttggatgttggctggacagctcctcaactgtttcccacaggtaaggatatacatccttccctttctcaaactcactcctccctctcacaatggcattcacagcaccgatcccagtcccattgccatttgccatagtgactggcactgatctctgattcttgcggtgacggttatcccgcccactctccatatcatcatcgctctctctgccatattgctcctcttcgctctcaccagcatcagcattatcatacccacttcctcctccctcaccagcagtactcattgtcccccagaccttcttggcaagctcgtagatattgtggtcatgcggagtggcgaatactt

SEQ ID NO: 38639 - DNA, 803 bp, Oryza sativa
gttggctatactatttttcagtctgatcgccttcacaaagttctggagtatgtgaatgaagtgcattgtttgtgtggagtccttggaattgattttgggaagactgtaaatgggattcatcccagtttacatcagaatggtcttgagcaatccacaaacatcagcaacagcacactggaaggccttgctaatacaatatcaaatctaaaagcagaacagagatctagaatcgataaggtaatctcaaggctcttttcttcatggttttgtgctagttgttaattattcataacatattgtccaacgacaattccttatagatgagagagacaatggaatcattgtgtaaactctggaagttaatggactcccctcaagaagagagaagacaatttaacagagtacttagtgttctcatatcatcggaagaggaaatcttatcccccggggttctctcacaggaaacaattgaaaaggttttttaccagtttgccttgttctaatttctactttgtttacagctaaccttcatccttttaacagcttcatatttaaattatcatgcagatgggtgctgaggttgagaggttaacaaaacttaaagctagaagattgaaagaaattttcatgaagaaaaggtcagagttagaagagatatgcagatctgcacacatagaacctgatgccagtacagcccctgagcaaactaatgaaatgattgactctggtactatgctatgtatcttgctgctgctaagttcacttgttactattgtatataagttgtaattatcttgtgcatg

SEQ ID NO: 38640 - DNA, 5948 bp, Oryza sativa
caggaatatttaggatgcaaaaacttgtgcagaaatataccatcattgtcacacttccgttgcgtgaaaatgacgtggggattacgtcgcgggcagtatcgcgcggtgaaagcatgagaccgcacggtctcgcgcgacaacggcgcgagaccgtgcggtctcgcggaaagaaagagcgagaccgaacggtctcgcagaagcaattagcgacactgtcaaatgggatccatttgattagtaattaattacttaattaacaattaactaataataactagtgattaattatcatgattagtgattaactaattgttatttaatctctaatcaggataattaaccactaattaaatcggcaagacatggtatcgctctctgcttgagcgatagcgttggttgcttgttcggtatcgctgtttccttgagcgagaccgcgtggtctcgtgctggaaccacgcaagaccgcgcggtctcgcactttcactgcgcgataccggtcgcgacgtcatcttcatgtcattttcgcgcaatggtcgtgcgagaccgatggtatatttgtgcaaaagattttgcatcccgaatatttctaacaaaaaattgaatgaatagtatattttcaaatttaattctgctcccgtcactgcttggttatatggagggaaaaattggcgcgacacaatagacgagggaaaaaaaggcgccctttcggctgttgctctgagctagacgatgcagacgatgaaccaaggcgcagcgacgatgcagatgatgcactccgatagtgagtaagtttcaattggttgcctctcttctactgtatcccacttgaatgccttgttataattgatcaacctcttgttattaggtttcctttgatcaagctttcttcttttcacatggaagaaatatctaagtgaagatacatttaaatctctgctgtcaaaattgtgagatggaagaagaaaggtatgtcaaacaacttcatgcttatctttgcaatttttttcagtcatcttgtgtatgcgctttgcaaattcttttcactatgtgtgtacacaagtcatatacttgatgatgatgtttttctatatagagagaggctactgccatgtatggtcccccatgttggtatggaattcaaatgttcagatgaggctgggatgttttggcatagatatggaggtcaaaaaggctttgaggttagaaaaaggtacacaaagaaaatcagatggtgaagtaacatcatataggtttgtttgtggaaatgagggtcatcgaggaaatgacaaaagggatcatctaacaaagtgtcctcgagctgaaaccaaaactaattgtcaagttcgtatgagtgtagcaatggacaaaaagaagggaaactataaagtgtctgagttggttcttgaacacaatcaccccttgcacttgcatgaaaccttgcacttgatggcctcgtaaaggaaaatttcagatttacaagcttttgaaattgaaacagcaaacgattctggaattgggccaaagacggcatatgagttggctagtcgacaagttggtggatcacataatctaagctacaacattcgtgatcacaagaactatttgcggagcaagcgccaaagggagatggcatatggtcaagaaggtagaactatttgagaactcaaggatggatgcttgctttcgctataaattcctctcccacaaatttctcaacttggcacaacaagctgctagctatccagagtgcaccttgttagtaaacaatgcccttgacaaccttagcaagcaaattgaagagcaactcagtggatgtgctagtatctcggatccaagtataactcacacggaggttacgcccccaaacaatttgttgagtaatgcacacctaaagaaaaaggatcggaggttcgtgttagaagttcaaagcgaacaagaaattggcttgataaaaagcgtaggactaggaccagacaacaagggaaagggaaaaagggaaaaagttcgaaggtatgttatacaaaaagttccaacactatgttactattcagtactatgttttatggatcctctgatactcttttcttgaaaggaacaaaataatgggggagatgcggaccatgttggtgcaatggcacaaatggtagaggatagtgtttccagggaccaggagaagcttggagaatacagtttcttttaatttgcaggggcctattaatgatgatatttttactgaagtaccattttgggaataaagttgtgctgtggagaataacccaagtttagctgcacttagtacaagtctgatgaagttggggcaaaaatttcaggaaaaacttattttgtgtttactgttgattttattttggttagatcctggtgaaggattccaggtatgcaagaaagagtgccaagattaaggtagtatgcatgttctttttgccttttttcaccctttgggacaatctgtatacatgttaagcctcactctcacatgttcaattcagcaacaccagcacattctactgtcagcaacaacaactgtctcaaatatttggcttaattcaatttacaatcacaatccatatcaatttatattctcctctcagcttctcgagcagttgctgtaagcctccttcagaaggcagaggtgatgatattagcctcctctagaaaatgcagcagccagtgccttcctcctgtcgtggtgtggcccatgatagtgctctgctgaggatgtggccgaagagttcgacgagggcgccgcctccgccgccgtcgtcgtcgaggcacgccggtagcagggtgactctcgtgcaggggaggccgcgggcaagagatggggatgagggtggtgggctggtggtggagaggcttccctagatctatggtcgagctgaacccgcgccgagggaggcggcgagcttgcgagcagaagcgagcagccggcggccatggagcaaggcgagaaaggagaggaggaaggtcgcatcgtcggtctttgattgttgactgtgcttctgtgggccggattttgttgtcatgggccgtgtgagccagttcattttttcacactcactgattgccgtctgatgcagatcgtgcgctccatcttgctgctacttccctctgacgtaacttcgactacgtcagacgatccgaatccctttgcttgtgttggagttggtcattgttgtggttatactcgtctgctcacatttttacagtgttcaacgatgtggattatctttgttctttcctgataggtctatttttctcgaacgctttcctgataggtctaatatttttttttccaaaacaaggttgtaatcagctcttatatttaatcaggcttgtttcggaaaaaaaagattaggtcaatttggaaccaagatggctgcaaacctgcaaattacacatgaagggtgtgtttagttttttgtgtaaagtttttgaagtatacggacgtatatttgaagtattaaacgtagactaataacaaaataaattacagattccgtctataaactgcgagacgaatttattaagcctaattaatccgtcattagcaaatatttactgtagcatcacattgtcaaattatagcgtaattaggctcaaaagattcgtctcgcaatttatatggaaactgtgtaattggttttttccccacatttagctaaaaacatttgatgtgatatttttagttaaacttttttggatctaaacaaggccgaagtgaacatggcacaaaccctccaagtatatgtctggcacatatatagactcccaaatcatatctagcataaacttcagattgttttttaggcaaccacagaaattttcttggcttcaaacccaacccctaatttcacgctcaaatcatacatttacacacacaataaataaataaataaataaataaataaataacaagggaatagaatccagtggactgaaactcgtcactttcacgaacaagtctttagtggcaagataaaattgcatccagtgccagtgaagtcctcggaaacacattagactgagacctcttgatttctaaaattccaatggatcatgccagctgatgtgctccagtaaaaagcttgctggaaaagacaggaaatactgcaggctgctgctttcggcgagctgctttggataagaaaacgcattgctatcgttggcactgttacgactcggtctgtggttctgacttccgatcatatccacaaatccacaattactccagtttgttttgtcaacagacaacagcataaagcatagatttctatttgaaggaaaacacgttgaggcaaaatatctagattacgaagtagttttatttcccagagaaaagcatccctcctaaaagaccacaaacgatgtttttcttcaactaaaatgtactgtaataacaccaaaggagcattctgaaaattgtcccgcccaaattgtacagttgacacgagtgaagcattagtgttactcagatttacagtctggctaatcaactctaacatcatttccggaattatcagaatcacaactcgtcatttactggagagttgtcggccatcagctcctcaagggagaattcgtcctcttcaataacctcaccatctttgccgtcccatggttcagattggactatcgttggggtaccgtccaaaggaagattacccttcccaccgcgccctgcttccttcacaaactcactgcaggagaccggttttgttatcaaacatctggcaaatgaaccttaagcagcaattaattttctatgcacaaggaacttacgttatttcatcaagctggaaagcactacggagtggagcatatgcgccttttttcacgttgagagcaaccatcgctggatagccataaccaccaactccaacttgcttctcaagatcagcttgcttcccagcagctgtccagacaaaactgcaagacaatgctttttctagctcagaatggctttctcaagaaacggaagagatttcaaggcattaactaagtgaatggatttgtctgaggaaacttctcaacatagaactcagtcacatggcagatttgcatatataatatataaaatctccattatgtttagagcttatagtatacacgccttggcatataacattatcgaactaagtcatttaattcttttaaggtgtttcaaatatatgaaggttactatcaatctttttgtcaatcaatattcaatagcaaaaggaaattaatgtatcaatttaactgtggatttttttatctcaaaagacataacaagacaaggaatgataggtagaatggtataaagtccacaacaagtttagttgaatcttgcctgtatggactctttttaaatttctcagcaacagataatagcagctcaaggtacttgtttcttccttcggcctttgaatccaagatatctggaaggaaagatacaaagcaaatggcagcagaagcacatttctcttccatggcgtcctacagaagccaaaccacctcgtcaaaacatcaatcccagaccattgtctccacaaaaggataactttgttaatatcacgaaaacttactgggccagtcaactcagaaacttcaggtggagcagcattggcttccaactgctccaatgcaaaggactcgatagcagaggcaactctagccccctggtaagggaatgggctctccttatcggcaccaaataccaaaatagtaggaaagccttctaccttgtacttgctcatcaaagactgcaaaattcaagtcacacgttatgttacataagtggtacttgaaaactaggttgtatagtttgacaaatgttgtacagaacgcacatgaatgctttaaaaaggtcaaacattaactgtgttttataaatatactgatacactgcctgaattttctgcctaagttcatttaaactcactcggtaa

SEQ ID NO: 38641 - DNA, 21675 bp, Oryza sativa
  unsure (1)..(21675): unsure at all n locations
aaaagggcaagaaccttttcagcatcacaatccacatgacctagcttcacttggcccttcaagttctttgcagcctttttccattcaggtgccaatttcttgcagtgcccacaccttacaaaagaccagtacagttaatgagtcaaataatgtcttcattaacaggatttacttattatcttgaacaacataatcttaagggcaatgatctaaaatgtacacactacaatactaacatgtgactaaattgtatgaaattttgtgtttttcttcactttccttctctacttttggattcagagttaagttcagaaacaacagtaaagaataaatcagtcaacatgaaaaccataaatgcattaagccacataccatggtgcaaagaactcaacaatccaaagatccttgcttttggtgacaagtttatcgaagttttgagaatttaattctattgacgcacttggttcagttttctcacttgaaccacctgatttcttgccacctgaacctgctgatgtctttccattcaaccgatctctaagaagagccttgacctgtaggatacagattcattgtatttaaaagtggaaactcatatcgtgtgtcacaaggctgaaattttttacagagaaatacccaaaaaaaaaaggtaaaatggcaacccactgtaacacagcagcgacagacagtgtattttttaacgaaaatcatgggtgctaccagaagcaccagctgtgcaagagcaggtacataaagctccaccatggtaagaactgagaagcatcactgcatcacctcatatccagtatcccatataaaaagttgataagtttgaaaggtttagcatttgagggagatatatagcaaaatcaattagctacctaggacattagtatcagttgatatatgatatctgttgtttttcccccctagtaatacttcatgttaagataaaagttatttatgtcaacattcagctgacaattgcaatctgaataagtttggtctgtgaaaatccaggaagcacttaacatcttcagaaaaggatttgtagttgtatacactagtggagtggcagatagaacaggagcaataaaagtaaaaacaacatatcatttttatatatatcaaatagggcaagctgcaacaaacctgtgaaagagcaaattcaacaattggctttacatctcttgctccttgataatctactggaggctttccaggaacaaacaccttaatagttggaaatcctcttattccatattcctgcagaacaaaggcatcatgcatcaggaaaaacttgatagcatccagtcaaaatatttacaaatggcaatggtggaagacgttctaatgtgcagtttttattgatttagcctagacagaagactaatactcaccaaaacaaagatataacgtagctaaaaaatgcctcttggtcaataagcatgatactgtaaaattactgtaaaaaaaaatatatgtctaaatatgacagagactcaaaatcaccgcactgcaggtacaatggcaaaggtacataactatctttcactcttgcttgccttctctcaggatagatgcctttatttcatttgatgagtgactaaattttcagttagagaatctgggatacataacctaattttctgattcaccaataaacaatgttgcatcagatattgtaaagttgcacaacccattggcttccacggtttcgtccttcataaaagtatgcatttcccacatctaaagtcacatatacacttttattggcaataaactaaccaaggccgctctcaccttcggatcaaaagaaaaacagataaaaccctaattaacaccaattaaaatgcttaattcgttcaatataattcaaaatccaggttattttttttaaaaaaaagagaacagcatccaatcaccatgctgaaaaagtgaaaaaataaataaatttactgtatgaaatcaacaatgcaccacattccatcaatattaatcccagctacagcattttaatatgcattaattcggtattgtataactcatatccgatgttaatgccctcctttaaaaaataaaaacgacgcccctttttgatcagtacgtgtagacaccaaacattgatcttcccatatttcctccaccaaacaaatgtggcattgtactctctgatactgagagctacacaaaaaacccataacaggtgtaacttttttttttatggagtcgagtttgcacattgcatatacgcagttatgtcctagctcgatcaaattacgttgacgcaacaactgatgcagagatcagatcacaccaggaaaaggtagatcagccaatcccaatgaaccgagatgccaaacaggacgtttgctcacctgcgcgagctccttgtgcgcgtcggcgtcgagcgcggcgaccgtggcgacgcccttgaggacgcccgcggccttctcccaaatcggcgtcagctgctggcagtgcccgcaccacggcgcgaagaactccaccagcaccaccccattcgagttcagcacctgcacccccaaccgaaattcgaactcagcgagagcccccaagtaagggaagccgatccggagacggaagggaagagtgtgaggggggagtcgatcgagagaccttggatttgaagttgttggggttgaactggaggacgggagagccggcggagtagagggcggaaaccggcgaggccgcgacggcggcggcgacgaggaggagggcggcggcgaccgcggggcgcatggcggggtcgagaaggttctagaaggagtggagaggggaggaggtggaccttgcgatcggcgccggggtgcgactgcgattttaagttcgctcgcgaggaagacggacggacgcgtgtgcggaccaatggagagcctccacgtcggattcaccgccacgtcggagcagtttggctcgcttggcgtgaggggattggccagagagcgtggagtttgtggactcggagcaccgtgatacatcggatataactgggcccacacacgcttggaggtggtcccaaagttcagtgagcctaggctacactcagttgtttggaaacacgatgtggccattgtggccggtgtgatggaatgttcacgaatacaaattctcatacggccttgctagctcggaaagtccgttgactctccctcaactatactgagcctgattgtcatccctcaaccgtgaaagtgaaacagatgtatggtcttcctcatccatcaaaaccgacttattttacatgattttatcgacgggctgaacccacctatgagatatttgtaaagtataggaattgttggtaccaaggtatacgcgaaactgaagcaaaagagacagtagacatggatttttatacaagttcaagccccttaattgacatatctaaccctactcctgttgactgaaccagtgctgcctttatatatatcaatatcacatgagtacaatatttgagatgatctaatctattatctatcaacctaatgacgtggagctctcacatgtgatcgacggttagcgtagtctggttcctcgaatatgaactcgatgagattggagatagctctagctagatcccttttgtcggcctatgtggctccatattggcttttttaaggcttgcctttggtatattttggtttgtcttggattggctagatccgtcttggcttgtcttcgcctctctcgatggtcttgtatttataccctcggatgtccccttatttaagtagaactagagaactaacggggtcatcgtttaacttatttagggaataagctaaacggtgtgtttgcaaacaaaaataatttgttaataaaaactgttatatacgtgttcttagcgatctaaaagtaaaggctagaaaataaaccacgatttaaaaaaccccccaaagtgaactccaaatttaaggttaaaaattcaaattttggcttataagcatatgcacaagcgaaaagataaggttgtaagtgtagatataatccgagtggtccttatcgtgccgaagcgggactatgtttctcttttcttatccaaaacatctaatgtatatgaggcttgattgcttataaaacttagtatgtggtaggcttcactgagcttaacacaagaattattaggtatgatttatccataacattgacatatttgaacagtggttttgtcttacatggcgcctacatggcatgttgacctaacttcgaacaacgtgggacccacatgtcagtaaccaaacatcttcttttctactacacacaccctccttactctcgtccctattgcaacagtagaagtagctggcaacaaggtagtgcttgagctcccggaaggtggtagtcgagtgctctctctctcctatccggtcatagagctcgaggatagcgatgggcggagtagtagcaacaggctagcttggctccttggcggcacaacatcagctactgtcaacatctcctcttcgccattatcaatccgccacctctatctaggtactgcccaaggctctatgcctagatctaacatcgtcgtcgccgccaccgtcttctaggagagcttgagctcaagcttcgctaacgctgtctcctcctccctaagaagttgatagaagctggcgagcatgagctggaaaagctggcaaacctcctcattgagccattgtctctccttgcctcttccgccctaaggggaggcgatgaggcataggaggtaggcaagataggttcccgccgacacgagctcttccgctaagtcggcaacgaagaagggggggattggtgatgccgccattgccttgttgttgatgccaccaaagatgcaacaaggcatcagaaaaaaggggaggaaaaagagaaaacatcttacactaacacgtggagcccattgccttttttgttttttcccttgctaaatttgtcataatagtggagaaagctacaaatcacatctgacacatgcatacatgcaaggctgcgtctgtgtctgtagcatgcacgtagtgaggagaaaggctggcgcatgcatgcaagcaggagcaagcaagctagctgccaaaatggcatgacaaatcaatactttctctctcttttaatcaaactttaaacaaaattttcttctaaaatatgtgtccaatctataactagattataccattttattcatcgtaattaaatctttataacaagatctcacatgaatttattttgataaaaatatatatgtgttccagaaaaatcaaacttatgttgcaccatatacaaaaaaaaaaaaagtcacttgtggagatgttttaacccacttcataaaatgttccaaagagatgcaacatataaaagatactgactgcaacagtaaccattatcacatgaaacattatgtcctaactagtgaaacatttttatatttagcttgaaacatcaaattgtaattgttgaaacataaaaaagtatttactgaaacatataaaaataatgggaaacagggcaaatgcattagtaaaacatcaataaatacttgctggaatattacattaacaatgtgtgtaatatttaaaaagttaaagaaaagttatcggaatgtagtcatgtgatatcttgttataaagatttaattataacaaattcaatgatataattagtttgaaattcagaaaaatagtttaagagaaaaaatcatttaaactttgaaacatacttgcatgcacattccccttggcatatgagtacacctaacaaacttctttgtcatgcacttgcgcttttgctctcttagggcccatttgaattgcaggaatgagaaaacataggaataggaaaaacatatgatcttgataggaatacaaatataaaacaaaggattgcaaatcacaggaaaaacataggaatggtcgtttcattggactgcagaaaaaaatacaggaattaaaggagagataaagactcagaccccctttgatttgtaggaaaagtgtaggaaatttgaaggatttcaatcctatggaaaaaattcctatgaaagcttttgaaacaaaggattgaatcctattctatcattcaaaattcctatggaatgtttaatcatatagagattttgtaggaaagttagcaagaggtccaacctcttggaaaaaaaatcctttgagtctatctctctcattcgattcttgagtttttcctgtggttcaatcaaacaatcattcctgtgtttttcctgtatttttctatcctctgttttacacctgcattcctgtcagaatcctgcgtttttcctattcctccgttttttcattcctacgattcgaaggggccctcaaaggaaagtttccatgaggttctacctcatgttagaattcctctaaaacttgcatggcattaggcattccataggaattttataggatccattcctttgattcaaagaactgtataggaaaaattcctatgggaaagaaatcctctaaaattcctataaatttcctttgaatcaaagggggccttagattgagacgtccgatttttttatttttggccggacggccgatggtaagcattatcggagtttatttgcattggttttgattgttgggaggtgatatactgatatatttgcttgaaggtggttaactggactcggcacatagttgaaggaggcgatataaagttttcctgggctaggcgatgagtccgtcccggggcagcccagttacacggcccaattaaacttcgttcggtagctgtagttgtactgcagaacacacgcagcgtcagtgcgtcacacgaggaatttcagtttacagtgtcaccaagttgtcaaagtagtacgtaattttttgccaaaaaaaaatcaaggtaataatgcatccaaaccaagatacaggcaaggtcacgaggagactgcaggcagtgcttagtactagtagccaagaaataaacagggacttgctatgacacggatcgaaataagaatccgacacggtacaaactttcgagctcgtcgcgagtagtaatctattcatacctacacggctacacctggctagctgcatgctcttttattcagtacagtacgaaccactctgacgaatcctatgtaggagtatcacaaaacgacgacgaaaccacagttcatgcacacacacagtacacagaacagagcgagcgaggccggggttgctaagcgatggcgatgcggttggaggtctcggtttccatggacttgaacgcctcgaacctgggctccttggcctcgaacttgtggcgcacgtacagcttcatgtagtcctcgaacacgaacttggggtacgccacgacggcctcctcctccttcaccagcgccggcgcaggggagatcacggcgtcgctgccagggttgtagaacgacgcgatggacatcctgttgccgtcggtctgcgccaccacccggtggatcacgctcttgtacctgccgttggtgatcacctccagctggtcgccgaggttgacgacgatggagtggcgcatgggcggcacgtccacccactcgccgtccttgagcagctggaggccaccgacgcggtcgtcctggaagagcaggatgatgccgccggcgtcggtgtgggcgcggaggccctcgacgaggtcggggcgcgggcacggcgggtagctgctgaccttggtgccgaaggtgggtgcgcccgcggggccacggaaggccttggtgaggtagcccttctcgaggccgaggttctcgcagagcaggtccagtagccgctccgccagcgtctccagctccgccgcgaagcgcttcatgaggcgcctgtagtcgtcgtcgaggtcgggtatgtcggcgatgttggactccgggaggtggcggacgaagaaggtgctctcccagtccagcttctccgccttattcacgtcgtcgcagccttccttgagcgtcttgctcgcgaactcgaggaacctctgctcgcgcacacgcttgtagtggtccttggtcatcttctccacctcgtccatcagctccgtcgagatgccgtggttcaggatctgcacgatacgcaccgcaccaacaaaacgccagagttagttagagatgacatccattatccagcatcgaaatggaacttagtttgtctgttcaatgttcaatgtgtccattattatagattatggttttagtactatgttgctagtttgctacatataaccacctcgaagaatccccagttctcgcaagcatcatccagctgctccatcgccgcaggtcgctcctccccggcgagcaactccatgttgatgaccgggaacgtcgaagtcggtgccatttctagctctcaaagtccaggtatcacactctactcactaattaatcacaactatatctgactatagtatgctgttgtgaatgtgacgcgtccagtgctcagtgcaagtgtgatatgccgaacaccccgggcaggtgcaatttatagactcgcatggcaagctagctgctctgttccactctgctccactaggctgatctgtatctcagaacgatcgaatcgaagtcagggattagtgctcgctggctgttgcattgaccggacggagaccagcccatgtgggatacgcgtgttggctcgtggatcggcccagcatggaattatttggcccccaccaataataatctcccacatgtttcccgtaatcatttgggagagatagatagatatagatcatgttaataatcaccgttggtcccgtcccgactgatgagtcccgaccgaacagacatcccattctgccaggcagcagccagtcacgtcccgtagattaactattccgccgcgttcatcaggtgttgcgcgcgcgaaaacggcgaatccaccgcgccgccgtcccactctaacacctgttcaccgctcgatcgggcgattcggcgttgcccgcaccggcaaaaactacgtgggggctacgtacgcgcgccgcccggtgaatagcctcccgcgcgcgcccgtgagatcgccactggcgccacacgttgcaatgccgacgtacgccacgcagcggcggctcagatcagtgtcgccgtcccaccacgtgcgcgcggggcgccgtacgtctccggccccctcgacgcggagaattctatggcaaaggaatggaggaggaactagcggacgcagcccagcgcgcgcgcgcgagcggcgaaccacccaaccaatctcgggggggcggattgcctgctcccgttcgattcgacggatcgcatggtcccgcgtctcgatgatttgaggcccaagggggtaggagtacagcttttttgactcgtcatcagcttcgatgatccgtcacgcgccgcgcgccgcgcggtgcagatctggcgagcgagagataagaggaagaacattccgcttacttttctgtagtgacatgtagtaccgtcgtactggtagtgtagtacggctgttaaatgaacgcacgaacaaatgtcggttttacacaccaaataggagtagtatcagtgcttcttccatccatataacgagatatttaactatttataactcttaaaagattactggaccatatgtcatacatatataaggattcacatattatagacttaaaagtggcaaaaagttaaacgccccttatataataaatcgtttaaatatttttctagttaaaatattttaagtttaattaaatttatagcaaaagatagtaacattatcaacacaaaacaaacatattagcgtaatatattcaatactaaattaatgaaactaatatggtgttttagatattgctaagttttttataaatttgttcacacttaataaagtttaacttatagacaaatcaaaacaatttataatattgaacgaagggactagtagcaaatatgcatacttgtacgatgtactactacataggctaacaaaatggtagaggttgtagctcttacagtgatgtctgccgtgggggaaaaacaatggtcataggccgcgcacattgtgctggctttgatggacgatgatcctctcggagatggatcctaatcactccatggatatccaccagtttattatgttaactaaataactataaaaaaattgaaacaaatagattgttgtgcagtatattgtcagggttcctagttatgcacgatcgtgatcgaacctactattcggaatatcacaatcggatattgccatgggattgttgtgcacgatcgtggtcgaacccactattcggaatatcaagatcgcgcgagttctgatcgatggcggcagctcgattaaccttctcttcaccagcaccttggacgcgatggggatcccacgaagcgagttgacacccaccgatcaacccttccatggaatcactcctcagtcatcatccaaaccattgagcaaaattacgttgtttgtgactttcggccaaacaaataacttccgaacggagcagatcacctttgatgtcgctgaattcgatacaacatacaatgccatcattgggagaactgcactcgcgaagttcatggccgcatctcactacgcgtatcaagtgctcaagatgccgggaccgaagggaacaatcactattcaagggaatgctaagctggcagtgcaatgcgacaagcggagcctcgacatggtcgagcacatgcccagctaggggtgaaaacggtacgaaaacagacggaaacaacctttatcgttttcgttttcatatttttttcggaatcggaatcgaaatcggaaaccccggaaacgaaaacggaaacgaatattatcgaaaacgaaaacggagcgaaaacgaatcggcgcggatacggtaacgaaaatttatcggaatacagaaacccctcaaactgagcttcacagcaaaatatattcttctataacttcatataatttgcataacaaatattctaaaaaaattacagcaaaacactatggtacaaggtataaactattagtgctttcactccatcatcagtacatactacatagtcatcaatcatcacataacagcaacacatatcagtccatcaatattcagtacttagagcgtacacagtaacaaagagtgatagaggtggagccgtggaggttgaggaacacctgctgctgctgggctaatggctgctgaaaggcgaggcatcgtgcatcggtggtggtgaggctgtcggcggtgtggccagtggccggcgtcatcggtgtcgtccgcgtcggcggcgtcggcatcgtcgcctcgtcggtggtggtggtggctgcgaaaatggtgggggcgaggacggagcgagagagaggaagggcggcgagacggcgggggcgaggtcgcgaggagcccactagccgaggacggcagccaggcggccggcggtggcgtgctcgaccccctggaggctggatgcgccgcctctctcgatctgtctctctcctctctagcctctgtagggttagccagttagggacctagggacttgggttgggcgggaacttgaggaggaattatggactatttggatgggcttttttttacttcggaaattccgacaaactttccggaatttttccgaccgattccgagttccgacggaaactgctattatcatattcgattccgtttccgagaaatttcgaccggctgattccgttttcgaaaacaggtccggaatccggaaaaaatctgaaccgttttcacccctacgcccagcccacctaccacagctgagtcacccaagaaagtgagaaagacaaacaagacgccgaaactggactccgcaatcaagatcgttccactctctagtgccaaccccgacaagaccgtcaagatcggggcatcactaggcgagaaataggaactcgtgctcatcaccttcctccgtgacaatgttgacgtgttcgcttggcagccgtctgacatgccaggggtactcagggaggtgattgagcacaaactcatggtgcgacccgacgccaagccagtaaagcaaaaactgtggagatttgcaccaacaagccatacgagaagagctcgacaagcttctcaaagctggtttcatcagagaggtactccatccaaagtggctagccaacccagtcatggtgcggaaggccaacgggaaatggagaatgtgtgtcgatttcaccgacctcaacaaggtgtgtcccaaggatcacttccctcttcttcgaatagaccaaccggtggactcaacagccggttgtgagttgttgagcttcctcgacgcttactccggctaccaccaaatcagcatggcgaaagaggacgaggagaagacaacattcatcacgcctttcggggtattatgctacgttaagatgccgttcggactaataaccgcaggaaacactttccagcgcacggttcagggcgcacttagcgaccaactcggaaacaatgtcgaggcctacgtcgatgacattgttgtcaagaccaagacaagcgactcattgattgacgatcgacgggaaacgtttgacaacctctgacgatatcgccttatgctcaatccagagaagtgcacgttcggggtaccatcgggcaagctgctcggtttcctcgtctctggcagaggaatagaagaaaatcccgagaagatcaaggcaatcgagaacataaagttgcctacaagactcaaggaagtacagaagctaaccggatgcatggctgcactaagcaggttcgtcgctaggatgggagagcgaggacaacctttcttcgctctactgaagaagcaagacaaatttgtatggacacaggaagccgaagaggcatttattgcactcaagcgctacctatcaaatccccctgtacttgttgccccctaacctaatgaagaattatttctctatatcgccgccacgccatattccgttagcactgtcattgttgtcgagagagagaaggtgcaacaactagtctactacgtcagcgaagctctccacgacgcaaagacaagatatccacatatccaaaaactactctacgcggtaatcatgacatcaagaaagctacgccactacttccaagcccacagggtcacagttgtatcctccttccccctcggtgaagtcgtgagaaacaaagacgttgttggccgcattgcaaaatgggtagtcgagctaagccaatttgatgtccactttgtgccacgaacagccatcaagtcccaggtactcgtcgacttcgtagccgattggaccatgcctgataacaggtcagacaaccaaatcgacaacgaaacgtggacaatggcattcgacggcgcactcaacagccaaggagcaggggcaggattcatcttgacatcaccttcgggagatcaattcaagcatgcaattcacctcaacttcggggcgaacaataacacagccgagtacgaaggactactcgccaagataagagctgtagctgcactcggagttaggcgactggtcgtgaaaggggattccgaactagtcgcgaaccaggtgcataaagattacaagtgctctagccccgagttatccaagtatctcgcagaagtcaggaagctggaaaaaaggttcgatgggatcgaggtccgacatgtataccgcaaggacaacatcgagccggatgatctagcacggcgtgcgtccagacgagagccactcgaacctggcacctttctggacgtcctgacaaggccatcagtgagagaggtaagcggcgaagatagcccagtcgtcctcaacaacagctcgggggctacagaggcaaaatgcgccgttgccgatatcgaaaccaaagacgactggcgcaccccactcattaaattcataggtagcgaagagttgcccgaggacgatgcagaagctgagaaaataacccgtaaagcaaaaatctactgtatgatcggcaacgatctatacaagaaggcgccaaacggggtactcctaaaatgcgtctcgtccgacgacggcagacatcttctcctcgacatacatgaagggatctgtgggtcacacgctgccggtcggacattactcggaaaaactttttgacaagggtttttctggccaaccaccctcaaagatgcctgcgacatggttcagcggtgtgaagcctgtcaattccacagtaaacacacaaagctaccagcgcaagcactccagactatccctcttacttggccgttctcgtgctgggggctagacatactcgggccattcccacgaggacagggcggctacaggttcctattcgtggcgatcgacaaattcactaagtggattgaagcgacacccacgggggaaatcaaggccgacaacgccatcaaattcatcaaagggatattttgcagattcggattgcctcaccgtatcataacggacaacggctcccagttcattagtgccgattttcaggattactacatcaggctgggagtcaagatctgctttgcctcggtttctcacccttagagcaatggacaggtcgagagggcaaacggcatagtactacaaggaatcaagaccagcatctacgacaggctcatgtcacacgacaagaagtgggtcgaggaacttccatcagtactatgggccgtgcgtaccacaccgacaacgtccaacaaggagacacccttcttcctcgtatacggctcagaggccatgctccccaccgagctacgacatcaaagtacacgagtacagaagtattccgatgaggatcaggaggagctgcgatacgacgatgtgaatctacctgaggaacatcgcgaacgagttgccgttcgagcagccagctaccaacaggcccttcgccgttaccacgagaagcgcatccgagcacgcacgctttcgatcggcgactacgtcctctgacgggttcaaagccaagcagggcgaaacaagctctcacccaaatgggaaggaccgtacacgatcacacaagttctgcggccaggcgcattcaaaattgcagacggcgatagtcgcgagttggcaaattcctggaacattgatcaattacgtaaattctatgtataagtcaatagtatccatacttgtaagacatcttacagcttcaataaagcctatttttcaggtacagattacaatcaaagtgttccttcccgatgatcccttacctagatgacacctagcattgaaacttatcctcatgtccctttacgccgtcttgacaaggcctctgaggaacctaagggaacttcggttggggacgcccagagccgataaggccttgtcggatcctgtagagacgaaagaccatgtaagatctggtcgtgtaagagttttcgccgtgtgtattaaccaagccgtgtaatccgaaattaactttccaacttcacggctgggggctaggatcagttcttgttcaaccgaggtaggtcaaaggtccaagagccttatcttccaagaagaattctccgatgacaaggttgggggctagggagagtatataactcaaacgactgatcgaagttgcgaagtaagaagacactcttacacactatgtccagagtaagaaagcttagttagatagatttcttttttattttacaagtacttcttacaattccgtaaaaatccaaaattatattacacttttccctaagacatttgtcacaggacacgaagactaccaggaaggccaacgccagtccatggactggaagaccttctccgccagcagcgccatcgacttcgccaggccatctatctccgtaggagttctccgagaacgagaaaacccttcatggaggaactcgaggtgcagctgcggacaatgatatcgtatgcaagccaatacatgcccccggcatatcggctcgatcgacggcactcctgcttcagggcctcgtcgatacgctggccgatgccttcgagctgggcgcaaaccccatttagccacgagatgtatccggccgccgattcctcaggatccccacggggtactcggagctctctacagacccttgtcatggatgtgcaacaactcttcagatacgagctgaaccacacctcgcgacctcggagtgtttccacggcctgatccttcttcacttccagcataatcctctcgagttccgcgacctcaaatttcgtcctccaatactggatgcggcgatcttggtcagcaagcgcactcttgaggtctgctcagcatgtaaatgactaaggcaaactgctcttctctcccaagaacacaacaaagcaagtcgatccagacggaagagtaaaggagatgaaaaaaaaaaccaacctaaggaagtcgtcgccatgcccgtttccacaggcatattttgatctacatcgccctgcggcacatatggcttgaacgcaagtgccggaacgatcactggcaactcaggctgcccacgctgctggacatcctcgacatcaacatctctacaaatgacaacaaagtactcgagatcaacatgctaaagaaaactaaggtgatgactgcacacacaaaggcggttggaaccaatgagagttttacaaatcatgactaaagatcctactcttcaaaaagcgggagaacggactcccccagatcgccgacttcctccatcatgtccttgcgcgcgtcgctagccgccccctgatccaagatcttccgcaaatagagttcagggtgtgccagcctcatacacgcgaggacatggcatgccccggtatagatcaagttggacgtctcctctccgatcctggccgcgtgcttggagggggatcgcctccatcgctgtcgccagttctgcaagcgaagacgtcagcgagaactcgtcgggattcgccgggatggtagttttgacgccacactccccggcgagctggtgcagaccagtataggtgacccgcaacgagccacgggtttccgacaagttgttctcaagctccgacatacgatgctcgagttcttgtcgttgtcgctcattgccggccaccagctccgtcatcttctggaggtcctcgcgaacctccgcaaaatcacgcgtcagccggtcggcacgctcattcaccgacgacgccgccgccgccctcgcctccgcgatctcgcggctaatgccgcgagcaccagcctcaaggaggagccccatctcgacctggagctcctcctaggtgaggacgacagccggcgagccccgaccagccgcaagatcgctggctgggccactaggcgtcgcctcgcggctcctgggcacgaccacgacatctgtcgaggccacagcaggagacgcgctggaggtccctccagatctgtcttgcgccgccttcgcccacgccgccttgtggaaggctgcagttgagacaggctgcaagagtttgacgaagtgacaaaacctcaaattcatccacttacttctcgccaagcgtcacaagccactgccgtcacggaggcggaggagacgcatccgaggcctggagtataacgggtatgatgtgaggtggaagttttccgactacgcgataaaggaccaggaaagcttaccgagggagtgggcgccttccgacgatttctgatcacggaggagaatttcctcccccttttcgaaacgttgccgccacttgttgtggcagcagcggcagcaacatcggacgcctccttggcgacgtcctccttcagcgacgccgccgcctgataatccacgagcagcccgatgatatcagtcagagggagagcctacgctttatgaagtcacaatgcgatctcggaagaaaagtgcaaaagggctgctgagtacacttacattgatggcagcttcgcgttcagctgcccccttctcacaaagggggacggggactttgctcgccgttgtcgcgccgctgatcatcaattggccgacacggcgctccatggtttcgctgttcaaacctgcagattgagaaccagaattcgataagtcaggaggaacacgcacataaggaagtcaatttaaatacaagaaaaataccccgagaagaaacccgggtcgcgtcctccggcccaaaatagtcaaaggatgggtgggctcgagcccggagcggctggatccgcctaccaatgaagtcggcagcgacttcataccctgacaaacctcgtattcggaggtcatcgatggcatcgatgaagggctgaagagaaggggttaaggcgggttttgcggtccaagacgaaatcttgtctggttgttcctcaggaacaacgaagactggatccgaattttctatctgaagatagaaccacctcgcccgccatttgctacgagaggaagggcactggaaagggatatagcacgacttcaggccatcccggagtcggaaaccgacgcatccggataccctgtttgattccatctaacgcaactcgtagtagaaacgaaagaggtcaagaaacagctctaccccaatgtaggtctcacaaagatgcgaaaaaatactgagaaggccatggaattggggttcaaatggagcaaagaaaggccgtagaaattcaagaccaagagaagaaattcagaaggcggaggaagaaaaccacagagaatatagtcctcgatcgcaaccatgcgacccaggacaggctggggttcaatacctcctgcttctctctccatggtcccgcgaccgggaagggcgccatcctcctgtagtttcttcagcgacgcgctggtggaggtagacttgtcgaggtccattgcgggagcagagaagacgaggaacgcttggaggctggagagttttttcacaacaggcggacttcaaaatggatccccaaaactcacttaaatagtcgcacttccgacggtgcgaattccaaggaaaggaaagagatggccgccggaaatttatgggtccgttacgcacggcagtttttcagacttcaatttaaattcactcatgaccgttgagcttcacttggcgttgtcgattactccttatctcttggtcctcacacctagaacgacaacaacctcgacatcagaagtcacgatcagttacatgagttcatttaagcagaagtcgggggctactgtcagggttacgggtaaggtataccctctaccttcgatatacgtcacatatcgatatggtatacttgcgcgtatacggacgttttcggcgtacgttaaggaaattcatcatggagttcacagatggaaggagtcctactcggacagaactgggtcgtcattgtatcgtgccgggtccgatgtctccgagtcctacttggagaccagttgacctgcggtataaaagggacccccgggaggatctaaggcatcgaatctcatagccaacacatccacgacagcctacggagttgaagcccacaggagccaagtcgccgggagatctaatcgaacctgttcgattacgacctcgtcggtatcatcgagttccgcttttccctttgtaatatgtggtttccatcatataattccatatcaactggattagggctattacctatcaaggggcctgaaccagtataatctttgttttctgcctgcttgatgtcgtattacgtagatcctcgtaccagcgtacaccaataccctctatatccggtctacggatatccccgtcgacatatatcacttcacaaacatataaatttaaattcaacttctataagttataataaaaatatcaaatttaactgtaaatatatgtgtactaattagagtttgatttgttatttttgttgtaattgatagaagtcgaatttgaacttacatgtttatgtttatagagtggcatatcacattattcacatgtgaatttatcttgtcaatttttttaaaaaaataaaaataatttagttaacatacaacaaatgaacggatgttcatataactaattaaaagtgtttccctgatcctttgatgttagaaggtcagagttgtcctgtgctcgcgtggttgttttgtggcaactcagaaaattgaatttgtatgaactatgtacatgtgcctttgattgctgcaaaggaaaatgttttgcctttaaatttgtttctcctttgtttttctaaaaaaagtaaactggtaatcggaaaccagctagtagctgtttttttgggtgctatgcagagtaaagagaccagaacaactcagcactcgtagactcgtagtcacctgtcacgatcctcttaactggaggcatgcatggatctggccggtttcctgcactccaatctacatccatggttgttaatcaggtttgcaaatcaatgtctttccattgcccttattccggatctccgggagatgtttttgtactaatgaagtagtgatgattgatggcggcctgtataacctatcgctacgcccacactcacaaatcttcatactccataccaaactattgtactccacgtcgattttcaattttaaaaaatactttcttctacaaagagaagatcattttgatataacacaaaatannnnnnnnnnnnnnnnnnnnnnnnngatgcttggcaagaaaaaagagtaagagagagggagagaaagaaccggaagaggcatttttgtttgttgccccttgccaatttttttgctaacttgagcagtacattactagaaacgatcttttatcttaggccctctttgtttaggcttataagccaacttataagtcaaaaagtctaagccaaaacaaacaagcaacttttttatttggcttttttgaagccataagccactctaacactattaagccaaaagctaggttggagaagcttttttggcttatatgagatagatgtatgactccaccactaaacttaggacattaaatccactggcttataaatcatataagccaataaactgacttaaaagttaggccaataagcctaagcctaaacaaagagggtcttagtcccctaaacataaatatctcggttagattaaaaataggtactaaagatgcattactaccggttctaaaaattcaagcccctataagatagtaccggttgataacactaaccgagactaaagctaaaagatctttagtgcgggttagtatttttaataccggttggtaccaccaactcggactagctaaagctatttttaagtaccggttaatattaccaaccggtactaaagatgcctcagggttagcttaaaaggaaaatatatttattcaagttagatgtgtgtagtaggcgggatggtaacgtgtgtgagggttgagatgagagatcttgagtttgaatcctatatcccacatgttatttttgatttagtacgcatctttattaccggttctttcaatcggtactaaagatcgtgttacaatcgataataaaagaggttgttaaccggtagtaaaaatgagttctccgatcgtgatagttgttttgattggatacaactttttatcaaatctatgtagttgagacaatctaatataaaatattggtagtattaaactgtctaatatattttatcctatcaaaattttagtaaggcttcaaataaaaatggcttcaaactatgttgtccataggaagaaacttctctgacataggtcgctgacatgtggaccataagttatgtgatttacatatcagctactttaaagttagagagcagtaaattagatgatccattttggttgttcacgtgattacattgtatcaaattcagtgtaactatattcagag

SEQ ID NO: 38642 - DNA, 2654 bp, Oryza sativa
taggggtgaaaacggtaacggtaattaccggccgaccggcgttcgttttcgactttctaccggccgagccatatggaaatggtaatcgaccgaaacaaaaatggaaatggtaaaaaatatggaaatgaaaacggaaatggttttgctgttatacctatcatttccgtatttaccgtattcttgcggaaattaccgtttcttataatatggtaattaccgtattctaaatatgtcgatattataggacatgtctatacttgacccacagcttatagattgaatgactcttcaataaatctctaacttttgtacatggctaaaatgaagttaatttataatttatatagtataagcttgaatttatgtatatatataacatacttatgtaaagttaaatatatgtttttatagtttaatgtttccgtatttgttaccggtttccgatctgtaccgacatgtttccgtccgtattgttccgtttccggttttccgatatttccgatatcgttttcgtttccgactttaccttttccgagaaaaatatggttacggaaatggttgaggctgttttccgatcgtttccgaccgttttcatccctaatcaagacgtctagtccaagaacaaatgctggaatatctctgctgtaaaacaatattgatggagggagactcacaagtggctagctgaacagtaccataaccattttcagtcagatgactgatgacatcaccgaccgtgctttcacaagacactttcttcaggttaataagtggcaatccattcgtctagctcctcccttttgacacggtcacacttaatggtgctacgtacctatgtgatgtacttataacatgtccactggagtccagggtcctacaaatttggtctacaaccgacatggccagacatgattggacccaatccagacattgatgttgcatcattaggactactttgataggcaattaggcatgttggtacatgttcagacgcctccaaaatcctcagtttgatggtacaactcgacgcctgaagttatccgagactatcaattgattaagacattgtttgtggagctcgagattataatatgcagctagtgattactaagtcatctacttcttctatcctaaaatataataatatagtgctgaatatgttcagattcatagtacagaatgcatctcaaccgatatgactaggttcttatattttgacatgaagggagtaatgaaaatctaaaaaggttgggtttcatagtttctaactgttaatttattttctagattttataaatatagagtctaacaaattagatgagaatttaaattgcatagcggagatgtaaattttagaagaagttgtagccactaaaaaaactcttttaaacagatgctaagacatggttagaggatccaactccccatgggccacagggtatcaaaatcatgctaagacatggttagaagtcctccatgctctaaaaaaaaaagaaaagattggattaatccttctgagaggtttttttaaagatacttcattagaccttttacaatatagcaatataatattttctgtgtggcggtagaatcatgaatgtataactccatgcatctaccagggtgctgtacatcaatggctgatactaaaaaagtagcctcttgtaggctgtagcttgcaacaccctacttggatgctgcagtgtgaagtgttctatagatagagcaattacgcttttgaccctactttaaaacttaacagagtttgcttgtttgatcttttttttcgaaacgaagaagaggcctgaccctattccatgaagacaacgtgacggtgttaactcaagacaaaaatttcatttatacccttgtgaatttaacccaattagtgaatattaaattgcaaaaaatatacatggtacaaatttgtgtccaccaaaaacaaaaaacaaaaaaaaaacatgtcaaacaatagcactttcaacacaagcagaaatatcccattgtgctgtcgctggtgcgctcatcgcctacaaccacgaccaacggctcgccgcctccatccaccacgccgatggtcggatctacagcatcgcgggaccacctccgccccctctctactccaccgccgcaaagggagaagaaggacgccgcccctttcttgcgccgcgagcagcgggcgagtgctttgcgtcgagccgtcaaggtcttctctccacggcctccttctcaccgcgtcgctggtcatgcccctccctctgcgtcgggcgacggcgagctcccgcggcgccgagctcctgcgctgcgtcccgcccggcggcgagctgcgccaccctcctcgacttgcgccgccaagctcctgctccccgtgcccccctccgcgcccagcggcggtgagcagccgccgccagcactcctctctccgcgcctagtggcgcgagcagccgccgccagcgctcctccctccgcgccgcagctacggcgagcagccgccgccacagatcctcccactgcagcagcagtgagcagccgccgccacaaatcctccttccccggtgcgccggcggcaccgccgccgctccccgcgccaccgccgccgccgctccattcccctgcgcgccacctgagagagatgagtgagtggatgaggttga

SEQ ID NO: 38643 - DNA, 8824 bp, Oryza sativa
agcgcagtgaaaatagggccaaacggtaactttatttttgaaaagcagggtcaaataaacaaactagaaaaagtaaggttaatttggtagttaggctctgaaatagggttaaatgagcaattgtccctatatagattatcagtccatcctaaagaccatattctgtgataggcatcgttcttttcctatgtcttctcttgctaatgtatttagcgactacggaagcgtgggagatttgcttgatgatcaaagtgtagtcagtgtcaaccagtcaccaaattacttcctttaattaaagacaggtttgcaactaaactagcaacctatactgttaccggaaagcgctgtatgccctaaaaggcgaagtatcggaaaagaatgctggaagtagcatcataaaagagacaaactccaaatggagtacaagatggtagcctggtaggtaattgccgcttcaattataaatgtaaggttccctctgcttttttacatcatgagctcccattttgctcttgactgtgacaacgagctagaagtaacaagatgagagccagacgtaatcagcacatcaaagcaagttgccgacatatccacaaggtttcgctatcttgtctccctagccaatgcatcattccagcaagccttatcatataagcttaatgtttctctcaatatataccttttgctggcctttcccattagtgcaaaagatgaagctggtatatcaatagaaacctaaaaaaatatacgagagactgagctagagtacaaactcttgagttaataaccggagtccaccactagacttgaaaagagctactccctccatcgatgggatatcccacaatatataatctaagggtgagtttgagaagagggagattaataatattgggaagatacacaaaacgaggtgagccattagcgtatgattaattgagtattaactattttaaattttaaaaatggattaatatgattttttaaagcaactttcctataaaaattttttgcaaaaaatataccgtttagtagtttgggaagcgtgcgcgcggaatacaatgttcttttctcacccaatcccccagaactcatcacaaagaacgcagcctaaaactagctagatgaaacatcaccctgatcatacctcctgtctacatatgtactccatcttacactaggtaatgttccatctaaccttaggtttttatattttggaacggtgatgacggtgatagaaaatatagacacatctagtttttttcttgcatgcaacctgctatagattcttaccacactatttttactctcagtttggccagccgggagatttgtcgatccgtcgtctacggatttataagagcaaagtcaatattaaattttgttaattcgattagattaggcagtggcaatcgccaaatggtgaacgattttgttatatcttactcgaaagatttttttcttatctctcacttgattttctcattcaaatttacagtgtattttattgtaagttacaatgtaatttttgaatcttcgcatataagttttgaaatttatattggatttggtttttttcttgaagatatggtaattagtgtccattatggtgtttcttagttgctttttatcttttactgtgtctatttgtgtctattggattttaatccaaaaattaaaaatctttgtgatatgatcataaaaatctttcgaaaaatgcatttatactcccagtggatgactagttgttcgtttgatgaatcaacaaaaagttatataaagggaaatattttaagctcttgagagtatgcacctttgttatgtgacaaatgattacacaaatttctaaaataatacacaatgtagattattgtatcctatatccctccacaaacatatactcattctatccaaaaatctaagcgctcattctatcaaaaaatctaagcagtatttcctttgtcaccgagaccaaagaggaattaactcatgcaaggaggaattaactcatacaccacgtgaaaaaaattaataaactatatgtatgcatgcaactaatgagtattaaaatggctccttaagttctagacaataatttaatttagcacataaaaactataaatatgccatagacttcataaaaataagaaaatgaaaaacgacttagtcttttggatcgtgagagtatatcacttcttttttttttcactaaacacaatacaaacaaatacaaacatttatgctcgtataagtgtatctacatatacaatataaagatacatttgcacaccatatacttatgataatccccaagagactaggccgacacaggccttgtttggaagattagcccagggctaattttaagagctaatgttggcccctttgaattggaggaaaaacataggaattttagaggatttcaattttatagaaaaatttcctatgaagccctttgaaacaaaggattgaatcctatccaatcctttgaaatttctatggaatggacaatcctatagagattttggagaaaatttagcaagagtttcaacctcttggtaactttcctttgagtctatctctctcatcctattcctgcatttttcctgcggttcaatcaaacagtcattcttgtgtttttcctacgttttgcaatcctctattttccacttacattcctatcaaaatcctacgtttttcctattcctacgttttttcaaccctgcgattcaaaggggcccttagtcatgaattggtaggctaaacattagcctaaagtggtatgtttggatccatgagctaattcaagactaaaaggtggagagagagtaaaaagagaggagagagagggagagatagagctgctttttatggtccccacacaaaattagccccattagagcaggttcaatagtgctattaagctggctacaaaacttacaaatcagcttaatctgtgattaatgaaagaaaatcacaggaaaaggaacaagcagcgcttgttttagcgccggcgcttgctcagcgcctgaaactgtagcgctcgcatgcagcaaaaagacgataaaaaatacatttatgtgggtcccacatggaaccatgtaactatttaatgtatatgtatgctttaaccaatgcagcttatagctaacttatagttagtttgttatatgagttgtctccttaagttagctctattttaacatgataaaattttgaagcttgctgctagctatactattgaccttgctcttagcactccttgaaggggctaatgttttgaggggggctaattcactttagcctcaaattagcccacctgtttggatacttgagagctaattcagggctaaatgatgggggctaataattagcccatggaaccaaacatggccatatattaagattgaccaaagtcaaaacacacgctttattattgatggatgtgccacatattaaaaatataattagccgtaaatgcaagcacatgtgttgaatcgaacctaggtgagtaggtcccattcaaccacaagaacctaacaactgtgatgtgctatgctaagttcacatttgtagttgaattgatgtttttctatttttatgtatatatcaatttggccttgtacatttgtaaagaaatttgtgatagtcttttttttttacgaactagcaatcacagtgtaccaatttcgttaaatataacaaaacaaaaataaattgtacaagtatgaaaagaaccgtaaaaaaacaaagccctgagagctgttcgctcctactaggtcaagtttagtcttctctttgattttcgtagttagagctatcacgaagttctttatgttaaaacgctatatttctattttttcacaacttgttgaaccacatgcaacaaatgtataaaatccacttcctgtatatataggagtatgatataaagttgtaaaatgactttctcacctgctttacaactcctgacttcgtcccgtgcataaaatccctgcagaaatgcagcattagaatttgatcggctaactacacgcctttaccctcaagcatgcacccccatgctttcacctaacccatcctcatccaaccaacaagttcctcaagatggagacgcacaagagtagtactgctacaagcaccatatggacatggaatcgaatcgtttatatgtccccagcagccagcctgcttgctttttcccgcaagttgggacttggaaagttggaagtagcatattcacttctccgccacgtcgaatgcgaggttcctgtagtgcggctgtgcgggcgagacgacggatggcgccgcgcgcgcgcgtcccaactacagattgcgatggctggatggctaagctggacggccgcgcgcgcaccgcaccgcaccgcacgagccgtccaatcctaccctgcctgccgcgacggcgaatgacgggcgcgccatatggcgtgccatcccggactcaggcacaaagacaccgcgtctccatcatcggcgccctcgcccgcggacggcgcgcgcacgccgctctccgcaccgcacacagcggcgcacgacgacgcggctttcgtataatcccggacaggtacagggagagggacgtgatcggaagggattaaattaacatggtgggggacctgcgtgcacagctgcactgccgcgggaggattcgattcattccacacttccatagttgcatgcaccgcggatgacatgagccagtgcgtacgcatattgccacatgggaagcgagcagcgggcccagtccagtctgccacaacggatgctatattaactcgattgatcgaatcgatgtccatactggtacggccttcttaccaaaataatactcccttcctcctaaattatggaagaccccatttttttcaaaaaataaaaaataaaaccaggtaacttttgactaattttttttagaaacacagtacaaacgcaggcgctcacaacatgcgcacactgtcgaaacaagatttcggcaataataaaaggggtggctatcgagctaggaaagtggatgggtttggagacaaggaattttatacacgttcaggccttcttattcaagaagtaataccctactcctgtccggggatgattccgccgagtgtgttattgattgtatgattgggaaaaaaaagaatcgtgccccaagaggcacacggaccctccttatataggggaaggaatccgtaatatccatatcctaacggaatatgggattacagataaaatacaatcgtaaccgactaggatcccaggtactttcttgatatacaagtttagaatctaacccgagtcctcataaagatattctatctatatttggtactgtatatccagctggaatataactgccatgtagatatggggtaaccataatctccacagtagcccccgagaccttcgcagtcgaccaaaacagtcttctcgaaacaaaaaataataatccgagtgcttcaattcaacttgctccggcttgccgagtgctaaaagactgtgaagggcgaaaataaaacatggtgtatcgagtagatgcacctaattaagtgtagcccccgactatgtgattagttgaaaaactaaacatatagtcaagaaccgagtggttttacagcgaagcacgcatggtacttagtaagatacccagccgactacttctcaacttgaacatatcaaggacagaaaatacaagaagggctgagtgatgaacactcaaaaggtccaaaaatagacatatttgataggaatccgagtaagaaactcttaaaatgattcaccaaacatgataaaaaatcatggtaattaatgagtctaatagcctaggctgtgacccttaccataactaaaataagcatataacatgctaaaagaatgactatgaataaaccagtcatctcaaatcaacccaaacagcttttgcagcctaataaagcttacaaaaacggtataacacctttctgtcagacaccttttgtttgcatcgtgttaattctaaagaattagcaagccgcattaaaaatgatttaatcagcattgggccacaacattgtgagcacaaattgccaaagcaaaaagtgcctaagtccctaaggatcacaacgggccacgctggaaataaaattgggctgaagtactgtacaggcccaggcccattagcactcccgatactctaacaaaacaccgaagtctaagcgacgcttcgtcttccccgccgagactctcgccatttccccattcctcgctacagtacaagactgcgccgacggagctagggttcaccaatccgccccaatccattctcaaaaatcccacgaaacttctccgcgcgtccaccgcaccgattcccccatctctttccagccttatctcgaaccaaatcaaaccatcagttcacattcatggcggaagaaagagaaagcttcgagagtcagtgggcgccctccgatgtgacggaagataatctgaaggagatggtggcgcacggcgttcttccagcgaaggagatcattgggtggcgaccggtattcggcgaagcattcccgactcccgatacgcatgaaatcgtggtatttgctcacttcttctatggcggtttctcccttccaacctcaagattttttcggggaattctgaatttctatggaatcagcctgcatcatctgaacccagactacatagttcacatcgccaactttattcatgtatgcaaagcttttcagggcattaggcctcattttgctttgttccgccgcattttctttctcaagccccagccgaacaagagcaaaccatgcgttgttgggggcgctggtttccaactcagaggaacgctaagccaaaagtatttctccatgcccttcaagacctcaaacaaaggctggcacgcaaactggttttatgttcaaaaccccgagcctgtccttcccgagtactcctgtcttcctccagtttatcgggatacttggaactcactgccaatgggagatgaagccgcacaagcagtagaactgatggagaggatgataaagctgaaagaacagggccttcaaggagaatagatcacccggcactttatcaagtgtcggttagctccaatcaaagaaagatctcgtacagccttcgaatttgacggcaagcatgacccaaaccgtgaagacccagattctcttgacttcaaggtcatgaaggaaaggatgtataagatcttttcaaatgccatcgttgtcagctactcacacttgctgccagttgtaccgttcaatgcattcaacccccctccaccggtacgcattcatacacttcgacctttctcaaaatataatcttgctttcttgttgaatcagttaacaatgaaggatattacacccaggaatttgctttgatgaagtcggatcccccaatcgctcaacgccgatctccccgccaccaaactgggcaagggagcggaggaccaagaattcggtctgaaactcaaccaagtgcttctgatccagtcggccagtcagattctcgaaagaggaagctggttctaagcgacgacgaagccgatgataccaccaggaggcctgaagaccgagagacgaccaagaaactaccaaaacaggctactccaaggaagaaaacatccagtcgccctgcgccaaagatcaggaagtcttccaggtgcaactcatataacgatccctcttgtattgatgcacacccattgcggcaataatactgataatcaaatttgtaggaaaccatctgatatagacccgtctgggaaagactctgacccgactaacatggacacaagttcttccaaagaaaccgggccaactgttggggatcacccgagtgacaatcagccggcaaccgatcatgtagaatccggtgatccacctccaactgaaacccagttggccgaagccgaagccggagttaatcaggagcccccgactggaaaccagtcggacgcaaggccaaaccaagagattccagaagtcgaaacccaagcagacaaccctcgtggacaaaacgccagcaataaccagagatctggatctcctttaagggcatccgaatccactcgttctcattcagaaatcattacgggaaaacacttttgtctgaaaccatgttgacccaaataaactctgatcaattgtctaacctttgtcagcgaatacattaggaccaatgattggtgatgaagaagaaatcccccgtatacaagcagccgaagattcgtgccctcccattctggtcaagtggtgggatgataacttgcagcctcaaggaattgtaataaaccggcaaaaagaagacgaagaggtctgcctaccgaaaaaggcactcaaccaagcgactcgcattgtaaatgtaagttctctggtacttgatctcaaccatcttgtttgccatttaattcatgcgctaattaaactgtcttgcagaggattcatctcaggaacgaagccaaaacggcaaccttagagaagttagtccctcatctcggaactctcgaagccaccaggagtcaactacacgaggccagagaacttgccaagaagaacgaacacgatctaagggatcggattgctgagctctaggagtccaatttcgaactaagtggctcatcaaaaggttcgcgcaaactctgcttaactgactcatgctgttatctttgcaatcttgattaaccgtaatcaatgtagtgcaagctgccaagatatctcagttggagaagcagattcaaattctggaaaatgacaaggcagaactggcaagacaaagagacctagctctaaaggaagttgaaggt

SEQ ID NO: 38644 - DNA, 14257 bp, Oryza sativa
  unsure (1)..(14257): unsure at all n locations
aacattccgattatgataacgacgtaacccttgcaaatatcgagtcgattgaattaaagctgcttctcgggcttcttctagtcggttgatgtcgtctactcggccctcttcatagccctcctcgttgaagttccgaaatcgtagtgattcaaattccacttcactcggcaacattgcttctgcgccataaaccaaaaagaacggcgactggccggtagcccgactaggagtagtacgtaaagaccaaagtacggacgacagctgatctacccacttgccagcataggggcgtagtcggtcgaaaactcgtgctttgatcccttgcagtatcatgccgttagcgcgctcaacttgtccgttactcatagggtgtgccatggaggcataataaattttaatgccgaagtcttcacaaaagtctttaaatgctccgccagtgaattgagtgccattatcagtgatgatccgattaggtaccccaaaccgatgcacaatgttgatgaaaaaatctctagctttatctgctatgatcatgatgaccggtttagcctcaatccacttggagaatttgtcgatagccacaaagagatgcgtgtaaccgccgactgcccttttaaatgggccgaccatgtcaagcccccagaccgcaaatggccaggacaacgggatggtttgcaactcttgggctggcaaatgagtttgtctggcaaaaaattgacaaccttcgcatgtccgcacaatcttgtccgcatcatgccggtaagctttgccgacgatggtccgtgcagcagcatgattaccacaaataccagaatgtatatccttcaacaattgtctccctttctccaaagatacacagcgctgcagtattcctgatggacttttcttgtacagttcagcttcgtgaataatgtaaagtctgctgcgcctagaaatccgctcggcttcgtttttgtcttgagggagttcttatttggtcaaaaattttatgaggggttctctccagtcggcttcaagcatgcttacgccttgagtatccatggcttcaactgcttcttttctgggcacggttggttcgtaaagatgctcgacgaacacatcagaaggggctgcttctcgttttgaaccaaaattggccagtctgtcagctgcctcattgttatgtcgaaggacatgggtgagctcgagtccatcgaatttatcttccagcttgcgtacctcttgtcggtaagcggtcatattatcatctagacatgaccactctttcatgacctgattgacaaccaactgagagtctccaaggacgattaatcggcgaatgcctaaagagattgcaatccttaatccgtggagtagcgcctcgtattccgccacgttatgggacgcagaaaaatgtatccacaatacgtagctcaatctttctccggtcggggaaattaagacgaccccagctccagtgcctgtaagcctcttcgacccatcgaaatgcatagtccagtattccatcttttcctctggcatgtcttcttggcactcggtccactcggcaaggaaatcagctaaagcttgtgacttgatcgaagttcgtggtttgaaagatatgtccaaagacatcaattctaaggcccacttcgcaattcgtccgtttgcttcgcgattatgaagtatatccccgagtggaaacgatatgaccaccgtgaccgagtgactttgaaaatagtgagataatttcctgacggtaattaagacaccatataataacttttgaacctgaggataccttgtcttggagtcggctaaaacctcgctgacaaaataaattggtcgttggactttttgaatatggccttcctcttcgcgctcgacaaccaggaccgtactcacaacctgggaggtcgccgacacatataacagtagcggctcttgcggatgtggtgaggccaaaactggtggagtggtgaggagtttcttgaagtcttcaaaggctttctgtgcttcgggtccccactggaaattgtcagtcttcttcagcaacttgaagaaaggcatcccccgctcgctgagtcgtgagacgaaccggctgagcgccgccatgcaaccagtcagcttttggacgtctttttgggagcttggcggtttcatgttgaggatggcattgattttctctgggttggcctgtatgcctctttgagataccataaatccgagcaacttccctgacggtactccgaagatgcacttttccgggtttagtttcatcttgaaagcacgaatgcttgtaaaagtttcttctaaatctgcaatcaggtcatccttccgcttggtcttgacgactacatcatcaacataggcttcaacattgcgaccgatctgagttgaaaaacacctttgaatcatgcgttgataggttgctcctgcgttcttcaatccaaagggcatggtgatgtagcagtaggccccaaagggcgtaataaacgaggtcttcaagcagtcggattcttttagtcgaatctgatgatatcccgagtaacagtccaagaagctgagtaactcacagccggccgttgagtcaaccacctggtcaatgcgaggtaacccaaaagggtctttgggacaagatttgttgaggtcggtataatcgacacacatgcgccattgccccgtctttttccgaaccaggactgggttagccagccagtcgtgatgaaggacttcattaatgaagcctgctgctaacagcttggttaattcctccttgattgcgtccttcctgtcctgtgcaaaatggcggagtcgttgcttgatgggtttggcgtcttccttaacatgtaaagagtgctcaatcacctctctggggataccaggcatatcggatggtttccacgcaaaaatatctttattattctgaagaaaggtgtcacgaccggaaataaccaaacgggcgttccttacgtgcgtgtattattccttgtcccaggaggcaaggtacaccaaaagttaatacatttcagagtttaacaagcggaagcgtaaatagttaatttatttcatgggcagcgaaggcccagcacacacaaagacaaacgagaaacagcggaagactagggcgacgaccacaggcgcttgacagcaggcacgagctagacaccaaagccttcatcttcaaggggctcctcttctggggttgggaaaaatttgagcaaggctgagtacaaccaccgtactcaacaaaacacacccacaagtgcagattaaatgcaagggagtacaaaggagttatactataaagggttagggttgcagtaaacagcatttaaagatatttagttgctcaaagctactttgtaaacatgattctagaactatacaatattatttattaaggccatgaactcacacgaacctgccttaacccaaggcctacgatgattcagaccgaactggcaacccgaccctaggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgcaaccacgtgccacataccaccacggtatacagacggaagacgtgacatagtttccaacccatcctagccattgacaagagtaccgacccaacccacctacggccggaacctccgggacaggcaggcaggactgagcccctagcagcaggacaccggccctgtgccatgacatctcgactaccgggccgcagctcgtgtagccttcatttgtcctagagatgtccatcgacccccgacttcttccatctccatccgtgtacttttgtttataaccagactgagccacaaactaagccttacccactagacatgtggaagtacggtagtgctttgcaacagaggcccgaagaccggtccttatgtggccgaggtgctactatcaaaaccatgcaccccgagcccagcctaaaaccattttggggattttgaatagaaggagcggtgtgaagccaattccacaataaccaaaccattccatagtgtccaggtgatatgaatattcccaaagtctagagttgaaaaaccacctaatgttacctaattagatagcgaagcatctacctaaaatcatactagtggtaccatgagtagagtgtccactagttggggttttgcttattctagggtgaacaaggaaatagtaacaataacaataataataaggtcataacaaaggtaaataggcatggctaaataaaacagtgataacgcgggaatttaaataaagcgataatgcaataatttaaatcaacataattttataaactaggattcaatatgttcaaggatgatgtgacttgccttgctcgctttcccaaacgtcggcttcaacttccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaagtttatatgctcttttaatgaatatttgcgaatttcttcatttaaattttaatttaaaaatcggatttattgcgtcagtcgaggggaggagcgcgcggaccgggtccacgggagtggggcccacgcggcagcctcacggtccacggtggaccgggcgcacgcggcttacgccggccggcgccgtgggtcccacgcgtcagccgcacccgagggcgcgggcggctgacggccgggccccacatggcagccgcgggacgcgcccgaaggcggccacgccggcacagccgacgggaggcggcgcacccgcgccccgatggtcgccgccggcgaccaccggcgcggcggagcggcgcccgagagaagggagggaagggggaagtgaaacggcggtccacggctcaccccgggtcgacggcgacgacgggaatggcgaccggagcggaggaaggcggcggcgctgctcgggtcgacggggacggcggcgttccggtggtcggcgggcgaaacggaggggtggacgaggtcggcgaggttgccgcgaaccggagaaggcgacgccgaagcgggagaaggtccggggcgacgacggcggcggaccggagctcggcggcgacggcggagagagagagcgacggcgcgagctcgattccgacggggagagagagcggcgagtggcggaacggtggagggaggcacggggagtgtttatatagggttgggagtgagagagggcggccggaggggaaggaaaccggcgcggcgatctcgggctccctcaatggcgccggcgaggtttgcgggagtgtttccaaacgaatccgagggagagagagagggaaaagtgggggggaaagggagagggcatcacggggaatgattccccccactttattgcacgcgggggcggcgggatgcggcggaatccgcggcggcggcggcgctagggcacgggcgaggcggcgggtgcggcgggtggtaggggatgacgggtgggccccacccgtcagtgagggtggcgggcgggcccgcccgtcagcggcgcgcgcgggggaaggccggatgggccgcgggggagaggagagagagggagggagctgggccgagccggcccaagaggggaagggggggaaaagactttttagggtttttctttttataaaaccattttaactttgtttatttcttcttaattattatttgtgctctgaaaattccactaaaatttatttacgcattttaggcttttaggaaatatacaaaaatcctccaagccttattcgacttttaactttgcacattttaattgttggaggctttcacatggattttacttattctatgcataattttgaggatgtattttagagtcgttttgggacgcgacaaaaggtgatgagcgcgctttcctatttacaatctaactcagcgcctattacagcagtcttgtcaggatcggagggatctaagggaatctttttcgtcttagcatcactttcttcggtcttcgtcagcttggttgtaggaacttctccctcgcttgccgtggtcgcagccagtcggatctcttcgcgggcgagagtggtctcgtgggtttgtgccatctcgcaactttctttgtcacatgtgacggcttgcttgatgtcgctccgtagtgatatgacccctcgaggaccaggcatcttcatcatcatgtaggtgtagtgcgggacggccatgaacttggctagagccggtcgtccgagtatagcatgatatgctgtctcgaaatcagcgacttcgaaacaaacattttctgtgcgaaaattctcccgagtgccgaaggaaactggaagagtgatctgcccgagtggtgtggctgacaatcctgggataacaccatggaagggtgcattactcggctttaattccgtgcgaggaatctgcatatcgtccaaggtcttagcgaaaaggatgttgagtgcgctgccaccatcgatgagagtccgtcgaagcttgacattgcgaaccactaggtctagtaccagggggtaccgccctgggtagaccactcgggcgggatgatccgagcggtcgaacttaattgctgtctctgaccaccgaagatattggggcgtgttaggctgaaccgcattgatctcccgttctgttagcttctgttttctcttggactcataagccaggggtccgccgaagatgtgattaagttctttgcgatgatcttgaaaaccagtcggggcattgtcttcatcatctttcttctttgatgtgccctgatctccgtctgcaggtttgcgggcgttcttgacgtattgctccgcgaactgtttgtagacggagcaatctttggccacgtggttggagttgggatgatgcggacattgggagttcattatcttgtcgaaggtgttgacgcgaggacgttgtcgggaagatggagaggtggtcgccacaagttcttcgggcttacgcttgcgatccttgtggttgttacttccactcccccctgcagtcggcgtgtccttatttggcttccaagtggtgcccgactgtttggacgcggtgatagcatcttcggctttggcatactcgttggctttttcgaacatctgcttaaccatcctaggaggtttacgtccgaacttgccgactagatcctcgtggcgaatgcctttagtgaaggcggcgatgatgacgtcgtcggtgatgtcggagatcttgttgcgttgttcggagaagcatcggatgtaatctcgaagggattctccagacttctgaacgatgttgtagagatcaaactgtgtgccggggcgttcaaaggtgccctggaagttggcgatgaagtgatcacgaagttccgcccatgatctgatcgtgccacagggtagtccgtggagccaggatcgggcggagtccgctagggccacaggcagataatttgccatggccttgctgtctcctcctgctgcgcggattgcgaatccgtagacggtgagccaagactccggattagtggtgccgtcatacttctcgattccagtcggcttaaagccggctggccaatccactcgacgcaggtcattagtgaaggcagctactccatccacgtcgtcatcgtagcgatttggtgaatggcggtgacctcgtgctgcacggtgctggttgatcgtctcgcgaaggtcgacgggacgctggcgaggtggagagtgaggccgttcagctcggcgctccctgtgacgttcgggaggtgagtgaacagatcgtttgtcgtgacccctgctcctgcgactagatcctgtgccggtgatgttgaggcttggctgatgataatcatgagatcggaaatgagggactcggctaccagttggggtgcgggtgcttgcggagttggttggaaccgaggcctttgtctggttcaagatgttgacaacatgatcggcttggttgagtgcgtcttccttgaggagggtgtcgaggagagtgattgctgcaaccgcgttctgctggggggtgcgaaagaccgctgtcccgtcgacgtcttgttgcccaatgagctctctcgctcggcgcccagattccaaggcgcgttgccgtcgatcttcagcctcctttgcaatccgttcgcgatcttgttgctcacgctgtagtcgttctcgctcctgtcgctgtcgctctttctccagtcggcacgttcagcttcttgccgtgcgcgatcttggcccgcttctcgggcttggcgctgttcctctgtttcgttgtcagccatgaatacgccgaagaagaggggcatgtagttatcctcatagctgtcgtcgaagttgtcgaggtcgccgtggtcgtagtggtagccgaaatcgtcgtagtcgaggatctcggttggtcaagaactgacgccgggggagctaaggtaaccatctaactcttccgtcgagactgtcccaagaggttggagtataacgccaacctccctggatctagactggatcggggccgataccggagctcgcctagatctccaagtgggagatgttttggctgtgaagacggcgaccaagtcatcaggaagtttcatcaagattgagggataggactcgtcgtcttgatatggccacggaggagtaaattggatctcgtccgagtagtttgaagccgactcggaagatatgatcttggagtaggcctcgcccgagttcggaataccgaactgcacggggacctggtctctccccgactggttcgaatccgagtcaaggagagagatcttgccgaagtcgttggtgatgaagttgaggctgccgaaccggaacgcctgcccgggagagaaggcgaagtcgtcgatggcagaaacagaacccatcgcacttagtcggcaaaaacttgacgcttcccctacctggcgcgccaactgtcgaaacaagatttcggcaataataaaagtgggtggctatcaagctaggaaagtggatgggtttggagacaaggaatttaatacaggttcaggccttcttattcaagaagtaataccctactcctgtccggngatnnnnccgccgagtgttttattgattgtatgattgggagaaaaaagaatcgtgccccaagaggcacacggaccctccttatataggggaaggaatccgtaatacaaagtacagtccatatcctaacggaatatgggattacagataaaatacaatcgtaaccgactaggatcctaggtactttcttgatatacaagtttagaatctaacccgagtcctcataaagatattctatctatatttggtactgtatatccagctagaatataactgccatgtagatatggggtaaccataatctccacacacactcacccctatgaacgcatacacgcataccctacccctatgagcacctccggaagactggaccggcatatcttgatattaacgaagtcaccacaggcgcctcgctgtcgacgggtatgtcgcctaccactaaaagaataatcaaaccaggtaacttttgactaatgattatattaacaatatctatgctaagtgttatgcatgctatataactaaattcatattttgaattactttcatttgatgctaatttcatatattcattggaaacataacatacaataaattaatggtcaaaatatattattgaaaaccgtataaaaatgtaaaccttataatttaagacggatagagtactatctagtatgcgataggatattttttagtacaataaatctggatagaggatattttctaaatgaatctgattagcctgtccagattcattgcacaaggaaatgttttatcgcatactagataggaacattgtgggatgtgggaagtataagtcagcatcgagtaaggcacattatgccgttacggctgagcgcgcgagcatttttacttggagggatttattcgggtaaggctattgcgcccctccccatataagctccctcctctccccccttcctcctccccttattctctttctactacagtatactataaaattttaaaaaataaaagaacaaagttagaaaaaaatatatatagaaatactatatataaaaaatatttaattcaaattcaaatttaaaacgggtatataaacttttgacttataaattttggatctataaactaatatttgaattcaaattcaaatttgaacgggtatgtaaacttttgacttataaactttgggtctataaactaatatttgaattcaaattcaaattttaaacgggtatgtaaacttttgacttataaactttgggtctataaactaatatttgaattcaaattcaaatttgaaacgcgtatgtaaacttttgacttataaactttgggtctataaactttaggtgtataaactttagatgtatagaaatactatatataaaaaatatttgaattccaattcaaatttgaatcggatatataaacttttgacttataaactttgggtctctaaactttagatgtgtaaacttgatgtgtacaaactttaggtgcataaatttactaaaatagaaaagtaatacggtgtcaaaaaagaaaaccaggtggagggaggggaggggggacgggctgatcgctaggggcgaccgatcgccccttagcaatctcagattgattctcagtatttaatgtttttcatgaaatcatctgtgtagtttcaaatggacttatatagagaaatcaggaatctcaaggataactatccgcgatataggaacaaggattccccaccgtggaaatggggcagcttggtgccgtcatccattcttgagctcctgaggatgtcaccaggtttcttatacaaattatattgtcagcggctcttaattatcaagtaattacaactaacagtataagctaaaacctaaatataaaaatttcaccgaacatcctttgcgtcggggagagactaccttaaatatccgcccctggtaactccatggtccttagcctagctcattggttgatcctccaataccgatatagacatantnnncanatntngaggaaaaagcagttacacaataattactactccctccgtcccagaataactaatctaaaaccggattggacatatttctctgtccagattcgtagtactaggatatgtcccatccagttataggttgctatattctgggatggagcgaagtatactatagctacactagtaacatttaatacaaaaatatttcaaatgttattaagcttattagtcaatatgatttttttttcgtcacgcaaaaggcttgcacaacaataaattataaagagcgaaaacttgttttacacaacgtgcatgagccacaacggttgtcgtgagagatggggaggagaaaaaaatataagaggaaaattagttagtaggatagtaatatactccagttgtgatctaaccctttcagtttctattgaaatagtgctgggtaacggatactccctccttccaaaactaagtgcatttagcagaggatgtaatatattctgcgactatgaatttgataagcactttgtccagattcgtagcattagaatatgtcaaaactaatttcgttttaaaaacataatatgcgataatatcatgctaatatcaagaattaatatctttttaaatgctacatatctgtattgataacgatactgatttgccaatttttggaagtgactgcatttcaaagactgaccaaatgcctacaaatagcaccagaggcttggctcacctactcacttcctcactagattcttaatacacaacccagctggtgaaagagaggaacttgagagttagctagcatggcggcagcattgtcgttcccgatcatcgacatgagtctgctcgacggggcagagaggcccgcggcgatggggctgctccgcgacgcatgcgagagctggggcttctttgaggtagaaaactgtgcgattgaatactaaacacatgtagaaatagaaatcaagatgcatgtagaattcagtttcttctaaaccaactagatgcatgttctcttgtttgatctgttggtgcggtgcgtatatatcgtgcagatcctgaaccacggcatctcgacggagctgatggacgaggtggagaagatgaccaaggaccactacaagcgtgtgcgcgagcagaggttcctcgagttcgcgagcaagacgctcaaggaaggctgcgacgacgtgaataaggcggagaagctggactgggagagcaccttcttcgtccgccacctcccggagtccaacatcgccgacatacccgacctcgacgacgactacaggcgcctcatgaagcgcttcgcggcggagctggagacgctggcggagcggctactggacctgctctgcgagaacctcggcctcgagaagggctacctcaccaaggccttccgtggccccgcgggcgcacccaccttcggcaccaaggtcagcagctacccgccgtgcccgcgccccgacctcgtcaagggcctccgcgcccacaccgacgccggcggcatcatcctgctcttccaggacgaccgcgtcggtggcctccagctgctcaaggacggcgagtgggtggacgtgccgcccatgcgccactccatcgtcgtcaacctcggcgaccagctggaggtgatcaccaacggcaggtacaagagcgtgatgcaccgggtggtggcgcagatcgacggcaacaggatgtccatcgcgtccttctacaaccctggcagcgacgccgtcatctccccggcgccggcgctggtgaaggaggaggaggccggcgagacgtatcccaagttcgtgttcgaggactacatgaagctgtacgtgcgccacaagttcgaggccaaggagccccggttcgaggcgttcaaggccatggagaacgagacccccaaccgcattgccatcgcttgatagcgtgtgtaccacagcgacccctaccgggtcggtgtcagtaaggtttagtcgtgttcgtagtgatcagtgcgtgcatggtcagctactcagctcgcgttttctacctgaataaattaagctccgtcgtcgtcgtctcgtcaccttggataattgtcagttggtgtggcgtgctgttgcacgtacggccatgtatctttgtcggctgtcctcgtgtggtacttgatagcttgtgcggcgtgctgtaccgtgtacggtttattatctactccagttctatatcgtggtgatttctgataattttcgtttttgtgttacatagcaaaagtgcccgtgcgttgcaacgggaagtgtatagaccagaaaatatgcaattatttaaaatataaatttgctgaaatatttggtatttttaagtaggtatatatataattaaatcaatttacaagtaaaacaagtgtgagaaataaaatgacatgattaaatttaattttattaaatactccatgattagttacgctctttagaattttattggaattttcagagcttaaattgctaattttaataatacaaacatcatttaacaattatttaattggaaaaagaatcaaaatccttccttttaggtttgggccgaatatggaaaagttcatctcgttccctcttgtctattctatgtggctggcctgtttccttcagcgttcaagtccattttgcatcctctgctacgcgcggtccatccggctacccaacaggccaacggtccaacgcgggagaagttggagccatccgatcgaatggacggtccagattaatcctaacctaaataaatagtgggcacccaaaattaatcaaaacactaaccctagattcattcactcccatcccccctcccaccgctggcagcctcccccgcccgacgccacatgtccccttctccccaccggcgccatctctcccctctagtggcgcagcttcccttcttctcccctctccccactggcgcgccgctccctctccccctttccctcccatctcgcctgcacggcgcgacgatggcggggtgcggaggagacgacggtgatagtcgtccctcctcctcctcctcctccctctccccgtcggcctcgatggccgtcccttc

SEQ ID NO: 38645 - DNA, 6972 bp, Oryza sativa
atcgccgatccggcttcaccgatggcgcctcgtggacggatctggtggcgacgacgatgttggtggctttcccggtgatgtttttgttcttcttcatgttctttttctcaatcggttgattgtccgattggattttgttcagtaatgaatcgggtgcgaatttatgggtgctttattgggtttctttcttcttttttttgcaatttttttcatcgctaacaaaatcgaattgggatagaacggacggacgaaaagagaggtgacgaacgaaaaattacgaatctttaattagttataagatatatactataatatttccaaattacaattgtaaaaatgatgaatcgttcttgatcaaagaaaaaaaaggaaaaaaagccttgtctgcaatacgagtgcctgactgcctgtttctgttttttttaaaaaaaacgcccagagcggtggacctgagcggagtgagagaacggcgcacggctcccagagcgagggcgcatctcgatccttccacccagctagaaggaggggaaacggcggcggcggcccagtggcggctcggcggatccctggagcagcagccggtcgacggctcccggtagcaaggcggcgtggaggtccggcaaggagcagcgctcgccctccctctcctgtgtgatttgttttgtactataatttgttgatttcctatgatctatttttttggtaatttagacccatgccattataattttgcaaagtttaagatatgtcatcgatatctcaatgacatgtaggacccacgtcattgaaggacccacatgagtcctaatggcatatcttaaattttacaaaattataatagcatggttccaattttcggtattttagatttcagatgattttgtgatgattccgatttggattagtattttgtttttggtttggattatggtggtttgggatttggagagggggcacgcgtgatgtggctgacaaatgaagaggattttttttatcgtccttttttacgggttttttttgtccgcgccattgattgaatcgaactttcttttttttcgctcgcgattgggattcgggggcgggggttgctggtgcgcaccaacgattggaaaaatatgaatcttttaattagttaagttataagatagattagattggaattggtgtgagtatgtgcttgtagatggacctagaatactgaaatcacagtttgggcttgtattgtaattctatatggaccgaaccaaaacagaatcgggtggatgaatcggatcggatgagtttagcgtgattaatgacggacgaaaatctgtgattactgcgatgtgatgaccggaaaaatccaaatatttatattagttatagataagaaagggacagggtaggtcggtatagaaccgcgttttttcgcagatcgaacatctccacgagaccacgacgaagattattaattaattagattaaagaagccttgccggccgctctgtcatagtatgtgccggctggcttcgcctcacactcacaatctcttcgttcttattgagtattcaacggaattacgaaccgcaaatcgctttaaagctaaaaaatgtggctaaacatgtcggcatagtcatattatatatgtgccccggcgccggcgcctcatctgccgctagccgacgtgttgttcagattggcgttgccctccgttacagctggatatgaaatacaaatagaaatgatagagcacaatatacctctgcatagttagtatgcgctcactcccgtgcaagagctaagcctttgctcactgcgcctgaaatccgagccacacgcaaggttagtttgcacgatcccctccctcgtccacctcggataaaaacccccctcttgtcgcgagcatgcttatcatgaaaccatgggcgaatagtgcccaactatggtaaacttgtatatataggggattggccgatgtataaggatatgtacgtacgaaggtaaaaaaataaggacaaatgagatatgagttttcatatacgtacagtttgtataatacaaaatttatatatatgtgtgtgtgtacacacacacacagacacacaaacacacacacatatacgtagagacaagagggggcgggactgatcgtgtccgcgcggatcagcggccccgactttgtgcatgcaagcgcaagcgcgagcgcggcgcctttcgagctccactctcggcgtctcgccgcctagtcgccgaaacgccgatgctacctgcgcgcgtggcggcgtgggcgtggccgcatggataagccgggaatgcgtcctcgcctgtgctcccgactgccgctcgatgcgggaatccttccgtttcggcaggtggttgttgagtttgcggctccgcgctgggccgcgtgggcactcttgccgactgcatgcctgcatggagcccttcagtttctcccgagggccatatacggaaggaataagtttattttgtgaccctcaaaagtgatcgaaatctaatccgtgaccttaaaccataaaaccggatatcttgaccccaaaactcctaaaaccgtgcaatttgactccctaggcggttttggaggacggtttcgctgacgtggcgccacgtggcacctacgtggcgatattaaccaagtcttcgttacacgtggcgttgacgtggctcttacatggcaataaaattaaaaagtatacgtgggacccattagtcattcacaaaaaagaaatgtgggccaactgacatgtgggccttcttcctccctctctcccttctctctttctctcccctttagacggcgggcgggatggcagagagagcgagcggcagtgggcggtgacggcgaggccggagctgcggaggtgggcggggagggcaccaacgccggggagcgccggcgtcggcattcggcgatctggagcccgccacaacgacggggagcggcagcgtcggcatccggcggtggggacgacgtccggcgtcggcatacgtctccgccgcttcctttttctttgccgccgccgccgctccggtggagccgctcctagccagccatcctcccttgccatgctccgttggagccgatgcggttgccgcgatgccgcaagcccacaaccccttttcccgctgtggcacggagagggaggcggtagggcagagcaaggagaggcggcatcagcgaccggtggagctcgctgtggcttccatctcggtgatctacggatctgctgccgcgaggaagtggtgaggtcgaagctcgagcgggcaagaaatgaggttggagatcgagctcccatccggcgacgggaggcagcgagatagggagagagaccacctccgccacggcaagagatggcatgcatctcgcctcccagagcacaagctgcgcaagagagggagctcgtcggattgggcatgagcaggtgagctcgacggtcgccgcggccaatatctcacgtcagcgcccaccacaacgacgtccacgatggccgcgcacacccagctcacgtgctccgagtggctcgaatctgagtgcgccggcgggtccccctcttcctgctcctcctccacctcgtcgtcgttgggaaagcgcaccgccggccacctcacgtgccagtggtggaggttggcaccggcagcggcgcctcggcatctctctcgtcggcgccgagaagagctgaaagagagagagagagagaggaggaggaggagacgggcgagcgtcgccattgccagggtgtcctgaaggcgaaggggcgagccgacctcgccgtcgccgccactcccctcgtcctcccgtcgccattgccaacgagaagagagagaatataggagggtgtcactagcaggtgggccccactttatttttttaatttatttgatgactgggatgccatgtaggcgccacgtcagcgaaaccgccctccaaaaccgtcgagggagtcaaattgcaccggttttaagagttggggggtcaagatatccggttttgtggtttagggttgcgaattaaatttcgatgaacttattcctatacggaacgtgatgggctggactgcggttggagtaggccggatggcagagatgtgggctgttcagcctctttagtctagagccctattgcctacatgggccgtaaatagttaaccaaccgagttggagtttaaactgggttgtcaaatataatgttcaaactagaacttctatcagaacgaaatgccagtcagaataaaatcatgaagacctttttaatcgttcaccgtaggggcgcagtgatttctgtattcgaatttattgattacaaagaacagggactcttgtcacgaatcaggaattaggcaattggcatgtacaaagactgatttctcgtcccaattctctgtttctcctcttacaccgcaagcaacgaatcaaccaaaccattaataatcggagatattaaagaccaccgcagaatgctcgcaccatagcgattctgcggttttttggctggcgtgtacgcttctggtggtatccacatcggcccgtgttggaactggtcatcttgcaaaaaagtcctcgattaacttgataattactcttacgtccctcaccctatgctcctgtgttttgtagtctttcgtaacagccctcaatgtcttggtatatactatgtgaaggagacgaaattctagatataggaccgcgctatgaaaaaagagaaataagggtgttttctgcaaaagagaacatccctatcctatcctctccattcccctgaaaccctatccatcactgttctcctgccctttctcttcctttcccctgtccttgcgccgccgccgccttgccttacctccccggcttctcctcgccgacgacggctttcccctcacgctctcccgtaccctcctcctctcttggcgctccctccatcaccccccctcccagtagagcaaggggatttagggactggatggcgtagcgttggatttgggtgcggtgatggagtttcgccggcgacggcctccccctcgcgctcttccatgtcctgcccatctcctgccgcaccctcaagcactctccgcctgtttctcctcgccacccgttgcagcagttaccctgttttgtgttgggctccacggagctgcgacgacggtagcctcggccaggaagcgacccatggaccaatggtgggagcatttggcaaggacacactcactcaagaaccagacattggcctgtgatgggaaacaagctcgaggatgctaggtacggtcgccattgaggtggttcccctttttatttgcttttcttcagtttttactcgctttgcctaccgtgagatagtcttgatctggttttttcctctatgtcagatggctatagacttgatccttccactctcacagccgtcaacaacatcggggcgattcgttttgctgcctggtgggctattgtttactgctgtctgcttgctgctgaatgaagcagctagcaaatattgttccaaactaaaagttgtagtggtttggtgtgatgaggaagccagaaaattaatggttaggattcagtggcctttcattttatctttatataggacttcattcccctaaatcttgcctttatatattgattttaattatgcagattttctgtacaattggcactggacattctttctgtatccagattcattgaagcatgtaatatttcatctttgtaccatgcttctatttaagaggtgtgcagactctcactgtttcgtttgaatatgccaaccatcatgtttattttgcaattacctacgacactagatgaagcacttatatgtaaatattactgcagagtgtttatcattttgcttaggttgcttcttaaaatctagcgcaggtgattggaagaaggtttagctgatcttggatatgttaggattattagaagctaaatgtttccctgattttacttaaagtagctgtttgccgcttgattttagcgattaaagtttctggtctgaaagaagttagggtgtgtttggttggtgggatatacccggataagacatggccgccgctttttggagggtgtttggatgctgggcgagagtgggatagggcagcccagaggggaatattccctccacatgctggatagagggatccggctgatttggccggatgcaaccgcccgaggctcgggcgagccgggcaagcgagttgcgtgactcgcgtcacccctcaccaccacgacgcgagcgaggcgacgagcgcggtggccggcaagagggacgacgagctcggcggccggcgtgggcgacgagaggggagatgagctcggcggccggcgagagaggcgacgagcgcggcggccggcgagagaggcgacgagctcggcggccggcgcgggcgacgagcgtggcggccggcgagagaggcgacgagctcggcggctggcgtgggtgacgagagaggaaggcggcggcgggaggaggcgagcctcggtggtgggaggaggcggccggcggcgggaggaagccggcgggaggaggctgccagcggcgtcggcgagcccagatctggcgctgctttttttttctttttcttttttctatgtgtatttataatggaatgtgtatttataatggagtgtgtatttataatggaatgtgtattatgtattaatttgatggggtatattcaccatctcaagtgagaggtgaccacacctacaaatccaccatacttcctccaaccaaacaaaaaattggatcaccaaatccacctttgtctctacaaccaaacaaaaaattagatcgccatattcacacaaccaaacaaaaattggaccgccatatccagcaaaatatggaccaccgtatcccatccaatcttgaccaggaaccaaacacacccttagtgttctatacaagcatgttgactgtttgataaaaaaatcacaatactgactgtggtttttgaaagaagttagtgttct

SEQ ID NO: 38646 - DNA, 7555 bp, Oryza sativa
tcagggcttctgtcctagatccccatccatttgtgcctatgaatcatgttgcttctcagaacagatggtaaattcaatatgcagatttatttactacagcaaaaaaataacactcaatatgcagattagttttctattaagcaagcatgtataactggaaatgtgcttaggacagaggtgatatattggtaggaaaattcctatccagattagtttcctattaagcaagcatgtataactgggtatgtgcttaggacaggggtgatatattggtaggaaaattcctatccagaatctggtatagcgccactgtaaacagaaactccgtgtgtgtttatttctacttagtgatcctggatcctgctaatatttagaccttgagatcctgctaatatttggaccttgaattatatcattcctccacatacacagcctgttgtaactgcagctcttatctgttctctctgttcttaccttgaattatgcagagttttgcatggtcaaattagatagccattaaaaaaactatggtatgttgcttctcagagcacatggtagattcgatatggagattcattttccagaaaaaagagaggcaatagcagattagttttctgtaacaaaaaatagcacatcattttctgctggcgataggaatttgcccagtaattctgtggcatgctgccaccaaagtttagcatgtgtctttcgtgttgctacatactagaacatattacctatgtgattaataagatgaatatatcacgtttggtttgtcggtttaattaggtggtgtttatagttcatcctgtgatgccttggatcctttgtgtggttcaccgtaggcatgtggttgggtgcgtgtgtgccatcggtcctaacgctctatggcccacctggaaatcaccttggtccatgctgcgtctggcctatgtagctctctccctgcctgacagccttgacttttggtgcacccccacgtttactcagcatagcctcatgtttctctatgcgatgtcactatgtgcgacagtgcgaggcaggcacgtttcttcatgattctcctaccaacgtttggtccaccgtaatccctggtcacacgagtgctcctctctgcctgtgttttgtgcgctaggagcacgttcatccagtgcaacgaacggattggacaaattacctactggttattacattggataaatgatggacatgcacctattcattgcagagccaatgacaggtggggtcggttttgtgggttgtcccatataccatgtgttatgcgtatccaagaggccgtgagtctatcgtgccatgtttttctaagcgccgcgtgctacagtgtctgacgtgccgcgtcaggccacatcaaatcgtcctgcgcacgagccgtaccggcatgcgcgcaggcatcgatgcatctggcatggccctagcctttcctatcgttcctgttacccggttagttaatagagattgaggccattcaaacagctgcgttgcttcggatgtcttcttggctcttctctcatctttccccttttcgctcttacatcaatggccaacactaggtaatctgctgccctgatttatgctccatgcctactgttctgaatgtgtgtgcgtgtgcaggggggatcgtggatgctgcgccggtgctgctgcttagaatttgcctcacgcctctagggtgctcccccagccacgcttccacgccgtcttcctctcgaatttcgcaggcgtggccctcaccaatctaccccataatttcctgcctatttatcgatgttagttccaattgttatatctgtgatgtataatgtactctagattatgcattgttctccacaaacaatgttaacattcaatctatgtattttatgtctacttaatccatcactggttttcctcataacctgaatgctatagctagtggtgctacagccaatccactgaataggctcttcagggcctccttatttattttcctcatttacacagcaagggcgccgcgaagcgcgccgtaggttctagtttcgtgaacgacatgagccctcaccggcttggttctgtccttcgtcagattaattaacaaacatacattcgatccgttcctcggtgcacgccatcctcagcctgcgcgttcagcaaaacagcacatccagataggctcattagatgccttcacacacaaaactaaacccaaattctccaaagatggcgccgctccgtgttgacatgatcagcacaaaagtactttggtagagtagtagcttacctctgacgacgtgcgactggtgctcgtcggcgtggccatggccatggccgtggtgttcgtgcagcttcaccctgttcttcttgagctgctccctgacgaacttgtcgtagatgaacgacgcccccctgaactgaggcagcaccagccacgccacgaacaggaccttcgcctcgtaccataacggtatcctgcaagacgacaattaatgtggtctagttctgcaatctgcatacccgtttgcagagcagatagaggcggtgccacgaatttaattaccagtacaagactttatggagtgccatttccatgagggtgatgagggagtacagtatccagtacaccagccattgctcgtcgtccaccttggacgtgctctccatcgcgcagatcgacgcgtacctgatccaattcaacactcttttatactcatccaactacaaaccaacagtctgaaaattcacaggcagcgatgtaaagtaaaatcagcagcctaacagagtaacagactagcagtgttcacttacagagggtatattagtgtcagggttggcctgcatgtgaagcatcgcaaattagccaaataaatgatcacaaaacgaaatgaattagaatttgcaattctcgtacatacccggcaaaagcatggaggtggctaatgagtgcccatgttttacccatctctttccttccgatatccaaccaaatcactcaacgaaggttgattttggagtttgatgggctaggagatgggacgcgaagagatccagtagcataggccttagcttgcttgagggaacggggtggttttatacggtcgcagccgcgcgctacaagttgacggcgatgcggggggatggcatcgggtgcctagcttggacgtggcgtccaaggcggggtgggtcggagcctggcccgaccagatcagccgggctcgaatcgctttgcgtggcgagtcgccttggtgcttcgccctctcgggccaaccaacacgccgtggtgcggcttttcatgaggccaggtggccatctcctctttttttttcccctcacacattctgtcttaaaaaaacaaatctagcatgacacatcatgtaccattatgttcatttttcatattatggaagaaatataatagagtacttgtacaaaacatacttatactaggtttatgttattaccttactctcttaacttttacattatcgtttttcacgcacacgtttcctaaactgctaaatttatagacaaatatagtaatatttataatactaaattagtttcatcaaatcaataattgaatatatttttataataaatttgtcttgagttgaaaatgttactattttttttataaacttggtcaaactcaaagtagtatgactttgaccaaaattaaaacgtcttataacatgaaacagaggtagtattagacaaactagttgggtggcccgcacaattgcgcggctaacacacaaacaaaatcatatattttttaagtatgattttacttaaaattttttaaatagctatctcattttcttaagtctttgaaagaccaaaccttatcatccccgtgtttctaattatatattttttaaaagtcataccagttgatatccttatatcatcttcttctttatttgcttgctcgatctaccactatttatattcattctcctttgaatctttaaaaattggcgtccattgtctcttctctttattgtcattgagattttaaaaatcgaacataattatcgtttgggttcatttttactttttagaagtcccgctaacggtttagccattgtactcctctacggctcacccgctatctcccttctttattgtcattgagattttaaaatcgaacatgattatcattgtttttttttttactttttagaagttccgaacctttaaaaattggacttgtagtttaatttttagaagtcccatcaaacgatgccactatgcccctctacagcccgtctgccgcctactctttattgtcattgtgattctaaaaatcgaacataactatcgttgcaattcattttttattttctagaagtcccatcaaccgtagcaactatactcttatacactccacccgttgcttctcctttttattgtcattgagattttaaaaatcgaatatgattaatggggtttattttttttacgttctggaagtcccggcaaccgccttacttgtttgcgtcacggcatgcctgacgtccctccttttaatcgtcattaggattctatttggtgtttcattaacaatttttatatgtcgtatcaaccgccaccactctactcgtttataggcctgttacttaattgatctcgttatgtgttttagatggtattttctttcaatagtctttatttttatcacaaattttagttatttataaattttattcctaattgtaatcttattttttttctaatttcagaatttattttttttaaaaaaaaattagttaatacaatagtattgcgttcttttaatgtttttattttttttattttcaatttcatttgtttcaaaattgtattcctacttgaagtctcttttaatttttctaattttggatattattttattttttattcgaaattttaattaatcttgtattgggttcttatatgatttttctttcaatattgcttacttttaattccaaatttcagctaattttaagttgtattcctacttgaactctttattttcttttgctaatttcgattttatttttatttttattctgaattttaattaatctcgtattggattcttatatggactcttcttttaatattcccttttttaattccaaatttcagctatttttaaattgtattcctacttggactctcctttccttttctaattttggattttattttatttttatttcgaattttgattaatctcgtattgggttcttatatggaaacttctttcaatattgcttttttttaattccgaatttcagctatttttaaattgtacttctacttggactctccttttcttttttttctttttctccgattaatgtgagaatttctagcccccacagtaaacgtggtgcctcctttcaaacctgttttaataatataatagatagatagatagatagatagatatatagatagatgatgggtcctcgaggctacttcttccctttcggaaatgccgttgctgggccatgaattgtgcatatttgagttgtgggcttatgcctatcgtatcgtagcttcacacaatggacacgcttcgtttcagtaaagcaacgcctgaagcagacgcaacagaatgcaactgatcaggcacaagcatacaaaggaaacgtgacctgtagctacacgaactcacgaagaactcgcctgttgaatctgcaacctttcgttctcgtcattgcaggatactgtgcaaaacctccaacagactaccagccagcttgacagcactatgcactatactgtagagtaatagtactgcccaggcccagctagtactggcccagctcggctgattctttgtggataaatatatttttaataatgaaatataacatctcgatctctgcttaatgagctataaccaattattacagcctaacactcagaatgaatacagttcaaatagaatcccttctttctataaagttaatgccaaaagctcaaacctcatgcttccacgtcatcatcaattgtaaaccgttagatgaatgcattagattgcttcccagccgttggatggaacgcagtatagagcccaatccatcaggcaccgggtgagtctcttcgcctcctcagtgccaaatgtagcccacatgaacacattggctcatcttcacacacatctacatgtatcaggcccatcaatccgtataaaagagctttatagtcgaatgcccattcagttaaccttacaatttgttaacttatgtcaaaccattttgcttctttgtagcttatactttgaaagttctacctaaattatctaaaaaatttagatagggttgctaaaaagaatttctccaagaaaaccatttgtttcttccgtttctttttgagattgtacctcctatctaacaaattgatgttaaccaaatccggcagcaacgcgcggggcatcctctagttatagaaataaaagacaccaatcatgaagaagaaacaaaccaaagactactaacccaagataaagagtacacaattgttaaattatgtttgcaaacctacatccgaaattggcaaacaattgcataatcgttgtcataagattacgacatgcaacctttaaaagctcaccatcttcatcacacatttgcagttgtgctcaagacttaagccaatgtgttgccttgaaaattacctgcatatacgaaacatatggtgttttataaaaaaaaaagatgttgaatcgacttatttttcatacataaacaacatttcaaacttccatttcaattcctccttgccaaattatccttagttaatagaacctctttaagcaagtaccacataaagatcttaatcttaagaggcaacttaagcttccaaataattttatttttctcaatatagccattatttattaaccctaaatatattgaccgaacagaaaactggtcattctgatgatagttccatctaaaacaatcactccattgattcaactgaatatgcacaatagaatcacataattcatgccaatttgctaaattctgaccaactaaagctctcctaaaagaaacatttagcggaacaaattccataacattagcaattgaagaacttctctttcgaacgatagcatataaagatggatacttatctttaaaagccaagttacccaaccatttatcttcccaaaatctggtttgttccccattattcacaatccaagaacccatgtttaagaaagtattcttaaccttcatgagacctgacaaaaatgagaatcaccatattttctatcaacttggcttatagactgattagagagatattttcttttcaataagtcctgccaaacccattcctcatttattaaggcaactgaagttgcagcaagtttcttctcgtctccatcaacgaggccctcgatgttgttgtggctgttgccccaccagcaaaaaaggatgaaattgaagatgccacgtggaagcatagaatgtactcccttcgtttcaggttataagacgttttgactttgggcaaagtcaaactgtttcaagtttgactaagtttatagaca

SEQ ID NO: 38647 - DNA, 4203 bp, Oryza sativa
atgtggcatcttcaatttcagccttttttgctggtggggcagcagccactacagcgtcgagggcctcgttgatgtcctgacttgcctcagtcacacgcttatcgacaggggcatcgtgggccttgttgatggcctgtcttgcctcagtcaagcgttgattgacaggggcgtcgcattccacttgcactaacacggctgatatcgcgatggctgcaaggagaagggcgacaactttggccattgccaataaaccgaacaaggattattcaatgttggaagatattgctactgcgggtggataagttgcttgagtttctagggatcattggggctttaaatagggaaacatgtaccattataacctaaggccaagagggctttacggtccaaaattggttggttgcatgcatatgtgccaagtattcggtccgtagtgcatgctctcccacgtcttaaccgttgtcagccggcgtggggtggcgtcgggcaggcgacggggagacagccgtcgggcggcctgggacggcgtcgggtggcgtgggggcgggcgacagggagacggggaccggagcaggccggtgccgggagatgtggcgcgcgacggcgggagcacgggcggcgcgcgctggtggcggcaaaccctagcgccgcgtcgaaccgatggccgggcgctcggtctcgcgaaaggggaacgggaaagaaagaaagtgcgaatcgtttttttccataatggtataggtgggtaattttacccctcaaaagccagtgaaagcaggggtagggactgcttttggatttgtactacactaaaagcagctttggagcaaaagcacttgtggcttttgggccctttggttggcttttagcttttgtaaaagcaaaagcaggttgaaaagcccaaccaaacacaccctaaacttgagagaaatgagagagctattgcttgaggtgtgtgtgaagtgaagagagtgagctccttatatagagctagttatgacggttgtggaagagaaattgtccgaagtgccctccaaccgtcattgggatgcaatcctggacgtccacgccaaaacttgaatccaacggcgccaggattggttcggccgaaccaccaagcccaatccagcccaatttcggctggtgacctcctctattgctccactccgcagacttgtgaattttggcccaattcatcgtgtcagttctgagttcttggtccatctattcataagtctggtactcgacattgtccgattgatttatcgtctgagttgatgtcgattctcctctactttatgatcattctctgcaaaaggttagtaaacctaatactagtggaatattattattctaacagatttatgcattgcaagcatcactagttctcctttattttggtagtatcgacggtcgagactgatcgataacgaccgtcaacggcatcaaacttcattaatgttacttagggtgtgtttgtgaggaggggaaagagaaaatacgtaaaaaaggtgggtcattagcgtatgattggttgagtgttaattattttaaactttaaaaaggattaataaaaaaattttaaagcaacttttattatttttttttgcgaaaaacacatcgtttagtagtttgagaagagtgcgcgcggagaacgagagagtttttcccccgatgccgaataaggccgcagcctaagaggttataaagcaaagcagaagtgaatgtagaggacatcgatggtgaatatgtcagattactcgttgaaggttacagtgaagtgggtcgtatttgggataggaagtgctttacacttggacggcgcggctatgatgctcttgttctagttttagctgctcatatagtacttacggcagagaaaagatatggcgggttgtcgtaagtcctaaatagaattcaaacgaaaaagtcatgcttttttactgaagggtacgctgaacagggagctacgtgcataaatatttctttgattaactctgcgaataggtccagcggctacaacaagaaggctagcgcagctgtgctattgattcaaggcggtttgcaacctatcaaaagtaagatacctaagaagtgagatatttaacatggaggttttgggcaaaccgaaaggtcttgcagaagtcctatggttattttacatggacgctccgcaaacaatagtcacctaacaacagtcttatatgtgcgcatatatcgaagtgttgatgatcgcaggctagtctggtttacgttacttcttacatgagatatttttactccatacttatgtttaaaaaaaattcaaatgatttcacagttgcctgtctagcagccactttgaaggattcttccatcactttaaacttctcagcaggtgcggctgtgaggacagcattagcaacattcttgtaggcaagtgaagctgtagcaagtttcttctcatctccttcggccattccgagagcagcaaaggcgaacattctctgcttccacatggcatgttcaatttcagacttttttgctggtggggcagcaaccacaacaacatcaagggccttgttgttggcctgacttgcctcagtcaagcgcttatccataagggcttcgagggccttgttgatggcttgacttgcctcagtcaagcacttatcgataggggctttgcattccacttgcactaacacggctgataccacgatggcctaaaggagaagggtgacgactttggccattgccaataaaccgaacaaggattattcaatgttggaagatattgctactgcgggtggataagttgtttgagtttctagggatcattggtgctttaaatagggaaacatgtaccatgataacctaaagtcaagagagctttatagtccaaaattggttggttgcatgcacatgtgtcaagtgttcagtccgtagtgcattctctcccatgctctctcaccggcttcatctctgaccaattttggttaatgtactgatccatgttgacaagaaggcattcgaacaacgattacgatcccaaatggacaaacagaggaaatactccatatttttcacaattagttgcatgatgctttcacctagcaaaccaaaaaaaaagcgtaaattacactgacggtacacaaatttacgatataggtataatctgatacataaacttgcaaaaacacttgttttggtgcacaaacttatctggtacgtgtgattgtgtgaacctaagccaaatgagcatgctatgattattagtacttagttgaatgttcatcaggatatcatataggcacaagatatgattagactatctagatatgtatgtactcagccaaatgtataataagggacctgagtaatataaaatatagatgaaggatgcaatgaattgaaaacattggtagaacaaaattaaatatcaaatagaggctattcgcacatgtagcgtgtatcatgaccccttatgtgtgctcataccattctaagtagactctaacttataattattagttattgtctgtcgctgtgatcttgtttcacgtattaaacaagttcatgtactgaaacgagcgttttgcaaatttgtgtattaaattgcaccatgttaagttcgtatatcattgatgtaatttactcccagaaaaaaaaaactcagttgtatgagaactataaaaaactttcacatgtacccaggttgtggctgtatacatccttaaggatgtagtggccggattttatttaatctattatctaaaaaacgtgtacccaggtttagttacttctcttggactaatatgaattccaaagctcaaccctcttgaccagaggcatctctttgatgtggtgcaccgtcattgtctcgatgagggtcggtcatagttgctctaagaccaaacaacgcctaggctacctatgcaggatacaggaggtgtttagatttaagggtgtaaagttttagcgtgtcatatcagatattatatagggtgttgcatgggagtattcgggcactaataaaaaaactaattataaaatccatcagtaaacagtgagacaaatttattaagcctaattccgtcattagcaaatgtttactgtagcaccacatcgtcaaatcatggagcaattaagcttaaaagattcgtctcacaaatttagtcgcaatttgtgtaattaattattttttagcatatatttaatacttta

SEQ ID NO: 38648 - DNA, 4467 bp, Oryza sativa
gcaccccaatcccgttgtacaacattgctacgctaggctgtcaggcattatgcaccatcaaacatgcatttcagtgctccatgcattgtacttcagtacctaggcttagctagcttggaactgcctgcagctagctcagcatcacttcatcagggccacgccacacaactgcactcgaagtgctggatgcatgtagcactaggagtgtattactcgcagtatgtagagccggacggccggccgatcgaaatgatgagcccatgattaattaaccaatccagcaccatcctagttggcactcccgattaaaaacgacggcagcgagtacgtacaaacggtaggtacacacagctacgcgaaattaaagcttgtagtacacgaagcatatatctagtatgaacagttgaacacacccaacccaacccaacccaacccaacccaaccaaccatccacggaggaaaaaaaaagagatattctcacgaaagagatcgaactgttcgagtacgcacgtacggttaggctgtcacattcggtatgcgtggcccccggcgaaagtagggaaagtacgggtccggttacgctgggaggactgcgcgccggctagccgctaggagtcatcaccctggcccgtctcgcgctttttctgcttgcccaccaactacttctacagttctactagtactcgtccggtagcgaggacggcacacgccacacggccacacgatcactcaccgatcggctcggccgcggtggaaagcagctgtttcttgaggggccagccgcgcgcgcgcgcgcggcgccggcggatgcgggcttcctcgacccgtgctgcctatcgggctatcggctatcggctgcagcacggcgaggcgaggggactcgcgcgcgggatctggttgggttgcccgcggcttgggctctccgcggatgcatcgccgtggcctggaggaggcctggaggagaggagtggagtggaggctggagctagctaagctagcgtgggttgtcacacgtacggctgatgtgacggagcccgtcggcaggtttggtcgggccgcgtggttagttatctgattgttgttgatcccggcgagtttatgtatgtgtcgcaacggagtgtacggtgctactcgttctgtccccaaataaaccaacgtaggagtatctggtaaataagttagattggtttattttaagataaaaagagtatgttctgttcttggtttgttttgtgataaatgtagcactccgtaacttaatagtataggcagcgagagaatgtgatgtacgcaatatatatatgtttacgtacgtctagagtcttggttatggctctgacgagtaacaaacggagccaaagttgctaattacgtgcatcggagcgactggatcgctgctgtaaaattagccgacgtttgtgcttttcatcgaccggattgcttctgcaatttgcgcactgtgggaaataagtgaagtgggggcttgagatcagccaattatctttgaggatgtgagctagggttcatcacttttggtttctcactgagctgtgggcactgcaaccttagaatttgttttttcctcttgtttattttccaaatctgcaaagccaccgacagttaaaagagtaggttgggtttcaataatcatttttttttaaaaaaggtaatgaacaccaacaaaacctcaattagggcagctatgtggctctagtggcgagatacgtcatgccattttgagcgttactgggttagttgcaatcaaaatactagaaataagcattagactatctaatcaataaacaatcataacaaccgaaattttgcaactctctcaatctgtaaccaatatgtgtatacgagttttgtaagaaaacaatcaagagatgtatgcaacttattttttaaaagggaaaataagggagcacaataacgtgttaacagtgaatcacagtgttttgattgtttggaaaccaattaaactactaatgagagtacgcaggtacagtaagcagctttgttgggaatgaatggtacggctgcatgccggccagtacgaaaaatgcggtacgagcagacaatctcatcccttcccgaggtatatgcatatgcggcttgaaatggtccatccaccgagagattaaaggaaatcatttggccattcgtgtgcaaaatttatgatcctgatccgagatcgatgtgggcaatcaatcattggtgtcctaatttgcagataagttcagagatggatacagaagagaatactctcaacacaatgataggttcagataagtagatgcctgctagtagggacatgctactgctagggacatgagacaccgttctttagttcagatcttggtcggctcccctgaatttgcgctagctttggcatcttgtttggttcaatagggtggtttgacctgtaattaattcatcatgcttccagaaaattattgttgtagagtttatttagcatatttcagtttaccctgaggagaatagattaaattgcctcgattcatctggtgactccactggtccaacgctgtgtagctcattctctgtttggaccacacgcattgacagggattcaacattcaaggggattaggccatgtacgactgcaactgtgtcgttttgaggcacagttggatttttattaattggtgagaaggtaagagaacttttttttacaaccaaatctatgaaaaaagaggtagttccacaaatataaggttacaaatctttcgttcaagaaaaaataaggttataaatcaacaagagaacgctatctgaataatgtttctgtaacctttggttgtgtcaaaataagttgtgatttgccatgcgacctatcatgcatgtcttttgtgtgtagtttctttagttgttttgtagtatttgatatggagaccagaacacaaccatctcaacgctgccctcaaatgaaaagccaattctcgcaacaagaaatttctccactccagctccaggaagaaactgaagacagaagacaatctacgaacagagacactccatgaaaataatacccaaatttatgtttttaaaacaatacaatacacaattacacatcagcagcatatctccttatgcccccatgcagtagacaacgaacccaactgtgtgtgccatttgctgtcactcaaatcggtcactgtggaatttggtctagcgtccacttcatgtcctttgctctgatcactttagaatgcctaataaattccttctcccaatcatacaatctgacgcaacacccatgattaattaagcagacctaatcaggcacaagcaccggccgaaaggtgcaaatcccctcgtgattttgcttaggactcgtatcaaaactaacctcctctcacctaaaacgaatgcaatagtacgaaggttcagagagagttgacctgatttcgctgcaggtccctcgagctaccacaagatcaaagaaggcctttgacttcccaagcttcaataatggataggactgtggcatttatatccatggattaaaaataatttcaaatgcatattgtactatttttttccggtgtaatataatgtacaacattacacggattatgtgtgtacagtaaggctgtgtttagttcagcgcaaagtttgtattttggttgaaattggagatgatgtgactaaaaagttgtgtgtgtatgacaggttgatgtgatggaaaaggactgaagtttggatccaaactttggatctaaacacagcctaatatggctccaaagagaggaattttgtataaacacatgcaagaaacaatgtaattcctttttttgattatacgcacacacactgctacacgtgcaacactacactcacacacccacatacatgtttcctaacccacactcaaagagatgaaaactaacatatcccttatctcactaaaattctattgaaaacacacctatatgtacgtagtatttatggacactaggatttgaactctagcagatagagttatgcacccacaactctatcatcacattgccggtgcttctctagaaacaatgtaattctaatgccatacatgtgaaatttccatctgcagctgagattaattggctcagacaataggatggcaagattgaggagaccctttggaatcatcagtttgcatgccccaaagatacaaatcagattttaggtgaagaatagcatcacatgatcccatgcgtaccgcccgttgcagcataaaagcggcgggggtgcagttaatggcgcgagatcagatactgtgtacgcaggtagttcaggtggattcagtgatcatatcctctgcatttttgcaacttgcacttcttcacagttcacagcaagtgtttggggggaaagctgcagtgttgtaccatttggtcggctagctctaaatgtttctgtcttaaaagaaaatttactgatattttgccctttcggcttaga

SEQ ID NO: 38649 - DNA, 912 bp, Oryza sativa
gcttaaattttccaaaatcactaggaaaagagcttctttggtccctaggttgctggcattttggtgcctacttttttgctcgctgttgccgccttctctaatcccaagaggggagaaatggagtagaaggctaaaataattcagatgcagctttgctcatggcttcctcaggcagttagggcctaggggtggagaagcctgaagctttgcctgattgcctccccaatcttcttgcctcctctcctttcacttcttctctcctctccgctgtggtttcttgctggttcttggaggcctccacttggttaaatgatgggtgtaggtggtggtcttggtatggaagctactaactgtggtgctttgctcagggagcttcaggtatcctcttgcctgtgttcttgagtgagaatagaattctgtttctttggctgcaattcctgttcttaatattgctaaatgctgcctgtgtcttcctggttcttcttcctgtttggagtgacggttccaggttccctttggttaaattgttcttttatgcgtgtttcttatctgagtttattcagaattcaccgcgtttactggtgaaatattacagtagggattcatttacagattctggcacccttgtgggtttctatcatatctatttgtttactgtccctgagcctaagtttcttcagtgatgttgaagagctcagtgttcttgagcttattcttgttgcacaaaagttagaccttttctttttctttttctgtgttagtattcctcctgtttgtgttgccctcgtttttgttgttaggtgtctcttttgctgcaaagcagtaactttttttttttttggtgtaaggttctctctttttcaccttcctggttcttcagctgcacaaaaagcaatttattgattcgttttc

SEQ ID NO: 38650 - DNA, 720 bp, Oryza sativa
ccccccgagtgcacttgatgcttctgaaattttcgacaagctgagagtcgctccgaatacatatttcaagaacatcaaagaagctggaagtatgggagcaagtctggcgttggcgatgactaaatccctttatccaagagttgatattgacgccattgatggctttgcagacgggacgagcgaagaagctgctcttgacctcatcagtgatgcgcagaaatcggctgacaaaattgctgctgatgtagttgagagatttcaggacaccgatcttcgaccgactggtcctgataattctgatgatgaaaagactgatactgattaatgtaccgataattttgatgattaatgatgatggaggcacaatttgtacaatactgatgaatttatgttgtgcttgatatcttaacttagctcctgatttcttaaaagtttttgtcaaaccttgttgagcctaaaatccgcaaaagttgttaaaaaactttcagtcctcattgactaagccaagaaatcaaacagggcaatgatacatcaagtaagcaaattaaattgataaaaatcacactccattattattatagtagccccctgactgaaaacttcgaggaaaaacttgaagttagcagtcaaagaggaaagatacaaacgaaatgtctaagcgtaaaatcgacgaaggtgttcaatattccaagaatggtgatgatagtaccatcttcgcgc

SEQ ID NO: 38651 - DNA, 6965 bp, Oryza sativa
  unsure (1)..(6965): unsure at all n locations
aaggagaaagaaaaggttttggctatgttgcacaaatcttaaagtgatccaatagttcaaaatttacaacatttgagggggtttttcatgtcaaaagtcatataggcagttcctaaaatttataccaaaatataacttctctatctacttatgttcttaacaaatcataactttttcatttagttccacctaggaagtgatctaggattggtccatggtcagggctagcctataaaagagttaagggcatgtttggatcctaccctaacaatttattactagtgccaaaatctaggcaaattttagcactactaatatttcgttaaggtaaagttatatggttcttgtttcgattgggatcaatatgaagccaaattttggtatcgtagtgaaaaacttctataatttggccaaataaaacatgggcactaccaattggttgtgctcaatccaaacacatgtactatttaagttgccaaaaaattggtaaggcacattagcctatgcataatgattacatggtgaaaatatatccacataattaattagcctatgcataatgattacatggtgaaaatatatccatcataattaatgggcagtcttcgggccatggcccgagtgatctgaggtgtgagtctgcccctaattatacatattttaaaaatatctttgtacaatctaaaaacggatttgctatcctactgtcgacagttttcaccacagttttcaggggtgaaaactgtcaaattttaaaccgtccgatatgcttagctttgagctttgtgctgtggaggaaaaaatgaaaaaaaaaaccacacgctcacggcaagaattgaacccgagacctgcagcaaactttaaaccgtccgatatgctttgagctttgtgctgtggtggaaaaaatggaaaaaaaaaaccacacgctcactacaagaattgaacccgagacctacagactacatgctcattgaaataaccaatcgctccatcaaattcttccaagttacatttgagtcacagatagcttatattgtagttacatggtactcctacaactacattgtaattgtaattatatagtagttgcagttgaaagtttttcattcaaaaaactatcgaatattatataactacttccaaaaatctttatgttttaatatggaggtatagtaattataactaattcttttgagtggctttggtaattttggacgctggaattaatacgtggatatggtaattcttgatgccgatcactgtgatccgccgtccggcactggtggagaaatattttttactcccggtttagaaccctcggtttttcaaccgggactacgaatccaggtagtcccggttggagtaaagaggggtaatctttagtccctgaagaggggtagcggcaatcccttgaggtctttttttttcattgttgatttgctaatggctagagttaatccctatatttttcccaaatcgagtgggatgcatatcccaaatcaacatcctaaatattaagttactcatacacacagatcaaatacatcacaaatcctacacacatatcaaatacatcataaatcctaaaaaactacacataaattaaatacatcacagattatacatgtcagatccatgcgatgcaatgaatcacaaaatctaaaaaaatatacatatagtgaaacacaaattatatataaaaaaacaaacgagccggccaccgctcgcagcctgccgccatcctaccccgcgcggccgcgctgccaccgcccgccgccggccggctgatggaagagggagtagaggggaggaggaggaagggccggcttatgggagggaggagaggggaggaggagaagaggaaggggggaggaagaggggggaggggaggaggaaggggattggatcgagaagaggaagagatgggatgatccaatcttatctaaatatctgtctgggacttaaccgatcagatgtgggagagaaatatttactcccggttgataactccaaccggaactaaagatcaatctttagtcccggactaaagtggtaatctactaaagatcctcggcccctgacatacatctgacaggggatgaaccggactaaaaatcatctttagtcccggtttttaatggaaccagtattattgtggaatttggtctagcgaccaaagatggtttctccactagtgcggggctccgggtgcaagtaaagatcgaggtgattttgcattattattggcgcccggcggagcacgcgagtggccggtttgttccagatattgtgccgcagcgcaggccgcagccgcacgtgtagccacgagcgaatgcgatgcagaggccggcgagggtagctatagctggctgattcgccggctgtggcacggtggatcttatcagatccaaccccggggccccgccatgaacgccacacgggtcaagctacttgtgtctgacgagatgcctacctctacgcatatacccctgcctccgatccggcgatcgatcgatcaccagcacggtggccaagtggacgtacgaggcggacgccgccgacgacgacggcgatccactagcagcgcgcatatgcatgtaccgatcgccgggcccgtacgcggtacgaacttattccggttttttgtgtacgtactgatcgatgatgcaatgggcggcacgggtaagggtggtacaaagctagctagcaaccgtgagcggaggtgcacggcgaatatcgcagccgattgggcggcgggtcagtgcccggaacgctgggtgcgccggcgaggggagagagagatcgaagcatctctcatctcatcgcatcgcatcgaatcgcggtataaaggtggcgccgcgggtgggtgcgggtgacggccggtggtttggactgacggcgatctgcgctatagctagctatcgtctcgatcggccagccagctgattgccggacagatctcgatcgagaagcgaatatctttgcaaatttgttaccttgctgatgttcttttccttgctaaaatcgtcggaatataatcgtagttaatccaatgcgcgcaagcccctttcgctcgccggccggccactcggacaaagcggcgacagggagccggctggccggccttgtcgttcttgtgctcagctagctagctgtttaagggcttatttcgagagctcaagattctgaggagtaactggcggcgttgatagttagtttctaattttttttaaaaaaaaactaggttttccaattttttgtttagtagttagaagctcttaaataagtcctaagtgtaaatgcacaactagctcgccaacagctgagatatcgagctagtacctagttgcatgccctgatgcccatgccacggcgtaacgttaacgtacgtgtcgtcggtacatggtagttttcatgggatctttttgtacgtttttgctagctagttagctagctgcagggaccatgcacgtaagcaatcacacggcgatctctcgatcggtcgactgatcgatcgattagctagcttaataattagcttggacgatcggtttgcgagtcggcgtcctcaactttggccagctcttgctgatgacatgacctgtatggtacacgacgtacggcgtcgtcccaaaactcgcagcccaattgtttgattgttagcttataagccacaatcaaattagttttatgtgtgttctaaaacttaattgagctggttttttgaatttcttttcttaacgatggtttatttttcaccatccacttttaactcatcaagaacacaaataaagctttatttattctattgttttgtttattttcctatgagtcatcagctgttgaccaaacgatgagactgttgtcactgacgtggcagtggcacaacacgtataccggcaggggagggcagggtacgcaacgtacggtacgttgcaccggtcgcatgcaccatgcatgcacatcgatcgagtcagctgatcactcacactgcggactcaccctgcagctagcggccatgagatcagattggatggatatgatggagacgggcctccaaacaaagcaagttaagctatctagctagctagcgaccgagtgacgacgcttatctcgttatctcgtttgtttgtcatatgtaacacgtatgaataccgacgaggaagcgtatgtgcactgtacatggactggttatcaacctatgatttgatgatggtgggacacgcaccaaccaatcaatctccatttttacctttgcatggctaataatatttccaacttttgtatgtaatagggatacaagcgggacgggcaaataggtttttttagcccgcttcttctagtttatttttttcttctaaattttatactactatatgggaaatgaactagcaagcgggtttttatacggatagcgggactacccacttgcatccctaaattttagtacttttctcataatgtaagtttatatgaatatgtgcaatgctagaaagttcattatggaacggaggaagtagcatatagcaagaaaagaaaaagaaaaagaaaaagaaaaacttccgatgcttctcggcctaggacagcacggcccagttaaactgggcccgaattagggagttgcggcccatgcgcttcgggaagagcccgtgatggtgttacgtccacgtcagcccagcaataggccgctgatatattgggccgacacgtcaagtctcggtctctcttctctctctctctctctctctctctctcgtcttctccgatcgcggcggaatggacggcggcgcggccacgaacgcatctggagtcgccgcggcggcagcggcggcggggaacggcgtgcaggcggggggcgggggcgagagggcggaggacgcgtcgaagcagaacctggcgctgatgatggcctcgatccagaggacgctggggctcctccaccagctcaacctcaacgtctcctccttcagctccgcctcccagctacccctcctccagcgcctgtgagattctcccagcaaatccccctctcccccttcctgtgcgggtgtgagtgggtggagaaatcttagggtttggttggtgattgtctcgtttgccgcaggaactcgctggtggcggagctcgacacgatgcagaagcacgccgagggatgcaacatccaggtccccatggaggtcgtcaagtgagttggttcgatttccatctcagtacccctttcgccccctggttctgggtgtatgacttggattggattggattggattggtgcctgttttgctagtttgatcgatgacgggaagaatcctgacgagttcacccgagacgtgctcaacagctgcatcgcaaagaaccaggtcactaagggcaagaccgatgctttcaaggtatgttacaattggttaatgctgacatagcatgtgctattttgattctaggtgctaagtagagatttaggtattccctggcagttgctaagtagagatttagatctgttcaaagggaaactcttgatccaaactgcaattgccgctccccccgccctaaggggtgttattgttcgtgttattagtcttatgttgatttttagataagaaggtttaaatgtagtttcaagggaatcaatgacacttgaatgaaaagaatcagcaagagccttgcttatctcatttcaaacattctcatccaaaccgtatccaggagcatatactaatcccttttaacccagtgaaattggttatggtctagtatcttctgtctagctagtcagttattaagtacacattttgcttattgtattgctctcattgacttccaacaatatgctctaattaattttaggcgaattgtggggacaaagtttgttgtactagctagacagattcctatcactggtacatctagctgtataagttgatggtcctcattgaaacaaatagatggaaattctcatccaatacttctatagcatttattgatagatgtataactgttaggcccagattttttttagccttttgatattttttttatgaggtgcatatagttgtgatctgcattagtctgtgtcatggatacgttttataaactacctccattgatttttatatgctgtattttaatttgaagaagtcttcaacattaacttcgtctattgatttcttataaattatactcataatagtaataaatccaatagtatgtgagatcactttaaagtacaaagctattgatatactttttatacactaactaaatggttcctttaatttgtctaatcattgatcaaaatctacaaagtttggcctttttgaaattaaaatatgccatataagaatcaatgtagtagggagtatcaacattgttagtttgtattttaaactataatttgatccatgattgatttctccaagttaaacatctgctattttcttatatggtgtttggttacaggcattcatcttttacaaccttttacattactatttaattatttcctgtattcagatgaaaaattgacatcgtctttcatttgaacttacttagtaatacaaattgaattattttccttgcaacttgtttgtttcagagcctgcggaagcatcttcttgaggagctggagcaagcttttcctgaggatgtagaagcatacagggagatacgcgctactgctgctgctgtaagttctggaatgtagtttctgtttcaggatttgcatatgaatgcccatagctggtccaatgggccagcaatgttgtggtgatcatcttttggtattatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgcagga

SEQ ID NO: 38652 - DNA, 11408 bp, Oryza sativa
ttaaatgtcctgcctaggaaggatgatttttactggttgtgctctttaggtatctgacagtggatatatattttcgcacgcgattaattcatgcttgtgaaaatactctatctatttttattggcatttggttgttggcggttggtccggctgtcagcgaaaatatgatatggccgccaatgaaaagctttttttatagtaaccctgaacatagcgagatttcatcaacatcataggttcttgtagatgttgcacatgccccagtggtgatatgtccgatattcagacaggcacttaagtttctgcacagcctgactcggtggctatcttgcatcgtctcgtcctggttctcgggctggcgcaggccggcaaccaaacgggcttctgcatggcctcatacgaaccagacctgatgtagacaaatccaacataaccataataggcaccgagctgcaagtagccatccaactgtagattgtctgatgagtgatgatggtattcagaaaatgctccaaaacttcatgatcaaatgactcatcaaacatgtcgttttataaagttcaagttcggagtgattccacacacgcaatctatgtgtgaaagcaactgctgaaaatcacagaaccaagtgaaagctgaagaacttttacgctatgcagtaatgtagacactcttaaggcctcatgttttgctttggcaaaatttgtttttaccatgatcacacttcccaaactgttaatgtttttttcataaaaaaattatgtagaaggttctttaaaaataaccaattttcaagtttgtaataatctattgtattataagaccgtcttgaatccctagcacatggtagccgtgacactgagagctgctgctaggtcactactccatggcgatagactgttgttgcggctacgacaacacatcctggtggttgcgagtggttggaaggtgagagaggaggaagaggaaacgggaagagaggagagagtagagagaggcgatgaagatgatgaggcggaagtcgctgacatgtgggtcccacctatcacgtcaactgaaaccgtttcccaaaccagcagagaaggcagttcgcaccagtttttaagttggagagacgttatacccgattttacgattgagggatatggttcgatcaaaggcaaaagatgagggaggtaaaatagactaactcagctcaagtaggactttccccaaactgggccgctaccatcagtcgtgtcgtttaccgtgcagaacttcagtcaagcaaatcatctgtgagaatatgactgtcaaagctgtgtagtaccacatcagaagaggaaaaaaaaatgctcctactcaattttgcggcatgcacctcgcactttgacacgctaaaactttatatcctgttatatctcgaatatttaaacacatgtataaatattaaatatagtctaaaaaataattaattatatagattatgactaatttgcgagacaaatcttttaagcctaattactccaagatttgataatgtgttgttacagtaaacatgtactaatgacggattgattaagcttaataaattcgtctcgtggtttaccgacggattctataattagtttttttatgagtacatgaatattttatacactaacctctataatatccgatgtgatacgctaaaacttttcacctctaattctaaatatctcctccgttgctgactaccgtgcacattattgcccatagctagtggagtggagtactctaccactgtaccagccaagaagaggagatttcagagccgaattcacagctagtaccgacaacttgccaagatatttcgctctgtagaaaaatcgctgtcaggccatctccctagccgacttctttgatcctagttctttgtcagttcattatattttctctcatataatagcatatatgttttctcattatattattaaaatatattacaatgacaacataattttaaattttgcaataactttacgaaactactaatgtgtaataaccactctagtctcctcttctaatattacttatttttttaattccaaatttccactgtttctaaattgtatttctatatagactctgccttttctttttctcgattaatgtgagaatttctaggctatgagagtgaatgtggaggctcctttttattctaaattttagttagttttaaattccaatatggactctatactctatttctaatattccttattttttaattccaaatttctatttttttttcttaattatatttctatatgtactctatactttacttctaatatttcttatttttaattccgaatttctattatttcctaattgtatttctatatggactctatactctacttctaatattccttattttttaattctgaatttcaactatttctaaattgtatttctatatggactttagtctcctcttctaatattccttattttttaattccgaatttcagctatttctaaattgtattttgatgtggactctgctttttctttttctccgattaatgtgagaatttctaggctatgagagcaaacgtggaggctcctttttctattcctttaataatataatagattgtgttcaacatttaaccgttatcttatttaaaatttttatttaaaaattttatgagaaaattttaaaaacaaatagtcacgtataaactactatttatattttatcatctaataacaacaaaaaaactaatcataaaaaaattaaataagacgaacggttaaacattggatatgaaccgtgtaaaattatacttattttggaacggagagagtataactcaatctaaaaaagacagattcttgctacgaatctagacacgtatgtgatcagattcatattaaggattatgtctttttctttttggaaaggagaggtagactaccttaattagatgaaatttagtactattaattatactccatatttatacaacaaccagtgactcatcaattatcgcggtggagaaaattcctatcttttttcttggagtaggattaggatgtaccactacgtcttcctcgccgccgttgcgctcctcgccgtcgtcggctacggggtcaagaaccgacgccgtcgaagcgccaagctcccgccatcgccgccgtcggtcccgtttctcggccacctgcatctcttgggcccgctcctgcaccgctcgttgcacgagctgcacctccggtacggcaccgacggcggcctgctcctcctgcagctcgggcggcgccggacgctggtcgtgtccacggcggccgccgcggcggacctgtacaggaaccacgacctcgccttcgcctcccgcccgctcgtcgcggcggcgcacaagctgtcgtacggctccaagaacatcaccttcgcgccgttcggggagcagtggcgccgggcgaagaagacggccgtcgtccacgccctctcgccgcggcgcgtcgaggcgttcgcgcccgtgcgggccgccgaggcggcggcgctcgtcgccgcgacccgccgcgccgccgatgccgcggcggacgggggcgccgtggagctgagggacctcctgtacagctataccaacgcggtggtgacgcgcgcggcgaccggcgccgcgggcacgacggcggagaagctgaagcagctgctcgggaacgccacgtcgctggtggccggggtccaggccgacgacctgctgccgggcatggcggcgaaggcggtgaggtgggctacggggctcgagaagcagtatgacgcctcgatggaggagtgggacaagttcctctcgccgataatggcggagcacgcggagaagaagaagaagaagcgagaggacatcggagcaggggaggaggatttcatagacgtcttgctgcgtctgaaagaagaagacaccgagctcacggacactcacgtcaagagccgcgtcgtggtgatgatctaagctatcaaatcattctcatccaaactactctctcaacaaattttcatcaaattaatctctcgattcttgcgtttaaaattctgcaggatttgatcgccgccgcaaccgagacgacgtcggtgacgctggaatggaccatggcggagctcgcggcgaacccgcgggtgatggcgaagctgcaggaagagatcgctcgagcgaccggcgggaagccggccatcacggaggcggaggtgggcggcatggagtacatgaaggcggtggtgaaggaggtgctccggctgcacccgccggccccgatcctcgtcccgcacgagtcgacggcggcggcggccgtgcaggggtacgagatcccggcgaggacgtcgctgttcgtcaacgcgtgggcgatcgggagggaccccgcggcgtggggctcgccggaggagttccggccggagcggttcttggccggcggaccggcggtggacttccgggggaacgactaccagctcgtcccgttcggcgccggccggcggatctgccccggcatcagcttcgccgtgccggtgctggagatggcgctggtcgccctcctgcaccacttcgactgggagctccccgccggcatgcgcgcggcggagctggacatgagcgaggcgcccgggctgaccacgccgctgcgcgtcccgctccgccttgtccccaagcgcaaggcgccgcttgcctagacatatttacaaacgaaatgtaattggtgaataaaacttgggtatagctatatttattacgctatatttttcatcaaaaaatagtcggcatgtatttacattgtaagtccctaaattacatatgtaattttagtgtatttataatgtaagtctcaaaattacatatgtaagcactaaaattacatatgtaaattcgaaaattacatatgtaagtggggtgtaaatgaggtgtaactactgtgtaagtggctgaaaaaaatcgactgtagcatatggcgccatatttctagcaactccgataaaacttttatatacgtgttcttaacaattaaaagaaaggtaaattggaaccatgtcattataattttgtgaagtttgaaatatgccatcggtatctcaatgacatgtaggacccacatgagtcaataacatgtgggtcaagatggtatatcttaatttttacaatattataatggcatggttccaatttttctaaaaataaaggcggaaaaataagcttcgatgaaaaatctttaaaatcggtttcaaatttaaagttaaaaattaaaaatttgactgataaatgtaagcctacgcgaaaagatagtttgttgtcgtgggctcgtcgtccgtgctgctagtcgtagatgcattgtatctggtcagtgacacggggatcagtcgtagtagtatgctgctacgagtgtttctcatctgctctgatcagagtggtgcaatgtactcctactccattgttgtatctgacctcattgtcagcaaatttgtcgatggatggaacacgaacaaatgaccacaaaattgttggaattgttgtcgttgaagcaccgttgttacaaatccgccgccgcggccgccgtggacacgaccagcgtccgccgccgcccgagctgcaggcggagcaggaggaggagcaggccgccgtcggtgccgtaccggaggtgcagctcgtgcaacgagcggtgccggagcgggcccaagagatgcaggtggccgagaaacggaaccgacggcgactgttcttgaccccgtagccgacgacggcgaagagcgcaacggcggcgaggaagacgtagtgatacatactacttcaagcaaaaggatttggatttttctccacctcgagaattgatgattcagataattgtgagctgcaacgatatcgtgtagatatgctttctccgtcagaaaatgttgcaatttatttcctccgttttacaatgtaaatctttctagcattaactacattaatatagatgctaatgaatctagatacatatgaatatggataatattagaaagtcttacaatataaaacggaggaagaattttacatattctaaaaaaatctggacagaatttgtttaggatagatctaaatctcatcctaaatacaacattttgagacagaagaagtagtgtgctcctgtgttggtaacttggtatcggtagctgcgaattgggatcagagaagacaagtcggctcatgagcctgcttgacagcgatttttcagacaaggaaatatcaggtccggtagatcaacgtctggtcgatccgagctctgatgtccccgtcttccttgctcctgctggtagccttgggcaataatgtgcacgtagtctttgtttgagagctgcataatgtggcgccaaatttagttttctctctctcaaaatttagtacagaaacacacacttatatacacgtacacacactcatatgtaaagacacatatgcatattatttttttgaacatctccaaaaaaatattttaacatatattgagattgaaatcattgtaggtgtttcaatgtcgactcataacactccgttcgttgagttctttttttttatgtggtatggagtagctttgacagtcagtcagtcacggcgctttgcttgtctgaaactctcaactccactaccgggggatgtcgattcgaaggcacattgggcctatataagttaatgggccagaactgatattcaaaggaacattgggccagtttatcgtggtccatctttcttcttcggtgatgacatggaatgaggcctggcccaactaaacatcgggcccaacttttcttcgtcggtggtgggctagagatggtgtcagggcccggcccaactagaccacatcatcctacccctacctcaacccgtcggtcctcaattccccatagcgcggctcgtcgcgacctagccctagccgccgcccgttcgcgacctcgccggcgccgccatcccgccgccggcgaacctccccccctagcggcaggtcgccgtcacgccgcgccgccccgcgccgccgtactaggcgccagcccgcgaggtccgctcggctccaggattcgcgctgccgcacactccgctccgctcggcgtccccgccgactcgagggcacccctcctcgtcgggcctctccgtcgccgacgagctttttggggggttgagccgaacccccatgccctacgtttggtctgtcccttggtcgtgaggatatggaccatatagctgaagaagagactgtgggagttgcggaagaccctggtttggctgatgttggcaaggctgatgagaccaaggaagaaggtggtggtgctggagtgcacttggatgaaactagggttgcagtggatgatcccacggaggtgcgtgcttcgcagattgacgatggtacggctatggtgtccgtattaggtggcgatggcgatagctttgttgagcaagatggtcaggatactagcggcggcggtgcttgcaatgaaggtaatgagcctgaggaagatgctcgtgttcaggtgcgtttggatgatactagtgccgctgtggatgaggggggtgcttccttgattgatgatgttatgaatacgctccccgttggaggtgtggctagctttgatgatggtcctcagacggacaagaatgcgcaggatgagggggcgcttatagatgtagtttcctcaactgtgctgaatgatgcgagcatagatcttgtcaaagctagtgatagtgtctcggaggaaggcacagggatggatatacttgtccaaccgggagaggacattaaggaaatggttacaatagcctgtgatgcggccacagatgacgagggcaggaaggtggatgcagtttccagctccagtgatcgcaacgaggaagtggttggtgcagctggtcttgatgagacagatgaagacatgcgattgggtacagttggcctgtctggtgatgacaatgtggcaaatgaggctgctgccgcagctgctggtggtgcagatgatgaggacttgaagatggatggggtcattaccgccggagataaggatgtggaaaatggcaaggctgacaatgctgatggtgttccggaagtgaatgtagttgccattagtagagataatagtgcggaaaatgaggctgctgcagctggtgatgatggcgcagatgaagagggcattcagatgaatgtgctaaacacaactagaggtgagggtgaagaagatgatgaggctgctcaaaatgttgttgaatatgctgttgatggtacagaagaactggaaactataggcctgactggagatgataaggcggaaaaagaagctgccccagctggtaacaatagtgcagatgaggagggcatgcagatggatgcggttaccacaactggagctgaagatgaagatggcaaggctgatgaaaatgttgttgaagatgatgatggtgtttcagaagaagctgtggctgacacagttggtgaggatatccctgaagaagatgcagtgcagatagatgaggacgaggatgatgatgacgtgcctccaccattgacaaggaaaggcggggggcgccggaagcgaggtcgtgcatcttccaaggctcaggttgtggtgaaaccacctgttaggaagaaggatgatgaggaagtttgcttcatttgctttgatggtggtgaccttgttgtgtgtgatcgtaggttcgttaatgacatggaatttcattctttccatatcccaaagtatattgctatgttacaattattaatggttatttctatgtcctcatactcaggggttgtcctaaggcttaccacccttcttgtgttaatcgggatgacgagttcttcaaatcgaagggtcgttggaattgtggtatgtgggacttagtctgaacaactcgcagtgcccttgcttagttacttagatggtttactttggaatgtggatatgagtattcatacttcatttcatcaaaatccatgatttttatgggtcatatttgcattgaacctactctttttacatgcagatagtgggatgccggtaaaatataaatataatagctgatttaaatttttttccattttgtcctgttatatcatatttatttgtttattgttctttactttgaaaactgaagcttgtgaaatctgtgtaatactgagtaaaaattgctggagataaatgatgctggactgtttctctgataatgatgagatttgtgcttagtccacagataatatcttccttttttttttgattttgttcaatctgcatcattttcccagggtggcatatttgtagcaactgccagaaacctgccttccatatgtgttacacatgtacctattccttatgcaaaaaatgcataaaagagacaaaattcgtctctgttaggggaaacaaaggcttctgtgagacatgcatgaatactgtgatgttgatagagaacaaggaggaggctactgagcaaatggtaatatttcctctgtttcttggcttaccttaatctatctattgtatttctatagtatcatccagtatctttgatcttttcatcattttttagtttctgtatatcatttgtgacaccattttatccttttgtcattctctctcatctaagaaacttaggtggtgtttgaaactcatgaagatgaagataaagttggtgcacgtaaaacgagataactattagcacatgattaattaagttttaattattacaaacttgacaaatggatatatgtgatattttaaagcaacttccatatagaaagttttcgcatggaacataccgttcagtagtttgaaaagcgtgctaacggaaatcgaggtaatatcttaattcataagaaaagaacagggcaaggcgtaacaagttttcgagatattcatgctcaataatcattttgttaagatgtaggccctatgtatcttggaactgttaatttgcacttgatttgtctatttgattagtaaactcaaatgagctaaccaacctgctgcctgcaggattcaaaaggtgtaacaagaactattttctgaatgatgttgtccaagcattgcagcttgctaaattgttttcacgaaatggcatttccataacttccaccaacaccttctatgcgctatgtctatgttgtacacacctatgatcattattgagatacagagttgtactgatttcagtactcacttacttattaatcaacatcaatattcttaatttgtcttctcatttcccgttgtgctttgctccataccttgccaaagtgttaacctagtatacttgtacaaatttgcttaacaggatgtagattttgacgacaaaacaagctggtggtatttgttcaaggattattggttgaatttgaaaacaaaattaccattgacgtttgaagaaatatcagcagccaagtctcaaaagaatggttcttctttggttattcgtgacaatgatctcagtgaaccacatgatacaaatgatgaagaagagggtaattcagacagctcatctgtgcgccatctagaaggcaattcaaagaggaaaggaaggaagcgatcaaagcaagctgctaacgatgacagttctgtagttaaagatagcactaggaaatctacaaagcgaggcctgacaggtggccgtgatactaaaagttctacagggagaaaggttagaaaattgtccaagcgtgctttgagcagtgaccatcgaccaagagaatctgaaagcgtagggacatctacatcgtcagctgaagagaccagttgggcttcgaaggagctcttggattttgtagcaaatatgaaaaatggtgacaaatctgtgctgtcccaatttgaagtccaatcccttttacttgattatattaaacgtgaaaacctccgggatcctcgcaggaaaagtcagataatttgtgattctatgctcaaaagcctttttgggaaagcacgtgttggtcattttgagatgctgaagcttcttgaatcccatttcctcatgagcgaggtctcgccagttgaaattgatgacaaccatggtggtgttgtagaccctgatcctagtctggatgctgatggcaacagtgaagcatcaatggtgatgagctcagaaaaaaggaaaaaatctcgcaagtatgaccagaaagctctgcaaacaaaccttgacgactacgcagcaatagataaccataacatcagtttaatgtacctgcgtcgcaacctgttagaagaattgatcagtgaagttgacacatttgatgagaaagttcttgggtcatttgtgagaataagaatatctggaacaggtcaaaggcaagacatctaccggctcgtgcaaattgttggtaagataagacactttcaagctaatctggctggttttagcttcatgatgctgactttcccatatctgtgtgcaggcaca

SEQ ID NO: 38653 - DNA, 3239 bp, Oryza sativa
  unsure (1)..(3239): unsure at all n locations
cagttaaacatgtagtcaggcaagagcacattatgttattgagtaagtgagtcacctagttgacttgccacgagtcattttcatgtgtttttaagaaatggacataatggtacaattaggggtgcatagggaaattaactaatcagctatacatactaattagtatagtaacaaagcaagcctttggcgtccacaggagactaacagaatctagctagcaacagatcagatattatctatattggttgaagcagctcttgtctgagagcatgtcactgcgtcacatactcgcatgtattgtcgatcgatcgattgcaagaagccaagaactggtaaaaacggagtagaaatgaatgcctgactacagcctgagtaaccccctatttgtcccagctgtttggtgtgtgatactatatgtgtacttgaaagttctatctttccaagaattaatgaagctgcgaataccactgaccacataacgatctgataattaccttgctgggcactttgcctgttctgttcatgctgcaccataactgaaaagatatcacacaaaagcagcagaagaatgttatgacagtgctgagtgcttgcctcacaaactcgtcacccttacgatcgaaatcatgagctaattaaaacaagtccagcgacaaagcatgttgatctctactattattcttaatttggtactagtacaaaatgtgacgtataattttcctgaaccatatatgtatgcaacaataatctaattaacacgcgactgcaattccccctcnccgggttcgtatcctctgcatttgggaccaaaggcaaagtttgccgttggttccatccaggacatccatacgtcaatcaacggttccatagtttagcagttagcacccttttagtgactaattagcagctaattaactaatagagttgttctctcttaaaaaaaaatcaaggaaatgatctccagcggtaaatcaaatacaactaatacctgccttgccttttggaaccaactcaaaaaataagataaaatcaagaagcaaacaatctcaggacaagaaaaatcctttatttatacagtagtaaaataattatgccacgtccgtatgaaacatctagcaattctaatgctaaaatcctcccaaaaaataaacatttattttgaaaaaactaatctgtctttattgtacaagagtattttatcataagaaaattaatagacagaaccgatcttgttaattaattggactaatatatagaaattattatattatattaattaattagctgttaatcatctttgaggtgctaaaccatgctaccgttcattgaagtcggatggtctggatggaacaacggcgaaccttgcctttcatcccaaaggcaagacgatactgaccccccagtattctttttagttcaaattttgtaggataatataaatattcgtagggaactgatcctaatgaacagaaattcatccatttaggcaatcatatcctcgagggggtaatctaaacaaatttaaaattggctactagtgtgtgttaatcttagtatttactactccctccatcccataatataagagattttaaatttttcttacaatgtttgatcactcgtcttattcaagaaatttgtgcaaatataaaaaacgaaaagttatgcttaaagtattttagataataaagtaaatcaaaaaaaataaataataattcctaaattttttgaataagacgaatggtcaaacagtgcaaacagaaacgcaaaataccttatattatgggacggagggagtaaataacttgcatatgttcgtatccatgggacggacatgcatgataggtgcacacttaagtacctgacttggatcgagttgttttatgcatcaaccttgcattatttgaggaaacttttttcataccttaatgcaatatcctcttatttttacatgcatttaatattttttagaaacatagtataaacacaaatacttacaatgcgcgcacattcaccctatgaacctatgagggccttcattgataaagtcgacacggacgcctcactatcgatgggtacgttgcctaccacggaaagaataattagctatcaacgcgagcagccatgtcaaatctataatttaaaccagatgagctagttccacaacaagaaacctacccagttgagttacactcacttcgctatatgcacctaaattgttattaattttttttaaaaaaaatgacatgatatattaatataagatatttcatgtcacaaacgtaccaatttaaaatcaatatatacaaatagaaataaaaaaacaataaatttgaatgtgaacagtgcgtaccattcgcaacgatatttattatttttttataattggctaagttaaatttaaatttacatatttgtgaagtctatcttgttaatattttaatttttatcacttttaaagtgataagtacaaaacaagggaatatcctcatggaatggatatatgtctcccatcactgtagtgatatttggcatggtgagttggtgacatttctaccattcatatttatttagtaggagtaatcacaaagtttgtttaatggtgtcgctaaatgcgtgacgcggtactaatatatagaatgacattatgttgcatcagctgggactccctgcccctgccctgataacctgatccgtatatctgatcattatctgaagatgtctagctgcagctatgcacacggaagaacttgcgtagactttcacaatcttcagctcctcagacaacctggattttcctatggatttcgaaaatcaatagctatagtatttaaaaattgaactaaaaactagaaacggaaaaacttctcacccgctaactactcatctcttaacaatgaatcctctaattcctgtttggcacaattccagctccagctccacctccatcctctactagaaaaaaaacacttttaccgacgttaggtatttattttcgcaggcggacatgaccctcggagccaaatagccgcctacagaaatacaaaccggggtgaagctcgttgtccgcctgcgaaaatagacttggaatataaatagagccaacctatagggcctattttttttcaaagtcctcattctccctcattcctctcccgcgtattaatatcccggcctagggcttaatagaattaatagaatattcatatcaacaagttacaacttcttttccggaagcc

SEQ ID NO: 38654 - DNA, 3190 bp, Oryza sativa
tttcaggatgggtgaccgatcgggaaattcttcctgagagtgcgcagaaaagacttgtgttggtttgtgagggtagtctatgacctatgaaggctgccagatgtaagcggccccagcctgggagaggcgggacattacacgcaccctccccttccccctcccctccacgacgttgggcggcggcggcgcggctcccctcccctcccggatccggccaggggagggcggcggtggcggcattgtttgtccagaggattttcgcaggcgggtgactaggccacctgcgaaaatttatatatgggtgacgggagcctgcgaaaatgatttttggttgcctgaaaaaaatgatttttctagtagtgatctctcctgaagctggagttcaatcaaacagttttagctccacctaaaatgggagcggaactgggtggagttctctcacaaaatgaactagagaggtggagctaggtttagacagctcaacaacttcactcgagacccaactcctgtagttatttagaagttggagctctacaaggccctagggtatgtttggcacggctccaactcgagttttagagctcagccaaacagttctagctccacctaaaataggagtgaagctgggtgaagcgttctcacaaaataaagtagaaatgtggagttgtgtttagggtgttctccaactccactccaaatccaatttctgagctaaatttaggagttggagctgtaccaagggcatgtttgatacagctccaactactaaatataactccaggagttgagtctggaatggagttatggagctgcataaacccagctccacaactccagtatattttgtgagagctccacccaattccactcctagttttggtgaagctgaaactgtttagctgagctccagctccggaaggggtggagctggagctagagctatgccaaacagaccccaaatactactactagctgcttttaaaaatctcaaaactcttcaaacagcgccgttgcggcatttgccagaggacttcatgaagcacacgatcgaacgagcgacaaattaaacaagggatacggaggaagaggtcgatccgccgatgccgttgcattggttggtgagcagcatcatgcgcgcgcccacgcccgcacgcgcacgagccccgcgtgagcgacgcagcgacggcgcgtggccgggctagctgtgggcgagcgcgcgccgagccgaccagccgcgccccgcggcgcgagcaccatgctccgcgcctacctagtattccgatcgtagacaattacacaggccgacgcgacgctagcctctgcacctgcatgggcgcgcacgcctcgctgccaaccggcgcatccgtgcatggtaatcacgtgcaccccacgccgcctcgcccccctgccccttctcccgcacccctaccaccaccgttcgtgtacgtgtcaccgccgcttccctctctcccccgtccttacgcgtgcccccccactctcgcgcgcgccgtttcaccccctcaaaactttcaccagcttgtgccatgcatctcgccaattcgtccggttgagaatcctctacgtgaattctactcttctactgctttacgtgtcactgcctataatagtactactattatgcccagttcgccacccaaaatatctcgtcttttcatctgccgaatcgccgttgaaatgaaaacagctagtattactactactcgtagaagtgcgttaaactgtataccgtcgctcgcgtcgcgcgccgttgacgactttcccgcgcctataaaagccggcgcctcgtccgtcattccgcctgtgtcaagccgaagcgttgagctaacgaacgagagtcgtacgtctctagacagtcgagtcaacaatagtcatggcgactccggaggacactggcagctggctgctctacctctccttggcggctaaatgctccggcgatggcgacggccagcctcaccggcttcttgggttcgtcgtggtttgcgccgtcgctggtctggttacatgtctgctgcactggtccttccccggagggccggcgtgggggaggtggtggtggacgcggcggcggcgtcgggggtcgccgtgcggtgtggcggctgttcctgggctgagggggctgccggtgatcggcagcatgtggctcatgaccgggctggcgcaccggaagctcgccgcggcggcggaggcggcgggggcggggcggctgatggcgctgtcgctcggggagacgcgggtggtcgtggcggcgcacccggacgtggcgagggagatcctgcacggcgcggcgttcgccgaccgccccgtgaaggagtccgcgtacgggctgctgttccaccgcgccatcgggttcgcgccccacggcgcgtactggcgcgcgctgcggcgggtggcgtccacgcacctcttctccccgtggcaggtcgcggcgtccgcgccccagcgcgcggtcatcgcgcgccagatggtccgcgccatcaagctgcagcagcggagccggagcggcgattccgccgccggcgccgccgtcgaggtccgccgcgtcctgcgccgcgcgtcgctccacaacgtgatgtggtcggtgttcggccggcggtacgagctgcagctggaccccggcaaggagagcgacgaggtccgggagctgagggccctcgtcgacgaaggctacgacctgctcggccagctcaactggtccgaccacctcccatggctcgcccgcttcgacctgcagagcacccgcgcccgctgctcccgcctcgtcccccgcgtcaaccgcttcgtcacccgcatcatcgacgagcatcgctcatctgctcccgtcgcagccgccatcgacttcaccgacgtcttgctctccctgcagggcagcgacaagctcgccgactccgacatggtcgccgttctctgggtgcgtcacgtcaccgaagaacccaacctttctcgccggcgactacctctgcatgttttctcatcggttttctgatacgtgtgcaggagatggtgtttcgcgggacggacacggtggccgtgctgatcgagtgggtcttagcccggctcgtgctgcagcaggacgtgcaggctcgggtgcacgacgagctgggccgggtggttgggctggaccgggacgtgaccgagtccgacacggcctcactcgtctacctccacg

SEQ ID NO: 38655 - DNA, 3153 bp, Oryza sativa
ctgactaacgacgcttagtccagattcgttatgttaggaggggtcatattcccttctaggctgagttttttttggacggagggagtagttgtagcatatgctttagatgctcctgccactacatatataggatgtgaagtgctgatgctttttggacgcctggtcagcctgcaccggcacaaaggccacaagggtgtgtatgctggcgaaatgaggtgactgagtgtgatatttttgttttgtactgttctcttgctaaatattaccctcggcttgctctgtaaattagtctcaatggtatggaattgtacatctattttactgccaagactcgaaatctccatttccttgcaatgctaagctgaactgtaactgatttggctcacaaaggaaggaccaagaacaatccctgacaaaacatctcaaccataaaattcaggagttaacaaaagcatccgacaatctgaagcatgactagatccaagcatatcctgaagacctgaacactagattttattccttcagagttcagactgtaaactagctaaccagccacttattacaactggtctgaactctgaattattcccagcttctttctctgaagatggcaaccgtttggggctcttggcagatagcttcttgtaaccgcgctacctgccatgaaatctgaggacaacaacttggcatccattcctacccaagcgcgtgcctctcttatctcccaatttcactgccgaaagttgccaagttcactagcgggtcgcttttctctcgaggcacaagttgaggcgctaagctacaaaactgaaactggcatcttgggtagaaaccgatctgtgaatccgacgcatgatgttttctagtaggaggttcagtttaagtcgatcggcagaatgtatcactgtctttgcttcatttttggtttctttcatgataaaatccagccgatcgaattgccgcgcaatcgcagtctatccataatccttaatatagcagtcagtgtttatttgtcactgaaatgtggggttgaaatggccaaatgttacacaggaacagataaggatcatgtcaagcatatgatatgtagtttttgctatgcagcagtagttaaaattgttgcaaccaattactcaagtcagtttacttttcactcatgcatcatgcatgctactacatcaccaagacaggaagcactattaattggtaggaaaatcacatgataagtacagcatattattgatgagagagcacctagtgcatgctcaggattctttaacaactctgattagaagggttttaggctttcagcaagtgtataatgtatacgcagaggttctgatcgactgagtcacagacccataaatccataattaattctggaaagggattgctcaagcttttagaacagagattaaactcaccaaatcaatcatagtgcagcaattttgctgttgtcagacgatctgtgtccacttgctgtatctcagtccaagtttgtggtcagattagacagttaagcagccggactgattgattgtgtagcttagaacgactcagattgatttatgcaggcccccagctaagctacacaatttacatatatatcatcattagtatgcagctgtttcgattttgcccaaaagatgcatcatgatcacgcaggaacaacatggcttcacaacaaaggatagagcaccttacgatggtctgtactcctccctccgtcccataatataaggattttgaatttttacttgcactgtttgaccactcatcttattcaaaaaatttatgcaaatataaaaaataaaaagttgtgcttaaagtactttggataataaagtaagtcaaaaaaaataattctaaaattttttgaataaaataagtggtcaaacggtgtaagcaaaaactcaaaatcacttatattatgggacagagggagtattatttcactgcagtattatcaccagcagaagtgatctcaatcattcaattgtgagttttattactagtaaagaaacatatattttattataagtagttgagatggtagtacagatagaaataaatacgatatatggattaggaaagatgaagtcgaaattaattctaatactactataaaccatctccaaagggttattattatctttagaccttttatgaataagaaaatctacaggacggtgtttgtgcaagataaattaatgagatacttatcctttcctcttccctcgctccatcctcctccgccccctcctgtattttcccctcctcctcctatgctcctccttctagccgtagacaactacttcgtagaaatgcttagcgatggtggagcaggccaatgaagccagattataggctagacccttcccacctactggatccggccgagtgcacgtcaataacaagggcggttgccagcatcattctcgtggcctcctccagttcatactttgaggcataacggcatccatctaatctggcttccatggcgaaagggggcgaccaggaagaaggaatgacatcgagaaagatgccaatcagcgcattgtcgatggtgatgcaagggagaggccaataaagttgttggacttggagtttcgattcacaacaacatggtggtgagcccatcgtgctccttgccggtattttgtgcagttgcggtgcattatccttatctggtacctatggtatcacagctgatacctacggggtatcaagtctatcagactgtcactagcacctcctctcctcttctcccttccccttggctcaacccttgctccctgttattgttgtcgtgacgagcgtcattgccaatagggatgcaagtgggtagttccgctacccgcataaaaacccgcttgctagtttatttctcacacgatattacaaaatttagaagaaaaaatgaactaaaagtaagataagcgggctaaaaaacccacttgcccgccccacttgcatccctaattgccaacgtagccgctgttggctcaaggtgcggggcgtgagtgcgtggagtgagggtaggattatgctagactacgagtaggagcggatacatggaactacgtcaaccttcataaagtatcctgttcggacgatatcccatgctctagcagctctctttatgaacagaac

SEQ ID NO: 38656 - DNA, 975 bp, Oryza sativa
tacatgtgtagatctaatgatgcgttcatgctagttttcatctgtaatgtcatgatttatttatggaatagattaaatcattatatgtctataatctcaacaatccaaaaaccttattataggcactgtgattttactatggctggttttgccgatgcactgagaccggataaattcaccggtgtgcattttaagagatggcagatcagggtcactctgtggttgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttgtaagtctgttacagtgaccattgggggggca

SEQ ID NO: 38657 - DNA, 8365 bp, Oryza sativa
tgcccctgaaatccactgcactgcccataaaccgctctggtctaaactcatccggtgtgtcccacgccgcagggtccctcccgatcgcccacacgttgatgaaggcgatggtcttggccggaatgtggtagccttggatggtggtcggcatcgttgagtggtgtgggatgagaagcggcgctggtgggtgtagccggagtacctccttgatgactgcttttaggtagtccaatttggttaggtcctcttctgtgacggttggtttggagccagtgacttgtatgatctcgttttgtagcttggacatcacctgcgtgtttcgaatcagctccgtcatgatccattctagggtcacgaacgaggtatcggtagctgcacccataatgtcctgcaaaaagattaaaaagaattttgtattcagtttgaatttagaaaaaaaagacccttttttacctataaggtatcagaagtagattctctcacgttactattcactgtgactaccacatgttagccaccaaatcagtgggaagttacgtcaaaggatctcaatcctaaggtatcaacagctgcaccaaaacgtcggttcccaaacatttgttttccttaccaatcggggaaaaatatgacttttttattgtgcccgtaagtatcaacatctacaccaaaaatttgtaaactaaatgaaagtctaagatttgccatgttattatgataaagttcttactcctagtaataaagaatttactcacggttaaatttgaaaataaaatttttacttacagttttattactcgtgctgacgtagataatcttatgctttcaaattttacgatagttttcagttttgcactgtatatttcccccataatcctttacctgccacgtgggtttatcgccagtagcggaaagaaacaactcactatattgacttttaaaaattttaaattttagtaaaatttgttcggtctttctctcatccctacatatggcattcaaaaccctgggtttttgtaaaacaaaactcggacattcgatgctggacaatggatatatcttcaaaaaatggtggatttttttcgttaccttgataatagccttgacgttatcctccgcgagctcgaggccgccggcggcggcggcgccttgtctcctcagtcgcaggagcacgtcgacgaagtcctcctcctcgccctccgccttctcgtcgtcgtgcgccgccaggatctcgcccaggaacctgtccgactcgtcggccatgtcgtctagcttcttgttcaggcccgtcagcttcctcgccgcccaccccgccgcctccggcagccggtccacccactggaacccggcgagcagctccgacgtgtccgccatcatcttcctgaacctctccgccgtcgcgccgctgccgccggccgccacgcgggtgatgaccccgttcgtgtaggcgtacaggagctccctgagctggacggcccgcgccgcctccgcggcgcggcgagcgcgggcgacgagcgcggcggcctcggcggcgcgggcgggcgcggcgaggggagaggaggtgcgccacggccagcttcttggtgcggcgccacgcgtcgccgagcggcgcgaaggacatgttgcgcccgccgtagaagagcctctcggcgctgtgcgacggcggccgggaggcgaaggcgaggtcgtggcccctgtacaggtcggcggcggcggccgccgtggacacgaccagcgcccccgcacggcccaggcggaggaacatgaggcccccgtcgctgccgtagcggcggtgcagggcgtccaacgagcggtgcgggagctccccgacgaggtggaggtggccgacgaacggaagcgacggcggcgacggcggaagcttcccctttccaagattcttgatcgcggcgacgacgacgacgacgaacacgagcaacgctgcggcgacgacgacgtacgatgacatcttggtggattttgccacaaaggtttggatttttactctgaatagcttggtgcttataaatcaatcagagcacaatgcattccatgtccttgtaaccaatcaacacggtggctggtggtggctatcagatcgattgcgagtctggaatattctatgatagatgttttttttttctccaaattggatttttatagaaccacatgtttgatgaactcttttgccatgtagttggggatattttctgaagatcatcataaatcatctccagttggatggctgctttctggctatagtgcacgtatgtttgtgagttgtgtcaggttgatctagaattacattcagaaatacatgtcaaatatttgcgttatcaagcaccagcattttgtgctgtgaagttccaaaatactctgtactgtttacagtcaaacacctttcttataatttttcaggtaagagaacctttcatataaaacacaaagtacaggtttcttcaataccacctgtattagtgcagtaaaattgcactttgacacatccacacaaaattcagtgcaaacccaaaaacagaagagaaaagaagagaacatgggaagaagctctcattattgtatagacccccatgcttttcaatccaatcctatgaataggcagtgccatcttaacacaaacctacttcttacattttcccctatttataacttctgtccctcatctatatctagatgccaaattattcaatctcaatgcctgacatggccttggcctggatcaggattgccaacaaggtaagcaagaactcctaccaatggagcattgatgtaggtagttggttcagatttcctgaaatcggcacggtcatcctcataaacatcatcctccccaggccccccaacaactgcgccaattaacgggtttgggttcgggctagatgaattgtagtaaggcgtgccgtcgttgcacgcaatgcgctggggatggctcttgatcgaaggcaacgatgatcctcgatggtgtatccgttgaggataccgatcgccgtacccgaccatgtatgacattttcatcgggttatctcctaatatataatcagcctgcaaataagtaaataagtacaatataatgttcagagtttagttagtcaatgttcctgcatttcatatttggatgttatgtaggacaattcagtagtcgctccctccaatataattacttttggatcttgacataatctttgtgatgctactttgacaaaaagttattttaaataaaaagagttgcatattatgacagtttgtttaatgataagtctagtaacatcattcttacataatcagtttataatcttttttattaataattaaagtttaacatgcttgacttagcattatttcaaaagttagttatattttgggatggaggtactacctgctttctggctagctgctgaagagtggcaggaccaaccgaaacatttccacagttgacagtgcgcgaggaattggagaggtacttggcataagtcaggagcaggaacgaaatggatgtaacatgctgcatgttgctgcctccaggcttgtagatcatgcccccgggcgtgtacgtgatgtgcggagacgacgactccggaatcagtgtgcagatgaatccatctgcaaactccttgtaggattgcagagatagcacctcgccatctatgaactcctgtaaccaaatttggaacccattttctctttgtgtcagctactgatgtttctctgaatttgttgcagctgcagaaggtgtgttcagaaactggaggagattgatggaggcaaaccttggagacaaggacattgatgccggcatgcttgttgtcccagccgaattcgttggtgctatcctctgctccaagggtcttgccgttgttctgaatgtagtcgaggtaggtgccttccttggaggctctccgtagccatgctgctccccacagcagctcatcctgccaagaattttcagtcgtgtgaactttgagatttttattcacccccccccccccaaaacaaaaaaaaaaaaaactatgtgatcaattatgagcttctgatggttgtgaagttctaattctggagttcgtaacaacagcatttgacgggttcagttttttttttccagaaatactagaaaacgctattaccgttgtaacggtttagtttatgtttgatggataaggtatcaggtttgatacctctgtgtatcatgtatttgtgtaccagatatggaacgtaatagattatgatgacatcagcattgtaactatatactagaactcgagtatcattttttttagagaagggtttttacccggcctttacatccaatcggatatatgcaaccgattatgatgacatcagcattgtaactatttactagaactcgagtatcatttttttagagaagggtttttactcggcctctacatccaatcggatatatgcactcattttatattaggaacttagcctatcaaataagaaacttagcccttaaataactcaatctgaaattcgttcatatggagatttgaactcaagaccttggggtgctactcagatcaatacaaccactaggctacatgccctttcgcaactcgagcatcatgtcacactgttctccggccaacttgtttttcaggtgaaatgacggcttcagtttcacatatgcctattccatgaaaccatgtcgcaacagttgcttttgccccaaagctcataaatagattagccctgtgaacaacctgaatttgtggagtttcagaaatagaaactttaatgttcccggactagataattgtttaccccttcattttggaaagaaattatcgtgtattcctagtttaatatccctgtaaaatagcatttacatgtacaatggttatcaatagtggtctcttagcgttgctaattaggaatacttgttgacgtggaagaaagaggagagacaaaacattgttgtcatgcataacaacggcttaacaacgactcttaatcactacaatatggaaatatggttgcatgagggtaaaaaaatagaaagaatattaataaaataaatattttttgagttaatgattagagtttttatcgtttcaactgttgtaaagatacggtctctaaataatcttatattgtttaagaaactatactcgtctctaccattgaatatgcccttctttcttttttttttccttgaccttacctactggaattctcatgctaaacttataaagacgtgcaatgtcagctggtactccatgaagcaaggcaccaaagctgctttgtttcttctgaacagtttatttatcgtttatttttatatgcgagagatatctaagcagcgtttcagttttgatgccaactactgaattgccagagcagcagctagcattgcagcaacagcatgcaaagctttttgtttctagtgacaaattaaagcagcaaaacacaaaaaaactgaagaaatttaagaacaagacaagaattaccctgacctgatatccatcgaagtcgcagtagaacgggcagccgccggccctgagctccgggtcgtcgctgtacgcgcccttgtgttcgtccgcgaactcgaacgcgctcctggcgccggcgagcagccgcgcggcgtacgccgggtcgtcgtcgcggaacaccatcgacgccgcggccagcgccgccgccgtctccccggccacgtccgaccccggcctcgccgcgctgatgttgtacaccgtcctcgctgtgtccatgtcctccggccgctcccagcacccgtggtccttcgttgggtcgcccacctgcattgccatcgacgccgcgctcacatggtcgtcgccgtcgacgaggaagacgacggtgcgcagtgcaatgtgtttgtgtgtgtgcttgcctgaatgaagatgacgccggggtgggagatggtcttgaggaggtagtcggtggcccagcggacggcgtcggcggcgtgggcgcgctccgcgggcggcatggcgtcgccgaactcgacgacgccccacgccagcatcgtggcggtgaacgccatcgggaagccgaacttgacgttgtcgccggcgtcgtagtacccgccctccaggtcgacgcccgccgcgccgccgtccgacaccgccgagtcccctcgccacgccgcgcgctgccccgccgccggcagccgccccgaccgctgcccctcgaagaacaggatcgacttggccagcgcgtcgccgtagtcatgccccgccgccgccgccgccgccgacggcgccgcgagcgccagtagcaagcagcagcacactagcaggacacgcacgcgcgagcggcggcggcgcacgggagccgagaggagcgccatgtcgtcgaacactcgccgcctcactagagcatgcacgtgacgtgagcacactgagatagctatagctctcgtggggcttcgtatttatagcacgcattcttcactagccagcaaacggcaagcttagctcacggctggattatggctccagatatatacgtaattaacacagatactatattctgatatgcaattatgtacgggatttttatatagagaaataataaatgctttactaaattcgtctcaaaatataaattggaaatatatgtatatgtctagatatatatatgactaaaagttagaaatatatatgtctaaatacatagtaagaaattattacatttccaaatatatgtgtccagatacagaatgagaggcaaagtgagtgtaactcaactgactatgtttctagaggtggaaactgtctatccaactgttcaaattttatatctgacataggtgctcgcatttacagctattttttaaagaaaaatggtaactgacgtttctattgacaacaaatcgtctgtagtgagtagtgacttcatgaatcttaaaatttatcggaccaatatttgaaagcgctcacagggatagggcgtacgtgttgtgtgctcatatgagtggtgagcgtgcacatgcttatataagtgtatgcgttttgtactttgtttttttttaaaaatggaacaagaagtagttgtatcttcggatgggggtacaagttatgctgatatgtcctaattattactcccttcgtattataatgtatgacaccattgacttttcgaacaacgtttgaccattcgtcttatttaaattttttgtgcaaatataaaatatttatgtcatgcttaaagaataaatatgataaatcaagtcacgataaaataaatgataattacataaattttttaataaggtgaatgtttaagcattaataaaaagttaacggtttcatacattaggaggaagtagtacaattttggagggtaattagagagaggttatggtgggacaaaatgtaggggtcacgggagcggtggtaagacagaggtgaggccaaaggtatgttttgatgggttacacgggcaggcagacattcagaaacaccttctgtgctcggtgtggtgtggtcacatgcagcggttacccaagagcatgagagaaacaacaaggccactagaatgatacgtagcactaggacccaagatgtaagatccacgagtaggctgtgttctaaagttctcatggatgactgagtttatcgcaattatttgagggcagagatgcaaaagaattaaatattagaaagttaaacaatcaattttataaagttatctaagaaatactctctccgtactcataaaggaagtcgtttaggacaatgtttaagtcaaacattggaaatataaatcatgaataactcttaaggtgttgagtttaaaaatgtaaaaattatatgaatagatttgtcttgaaaaatactttcataaaagtatacatatatcatttttcaataaatatttttatagaaataaggagttaaagttgtgtttagagaccgtatcgctgtctaaaacaacttcctttactagtatgaagggagtactggtttaggagtttcagtaaatgtgcccgtgatgatttataatatgtaaaaaaaaaaaggaatgtgtcctgaattcccagttattgatagggattatgatttttctactagtaagagaaactgaaccggttgatcccggttactaattatctcgtcggttgatgaaagctgagcagaaaaaggaaagcattgatagtatttattccgaaatggtaaccagatagtgctctttttttggggaaaccagataatgctcttaacgctgatacttgctggttggatatccctttttgacagattttaatactccgtccatttcaaaataagacacaatcaccttacaaaggctaaagacaatctccctagtttagatcaccctaataaatattttctctgttttaggttatgagact

SEQ ID NO: 38658 - DNA, 22613 bp, Oryza sativa
agtactgaactgaccgtcgcactgtgcatggaaattgtattgacccattttgtattggcccgattttgatgttagagtattaaattttgggggttttgatggtttcaccattccggcagatgatgtcaatgagggtcggagttttaatctccgaaccccttgggccttggctaatgtctgctgcatgtccgtttgttcctacctttggggtcatgcaggtttcccgttcaattctcaattaagacactctgaagtgaagtgcttgtatgagacgatcatgccaaaatcttcaccttgattcttttgatgcatccaaaagaataactaatttgaggtgaaatcctcctcctggaatggcttaaatttacagcaccgaaacccatcttgttcaaaacattattctccgaatccccttgatcagtattatttgggatgaaattctaatcttcgaccaccctttgctgctgctgtatcatcgtcatgccagcagcagaatccggttgtctgtcatggctagcagctgtagatcagtaggcagtagatgataccagcagcaatctttggaagagttaacaggattaaaatcagaagaaattgttcgaccagtaaatcaaagtcagtaacgaggaggagtttgcgaaggagacgagcctgtacgaaccctctttgcaggaagagggaatatgctctgaatcatctcctgctaaacttcatggacaaactattttgtttcagcaatcgccttctccatcagagaagaaaaatgaataattacgcgtgcatgggatgggtgatcgatcgattgatacgtccagcagattgaatgttcagtaattttcgttcgtgtaatgtttttgtttcaacaaatcgattacacaatcatcgcagcttgcgctcttgtcgattttttttatattttttgtgagaagggtatttttgcccagcctctatatccaatcggatatatacaacctttttaaattaagaacttatcctatcgaacatgaaacttagctctcaaataatccaatctgaaattcgctcttataaagatttgaactcagaaccttggggtgctactgagatcaactttcactcttgtcgattataaagaaggattaggcatgtaaaacattgtaaattttggccttttaaacgggaggaagcagagagcgctcgaggacaattcgcgcctgcaacctgcgcatctttccccgcctccgctcgtactcacaaaccctggctaccactgcagtcatcgctagcacgagcaggcccccaaccaccgcgttcttgccgtcgccgtggtggtgttcgccggcggagaggatgccagccacgcccaggcacaggagcagcgcgcccacgacgacgtcgaacgccgcgaacgccatggcacccttggaccaggcgaaccccgagctcgggcgggacgtcgtcccggcggcggcgatgtccgccgcgatcttgtcgccgccgcgctcgtccagctgccccgacgccaccagcctccgccgccactccggcggcatcgccccggccgcgaacgccgcctcgatctcgtcgtcctcgaagatgttgctgctgctcatgacgatgacgatggtgagagatgctgctgctaaggtttggttgcgatacctccgccgcgaccgggttggaatatatgataactccgtgctgccagatcgaactcgggctcggactcgttacaactcagaaaggaaatgagatacttctactccggcaaggctagtaggctacagagattaatgggcaaaataagggcatgttcagattgtagccaaaataaattttatcaagttttaacaatatcaaaattttgataagatggcaatattgcctaaattttggcagaatttcttatatattaatcaaatttggcaacaaactaaatgtagagcatgttcactttgatgttattttcaaccttaccagctaaaattttggcaagaaactaaatatagccacttttttagcaactttaccaaaatttggtaagtttgaaaatgacatcaaagtgaacaggcttgtaaacattttttttgccaactttaccaaaaaaaaaatggtatagtagaaaatggcatcaaagtaaacatgccctaaacctaaccaaattttggctatgtcaaaattttgataagatggcaatattaccaaaaatttagcatgatttcttatgtaattatcaaatttggcaataaactaaacttagacattttttttagcaaatttgctaaaaaaatggtatggtttaaaatggtatcaaagtgaacaggccctaaatgccacgagaaatcttgcacatcttcgtatagaatttcagtctttcgcagtgaatgatccctgacgatgtcatttccatttcgaagatgtcgaaatgtcgatcaataggatttaggctctatttgattcagcttagaattattgtaatctgaattattaggagtaagctgaaacaaatagatagcttattatgatagattattacaatctataagccaaattactataatctggtaagccactataaaggtgctttttctagattattggatggctaacaactaacaaacagctaataatccagataaacaaacagctaacagcttattctatgtcgacttattataattcagcttatagtaatctaattctataatttagattataataatattaagctgaaacaaacagggccttaaatgccaaactcccttcgtttgtttgtgttcgtccagtgatcgcgggtgtaatccggagtctgacactgatacagcgtcatggccgtcagagctcgacgaggatggcaatggcggaggcagcggcagagctgacgaacgctttggaatatggaggggtggtgccgtggtaggtttctccgacgagcaccgcaccgagcacgtcgtgtcgtgggtgaccgatcgagacggagaaactccaatcgaggagcatatgtgccctctttgcacgaagaggggaatatactctgaatcatcttgctaattttcatcgccaaactgttctgtttgagcaatggcttctccattgtcaagatcaaagtcgaaattaaagaggttatacgttgttcagatatcttcagaggagcaaaaagaattgtgcgtgcatgggaagggtgattcacccttgcaaatttactcagggcgatcgattagcagaataagtttttagtaattttacattgttcacagatcagacaggagatcagatcacaagttgccgcttctagccttctacaccactgttttgttttgtttcagcaaggccgatttcagagttcagaagaggtgcagtgtgaaggaggtttcagaaattcagagttaagcctgatatagcatttgcactttgctgttctactcctattttgctatcggtggatttctgtagtcgctcgctgttctgctgttatctgtatcggatatttagatgacgagctagcactgtgcactcggcaaatgggacaaagctgtccttggattgatttttcctttttaagcagcaggtctctgccatgtccaacttcggcagaattggaaatgcaaactgctaccttctgaagaaaagagaagtatttctttggaagagtttacagtattaaattcagacaaagtattcgttcatcaacgaagaggaatttacaaggagatagccctgcgctctttgcaggaacgaagagggggataatctgaactgtcctgctaattttcatcgctaaattgtttcgtttcgtttcgtttcaacgacggcttattcatatgaagagaggtgcaatgcaacgtgggggaggtttcagagttaaagagtgatatactgcttggtaagagacaaagaccgagattggttccaacaaataagtatctggcattgactaagttttactgcttgacatcactgatggctggatcacaacatcatgttgtaaagttcatagtgcattccaagtccaagatccgagagaattgatgcttgttctaacatacttatctattttgtcaaatgggcatgctcaagtatcatacaccgacaagtcgacagcagcaggtcatgagaaatctaacacatcttcatataggcaggaggtccaaggaggcatatccttttgggaaaggaagaagaaaggatcaaactagtgcactatttatccgagaagatgcctcgttacaactcatcacacctccatgttcatgaatactgatgcactaattacaagtaatatgtcctaattgcttattcttctccttcaacagccggtaggccttccttgaaccatgtgtagagtcctccatccagatggaacacattcttgtaaccattcaggaccaacaagtaagctgctatcagggacctgccaaaatgaaacagatgagatgagttagctatgttccagaggcacaaacatagtcacctttgtaaaacaacataaaattcagagctaaggtgaagaaaggagtgtgggcagacaacaagtttatagttttacatgaaatgaaacaatacagatgttgggcaaacggggtaaattggaactcagatgaacgaatagtataatccccttctagtttgcatatggcactcggatgaactaccgctcagcaacatggtagaaatttcaagctggtaatatcattcaactgggaaacattgttgacaaaagaaatgtgaaacaaaaccaccagtagaaagaaacgaaagatatccatactacaaaataaaattccaccaattaagagatgatcatgacactacagaaataccttatgcaaatattaggaagaatatcaatgccacaatatgatagacccatttctgatttcaaggaatacagaaaagaaaaaaaacctcatttgcgacagtggtattaagagactgtatcagcgctttcgtgtcagttagaacatgaatgttaattggtaaaaattgaatcaagtttactgataaagaatactaaggtaacatggcatacctcgattgcttcccatcaggaaagttctgtgttggtttcaatgttcctcctgtcgaacatgccacaataatctttgcatctttaccaagtttctcatcaacaccttcgtaaagataatatatgtcactgattgtaaactcatactccctccgttttttaatagatgacgccgttgactttttctcacatgtttgaccattcgtcttattcaaaaattttatgcaaatatataagatataaatcacacttaaagtactatgaatgataaaacaactcataacaaaataaattataattacataaattttttgaataagacgaatggtcaaacatgtgagaaaaagtcaacggcgtcatctattaaaaaacggaggtagtatatgagtaaccatgaagcagaaaacagaataaactaccatactttgtatgaactcaggattctcttctgttccagaaaatatgccaaagaatgcaaatgctgcccgtcttgcaatatcccatgctgtccattcctttatcaatctatatatttgcacattaacggcaccaggtggatgagcctgcataagaatgaacccatatgatggcatttgcaacaaaatctaatgaatctaagtatcaaacaccacatagtatgacagcaacaaagtttgagatacacttgcacatcattggaaataattttgttaacaaaattatatccatttttcaccgactgcagacctttttttctcttccaaacaaaattactcctatttctcagacactctaaaattgcgtaaagtcagaacctttggttcaatatacgatatttctaagggaataaatgccacaaaagattataattacatattaatgtaaagcgtaacctcaagttattgtgttaaacctaagagctgcattatggtgcaaaaaccgaagataagtggagaacaattacaacattacctctttaaagtccgctactggcctgacatcaagaattgcaaaattgttttccttctgaagacgcagtgcttccttcacatcaacactacggacctgcaaaaccaaacaacagaaggaattctaatgtaaatggaagccgcttagcagagaaggctccccacgggtaattaacatatgaaatcaacaaacccagggaaaacaagtccataattccaaaacagagcaatatgacatggaatctatggcttatctactcatatatgtgcaatacacactctctgaagaactaaaaccaggtattcagtaagatacttcatatatggagttgataacaaaatagctaacatttggaaatggcaggaaattaggaattacccgcttttctactagcacttgcctcttgatcttccattcttcttcagctgtatataaaaataaaaaaaaatacagcaaattaatatcatgcccagagaattactagctgctccaaaccaagaaaatggagagcgtattcgcagtacctggtgactttgcaggctttgtggcagtacaggttatctgcagcgagcgcacagctcgtgtccggcagagttttgcagcctctataggacgccaggagtagccagatgtgaagtctgagcaggaggatatccttgatgagcaaggaaggttgctgttcactacagagctagctgcaagcattgtggtcatgagaaaaaaggagcagaaagaactatggaggactctgagagaattagaagaggggtttgcctctaacacctaaggatggatcctgtaactgagaagatttttttttctggatggggaaacgtccaaagaactcaatggttttggatgggaggtgccagcatatctgaactggtggtggaggttgagctagtgttgtgatagacaatctggattctgaacttgtagcttagcctgaccccacaacaccaacaatctagacaggaacacttaagagctgcactttttttccatgacataatttatgatgcttgactaaaagtaaatatactaggatgtgcaaataaagaaaaatagaggatactacagcgacataatttatgtaaaatccaaccttttctgaatgatataaaaatctggcttttattggtactcagaagttaccacctacaaatgggaatcctaagatgcccaaacatgatgttctcaaaatcgacctgacaactaaacaagagtacaccagaggcccctggaaaatggaaccacttagacctctcaatctgaattcagaagacaaacaaaagacaccatcaccacagttccttgatcatcttcagctcaactctgctcagtgctcactcactccagtacccgtcgtcttccttgtccttcttttcatcgtcctcctcgccttcctcctcgccgatttccatcactgcctccttgaaccgcttgacatcctccaacgccgccttccggaacatcccaatgtccactgcaccagacaccatgtggtaacccctcagcttgagctgctctgccgggtcgttcggcatggcgaatccgcctagatatgcgacattgccatctgaagctgtcacattcttcttcctggcatccaacaccttcttctcggcctccctcagcctggctcgcaccttcctgttccctgggtcccacaggtaccccatgctggctgacaagtcgagcggtcccatctggacgacgtcgacgccgtcgacggcggcaatggcgtcgacctccgcaatgccagcggcggtctcgacctggcagatgattagcgtctcgtcctcgcagcgggagaggtaggagtcgtcgaggccgtacgcggaggcgcggacgatggggtgggcggcgccgcgaacgcctcggggcgggtagcggcagtgcgacacggcggcggccgcggcggcgggggactcgacggcggggaccatgaggcccgcggggccgaggtcgagggccttcttggcccagatggggccggcctcggggaggcggatgacggctggggtacgggcggcgtcgagggcgcggaggcaggccagcgcctcgggaacgccgccggggccgtgctccatgtcgacgacgacgtagtcgtagccggcgagggcggcgagctcggcgagcgtgggggagaaggagaggaggaagagcccgtacagggtctccccggcggcgagccgggacttgagggagggtgcggcgtagaggaggtcggaggcggcggcggcggcggagatgggccgctgcccgcgccgccgcggcaaggggagcagggcgggggcgcggcgggaggggagaggcgcggggtctggcttgcgcgcgaggaggaggtgggagagggaggcggtggcggaggcggaggcggaggcggccatggcgcgcgaggcgagccggcgcggcggcggagaggtttggggatctgcggcgagtgagtcccagtcagtgtggggggacagcgtgaggcagtgacgtggcgttgctgcttcacgtgtcgctttgccacgggccttattgggcctcgcccactgacgttggtgggctctggcccgtctactttgtaaggcccaggaattgtatataacttaacttttaaattggaataagttcactttaaatcaccgccgagttcgattttcgttgttgtcctacaaccgtataataccagatataatgagattcaaagaagtatactgtatgtttttggctcacgtggcgagtgggttatgtttttggctgacgtggcgagtgggcctcacgtcaggcctatttattcttcctccaatctcctctctttttccatctcctattctccaaacctcctctctctcatccgttccacatcactgataggggagggcggatgtggccaacggcgggccgccatcgtcctagacaacactatatgcaccgcatcgccgtcattgtcgatgccctctgcatcgccaacctcctcttcactggacttgccctggatgctgccccaacaaccccgattgcacaaccactgggcggcatacgcctagctatagttgaggcaacattagctccatcaattatccccgcggcaaggctcctccggtgagaaggtgtccttctcatcatcgtaccccccaccatgtagaagtcttggtgcatgtcaaactcactaagcttgagcatgtgcttcatgccaaaactatttgctgacatgtcgaggctgttggatccatgctccaccatcgggaagaggttcagtcatcctaggatagggatgaccgctgacgagtgcatcgacgcaacgttccactcccagtggaggaagtcagtgctccgatacaccaaagcagagccagtggcaatgaccttgacatttgttcttcgatccaccccaacaaccccacatggcaccgcgcttggctgaccatcatggagacctcggatgtcattaggcctagggcagtgaccgcacactcaaggccacaaatggcatgggtgtaggtgacgatgaggtcagagaacatagcagtgaagcgcgcgtatgtgtagtcaaccgtcggtggcccaaccagagccatcttagatggtggttgtcaacgtagaagatgacggtggtgcgggtccaagagatgtgtaggagtgcgtggcgacgatggggtcgtcgaaggggaggaggtaccgaagtagtgttccttgcagctgcaagtgcggtgctgccgtcgcctccgtccctcccttagccgatgatgggaaatggaggagagagatgggaaatggggaatataggagatatagagggaggggaggttggaggaagaagacatatgcctgacatatggggcccactcgccgtgtgagccaaaaccggggaaccatactgcttgggaccttgggtacaccagttttgcacatgtcatatctggtattgctgttcaagaaaaaaaaatcgaacttggcgaaagacgagggaccttgaacttattcctttcaaatttcgttgtggatcagaaatttggtgggccttatccggattccagcccagcaaatgatgggccccgcagtggagagaccgtggcccaaacatcatcgcctctcgccgtcgtctcgtctcttcctctgcggctgaactagtcgccgatccagaggccgtcgtccactcgcggtcccaccggccaccgcctccgccgcctctcaccggcgccaccgctgctctgcctccaccgcgttcctcctctccacaagcctcggtcgcccagtacgcatcccatccgtcgccgtcgacctagctgcctggtggaggtggaggcgagggggattgactcggctccggcgctccgattgagcccgcagccgaccgatccggatacgatccgctccgctcctcgccggagcggaggctgtcgcgaacccaggtaacatccccgccctaacctcccacgccgcacgcacgcgaaggccgacggcggcagcgccatcccctgacggccgactgcgcagcggcgctccgccccgcgccccggcctgggcctgcccgccttcggccttccccgactcgcgccgctgctgcgccccgccgtgcagccgttgccttcgcccttcgcgtcggcgctgccgtgtcgtcgctccgtgcagcgccgtcgcgcgcggcgcgcccgctgcccggcatccggccctcccccaagccccagcccccttggactccggtgagcactgcctctcgccctctccggctctccctctacctcagtccctctcccccttctagtagaccacagtattatccccttcaataatcaatttctttgtatgattgtatctgtgattagccaattagggatatagtaatttgtatagattactacaaaattatgtgcaacaatgaacctcaaatgaaatttttgacttgtattgtaatatcctatttatctaagatgttatgttatgtttgaacaatttacattgtcctttaggtaagattcaaacttgtttgttattttctacttgtattgaaccatttagagttatataccgtatcacggtatcgtttataatttatcagatatcttatcgaatcataccgtattgcatttagatttttttttgctaggcctaccccgggttcaaatcctgggtccgccactgttagaacacacgcagagaactctggccacatcgaatcgatcgccgttcacgagatgtgctaattgattccatcggattttttatggaactgcagccaatttagactaggaagcatgaggaggcgaccgggaatcgcgggcttgcagaacgcagcggctactcgtgtatgtggacatcttgcttgaatagcttataatgttttttttttctttttctgtggattctgagatgagtgtgctcttggaaaatttaaggaccaattccggctggttggggaaaatgtggccaaggtcaggaccgatgtcatgaaggagcagcttgcgacgtttcggacacagctcgaagaatttgcacgcaagcataaggtgattcctactcctgtattctagttgagttttacagaaaatattaccgacgctattcgtatgtcacaaattgaattacacatagcatgctttcacaatcttcttaatcttggggatcaggatatatcagtcattcttgcagactgactgaattcttacattttttttcaactgcccagcgcaaatgaaatgaatgttctaacaaacatgaaaacagtgaagttactgctattcacttgattaaagttgtctatcgaactgggaaatagggaacctaagtagcatactagtccatggtcaagtgctcaacatatactaaaactgaggaacggtagttaaagatggaaaatgtaccaaagaaaaggtgttggagttaccaaggtgccaattgatcttgtttcttgtgatagatttcacttgtctcatggcatctagttccaactgggttgacatttgcaatgtaacactgatgttctaggtgatcacaatagagctcaaatggcacagcatattccaactcttaagtaactttgtgtacatggtgtgctagtgcagaatgatatccgtaaaaatccactatttagacaacagttccatgagatgtgtgcaaaagttggagtagacccgctggcttcgaataaaggagcttgggcagagcttctagggattggtgacttctactatgaattgggttggtatacttaatttaagctaccttgtatgttttgatcctggaattttctgttattattggaccatttacgttctgcttggcatctgtgtctattgcaccaggagttcagattgttgacatatgcatagcaaccagagcgaccaacggtggcttgattgacttgctagatctccgtaaactcctctgtcagaagaggaaagctgatcttggatcgttaacatcagatgattgtttgcgtgcgataagtaagctgaaggcaagtattttaaggaattctacagctacatttttttgggaatcctgtaattgcattcatgcaagttttacaagattgcattcgaatctatggccaataaaattttatttgatgtacttggacagatcgttaattcttctggtcctttgcctgtgaactctcaggtccttggtagtggttttgaagtaatttctgttgggaagaaaaagcttgtgcgttctgttcctacagaactgaataaagatcacaatgggatacttgagctagctcaggtttgtaatcagcttttaatagtgtataataccacagtacacttaacaagtatgtggatgctgtcataaccttatcatgcttacactgaacaagtatgtggatggtgtataacctttggttggaagtcataaagccccctatgttccacataaacgcttatttcagtcaacatagagacatagtacaaaactaagttaaaccgaagctttcaagttgctgccttgctcaatctgtcaccttgccacaatataaccgtacctgtccagttataacattatttcacatgcaggctgaaggttttgtcaccgtagagcaagtcgagagaaagttctcgtggtcaactggccgtgccattgacgtccttgaaactttgctcaaggtaaatcctgctcctgcatttccactctttaagcaacctttgtgcttcatttctgtgcccaaagaaaagaaaaccggcttcctttgatgcaagttatgtattggtgaatggtgattagatctctctgttgaatccacgcttaagccattgcaggattaccttctttttgagctatccataatccatatataaataaagtacttttcgtatgtgcatctgtattgacacttttatgaacgtcaaattttttggcatctatatccaactctggtctctattacataaacaggaagggcttgcgatgatcgacgatgggcacagggatggcaagcgcagatactggttcccgtgcgtcactctcagctctgactctactggtgcggatgccaagtcatgacctgtgccgtgcctgttccactccgttgttgtcacctgtatccttttccattggttcatttctgtaggcactgaagcacatatggcatgccatttaccagtacagctctggaagaatcatgagatagcaatacacttttcagggctgggctgccggcaaaatttttacattgtgattcgtgcatcaggattctggatgtatttgtactagtgatctatactatactagctcttctttcacgaaattactcgtaatcgtaaatgttcaatgctatttcctccgttttataatgtaagactttctagcatggcttatatttatgtagatataaatgaatatagacacatatatgtctagattcattaacatctatatgaattatctatattcatttatatctacatgaatataagcaatgctagaaagtcttacattatgaaacggagggagtaacttgctaatgtgagcaagagaaatgctcgcaataaatatgataaaaagagagagatgctaagtaacggtatcttattcggatgaaataataccttaaagatttcgtctctaatacctaatagcggctgataccctatttgaaatagggtatcacacgatacttatgacttatgatatattatttcatggaaaaagtacaccgaaggtcactcaacttgtcatcgggataaaaaacatcctcaaaccacaaaactagatatgtgaggtcccttaactatacaaaaccagtcacaataggtttcttagcggttttgatcctggttttgtcttacgtggctgctgagacagcgtgagccccatatgtcggcctctttctttcccttcttctctcccttcctcttctctctctcttctctggctctgggcaagccggcgccggggcgaggccgcgaggcgggggaggaggtccggcggggcgaggcgggagaggaggtccggcggccggcgacgtggcggcggcggcagcggagacgacgcgggatcaggggagcaaggcggcggcgacgacgacaacgcgggagcaggggagggcatcggcggcggcgagggtgaggagccgcctccgccaccatcagcgacctcaggacggcgctctgttcctccttcactctcgcgctggtttcccttgacttccacctcttcctcaagggcaccaagctcatggccgacgcccgaggtcggaaacctccccgtcggccccggcgagtccatctctttcatccctgtcaactccgctgcatcctccgcttggaagccgacgtcgagctcgagcacgccgaatccatggagaaaacgcaagttttcttggcacgacggcggcggtgaagacgtccacgccaagaagccaacgagcccagcgctgccgccgccgctctcctgccatggatgtgtagttcggggatgtgaatgggaatggattggatcttgggattatggtgtccgccgctgttgccgatcttgatggcgccagggttgagctcaccagtgggaggatggtgaatgcctggatcgagtactcgcccaccttgtcgtcgccgtcgaagccatcgccacgtacgacggcgcctttgccgccgccggaagcgccagtttcatccgccgttccgcctcccgtgagttttaatccaatgcttccctcgcctccgcagctccccggcgtaaccacggcgccgtcgccgccggtgtccacggtttcgatgcctcccaccagctccgccttgctcccctcgccgccgccgacgcccctcacctgctcccgcgtcgtcttcgccgccgccaccgccgccacgtcgccggccgccggacctcctctcccgcctcgccccggtgccggcctgcccagagccagagaagagagagagagagaagaggaagggagagaagaggggaaagaaagaggaggctgacatgtggggcccacgtgggcccacgctgactcagcagccacgtaggacaaaatcaggatgaaaaccgccgagggatctactgtgactggttttgtatgtatagttaagggaactacgtggttttgcagttcgaggatgttttttattccgatgacaagttgagggacctttggtgtactttttccttatttcatccgaacggaatatcgtccttaagcattccaattcggcccacgggcctcaaggcttcaacccatgacaattgacaaccggacaggtgtgggcgttgactagtcttctttagttttccaccggacaggagtaattggcaagaagaaacaaaagggaaaaaaagtggcggaaaattcatttttgggaggggaaatggccaccgcagaggcgaagcgccggcgccaccactcaccgccggcctccatcgccgccggcggcgattcctccacccctacctcggcggcgcccgccgactcgtcgtccccgtcgctggatctcatccccgacatagcccgccgcctgacgtccctggaggatttcttctccctgcgcgcctcctgccgcgcctaccgcgcgctcctcccggcgtcgcgccgcctcctcgcctcgcagtccccgctcctcctcgtctccctctacccctccttcgccgaggcgctcttccacccgcgcctccgccgcctccaccgcttccgcctcccatgggggcaccacctgcccccctcgcgctacaccctcctctacgcccacggcttcctcgtcacctccaccaccgccgccaacaactacccgccaaggctcctcctcctccgcctcttcaccggcgagcagctccgcctccccagggtcttcgcgcccttctcccgcgtcatcctcaccgcggacctcctcgtcgtcatcttcttgcccggccgggccaccgtccagcactgccgccccggggacgcgctctggcgcgttgcctccgcccctgcaccccatgtgttcgacgatttgatctctgtcaatggcaccctctacgcgctggttggcctccgtcttgccacgctccagctgtcggagagttcgctggagctgtcatttctgggaggagagcatgatgacgcgaacaggccggagggggatcggttcatgctcggggagtgtggaggcgaggtgttgctcatcagcgtggagcatgaggagagggttgtgtaccgcgtgttccgttgggcatctgagaaaaggaagtgggagatgatcaccaacttgggcgggcggtcgctgtttcttggcttggatggattcgcagcttgcgttgatcaagatcatccaggggttcgaggggattgcttatatgcagctgggcgacgcttgggtgagtggcatgagtattccttggctgatggaacctgtgatgtctgcaatgctgactatccaggcgcgccacccctgaacaacagttcactgatcagaccatcagtttggatctttcccagcttgtgttgatgcaagcctgagtagggttcatcctagatcaatgttgaagccctattgctcagttgctcacatgagagaaaagaatggtaatgcttgatcactagcttgcttactaggtcatttatgtaaacaatatattcatacggcgatcagtacttgcatcttattcgaccagtcaattgttgttttggttgatatagtgaatacttttccttaggattttgaccacaggagcaaaataattttgttccctaaatgctgacagcattactttatgtgctatgcaacttgttgagatattatgaagcttcttttgcgtttattttcctctgatactgcagtaatagtgagtaaagcacataatacatcaaggaatatgctagtaccataatgttaattggttatatttgactatgtccctgaagttgcatggttgtaacttgtgtagggtaggcagtagcagaattcttaaccctgtttgctttgtgatttatacaatgctgcaaatcctgcggagttgtcacagttagtccagtgatagtgataaacaagaccaggaatgacacacatgtccaatggatgatatcataaattatagctgatcatgtttatgatttgtactcctaaaaatatgacatatgccaggtcttagaaccacttatttatatgattttccactcctataactgtaactttcattcctgaatcctgatagaacctgtggtgtatgacctccaaatggtctacccaatcagtagttggcagcaagcagatgtgaaggggttgggcatgctcttttctggtccatcagtttaggctttatatttaaagtgttcttcagttccgtgtttttggactacccttcagtttattcttttttcgggtctcctgtctctcccttccttgttcttgctgagtgctgacacgagacacaacttggttctcttgcggttgtccgttttgcttggtccgttgttgtttctctgtcttaatacaaagttaagccaggcttttgtgtgcttcctgtgtttcagaactcctcttattatctcaaaaaagaaaaactcttcttattgacttcagagggattggaacaatttcaagtttgaaagcatgattcgctgacatatggacctcaaacttatgtctgtgcaatgttacctggcatctcattttgttagcactcgtaaacatgaagtctggttacctgcaattctgaagaacactgtcttataacctctgacttgtgtgcaggttttcaagtttattttttgacctttggatggtatttgcaatgagattcagtcatatttccttatacatgtttccttattacttgaaagttgaaactaactttgagaatgttcaacccttcaaacacttgctctacctacttggtgtattgatatttgcatgtgttcccaagaatgttcaagtgctgcatcaatttgtgccaggatgccagcttagcgagtgcatatttgcgatctcaagtctgtcgatgacatacgcacattattcattttggatgcctactgaatttgttctgtaatcgcaaatactgtactcaatttcaggttgcatcactggctttcaggtgttctctttcttctgacatgttgctacttgcttgcaaatggatcgctgaataccaaccgtccattctggattctgccacttgcagttcttgctgatagccttgcagttctttctctgtgtagctcttttgttgatgtctgaattctgatgcttcaaaaattcagaaatgcagtaataaacagtagtagtagcactatttatttattgacacctggaagagaggtcctgtgcctctccagtcactgacatgtgggcccactttgcagtcattgaccaccctactgctacggaggtccacaggcggtctattgtggggtccacctgcagtgggtcaaacgggccttcgctaactcctcgccgtcctcttcccatccaaacctccgcagcagagctcgctgccgcggcgaacgcacacaatgcaacacctcgccctcctccgtccgctcatccatccctctccccttccggccgcgagtcccctcgctgcgcgatgccgcggcggccggggccgaggccgaggccgaggcgtccgctggagatgcgcgacggggggaggcgcgggcggcggcgaggttgaggagggggagggggaggggaagcgggaggcggcggcgtggctgagctcggcggtgggggagaaggtggacgagctgctgctgcgcgaggagaaccgcgcgctggtggaaggggtcgaggccgccgagcggcgggtggagcgggcgcgcgccgcgctcgccgacatcgagcgccaggaggccgccgcccgcctcgccagcgaggaggtccgccgcctcgagaggcgccgcgacgaggtatggtgactgctgcccgcgttcaacctgtttgatgctttgcctgctctgcattcgcctcaatcaacgagcagagtgcctgccctagcgagtagtgggtctctcatggcctcatggtggagagcgacgtggcctcacctagctatagtgctgtacagtgtacacacgcgcggtccaatccccaccccgacgcggtgatgcacgcatctggtggcaatagacgtagcatgaaccagcaatatggcaccaccagggtgttgcggtgcaatggcgtgctagtatggttgtggttgtactgtactactgtgtcggtgtggccctagatgttctgtgactgccgcctttgtgtttgagttaatgtggcaccgacgagcttgaggaatgctctttaattagccgaacagtagtacctcaccacgggtgcatgtgatttacgaaatgtaaatatgtaatgcacggaaacagaaaattgcgtattgaagactattgtcagagaatatgaaaaagctccagttattttctcctatctatatactgcctaacctattactccttgagcgttttctacaagcaggcaaaaaatgctatttctgaaagcaaaccctgatatgcattgcaccgccttacattgaaccgacttttccatgccatttcgctggattcgattctttgaaatgccttttggatagaagtgccaagcacaatatccctacagtcgataaattgtagtttatatattcttgctttgtcatggcttgttatgcatatccagttggagatgtactgtagaaatcagctcatttgatctatgctgaacagtttgttagatttagaaaactagatgaatttcccctacaaacgcttagctggatactgaaacaaatacgaaatatccttatgtttgaagctggtcgcgttaatatatcaatctagtacctgaggctgaaaataactgtatttgtacactaatgtagtctgtaaaggtgcaatatctgtccacagttttgctaattctatgccattataatctgaccttagcaaatcatctgtgtagtttccatcattttttctctaggatttttttattttacaaattaacaattgaatatcttgccttcttagcatatcagatgctttgaatccttccaactgtttatattctccatttctgtataggagatggttccatgtcttttgagaaaacataaagtactagtagcatgtgtcagattcatgtggtcccatgacgataaaggcagaatgattattagttgtgatatcaattgtatgacaattcatttctgtaatcatcaaattatctttccttcaatatacatgggaaggacatgaattatttgtagcttggtgtttcctatgtgctatttcctcttaataatgttgtttacaatgctgcattacataaacaagatcacagagtcccaacgtgaattgctacaagcaagagaaatgattgatgaagcacaacgttccttgtcttctagtcttgaggatcaaagctttggagatgtaccaagtggagatattgatgaagatagtgaaagactggaatctgtaaaagctgcagcagtttcctctgtagttggtgttctagctagtttacccatatctttttatgaagcccatgattttccacaattatttgttcagttgtcagttattttcataagttgtgctttgtttggagtaacattccggtatgccattaggagagatctggacaatgtccaactaaaaacaggggctgctgctgcatttgcttttgtaagaggtaaaactcgataatgctatttcataaaacttctcagcacatattcaagcacattgtcattttgtttatttgaactaaattatttgcaggccttgctatggtggaatctgggaggccctttgagctgagcactgatgccttaatatcacttgcccttgatggtgcagttagtgtggttgagaacattttgacatttctacctgctgcaattgcactggactattgttttaagatgagatttttgagtccatttcctacaagaaaacagtagttcctgcaaataatctgtaaggtccataatgccatttgttggtccaatgattgtagtaaatataccatactgcttatgtcttatattcatcatgccaaatactcgtggaatcaaaaaatcatgttgtttatcaaatagttgctttaatgtaacagctggatcttgtcctgtttctcagatattctgagatcgataactcatagctccactatgtgcttgaatagacatccttcttaagtgccctacactttgccaggactgaggcatatggacttatctgtttgtgtttctcctgtactattgatgttcactcccaggaattttttatttccacttgaatcaatgctttgggctatctgtttcatatcagcttttggtgaaatgctgcaatctgcgtaaactgatatgtgcttcatcagtccttgcccttatgcaaagagaattctttactctccatgaccatccattctttctacacaataatctatattctaatgtgcaagcacaagaaacatggtacatatctttcttcggtatgttgtatctgtcatctacattgatttatgcctgctgtaccttgcttgtctattagtgttcttccctttatttcagtattgctgtgaagcaactagctgctgaactgtgctataacctgatacagtattattctggtcattcataatgcgccaaaccggatggaactggatgacatatcattgcatcacaaatatgggtccgctggaaggtcggtactgttgagaggtggatgcagagcatgtatttctgttcttgtgagcctcagctgtcattcttcatccgtcaagccagatggaactggacacagcttgatctgttgaagctttcggtgtcatgaagaagatgaagtgcacaggtcttttttgcatactgaatgatggtggtgggggattgtgcagtgaaagagcttcatgaaccatcatctggacaaggttaccttctcaatagtctatttttattaggttattgagatgattacatgatcagcccagcattattttgctcatccccactggtttgttggtgttggctggtgctttagttctggcacaaacaactgcacgaggtctgtcatagcaacatctttggatacattgtatgtagggagctaatcaaggatgagagaactaatgaaaaccacttctatgtttgcatcctgttattatatctagaacatattttgttccaaagcagtccgctagaattttccaagctatttcagccagctgtctttactgatgtg

SEQ ID NO: 38659 - DNA, 15544 bp, Oryza sativa
atattttactagtctggaatttattacactttgttccatggtcagtgcgccacatcttacacatatgttttaccatatagctacaactggagtaagcattatgcatctagccagtctttagtggtaaatgatcactgacctggaatgcacctttttggtttttgtcatctgtaaaataagtaggtcatgaggaagatgttggggaagaagatccacccagagcagctcaatggacgtagcaatgcagagggccctgtcactgcataatgctaggtttgtggacaaaagtttcctttctctatctggcaatttattacctagagtttttttaaagctgtctgttgaactatacagggctcaaggcccttgtgttttgcatacgattttgtacctttccaaattttcttgatttttacttggattccattgtttgtaataaaattaggttaatatctgaggtagtatttgcatagaatggataccttctaccaaagttatatttgtttgtgggtcctagagctagcatgacccacgaatcacattcaagaatatagtaattcgtttaggctacatttcactaggaatagaacatatgaatattctcaggtttaataaggcagatgcaaaaaagaactgaatagcacaggaaagtaatttttccatttcaagcttctcacagtcaaaaacaagtaatggttcaaaaattgaatattctatcacctgttgcctccatttatgtggaactcacaagagggtctaagtgctgcttgacactctgacctgtatttaaataaaatgttatcacctattgcctctgcttattattgggatctcaaaacacaatctattactgtgtatgccttggcattttttaaaatctgagctgcccccttattcttcacattttctcagaaaaccatataaacttttagataaatgaagcttttattgatctcagacaattacatcaagttgatagaaccaaactaagaacacttctggcctctgataatggaactgctgtttgtttaagtagaaagaatggtgtgtgtattttaacggttggtgattgggaattgggatgcagtgaccatggagactgtgttcttcagaatatttttaagaaatagtgttttcggtggatcctatcatggaactgcctatggtggaaagagcaatacgagttgaaacatatagggattaggaagcatgggttcggactaaaatgcattcgttcctgccatgatgcaaagcttcattcgaagcaaaatgagcacatgccatggtacagtggcgtgcaacgagcactgcaattgcacacgacgtgcatgttctgaaaaaggccagtggacactagacatgcagctaatcctcttttgatgaattctatcatgaaaccaatggattcgttgaaaatctgaacaaattgatggatttggtcccagctgtagaaaggttggcaaactcttctcgctcctgtattattgtaggctggagctatgatggaccaaatcatcagaagcaaatttcaccatatataagcatctacttttatctttttctctattttaaaatgtgatcatagtgaagttatatacattctatctgcttaacgctccacattatccaaaaaaatgcatcacactccatattgggaacacgttggtggttctgaaccaaagtcgatctcttgatgccaattttttttttgagctggttgagtagtcgaactgggaacaattactgcttgaggctacaaaatttctggccgacaatacgtcttgatcaggaactgactaaagaaattccctttcaccttttgcgggatttgttggatccatcctcacgcttcggattccttgctcaagagaaacatccatgcatatcgtcgacagcgttcgttcagtcctcttccttttgttgttggtgctgttgttattattgttattgttattgctgcctattcgctcgccagtgatgaagaatagtcctgcctatatttgcctgtagtacattgtaaagctacagttgacgtgtcttgtaagacccttattattattgtccataccacgacgtctcatcatcgtgttcctgtcgagattaataaacctctatcctatccgttctgctacctctcctaccctttaactgtgtactcgtttactaatccactcaatccctgtctcgtccatggtccatggctggattggctgcagcagctgcaactgctgtgaataaataaataaactagacgagtggttgcagtggtgctctgcaccaaagcagttcagtgtttatacaacaaaacaaggcgaaactgccaaagcagcagcttagctagcggaatggcagctgatgattgtaagcgtaaaggtaagcatcggcgcgtgaagctcataccctcatgcttgcttgctgctgctgcacgttgctgttcccgtctcgccatcggttcgatctagacgggtcgacggcgagacgggaggcgatcgattatcgataccaccagcagcaatactggtgctctccatcggtgggcgccgtgtcggacttcggttggtcgccctcatcatgccggatctgaaacctgacgcccacgccttcttcttcctcgtctcctcttcttcttctagcggggccttcttatgtcggcctattctgacagagatggagaatttcagttgagatgcgcttgatattacagtgataactgacaagagtatgtgatttcaaccttaagatcatgtttaattcttaagacgctcacagtttcttcttatttatttgacaactaagtttcacgcgaagtagtttaatttttgttgtctaacaaaggcggataatttcatataacacgttcttgtagtgatcaaaagttacctcctcttgaagctgcaaaggggtgcagccgatggcaatggaggctggtaaggagtgagaggcgcggctaacggcgggaggccggactgcacgatagacgtgtccggtggtggagaaggccgacgtggcgcgatgaggcgtagccagcggtaaaggtggcgaccacgatgtgaggaggagctgtcggtgagtgtggcgctgtcttcgacgcacgaaggctagccggcggggggcgttcccacatgtcggcagaggatgagtggtggtggagcatcggtgcgacagccgtggactcgcaggtgatgagcagcgggtgaaaacccagcccggccttggccggaccgacaacgatgattctttcccccctcctaagggcgttgtcgtgccgtctcgtccttcaagggtggttgctgggtaaaagcccagtcgtggctcctttaagttcctgacggacggcgcggcggttttccgtcgcttctatccttggagacgtcgtttaggcatccccttgctgaaaccactcgaacgattggtgcaagcacgctctagatagagttgggctttgtgttggttgtaagggcgttttttggcattctcggctgtgttcctttattggcctagcggcaattggtccgttgctagctttctcctggacctgtgtgttgacgttgtctgtgtatgtggtggtttatttttgtccttttttctggttacgaccttccaggattgtaatcttgtaatttttttcgctttatcaatagaactttgcaccgtctcgtgcaagtcgttaaaaaaaaagttacctcctcatatttcacgtgaaacaattcaattctcgtagcgatcgaaagttacttccgttgcaaacggagatttgtgagttgtatgttgagtgccgcactgatcgacagtcactgccactaaactgattgatgatggggtgtcttctcaaattctgggcgttgtgctcatagcctttgcgacgcactgatgatggattctgtttctatggtaacagaggggtgacgatgatgcagcactgctttgtgcgcttcccaaaagcaaagatacactctgtcacgaaacagattaaaatctcttcatgtgttatctctcttatgtgcgaaatctctccatgtttatctaatttatgtgccagtagtgcctgaacgttcatagttttcgagcaaacggttcagaacttcatatcgacttctcctaagaaattgttcaaaactgtactacgttcttcgcatacagtagagttgagctaagtgttagttgggctgcatataagcccaattacatcaaacaaattgctggctgggccaatcttaaattggagcagaagaacatgaacctaaggttgaatgcacggattatggggatttttcgtctctctctctcctcatttgtcttttgatttatcgactacagttaaatttaaattttaaaacttaattttagagctgattttgaggggttttttaaatatatttttcttgcctttggcttttagaccacgaatgatatagatataaagttctggctataaattagttttcgtgttgcttgacttgcttgctttgttcatatttctacactttatcagtcgtaactcagatgatcagagccatactaaccccttcaaacatatatcttgagtgaattttatattataaagtacctgaattttcctcttccattagtacacatgttgagccgcccatatagagtaaaaaaaatcatgagcatataagggatgaggaaagactcaaaaaatatcgaaggttcgtcaagtcaaggactggggtccaaaccgtttaatcctctttttttttttgggagactgctatacagcagaatcccgtttaggtgagacaataccggttaggtatcatgttctggtattagtaccagattctagatgttaatacttgttgatatcacctgatacttgttgatatcatagcgatacctaccagatataaggagtcaagcaccgaagcgtcatcgccggtggccgtatcttctgcgttgaccagatccttcactgtcacgccttacgccggagctcgtcaccggcggccctactattcacaccccacgtcggagctcattgccagcggccgcgtcctcctttcactgagcaggtcctcttccccgacacacgacggaggtcctcacaagcggccacctcctcctcgctgctcagcttgtcgggacaaggggatcccgtctcgccgaagctcgtcgccgatggccatgtcctcctcccgctgagcaagccctcttccttggcccgcgttgaaagtcttcgcaggcggccaccttctcctcgctgctcagctcgtcgggacaaggggatctcgtcccgataggatcccggcatgtagcatttccaagtgctaattttttcccttatatttacctgaattaaattgattcttataaaaaaaatctacaagattatataaaatcaatgtatttcaaacgatggttgaaattgaaagcctttttaagaaattcaaggatcaaaattgccgtcccgcgaaaattgtaaatgcaattacttagttgaaaaatccacaacaatgttgtgctaaatattcatttcattcttgaacaagaagcctattatattattcttggaagctttggcatatttacactttctcgagatccccgcatccaagccgtccatctcgatctggacggtacagaaacgtgtcacgcctctccatccacctgtcgcatctaccattagcccccacctcctccccccctcttataacgcgtcgccttcccttcgccatgtccgtctccgccgccgtcgccgccgcctccacctcccgtaccctcgtcctcgcccgccaccgctcgccgccggcgtctagggtcgcggcgacaagccgcgggcgtccgttctcctccggcccccatcccctcgccgtctctcccgccacccgcgcccccgccatggccaccgacggcgccgccgccgccgccgcggcagggtcgaagaagaagaaggaggtgctcatcttcgacgccgaggaggacctcgcggtgtccctggcgaagtacacggcggagctgtccgcgaagctcgccgccgagaggggcgccttcaccgtcgtgctctccggcggatccctcatcaagaacatcaggtgattttgattgcttggaccccagagatcgcgcgtttcttgggttgcttcctcttcctccgggtgttctcggatcgcgtaaggaatctctcgccgttttggttggtggtggcgcaggaagctcgcggagccaccgtacctggattcggtggattggagcaagtggcatgtgttctgggtggacgagagggtggtgcccaaggaccatgaggatagcaactacaagctcgccttggatgggtttctctccaaggtattccctcgcgagctctggatttcttctttccgaaactgcttgtcctagtcgtcgtttcggcctggatgcatgatctgctcggggcatgatcaggctatttagggatcataatatttttgtggtttagagtgatggaaattcattcaggaatagaattctggtaatgcttgggttaactgaagatgaaaacaaagaaccgtgatgaagaacagattcaggttttcagacttagagcatctccaatagcctctttattccactctccaagccaaatgttagcaactttggacaaaaaatacactccaacttagggcctgcttggcaacttcgaaaaattttgcaccggtaaagatattacacttgtatttttcggggtcccgaaaattcccttttggttacggaggaaaagtttttccaggcaaatgatgtttgggcaaagagcaatgggtatatcacaatatttccattactgcagcaataggtacccattctgaaacatcttttctataaactgaaatcaaatagaaaaccaactgattataaagaattttcattacaaatcaggaagaactgcaatcgatacttgcaatttataaaagaaataagaggcaacaaatttgaatgagaaaacaatgatcttgaggaatttcaatcttgcctgctaagatctgaaataacaaagaaactcaaaagctgacaaaccagaactcaatctttcatcttgtgaaaataacaccaagcttctccttccaatccctcggtgtggcaccgggcgtagcgctgtgaaacgagcttgaggctgaccttgcccatcaccggataggagagaagcagggggaactgttgcgccagcctccgaagagggctaggtgagggtgcagagtgctgctagagctagaggaaagcctgctggccactggtaagaagctgatcgagctagaggcggcggccatgggatagaggggagaggagcgcagcacgagcacaaggagaggcgaagcggcgagcctgacttctgtcattttatttgtgtggcctgaggaggtgttactgttcttccgggtgtaatgggcattttccggcggattttaatccgataacagcccatccaagcagtcctttccagcccgtccagtaaaaactcatggaccggtattttacaccggttttgaaccaaaaaccgggcttccaagcaggcccttgtgggaagcggttgattgatatgttttctgcagtgtactagatctgtaacaaaaacacttgtgcttctcatccagtttacagaacctctactgctctctggagttatcggcataagcattttgattgaccaatgatgaaacgctttattcgactgtgggcagtgggattttataatctgcttgcctgtatccatgctcaattgtttgaaattgtgccaaccatttgaaatataccgtgaaatgaactatagtggttttttgtggataatggataatgaatcattagtatccgcaactgtgaatatttaggaaataagttgttgaagtggtgatccgagatgcattcttgtgtctacttattgcattttcatcagttttctggtgtgcgtgtaaatttctttgctgtgtattcagaagtactccttaactaggttcttcctttcgaatttctaggtcccaattcctactggccaagtttatgctataaatgatgccttgtcagctgagggagcagcggatgactatgaaacttgcttgaagcaacttgtcaagaatggtgtgattgcaatgtcgcaatcgactgggtttcctaggtttgatgtcatgctcctgggaatgggccctgatggccatattgcatctcttttcccaggccaccctcttgttaatgaaaacaagaagtgggtcacctacatcaaggattctccaaagccaccacctgagagaattacgtttacatttcctgtgatcaactcatctgcgtatgtcgcaatggtggtcactggagctgggaaagctggtgcagtgcagaaagcactttcagataagcagacttcgtctgatttgctgcctgtagaaatggctgtacttcaagatggggaattcacttggttcactgacaagccagcagtgtcaatgttacagaacaaatgaggtccatgcctggatattgtttaagctttcatcttaaataaagatccaggggctaatcccagcctggatactgcttaagctttcaatccaaagctgggttgtaatgatcttctgtctaaaaaaggatccaggtgactgcatagttgcattcctcttttatgcatcacttgtaaggaaaacatgagcatgtatgttgtatgttgttcagagtgatgtatctgagacactcctggtttcgacttagtaaataacctttcctggcccttgctcaagtgtctatgtttgttaaatttgcgcggttaataaaccggcgatcaacttatctacatattttgcaaattcagatagagaactcattttgtgcatgttattcaaatggtttcaattcaagacacaattctttttgtttactgattgaagtgatgccaatgctgcttgacaaagtgaggtaaactgtgatacaagcttggagacctgcatgattctgcattattcactattaagaggagtcttattcagagtgtattgcgagtaccttcagtttccagtttagtaaatcacctcttttgggcgttgcattggaaatatttagatgttcagctgccacttgtcaatacctgtaattgttagtttattgtgtatactgttccatccacagacaatccatatctttttactgcatttgcacttcagaacggcaccaatttcgctcgctttcagctgcctgtacatcgcaaggggctagtgattattcaatttttagagccatgcataggtagtgtacaggttgatctgtaagatttatattttcaggcagtactgcacgaggatgaatttacttaggcagcagcctaaatggctgtacgttcaaggcagggaactcagaactgattagcaacatggcctttctacccaacataaatcgcgcattagttgtgctgtctgacactgacctcggtacatttctggcatctaaattttcatagacattcacattttgggcaataatagcatgttgacccgttgacaaattatttcacatatttaaccgtaaggaattttggaggaatttcataagaatcgaactactcgttaataatatttgacgttaggagtactagtactcttagcatattttgaagttgggagcactaattgtaatactggaagtagtgaattttatgaaaagttctataaattccatactcctatgttccaaagaagccttaatcatatgataattgaacttattcctaaggccgagtttagttccaaagtttttcttcaaactttcaatttttccatcacatcaaaactgtcctacacacacaaactttcaatttttgcgtgaactgaacacgccctaaaagaaattataaattccatccatttcaaagaagccttaattggataattgaacaccacgttttcgacatgatttggcaggccaaccgtggtggacacatccagagtgaatgcagggagacgagacgatggaccatggctgcattcccctcgtgctgccacgggctctcggccggccaagccaagccgccgcaccgcccatttcggccatttgcaccggcatttgcagccatggtcctccatccatctgcaacgcactccaaaaatcccaacaaacaagcagcagcaacacatgattccatgagctgctccagtgaaagcttctgctgccactcgatctccagtttgcagcaagatattactaatccagtacctaacctctcacccaggttcatgtgaggtgtgaccctatctcctctcaagactcacatgagctttggagcaaaagaacatggcctagaatctagggcactcttaaaaatctaacctattagtttcaaaagaaaaaaaaatctaaccttggccatgttagaggctcatcatggtgtggcatggaattctttttttgttcggataaataaaactgaaagattcagaagcctgatcttggggacacgttgctcgtcactacatgaggagagctccatcgttgctgctgttggtttccccacaaaactactccgcatgttcaactgtctcatgtaagatcatattaaaattcttggtgttgcaacttgcaaattgtgactttgtgactgaactcatctgtccaaattttgtgtgtgatcgaattaagaaggatactggatatatagagaattgttaattaacatgtggtagcagaatagatgataggatctttcattttttttgccgcagcaattgataaagagaagagaaaggtaaaggtgttcgtcaaaggtgcgaccagtgcagaaaaaaatttggggtggttatgattgccggacagacctgaccgatcgatttgcttttgtcttaaggttttgtgcttttttttgggcctgctttattctaaccatgcgtattgaattaaatcaaaatttagctggagtacgtaataacttgaatacgaaatacatacgaatttctgaagaaatttgcagccattacatgagaaaacacgcgcgttattgtcatgtatgattgcgtatggttgttaatttggcttggctgcatccacaaaagattttgatgactcgttcaatgagtcggtccacgcgaaatattctccaattttttcttcgttttttttcgagcatatttgatccgttgacaaggtgaggatttccatgagctaaacgtgtcaggtcacaagtcaatcagtgttgatcacgcccatgccattttatagttcacacgtacattgacctacctgaaattagtgcaggattaggttagaaaaaaaagttaattagtggttgggattttcatgggcttcttctcctggataaaaccgtgtggatttggtccactctgaatggttcattcaaaatttagcattgcaagtacacaccttttagacaaacatttagacctattataagcctaccaaatctcgcatgaattgagttaaaatacactcaagtagatgcatataaaaaaatcagaaaaacaaacacgctattaaagtatgaacaaattttcaggtcaaccaacccagtctccttttgtccttacaacctaagcttagttattcagacaaacataaaattgccaaagaaagagttcaagaatgtatccccactttgaatatttttttaaaaaattaaaaaaaaaatcaaagaactaaccgaattcaaaccaaaggtacatcggttctattcgtaccaaaaattcctttgaaactactagtatatgattctcatcctctacttgttttgtttataagctgcaactaatatcgaaacgtaaccttagagttgatttaagatttttttcttttattctactaaagctattatccagtcttaataacctctataatataatttttactatacagacataaaaagttttacctaaactaataacctaataacatgttctttttccaatggtttatcaaccgacaagagcccaagatttaccaaaccgtttggattgggactactatcaccttatgatataacgattatcacgaaaaccacgtggttaccacgaagtatatcgtggttaaaaaactgaaaatgttatttcacacgataactgcacggttttatagacatttcgggagcccaaaagtttcagaacagatccacaaatgtggtgggcccacaccgccagcctctcccactgacacctaggccccacaagaaggacagggccgtgggtcccacgtggcaggccggaacaaagacccgtttaaacgcgcacggcacccacccactcctctctccctcttcttgtgtgtgtgtgggtgtggctttattggcgtcacatgcgccctcttttcctctctctgtttttcttctttttctctctctatctcttcgcttacgagcttaaagagacaacgagttaaagccgaggaagaaaaaaaaaaccaaccgatttttttttaattaaccggcgcctcctccttgcgcggcgtgcgttcgccggcggcgagatcctgcggcggcggaggaggaggaggaggaggaggaggagggggatggagtggtgggggccgggggagtggtggcgctggtagtggcggggacggggagtggttggttgggtttggggagtttggtgggtgagagagggggagagggagaggggacatgaaggcgctgcggcgatccagcacctcgtcctccccgtcgtcgtcgtcctcgtcgccgacggccgcgtcgtccccgccgtcctcgtcgtggatccacctccggtcgctgctcgtcgccgcggcgtcgtcgtcttcgtcggcgtcgtcgtcggcggcggcgggaagctccgtggccatggtgtccgcttcggcgcccgccgcgtcgtcgtcgccgtcgccgtcgccagcgcccgcccccgcgccgtcctcgccgcactcggatcggtgggttttctccctctccttcggattggtgaaaaggaggagtaaaaatgactccttttttagtcctttccttttgggggcgtcttgatctgcttcccgtggagtctagcctcacatgttctgatctaattggtggtctggaggctgcttaggtgctcatgttatggtttttttgtgcgcctcaatccaaccaagtctttggatttcagcttaagagtgcagtaaaacgttagagtgacagcctggcttaattgtgtgcctagcaattcctgcctcgtgcaggaaggttgcggggcctgcaatccaaactgaggacaccggatttttaagagcgaatcgattatgtgttcaatctgttgacatgatagtgggggagattcggtttgttgattcagagagatcatggattctgttgcagagtggtttgcttactctaaaggtgccttccgtctaagttctagtgtgataagattttgtcatagtttagtggcagcgttagtgctgaatgcagcttgcacaattgcctcaagatatgttgatgatgtgatgctgttggtggtttgaacaagggacagcttgctgctatcttgaattatgtgctttaggttgttggatggcatggtatttaagaccttggaggtgatcctgtcccctaaggtagcaaatttagtttctaagaataatagggggggtgcttgatgtttccttttggtttgggagtgaagctgtggcactgtaaatgctacctaaaagtttggatcttccatgagttgaacaattttgctgacctgaataggtatcaccgtaaatcacaagagtttttagatgatacacctccagttttcctgtgatctgctcttgttccgtagttatctcttgtcaagtttgctttcaacttatttgttcactgatctaggtattatattgaactgcatgttgactataacgattcctttttgtagcccaggtcctcagataactcataactatgaatcattgcctagaaaatcgttttatgtggtcatcttttcttaatccaattaccaagttcaataccatcaatttttttcactagcgtatggtgttagggaccctgtttcatccacagattccatagtattgtctgatttatgcctcttgatcgatgtatgtattattcagctatgtagttttgtttagataatggataaaattgtatggttagttcaaaatatggtagaccatactgcttgattaagaatcagttcatgctgcgcataacgaatgtatccttgacgctgcacaattatgttcttaacagcactttgaaacaataactaggaggaagtttttcagtatcacgtttgtttcgtaaactaattaataccttaatatctgtctattttatgaatttgttttatatccaaccttttcgtgtgcatacaaattatatgtgaagttggatttatgaggactcaaagcattccctcttcggatgctgtagcttagagagtgtgttaaagatggtactattagttagtctgtcagttggtatggcagtgttatcttttattgatccatatcttccttgttgctccactttctaaaactattctttaatcttctttcaggggtggaataaagtctccatggtctcgaaggaaaagaaaacgagtactttctcgtcaacaatgggaaggtctgttttctgctaatgggaaacttcgtgatcgaggaaagaagtttctgaagaaagttcgcagcggggtaagtttgattatctatttgtttagatgtcctgcatatgtttacaagaatacttgcctattgttttgtttgttcaaagatttagacatatatagtagtgatattgaaagcatgttctgcatcttactccgtacagtctaattaatatactggccttttttttctgttgtgtcagggcattgaaccaggaatcagggctgaagtttggcccttcctgctaggagtgtgagttttttaatctcttctatgcatctagtaattcataagctttcgtttctttgaccaagtttgaggtcgcaactacatacacgtagacttcctatagcacctaattggttatgtgaccacatggagtgtgcatgttttgtgtagctctacgggacggctccgattcatggactagggtccttccttactgtttcccataatgaaaaggtttaggattatcagttagagaagatagttcttcatggcaatataatacaccattcttagtatttgaatccaggataattaataccttcatactacctctgtcccaaaaagacttcatttctcagttcttgtccaggtgcatagccagaaatgaagtctttgtggggcagaggtagtaacatcttttccagtttggttttggttgatgtgataaattgtatggttgttgtcataaagtctgttcggattgttgtgttgtgtttaatgtattctgtcttcaaaccaagagagattgacgctgtcaattcttatgtgcagctatgatttaaatagcacagaagacgaaaggaataccatcaaaatcaagaaaaggtattatattcattgctctgaaaggctgttcaatttaagtaggattgaaacattttgctcaatgtgctgtgtttccatcaagctacactaaaagcccaaccactaatatgtaacatagcagaagatcccc

SEQ ID NO: 38660 - DNA, 3706 bp, Oryza sativa
tactccgtaaatcaaggatacaaattagtatatcatacatgggttagtgtcaaaatttggccaaggtatcatacaagttatttactccccccgtcttaatataagtgtaacctaggataaacgtgacatatcgtagtgctacgaatctagtatatgtttcatccaccataggttgcacttatattgagatggagaataaaatttagtaatacactacttcctctgtcccgtaaaggcgatcgttttatactcacaaaatatcctatatagattatcataccagttttgtcggatcatatagtacttgaattattcttgtccacttgtttgaattaaatgcatgtgcgtatttattgttatttctcaaccactcaaaccacctttgatgaaggaggataaattggaaatttacacatgagctaatttatcctataatccttagaacatcaatctttctgggacagggagagtaatagcttatcttacatttcttttctaagagtttgataaaacaaactagctactactgtagtaaccatctcaaaacaagcccacagcattctgctaacagtctatcagatatatatgggtatcccgtacacgtttcgattgtcttctttctgccgcatggtggattgccctgagtgacaagacaaggaacatatcaaatcgtagtatgatgaagctctccatgttggggtagccacaagttgtcgtagggcataactttgttgtcggattcatatttctaaacaactttccaatgtggcgtacaaaatttcatggcgtattttttttccaagttacatggaaatatgtaaaatatgcatgtacaattcattttattttctaaccttttaaatataattttaaaataaactcctcttaagcatatttataaatctgaaccatttgcctactgtaatgttgagatagaataatgttgttgcgtcacttaagagaccaatgatatggcaaatcattgttgtcattccatgccatgaacaatagttctataatattttttttcaattattgatactttttaaaacaagttatttaagagtttagtttttaaaatataaaggaaatactatctccatttttaaataacttgtagctgaactattcatgcttaaactttaatctctcatttttttcttaaaaaatacaaatatttaagaaaatactatattatcgaagtatatgtatattgcatatatcttaaacataggcataaaacttcttccatttattacagtaaaaataggaaatgaaaatgtgatagtcaacgctaacaattattcgaaaatggatcagcaagcaatacaattcattgcatcagggttcgaaattttgtttcaacatttcggcccccaggaacgaaactatagcatccgaaattctaatatatccgtgaatttagctaattttattcagattatgacatgtggatctaatggtaaatccttaattatcacttgtatggcaaatagttaaatatctcaaaattgaaattatatcagaccgaaatatacattccaaaatttctgaaatttcggatttatcgtgaaccctctgcaaatggcatacgtacgaaggacggagcgcacaccgtcgatagtgagacctctcgactgcccaccgctttgcaagtctcggcttcttcatcaaagctcaaacgaccaaagcgatcatatcgcgacacagtcgagtcaccctgcacctaagcctgcgcgctactgaagatctctcgatctcatctcatgcgtcaactgatcgagatctgcagctagctacagctatagctttagctatcggtcgccacctcgtacgtcgtctacctctagctacagctcccatggctgacatgcgagcacgacggcgacggcgagatcgacagccggcaagccaccgtgcgtccgggctccctgcaggtgaactgtatgacagggaagcctcatcgactctcccctcaaacactagatgccgttgctactgtgtagccctattaccctatatattcctgagcctagatatccattacaaattatgaggttgtacatatcgatattatttcaaatcataccatttttttaagttgttcaatatgtgcatctatttagtttcttttttatcaaactctgataaatatataagaagtcctgccaaaacctggcaatattgctaaattgtcaaaattttggtattgtcaaattttgataaagtttattttgagtacaatctgaacataccatatatttcaaaacctccaaatatagtatgagataaagataaaaatatgtaaattacactagttgaatcttaagttccgtttggtagaactccaattcctaaatttaactccaaaagttaggtatgtagtaaagttatagaacagtctaaacctagctccactactattttagatggaactgaaattgtttggttaggccccaacttcaagagagatgaagatgaagccagtactgcaccaacatgctcttaggcaagaaaatctggctatgccttcaaacatgttatagcaacaacatccagctgctgccatgcatgtctaagttagctacaccatacgtttcaaattatttatagttatcattttaatttatcctaaatcaaatatatttataaccattaatttttattcgtgtgattcaataacatgtgaattataggcataaaagtatttgtatggtgaatttaaaaatataaatcttatggtgtaaaactatatgagtttacagaaaatattattcaaagagattaaaatgcttgaattgggataatcctaaagcgataagtaatttaaaatgtgggagtaattaactgtctagacagacacaagcatggtggagatgatgagtgattcgatcacttgcgcaatcggcaccagcaggtgggttggatcgatggttcgttcaacttcaaatcagaggttcggttcagaagatacggcagtatcacctatctgcttctctgataagtggattggcatgcatggtgagctaatgtctactaatactttaaatttgaaagattgggcttattcgtttcaaaggaattgcaaaggaaaagcataggaataggaatgggttttaaactaccattcgttttataggaatgcaccatagaaaaactataggaaagttttccattcctccatttataaaggaaaagcataggaaaaaataatccactccaacctaatgtttgcattcctttggttggattgctcaacaacataggaaaaattcctgtgtttctcaatccataggtttgcacatgtattcctatagtattcctacgtttttcctattcctacgttttgaaaatcctgtgaaccgaatgagccctgagtgaattgttgctgcggctgatctacttaattataaggacaaattgaatattttaacaaataaacttaataaataacttaaaataagtacatgatccaaacaatacgataaattttttttataaaaaaatatatcttttaaagcatgaaacaaatcattcgtttcatcaatctgataaacatttcgaaaagaaacattcatcttgctgaatgctgatgagctatatcattgcttcaactggcactacacagtggctacacacctacatacccactggcctggtcgatcaatctgcatttgcacgtgtggggattgaactgcatttgagg

SEQ ID NO: 38661 - DNA, 2749 bp, Oryza sativa
tgagacactaattgcaagcactctttcccaatctgacataattacagtgtatcaaggtatcaacaaatctcaatctgcttgaaccacttgccattgttcccttgcatatgttactgtccccatgcagttatattgtgtttgtatctctattaagggagagtttaggataagagtcagactatatttttttatcttgcatatgttataactctaaatcctacttcctttgtctcaaaatataagtatctagcttgtttttggagagattaaggattatggtgcaaggtaaaaatttattatattctaaggctaggtagttggtttgatatagattgctaggggtagggtgaaaaagtaagtgaaaaaaaaaatcaccttttacaattctaggtagctactccctccgctcctatttgatcttcatagaagtttttttcatcaaagatgaggatggcttaacttccatgcatttcatttaatatgagtatgttttcttgtgtttctatgttgtcctggatagctggtagccccagtgtggtcacgcccagaaattcccgaatagaattccaagcagaatgtgtattaaaatccccgtccaggaccggccggggtacacaaacgacaatgttgacattcagatccatatcttacaaacatcataaaagtcttacataaatacagtggaaaaacgaaagacaacaggagctaagccttgactagaactgcagcgggaacaccactccacaggcatcctcgatggcacggacgaagcctactcctcggagaaacctccatctgacacatactcgtactctggggttggggaaaatagagcaagactgagtactacccactgtactcagcaagtcataccggaataggggtatgatgtagggaattatcaaaagagagctaaagtggttcatttgcataaagcgagcatttataaacagaagttgaaagaattaaacagttgcaataattaattaatattgatcatcggctgtccaacgccatcccacgttgcaacaggcccaaccatccacctatactatccaatttcattagactaaactagggtgagactaatcacggtgaatctggttgaccgcccataaccgcgggcacggctattcgaatagttttactctgatcagaggtgtacaactgtacccacaagacacagccccacgacacgtttccgtgcgccgacatgccaccacgacataccggaaagatgccgtgacaggaccctttgcataaccccctctaaccaagcacaccacacctcaggtttcacccccactcctcgcaaggcagcgggcagtcccctctcgtacctaggtgaatccagaagcgacagaggccgtcgcagggcccgccccgctccatcacgcccacccttgcctggatgcgtcagctagaggaaagctacactacaagcccagccgttgcccacactggcttgtggtaagtacgataagttcttccagggcatcccgcgaaccggtccttaactgccatgggtgcgactagcaaaatcatgcacccacagcccaccgtgtgattcattttaattaaccaacaccaaagcggtggtactaaaccaacattatcatatgaacctacagtctaaacattaataggattttccccactgtgtactagttgaactaagcatggctaagcaactcctagtccaacgtctattcatgttataacccaagctaaaaaaggagcagggtaccaaaatagcatggctgtaacaataggtaaacatcccatagtgatattgcaaaacaaatgtagtatttgaaagaaaacattagaacatttgcaatatagtatcaacatgatcaagtgacaagcatgacttgccttgctctgctgctggagaaacctcggcgactatttcgaagtacaccggagcgtcggaagaaccggaatctagcgacatacaaggcaaacattgcaaacaggctataagactactgaaacagagaacaaaaccatttttaatggattctacacatttttcttgatttactgagacttgaatgggcttaaacggagctcggatgaattagttatgaattttagaagattcactgtgtttattactataacaaaaagtccttaaatcatttattgcgcaataattcccagggctgacatcatcaagggggcggcgccgacgggtgggtcccactggtcagtggctcgggagagaggggaaggggcggcggcacgtgggccccactcggcagcggctcaagggggggcggtccaccgtggaccgggaccacagggtgatccaccgccggtccacgggaccgacggcccagatcggccccgagccgatcgggcggtggcgatagaggtggccgccgggctcggctcagcatcaaagccggccggccggccagggctagcggcgatgacacgcggccgacggcgacggcgaccggcggcacgggaggcggcggtggcggccgaaggcaacggcgcatgacttgaagcggcggcgcggcactaggagggagagggaggggagtaaaggggagaggacgcctcaccgagggtggccggcgcggaggaagatgacggcgaacggcgacggcaagccacgggaggacgacggcaaccggcggacgggcttcggggtgccctaaggaaggaggagagagagattatagagagggagatgaaccacggcggccggcatccatggccgaaagcggcggtagag

SEQ ID NO: 38662 - DNA, 7661 bp, Oryza sativa
ggtaggggcgagattccgccggccaacgtgggggagtgggagaggagagagagaggcgggattcgaaaatcgaatcccagccatctcgggcgcgggcgcgggcgggagagagaggggagtgggcgcgggaggtgcggcgcatgcgcgggcgtgaccgacgtggcccggaggaggcggaggcgtgggcgtggcgacggttgcgggcgcggcggcgcgggcgcgaggtaggagacgggcccgacaggtggggcccacctgtcggcgtcctgggtgggaggagggaggcggccggcctagctgggccttggccttcggctggcccagcggaggggagaggaggaaggggaatgggccggcggcccactcgaaaagaaaagggggaaaaagaaaaagaaaaaggaagaaaaggattttccctggaattaaaatattgcttgctcaattttaattagttaaaattatttctagggctctgaaaattccactaaaaatcttgttagcgtatttcgacatgtagaactcaagaaaaattccacatgccaattctgattattatttgcattaatttattaaggttttctcttgatttacacaagtatttttttgagaccatttataacttcaatttaggcttgggaaagaactttggggtgtgacatagccccagtgtagttgtttactatggttctgcccttttgggccttttttcacttttagtgcagcaaggttctcttgtctgcttttcatgtatgcacttatgttgtctcttgggcttggtttccaagctgggtaacgaaagacttacctgttgtacaaaaagtggtagagaataatcaagaaacatatagacttaaacttcctcatatgcacaaggaaagagtgcttaagggcaatcccaacctagaaatcatatagtgatttccatacttaccttatcatatagacactatatatagaaactatgtacccaataagtagtttcttcaaaatatatttgtcgacgggggatacccgcggatcgtatttggagggtattggggtacgttggtacgaggatctaaacgatacgacatcaagcatacaagaagaaaatgattatactagttcagacccctcgtaaggtaatagcgctaatccactttatataagattatggaagaaaccacagagagtacagaagagaacgactgaactctgagattactgacgagatccttgtcgagaggggttcaacgagatctatcggcgagtaggcttcaagtcctccggattgcgtctatggtggcaggtgtcttgcactaagatttgataccctgtatcccttagggggtttgtatttataccgtagatcaccttagtctccaagtagaagtcggagacaacggaccccgtacgaccaaactatatcctaatcctctccgagtaggactctgttactttccatttcacaaatactatttccttgatttatacagatccttttcgtgtacttatggatataccgtatccgtatgtctcatgaccctaaggatagagggtatgacttatccataaccctgacaatattcttgtccaatcacctttattctctctcctcatcctcctatccccttgttcttttttttatgtagaactagtttgttgcataaaaatggtttcttcatcttttttccctctctactcattaactcttttgccaccttatttttttcttatgtgacaatatatttaatgatgagtaaattgcacccatgatgcatcaacttagcaggtgggtgcaatttggtgcaagaacttgagaaatgagcgttctagtgcaacaacttggcagataagtacaatttagtataagaacttcataagtgatcgtataaatacaacaacttacaagatatgtatgattttgatacaataagttaagaagttattcaacaacttaattatttggagcacatttttacacatattagatttttaagtacttattttgataatatactagcgtgggtttgtatataagtatatttatatttttattctaataactaataactgaaagtcaattaaactggatgtagaaattattatatttcggttgagatttgggaaggtgaagaaaacaaaaattcttgaaggtaattggatgtgcagtataattcttaaagattaaatttaatattgtaagataatatctgtaggattgctatgtaacagcatattgacatcgtgaaaaaaaaactcacctagcatatgcttagctaagttgatgcaccaaaatactaaattgtcaagttcttttactagaacacacccacttgtcaagttgttgcactcgaatgtttaattcttaagttcttgtactatatcacagccacccgctaaattgttgtactatgggtgcaatttactctttaatgctatagaaattagctcatgtggagggttgggaccgttctaattaattacccccatttcatgcaaacttaatttgcatgtatagacaataatactgcacgtcaaatgaagatgtcagtgttatgtgacgatcagtttgaaatttctgaattttttttatgtgatgattaatatggcatggagggagtatactagggacatttaaacactaaagtagctatatttttggatggttgtgtactttgtaaccgcctttgtgtatatatttggcactaaattaaattagtttctgtcaaattcttatgggacctctcctgcgcttccgacagaatcttactgtgaaattaatttctacaaaaaagaaaaattgtttgctccaaacaaactcctcacagtgtagctgacctcactcgattacattgcactgtcagaaggttgcacttgtgacttgacagaatactagtgtccgagctccaaacaccaaacggataggcttgtcgacgatgctttccactgaaatgatcggaggattagatacatgatagaaaagaaaaagaaatgaaaccgataggaacgcccgtgtaaaacagaatattgaaaaacacaataattctatataaatatgtatttgaatggaacatatgaaaaattaagaattttagaggattttatgctgctaatgttgtgcgaacgttgtactaactttttcaataaaattaatggtcaaacattatgcgaaaagttaagggatgaaaagaaaatcaagagctctgagtgaattcttcttttcctctggaatagacagggaaggaaactttctttatgctttccttcgattttcctttgtgccattaattacgttgatccaaacgatgttacagtggttaaatacataggaaagcaaatccttggttttctttgcttttgctccaattcaaattggcctaaatgtgagaacttctaccgctaatcttacaccatacaattcaaaatttatactttggataaattggaaaacttctgaaattttgaactcgataagtgaccaatttacgccagtgaaatttcagtttaaaaatacactgtaactgtttgtttttagtgctgcattttcagtggcaagtgtgtactgcatgcactgaacatagtacaggaaagcgtgtgtgtgtgacactcgatggctcgacatggacgtcgagacctaataacgatagcaacagcttcaagagttttcctagcttttctttactttcagagaaaagtgtgctgtctcgcgtttgctgtttctgagtgttgtgtttatatctgcccttttttagtgactattagaatatgattacacaacttgctttttatgcaggtcttttttttctcgtagttgatagtgttgagattatagacatataatgatttaatctattccataaataaatcatgacattacagatgaaaactagtatgaacgcatcattagatctacacatgtaaactacacagtataacatgaatagatcaaatatgcgcaacatattgaacacgtaccgaggtgacggaaagaccggctgcttggtcgaaacttttcgcaagtgtctacgaaggcacgaaacacgcgagcgaagaggaaggcgagccgtcgcgaacgaacagggagcagtcgcgcgaagcgcttcccaaaaaccttattaccgccttctcccggtgcagaacgtcgaaggcagaggttccggagacctgctctcccgatcgccggtgcacgccggcgagcgggatggagtagtctacgagcgacggcgcagtacagagtaggaagcaaaccctagattgatttttttgtatgttgcgtgaagacggcaggtcggtttatatagagaagggtcgcttgatcagggcgcccgcacaatctctactgcgcgtaaccgaaccggataagtcgcgcgtaacttatccggactccacgccgtttgcacgcaccggatctttcggaacgtttccaaaacaaaaacgaatccgaatttgcaacgaaacaaaactgcaaaaggaggctgcatctgcgcaagggtgaggagccaatttttcggaccattcgacgcgtacgtcgtgcacgcgcgccgcctgccctgccctgccaggcgaggcgagcgagcgcgcgcgtgtgtttcccctcttctctccaccacacatgcttcaagcgactaggagggcatcctcccttttaaggaggtccccctctcctagaataagcaaggtagtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtattgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttctttcaagaatgctctgcaggacaacatctttgctaattaaagccaacagaactcattaaggcatagccaacctgccttgcagctcacgagagtatatgcatcttcacttggagagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaattattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaattgtctgtttgcaagacctccatgaaacagcaccaccacccagtgtgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatctttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaggaacttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattgggaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctcccccccaccatgccttaggcagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccacgattagacctaagcctttttatctttctgtcaagttgattttcaacttctgccttataaattttaaaatagtctagagcctcgtctttcgttttcaacaagtacacata

SEQ ID NO: 38663 - DNA, 517 bp, Oryza sativa
caaaacatgtggtacataaaagagagatatcctggtatccttacccttgttctcattgatggtgcaatactcgacattagaatgcttcttccgattcagccaattgaacacctggtagtgccataaaaacataaatcaccagtaatctcattagatataagaacagtgagttgaatccaacgcacttgtttaagagagacagaaactgcaaagacctgtactttacagcatacactatacacggacaaatggtgtatcagcatgaactaactgtgtacctttagagccatctctctagaaccaatatgaaaccagaagagaaagccagacagtagctcagatcctcaaatgcatggcatggttttataaaaagacactagtctcatgattgaatggtccaggagacagaagaatggacttttggttgcaactggcttggcctgactcactgaagtaaattctttcaccaaggtagataagcacactttcgacagccatatgctacattctgttcaaa

SEQ ID NO: 38664 - DNA, 667 bp, Oryza sativa
tgctgctcccaagtcccaggtatcaatcaaacaagaaacagaagggtgcgttttgaagccaaatgtttagaggcatcgatttcagacgatacaatttgattcccacatgaacaagaaacttctcccaaatcccaaacgaagcccaaattattggagaaaacaatatgacagaccatacaggcatacacagatatacctttcaatgaaaaatctgtccgtgcctataacaggttaaacaatgaatagtagtagtctgcagagcctcagtaacatcaagcagtattgctgatcttcgtgtgtgaggaacactcgagtcctcactctttttaagttacaacaatctctatacttagaagtgggttctaatgttctatgccggtacgagctacagggaacataacacttttctgcaagcagcaaagaaacccccccccccccccccaaaaaaaaaaaatgtcgaggtctatatttgttctaccgcaagaacaaagagaaacgcatccctcagatcagattttgtcgtggaagttaacaaccaggtcgtgtgcgtcgtcgagtagcctccagacgtccagttgcccagccatgctattgcattctcgcaatatctcgtccatgctactatacttctcgattatcagcttcctcctctggaggacgcaagccg

SEQ ID NO: 38665 - DNA, 14705 bp, Oryza sativa
  unsure (1)..(14705): unsure at all n locations
agctaggtgtaattttatagttgatcaatcattcatatcgattgatgatcagttggctaattatagcttgagcttggcggcgatggcgagggcgccggtgacgacgcggttgacgttgttcttggtggccttgagcgcgaggctgggctccagctcccgctcctcgtaggcgttgccgcagtcgccggtgaaggtggtcgccgccgacatcttggtgatgaggctcgccttgctgtcgttggcgtcgatgcagcgctgcacctcctgcagcgccgacaccgtgctgtcgtacccttccttgcaggtgtccaggatggactccatcggcgtccccttctccgccgccctcgccgccgcctcgaacctcgccctcgccgccttcgccttcctcatcgacagcttcaccgccgccgtcaggagctccttcggcgagctcacccccggcagcttcctcagcgtgttgcacatcttcttgttacccgcctgcatcaacatcaatagacagactgttcatccatgacatgagcagtaagtaattttctgaccatttctggagcgggagtggattttaatccctcgaggaacatcattccctcattgtttacatgtcactcaaatagttataaaaaaattaaaaaaaattcgagaagatgtattaacatgttatatatcacttcacaaatatccaagttcaaattaaacatctatatttggtttaatttatttttttcgttgcgagatacagaagttgaatttgaacgtgtatgtttgtggggtgatatatcacaggttaacacgtcttcttaatttttttaatttttttataattatttaagtgacatataaatacgagggaccctctcgagcgatcaaaataagcttccatggacaatagtgtcgtcactcaccgcgacatgatcgcaggtccaggcgcactcgtcgacgacggcgccggtgatcttgcggccattgtcgatgatggcaccgagtgggttggtgatcaggttggtcggagcgacgtcgataggtccaacccgggcctcaacgacagcggcagcggcgaaggcggcgacgacgacgacggagatgatgacgaatcgcgccatggtgtaatgtgttattttgctcttcctttctctcttttttttggccgccctcgatggttaaattgagggatataagagagacggccaagaaagagagtagaaagagaggcaaaaggctgagaagctaaaaggtttggtgatggcttggcttctccgacaagctgagtacggtttatataggggagaggtaaaggtaaatgaatggccatggtttctttcaggttgggtggttgcatgccatgggtcatggttattttcagattttggtggttgcataccatgggctctccttggtttcaggctgtcttggctaaacttggtgttgccttttttttttcttttattgtttataagaactttgtacatattttttaaaattaaacttgtaacttattttttttttatgaatgtttcgacaacgccaaaattagcgatgtatgatttgttttctaaaaataaattagatctagccgtataatttgcaccaccatccagctagtttatttatttttttataagagtacagaagggcaacatgtcaaaaatctataccatgatttccgcaatgcttgcccgccataacattttaattaaactagttggcaccatgtgtgcgccttacagtgggattcattagttctatcgtcaaccaaaatcaaagttctaaaggattagatgcaactctatggttgtgttatttaccctatctgcctaactcatctccctcattttccatgtacacgcttcccaaactactaaacagtatgttcttaaaaaaatctatacgaaagttgctttagaaaatcatgttaatgcattttttaaaaaatagttaatacttaattagctatatgctaataaatctttctgttttacgtgcgtgacggatttagttcccaacaccaacaaccgaacgcagcctatgtatatacaaaatactaatgtagcttcatatgtaccttcaatattacaatacaagtattgatatatgaatgttattgttcatatgtaatctagatatcgttgtaattactacaatctcaagtttgatctgaaaatgggtttgggttagtgactcccaataattatatgctatctaattattcataataaaacaaagctcacatcttaaacaataattggaatcgtattaaaaaaagataagttagcattatatttgaggacttaggaaggaaaagcatggtgctatgtgcaaaatgggtaaagattcttgatcgagcgacagttatctttttattaataaatttgaaggcttactacatgttttactctatagaagtaaatgctcctaactaagagtaccaactcctacccctctctcaaagtagagggaaatttgtccatgtaactatatgtgcacaaaatcccagcttttttggaatgcaggattttagaaacacacgaatgtgaaaaaatatgggtgaatagctaatttagtccctcaagttttagcgaaggctcaatttggtccttcacgtttcattttgtccacataggtccttcaaatatttgttttggcttaaaatcatccttgggtccacttaatatgccatatggctatttctagtcaatatttctattagaaaatatcatttttgcccttaatttgtatacatctatatactagaaaagagaaagccaacatgaataaacaacattatagatgtacttcccattatttcaatatgtgcacatgaaacttaagcaatggctatcgtatacacttgttagtgcataattttttttcgttttacataatatactatgtattatctataaaaaattcaagcatgcaatttttctcttatatatgtgaatgatgagggatataagtgtcatttatgaagagagttgttggttcaaggataagtttgaactaaaatgaaagagcaattttacagtccttgaggaggtaccatgaggtaccaaaaatttagtgtaaaatttggtaccccatggtacctcatagtacctaggtaccaagaggtaccaaatttacaatagaaaaaaggtacctcatagtagctcctcaagaaccgtaaaattgcccaaaatgaaaacttgaaagactaatatggatagattgaaacatcaaggactaaaccgaacctcagatgaaacttggaggactactttggctattcacccaaaaaatatagaattacagtagtgtaaatcaggaaaccataagctccaaagtttgtttctcgatttatccgcatcagccaaagtttcaattttaaaaacattaattttgatgttttattttctaatattttaatttatcttttcagcattactagcttttaattgctgataacaaatatgaatgttttactcgcaaattattttttctgctaataagcgctattacctccgttacaaaatatagcaatctagaacggaatgagacccatcctaaaactacgaatctggacatgaggcatgtccatattcatatttctaagatgggtaggttgctacatttcttaatggagtgagtatatcttataattaccgctcaacgcgctaagcacttgaaagaaaaagagtagaagtagcaagatgtacgatgaagcgtgcgtaaatgtagagaaaatgctagtcaatctgaacaacccaatcatcgcctccttgcacgataatctcatcctaacatcgtggccgtccttctcttgttttattaaaagttttttttttacgattacacgatagatacatggtatgtgggttctaaacttttattatcctcacacgttagtacatgtaataatagcgttattatggtaaaggatgtgaacacgtccactacacacgctgacttaacctgccacggtttcaccgatcgtcatcttctcctcccttctcctgcgttccgccgccggcggcggcggcggaggcggggacttgccggcggaggtagtcctccttcccgaggcacgagtccgggacgacgacgccgacgctcttcccgaacgcgtggtggcagtaggcggacgcgttctgcccgccggccatggtgatgttcacgttctccagcgacagcttgctgcacggcgccgcctcgctgcacgcgaacgtcaccgcccgctccgacgccgacgtgccggtgatgtccgtgtagctgatctcccccaccgtcaccgcgcttccgttctgcacaccatccaatccaccccaaaaaactcaatgttcagagatgttaggcaaaatgttcagagatgttgatcttctactatgtgctgatcagatcagatgctgatcatgagctcactgtacctttgatccgcagggaatttcgttgctcgaggagttctgctgatcgatgacgatcgggttcttgacgttcttcataaggatgtcaccgaacttcattttccgggcggtgccgcagccgccctgaagaacaacagcagaagttagctagctaggcagttttgagttcagagttcagtgtaatcttgggtgtttctgacgaagattcatgtgagaagtgggcgttgggtttacggttaacctggaaggtcttgacgcgtacgccgttttcagtgttggaaatgaacagggtgtccatcttgatcttttctaccctgtggtaacttcggttctcgcctaatcctccaatactgacaagcacaaactgttaattagctctgttacgaactgctactataaatggatgtggtcatgtggagtgtgtttgggtggagtcattgtctgaatttagttcaaaatctgatgcaaattccactgaaaagatggagaaaaaaatgctaacctgataccatggccaggtccacatgagatggctcttagacgaacatccgtagaattgcccacaatcgagacacaatcatgaccttaaaaaggcaaaaagaaggggaagaaaatgttctttgtgagcctttttactgtcctgcaaaacatatctgatcaactaatttcaaacgagacatctgtttcagcaacagacatcattcagaaattcagagcaaagctccatttcttcagaagaaaaaaaaatgtgtagtacctgtggagatcgagtcgtccatgatgtgaacattgcgcgagctgacgacgtgaactccggtggtgtccgggctgtcctccggcgaggttatcctcaggtagttggccttgacgtgcgagcaccgggtgaacgtcaggtggctctcctggctgttctgcagcgtgatccccatcacgctgataccctgacaatcctcgaagtgcagcgcctgcaaattaacaccgcgaaaatgcaatccatgcatgaattctccatctttttggtccaaatcctctcgagctagccaagatctctgatcaaattaaagcgaaaatctcacctttggagcagcctgggtagtgcaattctgcagagacaagattgttcagaacttcagaataattcagatatttctgtgttgcaattggcaacatcatggtcatggaggagaccattggttacctcggtcgcgttgtgctttgccttgcacgaccgggcccaccaccggtggccacggccgtcgatgacgcccccgccgctcagcgtcaggtcgctgacgccgacgaagtggagccattcgccgccgccgccgccgccctccggccactcgtcggggctctccggcgcgacgatgttgccggagatctgaggaaccggacgcgattaacgaagtggataaggcacaagaaatggaagaggcggagatagtgtgtggtggtgtgtgcgtacgaagagcttgatctcctccctgcaaggtccggcgagggtgaccggccagacgaggtaggacttggcggcggggacgtggaggaaggtgtggtcgccggtggcgcaggcggcgctccaggcgtccaccaaggcctggacgaggcggcagaaagagtgaagacgccattgtgagctgagctagtgaagctggagtggctagctgctgctcacctgcgtgtcgttggcgacgccgtcgccgacggcgccgaagtcgtcgagcgagaggagagtgcggggctcggcggcctccggcaggaggagcaggagcgcggcggcgaccaccaccacgccggcgagcggcggcggcgccatccttgaactaggtggcatccaagatcagcagcttcgactttctgacaacaagtgtccaagtccacgagatattattttgacgaaaatctgatccacgatttattttttttcttttcttgggagaatcttggatccacaattccacatcaccacgtggacatcgagaaaacacgtgggccgtgggccgtgggccaccgacaccttcgttacgtggggccaatataattgggccatcggcccatcactgctagtagcagaaactccggtaaaattatgtttttttgtatccattttaacttcacataatgccctctaaaaaattcttgacacaaacgtcgtatacagcttacaactctctgtactcatacactctcccaaatacggcaacagtttctacacctacgtgtacggtatttatacttcagctttttccggtgatcgttgccaggatcgggcattgccggcggcgatcaagaaccgactctggccgccggcgtggcgtcgccgagcatcctgtggggcgccttggcgaggcaggacgccggcacgacggcgccggccgccttcccggacgccctgtggcagaacgccgacgccgcgccgccgcccacnnnnnnnnnnnnnnnnnnnnnnnnnnnnnnnncccggcacggcacggcgtcgctgcacgccagcttgatcgcctgctccgtcgccgacgtgccccggatgcccgcgaactcgatcttgcgcacctccaccgcctgcgtctgcatccacagagacgaaaaattcccaagtttcagagatgatgaactagtgctctgaacaatggcaaaagttcagagtttcagagatgatacgatgctttgcaggtgaaaatgcagattattacctggtttgcacagggtgttggttggtcacagtagtactgatcgatgatgattggattggagacgttcttcatcacgatgccctcgaacctcaggttgtgagcataccccatccctccctgatcaagcacaaagttgcattttgtcatataattactcctttttctgaatagattgttcttgtcagaaccaagaactgcaagtgttttttcccctcatcagattgttcttgtgagaattcagaagtgtgatgtcctgcaactaacctgccaactcttgatccgtacaccgttggttgtgtttgtcagcaagcaggtgtccaccctcacgttctctattctgtcagtggtccggttcttgcctaagcttccgatactgtcaatcaaacaagtgccacgtgtcagtgacattggcagttccagtaacagaatcctctttagaaacagaaaaatctattgttatactgatcagagatcatgggcaaagactggcatggaatcctggaaagtactgcaacctgatgccatgtccaggcccacatgatatgtccttcactcggacgtcagagcaattgccaaccattgacacgcaatcatctcctgaagaaagtgattaaacagcagattaattaaccaatcatccaaatatcagcggtaatcactgcctgcttcaaacttcaaaggaagcccaagattctgaccaagagcagcaatgtatgacctgatctcttatcaatcaactacattaatttaacaactttcaagtattccttttccaggtcaattattcgattttgggcgccgacttggcggatttgatcttatcttgaataacaaaatgcgaaaaatggaatcagatagctgaattagtttgaccagaagtaggagagacactgacacactgtctcagaaagtcagcatctgaaactgaagattagtccaagcttgcaagcaagtacattccgaattttgtcatggcattggcatgcacagcacactgacctgtggagatgaggttgtccatgatctgggcatgggtggtgtcgttgaggtggatcccgtcggtgttcgggctgctctccggcgccacgacgcggaggaagcttgccttgacgtccgtgcaccgggtgaacatcaggtggaactgcggcccgttctgcatcgtgatcccctgcacgctcacccgcctgcactcctcgaactgcagcgcctgcaattcaatgcaatgcaatcgcagagagaagaatcagtcacggtcgccgccggcgaccgtactccggcggccggaatggaggagcgttcgctctcgctcaccttgggagcagacaccgtgctgcaaggctgcaagaacgcaagaagagcaaacgttcagatgatgctttgatggttaacaatggcgaattggttgttgttgttaccttggtcttcttgcgcttgcaggagcgcgcccaccactcggcgcccatgccgtcgatggtgccgccgccggagacggacaggtcgtcgacgcggaagacgtagagccacttcgtcgggtcgcgccccgcccactcgtcggggctcgccggcgccgcgatcgtcccggaaatctgtcacaaacacaatgcagctcgcgtcatcgaatcgaacagacgaacgccgccgccgccgccggcgcgcggcgcgacacggggcaagcacgtacgtaccatgagcttgagcttcttcttgcagggcccggcgagccgcaccggccagatctggtacgtcttcccggccggcacggcgaggacggccggctccgtcgaggcgcaggcggcgttccaggcgtccaagaaggcctagacacgaaaagacagagtgcaccgtcgtgccagagttctcgccgaccaaaaaaaaaaattgcaccgagctcgaacacctcacctgcgtgtcgttggtaatgccgtcgccgacggcgccgaagtcgtcgagggtgaggagcacgcgcgcctcgccggcgccggagaagaagagaacaccagctgcaacagccatggccgcaacaaccagccgcatcacggacacacgaagaatcgccattgcttcctgcaccaaagaaccgaacaaggagacgacacgacacgattgaaggagaagaagaagaggaagattagaggaagcagggcaacaaaatagcaggacacctagcagctgctactaatagcagcgcatgtgctgccttgtactaactaggttgcttttgcggttgaatcatccatccatggcgatggatagcgagatttaagcatgcaaagcgagggggggggggaattttgcatggccgtctgtggattgggcaattgcacatttgcacaccctgattgcgacttttgctgattgatttggtgactaaaagattccaacttttgtgcttgtgtacgtactttgtgtaggttggtaagtaactgaatgtgatggctaataaatcagctgcataagtcatttcctttgtgctatttattagagatttttttcaaggtaattaaatagacataaaggtagtaagaatttctccaaatgggggaaggaatcagggccatttggtggcaactggcaaggttgcatgcatgacatgaggcatgtagtaataatttatgcactgttatggtaaaatgttaatattatttttttttgcatttcaaacggtagcagagcaagagttgcattccatatttccatgcctgctatgctgcttagctgtttagagctcttgcgtcaaggaactgaaagcgctggaagctgaaagaccgatcggctcttcttcagtttcacctcttatttcactttttcttttctgaagtttataaaacaatgatgaaagcatttacctgttatgacctgacctaaccaaacagctagttacagcgtgaatttactgtaattttgttctgttgtttgtcaactgtctgtaccttttgttctattatctatcaatcagtttgttgctttaaatcctaactaccaaactttgccctctccagaatcccattctgatttgtccttgctaagcattattccactactaatgcaccgattagacacctgcccttttcctccctctgaatcaagtagccacttttctagctctcgttttctcagggacacttttctagctcttgaaaagcatcaaatgataaaaacatccacatgagaacattatcctgcttctggcaccttaaatgagtggctcaagcgaatctaagcactcagttgcttttgtcagataatctaggtgtaggtgacgtcttgcataatttctaatcggagtatttgagatgcatttgtctgattctagttttgatccactgaactcagttaaaaatgttattagtgagctgaagccttcgtttacaatatgagaagcagaagcatcaggtaaagaaaattcagtacgtacttgctactgtacggttttgcatttacagacataaaccaaacacacgctcaaaagtccaccttcaactaccaaacagtgcagtactgttctatgtgctaagaacacagaattatttggccggcatccatcttcatgctgtcaaaatgcatccatcttcatgctgtcaggactgagagtaactctgttactaggaacagaatcatttctgcattgaaaacactagctgataaagagccgcatagatatccagggttggcattgctaaatgctctcctcttttgcgaattatttggccggcaagtttgaacacgatctgtccttgtgcaaatggcaaattctgaacaaaaacgttcagctttctgactcctgaatcttcaaaggaagcagctcaccatcatcgcaggtgccgtgcttcagaagggtgctggaggatgattaatgccacgcgtaacaggaaagaaagaaagaagaaaaagacgaagaaatgccattcattattaatccaaattacagaaaaggccaaacaagtttcagagaattcagaaaacaaaaaagttgattcacaccagctgaggagcaacttgggtagcttcaggtttcagctctccttcgtcagaaagaaaaaatgagtttcagtttcaagcagcacaggcataacgcctgccaaattctgcactagcacatgaggttccaaaaaaaaaaaactatacaaaaagtggaggaaaaggatattgcagagcaatttttttcccagataacacaacatttagcacgtcgttgcatatgaaaaagaaaatctgatatcgtccgaatagattaattacaagaaataagattatcaagctctgcagatgatactccacggacacattcactgttcacatgaaaaatacttaatagttcatagttgcttgcacgtcatagttttctagtgctaatcacctacttgacatgaaacaatttacaagataagcaaagaaactatatgaaaaaataaaaaggctacgaaatggactaatggattggagcatgatccgatcagatggggaattgcatgtatgtacagatgatgagacgatgagtcgctctagctctcgacggatcacgacgacgagtggcgcctagccttggccttgccgccggcgacggcggcggcggcgccgccgccgctcctcccgcccttgccgctgccgccgaagaacctgcagaagccgcacacggcgacgcgcggcgacggcgggtcgagcgccggctggacgcgccccgccgccctgtacccgccgtgcccggccgaccggctgcgctccaccctcgccgccgcgccgccgccgcgccgtccgccggcttgatctccccggacaggtgcctgtcgtcccacacgagccccgacgagcccgaccgccggaacgtctcgctcgaccgctgcagccccgccatggatcgatcgatcgatcacaaaaattcccgaaattcacaggatcagagacccagaagatccgctatatacgaagaaaacacggggggtggttcaccgagaaccgaaagatcgaattcttattggggaggggaagatagtggatgaaaccgatcgatgatgaaaccgaaagggacggcgacgtgtgatgacgatgagcgtaaaaataaaaataattcaaaaaaatataaactaaaaaggaaaaataatggccgccaccggtcacttggctccggagataatctactctgatccggcgatcgatcagctcaactgttccgaggcgaaaaaggagagaaaataatggatttttttttctcatcggcaacgctggttggcgggtgggcaaatggatataaacggtggcggcttggtccaagaacgtggacctactccaccgcaggtagttcattcatatttgaccagaagaacaggcatggatgatttgatcaagctctaatccgttttgggttaggttaaccacgaggttaattcttttttttagttttatagaaaaatgcccgtgcattgcaacgggtgaagactattttaatcttattattgttttacggtttagctaaggtgaaattcaccgtgggaattcgcttgtatattctttttataaaatcatgagccgcaattaggggtctgattgtctcaaattagcatgcaagtttttttaaagagatttcttatacaactccttttgtatttctaaaacgaacaaaattaaaaaccggctcaaatacagatttatatttctaaaaacgattgaatttaaaaatcgattcaaacatggatgacatactaaaagctgacgtttttataatagtagagattctgaccttgtgtgtgtgggaagaattattctagcactagtccactgtagtgtgcagtggagattgggaaaaacggatgtgattcgagcggacgagcaccatccagtgtttgcacacttgcaccgttggtgaacctggagctgcattttgcagctttcatgatggattcgttcggcctaaacaatgattggacgtggatatagggggtgtttgggaagtagggactaaatttagttcctctcacaaaaatataagtccctatgatagggacttatgtttttgtgagatagactacactttagtccctacaaccaaacaccaccctaggtggcgtctaagctttcatgagtagtacggcacggctccgatctggcatcctccgtaacttggacgcgagatgtattgtctcgatcgattttgctttccaattcgatcattaccgggtggcgatgtcaaagaacaggggcaacactggcccatgtgatgcttgaagtgtgaaccttggaactgatagcttctgccggcttccattccaaggtgggacattcagtttcgttcacggaaaagctccaaatacatttccatgccatggcaccaccactgaaacgaatccgtcatctgtcgaaactgcaggtcgacagcatgttgtcgtcactggacaaagaccccattgaataccatggttcaagtacagtggataattgcagatatactgatcataacagaagtctccatgcattgtatacacaaaatactccctccgtcccataatataaaagattttaagtttttacttgcaacgtttgaccactcgtcttatttaattttttttaaaattattatttattttatttgtgacttattttattatctaccgtactttaagtataacttttcgttttttatatttgcaaaacaaatttgaataaaacgaatggtcaaacattgcaatcaaaaacttaaaatctcttatattgtgggacggagggagtacttcctatccagtcaatgtcgcccacttgacactttggcagcaagtgtgcctgagcatttcagcttttggattggtaatagtacatgatctgttccaacagcaaagcaaaaacaagcttcgtctttgcctgcacgggaaatgcattgcatcttaattagcaatagctcaaagaaagcaaccaccccagcacaaactacaagctcatggaataagccctcggaagggaaagggatttggcgcaaattaagcagcagcgcgaggaacagcagtacaaagccaagggaggccgcagtaacttttacaacagcactggtgctgaggagttgaggtatgtacaaagccactgtacacaccttcatacaccggaaaaatggggattgcagatagcaaggggtggaaccgcagctcacgatattcaccatgtcaagtgaacaagattgaaatcaggaagcctttctccggccggtgccgctaggacttctggggctcatttgcttatcctgtgccatcagagaactggtgccactagtcccatgatacatcaagcgacgaggagaatcatttctcatgctctggttctctgcctcaagttgtttagcctcctccattagcatagataactgttcacagaaccaagtagccattagtggcaactccctttaagagcagtgtaataagatgcaggctccactcacccgaagttcattttccttcagacgatcctgaagtacagttatagcagggctcaaactagaatagcagaatgcaagataagttagcagagggctgcacataaataaacatatcagccaattaacagacagagattgtgctactaaccaatattccattaatttgcagagagatgagttgtatgtagatgcatggtg

SEQ ID NO: 38666 - DNA, 4195 bp, Oryza sativa
ccatttggcaaacttaagagaccatagatcagtcatgctacaattggtttgtttcaaaacagaacatatgtgacgtggatatagctccatgagaaagaagtgtcactggaattgtgtttattaaatgtatgtttctagctgatagggacttagagatcctatagaagcaggtgtcacagaaagtaagtcagcctgatcattcaactgacatttctacagcataaaaaggataaatgcattttacgggaataacaagttttcaactataatacctaatgtccatgtttgacctgtgcaacgcctcctggatgcttggggtcatatctgattcatctagatcaacaggggtctcaggtgcattattgggatcgtatgcaactatagcattttctttggattgatgttttgctgagtgattggcgtcaaaatgaggatagaaatccacatcagaagattttgcccacacctagataataagcacaagcacagtaagtttaccaatattaatatacttgcaggaaggcacacagacaaattgtattgcataaatagacatctaaacaaaattatcatctcccattttaacatacatagtatagaaatttccatgcttcacacctgtcgcatcacaataaggaattatcattaaatgatacctaaaagctacgtagattcaacaaagctgtgtaattttcagacaacaattacagtagaggtaaaatgtgtctccaattgatatggatcagtggacagggttgcccaaacaatgtagtgcatgctatctgttaatatctgatgtacattggttcatgtaaaaccatatcaggacatgtataatccatcagaagaattggtcatagtcataaatgtcagcagtcatcctgtggatgttatatatcaggctggtgtatattcaagaatgaaaaagcatctgccagatactactgagcataacaatcataactgttatggggcttggctgatttattggtgtcaatacttaagatacaaaacccatatacaatatctttattacataatgtttatcacttataagagacagtatcatatcccaatgtaaaatcagatggatattttatgactacaaatatatatcatgagcttatttcagtttgttttcaaaatgttctacatcatgtcatgatgttcatacctaaaaaagaatagaaattctatgttttccattgacaagtgatcgcttttagaattgccatcaacgaacataagttacacagaataccatcggtgtcagttgaccattagtttaactccattaaccctgtgcaaacagtccattttacccctagaatatactccctccatctcaagatatagctacttttggaattcaaattttgtctcaaaatataggtacttctccacctaccccctcacattgaccaatcaaaaccatcccccattcaatctctccacctcatttcaaccaatcacaatcatcccctattcaattccacctactttcttaatattcccgcaaaaacctgaaggtagcaatattttgagatggatggagtccaaagggtaaaatggactttttgtatggggttcatggatgtcaactaacggtgatggcaatagggaaggaaatctcttgtgcgatggtatttcatagaactcacgttcgtcgatggcaattcgtaggattgatcacttgtcaatgacaaaacatagaatttctcaaaaaatcaaactaggttgctattaataaatggcaaagcccaaatggatttggatctttgcacatttcctatttagctaactgtttcatctttattcattcattaattagatgttttatttaatccaaaaaatgtaacaatgccacttaggtatccttgcatactatgctatgacagtgcaacgactaacattgccacatgatcaggtagttgtagaacattgctagtgtggtttaaatgttgcccatcaaaagggaaggcatgggaggcttctagaaggacacatatcactgctatgtaagagaaaaggtcattcttggtctatatatattgcccaaacagatggaactgttaagtttcataaacataatttctatagcgccacaaagagccagatctaaaatccacttttcactcttattgcttacttttttagtacagaaattgcggttgtggaatcctatcttagagaccagccctatattttcttaataaaattgaaaagaaatttcatgacatgagagtacaacgaatacaagaataaaccttgctatttcttgaagatttagaatcccccgtgtcttgttcaatgccttcaatcaatgccggatgtgaggtatcatccaacgaactccaagatgattcaaggttaatgactggatcattaacaggaacaacagattgctgatttccaccaagtgactgaaaagcaatcacttggatttttccaacctgtgggaaccaaaaaagaaatcaattcagcagggctaattaaatgtcatgggtgccccaaactagaagtaaacatgatgtgcatatgaagtacaagaatcataccttttgagcatcttcgctaaaacaagagaatatcagacccacaaaacctggctccatcaactgaaacattgcctgggtccgaacatctgcagtatatgactcatgtaagtcagatataacaagcaaagtccagccctcactgcaaacgggcagcatctcataagagacaaataaagcataaaagcagatgcactagcgaattccctagatctacattgtcatcgtcaatttgtcctgatatggaccctctactgccttcgtactcagggaagtataagttggtgccataacggaaaaaatggagtaaacccacatgcctaaatatagcattcccaaatacaaaaaaagcatacattaccaccaacaaaaaggaaatgggctctagcataattaacattcgttttccaaacatcagataggataacgaaaggtttcacatcacttcaaattcaaaatggcattagtacaataacacaattgcaatcaaatttcaaaaccgtgcaaagttccatatcatctcacgacatcacaaatacggaatgcgacaaagtactgcacaccaagggggttatcagaaggcgctccagccttagtgaagcacagcaaattggaggtaacttgaaccacctacctacatgggaaggcagaacggtgatatgcgggtgcgagtggtaccatccaatcaccctcgttttctcgccgatggtggccgacaagctgtgcgaacagagttaagtccaactccaactcccgaaaccccaacattaggcttctcaacacaaaaccaaacacacaaaatcacagaaatggaggggaaaaaggatatctcggcctgcgccgtcgccgccgcgagcagctcggggttgacctccaccctgtccttcttccgctcgcacctcatctgcggcgacgccccccatatcagagcagtcaccccgcccctgctcgaatgctgcgaagcaggcaaaaaaccaccatgatctcaacaccagcaagcgccacgcattcgcgctggaggaggagcaggagaacggggagagaggagaagcaggtgaccttgatgtcgccgaagaggaggcccatgacctcctccgtctcggtggtgagggcgtgggagaggcaggtgagccacacctcctccccgatcctgacctccgtcagcgacatctcctccgcccgccggcctcctgccgccgccgccgccgccgatccggtggggtttcgggccgcggcggaggaggggttgggtttggtttggtttgcctcttcgatttggcttgtagcgctgcgcctctttgaagctcggtttttttttttccttttctttttctttctcgtgcgaaatgggctctctcgctcgcctctcggtcggatgacggctgcgccgctggctccctggccttctgttacgtgtttcgctgcaaagtggggccctggtctgatgtagccggcagatactgcaggtggggcctacctcaaagtagattttgctacggcttgtttggtaactcgacgtaaagggattaggagtttacacaagggaattaatgatgagattaagatgggaatttgatttttaatcccaatatcttgtttgacaggggagatggaaattgatagggagtttagttggagat

SEQ ID NO: 38667 - DNA, 5053 bp, Oryza sativa
aaaacacttaatagcccatccctctaaactcccaatccctccttaaaaactcactccaaccaaacgggccgctatagtcgtgacacttcgatttggcacgtcagcagcaatcccgcttattaggccccacccctatgttggagaaggctaatccacgaccagttccccactgtgagcctgcctgtttaggtctttaggggagtttaagattttgagaaactattgttgaaaaactaacttgtgggaatctgaagaagctagaaaacctagtttctcgcttttttttctcgcttctagttcatttttcagattttataactacaaattctcaaaatttgggaaccttgagaatttaggtaaaaaactggactgtttgagagagctgttagcacctaaaaattttaggagaagctgcaggcgctaagttcgtttggagaagttcccgacctttccctatgcacaaacaacggaagttcaggcccaaactacatgggccacacgtcagcagcgatcccgttacggcctagtacatatgggcctcacatgagccgcaatcccgttacagcccaatatatatggaccggaatccccgttccaggcccgactgagaagagctgcaagtgtgttacggcccaattaaccgatgcaccgttgtggtcgtggcagtgccaagcgtggtgaagtgctggcttgctctcggccgtccatggtcgatccaacggctgactaggggaatcacctgatccccttaggagggcctcatcgtttggcttttttttttaataagccaaaacggtttattagagaataaaaataaatttgttggttaaacttttatatatgttctcgttgacttaaataccaatgctgaaaaaaatacattaaaaatatctcaaaatcaatgttacaatgtcaaaattaagtttgaaattttaaattttagctttctcttaaaatttaaattttaaattttagctttttcgttggcttaataaatagggcatctagggcatccgatgagagcctcttatggtcgagtgtataaaaatatgaatgatccaaagtattttttaaaaaaattctgtgatcacgagtacaagggaagatgatacggtgaatgtaaacacatcgaaatgataaaccacaaatgcgggctttaggcccaaacttttattattgttacgccataataaacagaacacagacgagaaactctgacgaaaacaactgaacatcatcagtacacatcacccacacccgtcagaaatcctcccctgcgacgaccaccacttcatacagcatcgatacagactcaaaacgacacaaaaacaaattcaaacttgcaccgaatttgaagtgaaaacatacataaatagacccaaagggaaatcattcacggcgtctagtgatccctcgccgtcgtctccgtggcggcggcggtggcagaggtgtccttgttggcgccgtcgtcggtgccggcctcgtcttcggtcatccccagcgtgctcatcaccgcgtccttggcgccgaccaccgtgctcttcacctgctcactcgcctgaaacacaaacaattctcctcaagatccacaacaatggtgttcgacgaggagaaactaatcaaagagcaattttacagtgcttaagaaggtactactttttctattgtaaatttaataactggtaccgtatttttttatctcacggtacctctgctccccgcaaaaaaaaaaaaaaaggaggtagaattgcttttaatcctgtgtgtacctgttggaggacgctgccggtcttgtccttgccggcgatggcagagtccttggtgtactgcgccgtctcggcggtcttctgcttggcggcgccagcggtctcggcggccttctgcttggcctgctcggtcttctcgccgaggaagccgccggtctggtccttgctctcggcggctttgtccctcgccgcctgcgacgtgctggaggtcttgtccttcgccgcctgcgccgtctccgacgccctctccttcgccgcctgcgccttctccttcgtcgcctccttggtatcctgccccttgccggcggcgtgccccgccgcctccgacgccctgtccttcgcctcgctcgccttgtccttgctcgcccccatcacctgccccgccttctcctgcacaccaagaacaatcaagtgatcaacaaattaactggaagctcgccggagctggagaagatggccggccggtggtggctgacgctgacctcggtgtgggccttggtctcgccggcgcggtagctagcctggtcctggtgggaagccattgatcctaagcttcaaaaattaacctcgaaattcacgcgcgaatgttagaactctgatggattttgctcgattatcttgatcgatcagatttgcactggctgtggcgatgggattggaatggaacagtatttataagggttggcatcgagacatcctccgggacacgtagcatggcgagacgcctacacgatggccacgtagaaaggacacgcgttgtgtaaggttccgtaccttcgcgaagccctctcatgcgatccatccatccatccatcgatgcaagctaaaagccaaacaggagaggactactatagtatactgttgctactaaacaagtgtatttatgagcggctgagagctcaggcacgtgccgatctctcgacacgtgggcacagcgagttgaaactgatcatgatcagatcgatcagtgtgtcgatacaggcgatcgaaacgtcgatcgatcggtggctgtttggcgagtacaagttggatgcggctttagtttttacacttggtgatcgatcgggtgtcgttgccatgtgcggcgcctgatgtcgccgatcaacgtgttcaggtctgattgtaaatggtgttgttgttaatttggatgcctgatgtgttctgctacctttcgcttttgagtgtacttctgccacaaaagtttggagtgtgtagtaaccactttggcggcaaagggagtaaacaatgttaaggggacacatgttaggaaggtctcgcactcaaatgagtaggcacagaagcttcgggagatgcatggcattgttaacgattgttatcattacatgggtggcagatgtttgcggtttaattacgagtatctgctcatcttttcgagatcgagagaaaaagagaaagacaaggtcaatcatggggaatggatgccatgggctcaccatgggccagtaattcggcctgacgctgtgacgaagtgggcttctcaaaccaaaattactgggccaaattcagcctggccctgacctcaaaccatgggctgggccttgccgattaactcaagtcgatcaccacagatcaacaaaggatgagtggtgtgtcaccgtacgatgacacattgagcggccattattgatcgcacacaagcatcctttggtcatagtggcaatcctgacctgcactgcactgcacacaccggctaggctacatcgatcgtcgccgtcgcagcgtagcacgcactaacccatgcagatgcaggatgggcacgcactgtgccatccatcgtgctagggctaggcgtaggttatggaggccctttcgtgctgctagcctcggtgcagcatcgaccatacgtacatattgtggcatcggtacacgcgcgtatctcacctgacacgtccaacttcggggctcatgggtaagccccataggtcggtcagtcggtgcgccgtagtgctccctcctccctaaatataagggattttggttagatatgataaatcctaatacgataaatctagatatgaaatatatcacatcaaaccaaaatctcttatatttagggacatagggaatacttactttgcacgagtgcgattaaaactagggtgaatagttaatatggtccttgaagtttcgttttgagctcagtttagttcttgagatttcaaatcgtccaaacaagtcctctaaattaatcatttgggttaatatagtccttagaccaaaaaaaatgccacgtgagcatgccaagtcatcctcaatgaaatgactattctaccattatataccatatagaaaagaaagaaaagacaaacaggaaaaataaacaggccagcccatgcccaatattattgcggagggtggccgacaaaagaatttatacgatcagtgcttggttgtagcaatcataagtgacaattgtaaaacgatcatacacgcgtgaaaacatttgttttctttttttattcttttctatatggtatataagggtagaatggtcatttcattcatatcgctgcatgtgaggatgacttgatatgctcacatggcactttttgtgagtccaagaactacattaacccaaatgtttaatttagaggacttgtttcgatgatttgaaatttcaagtactaaactgaacccgaaacaaaacttcagggaccatattagctattcacccttaaaactataaattccttaccactgcactattaagtgcatctgatattctgataagtgacgtaactacaacctacacaaagttagaggattgtattttctggctggctaccttacgtacgttgcacttgtagtcggtagtccccttccatttgggtcgacgactagcaccatagcatcgattctaggtactgctatacagatacaacgtaggagtactgctatacagatacaatgcatgcaactatatatgttttacgttggcctgccatgtgtaagtgcaactgcaaccaacaggaccagctccactatagaaagcactatgtagacgaagacacttatattatagatgatgaaaatataatggtggcgaaaatttcaggccgttttttattttatctatataaaaaagtaacttttacaatttctatcacagacgtatggcagtcatcattaaatagttaaattgacaaaataaaaaatccttgaccgactgactatcatttctatagagatgatattgatacaaactgttttcatacatatatgaactgcgtccatctttgaacctctcataatatataacagaggga

SEQ ID NO: 38668 - DNA, 24870 bp, Oryza sativa
tagaatgtgcattgtgcaaacgacagtacactacactacaccttacaagacagcaacaagcacgaacttaaactgccccttaattaattgcagctaattaatcaccagttctctgaaagaagttagctcaagattaatcctgtcagtattactctttactcttttcgtcctaggttagtgaaaaagttgagcacttgcataagcaataagtggctaagtgacttcttcttctggtagtagtttctgaagatcgagtcgatctggtatctttctgcaggtaaatcatgcaaatgcatgtatgatagttgaccctgcatttgggccggctaggtagcgcatacatgtggattgtggagttgtggacttcgctatcatcgctatctcgtagagcaaaatcattgttggtatgcaccattgcaccattgacaaaaggctgctgctgttcacttgtcctttccagctgtagatcatgcaaattcatcggatggccatcggtagtatataagcaagggcaatggcactgcagctcctcaaccaacagtgcagtcacactctcgcacactatctgcataagaaggggataagctacctgattcatgccatcagtttcagttgcatccagcatgagcaagctcaagttcttggtcactgtcgtcctcgtgatcctgctactgttcgattcatcgtcttcaggcatgttgtttatcatgttcttgttcttttgtgtgttggtctgtcgggctgtgtaatactgatcagtgattttttttcttttttgcttggtccgtaactgattaatggacagttttaatttatctgtcgtctaaatgcagggcaagctgagacagcatataccaattatgaagtgacttctaaagtgaaagaggtatgtacttaattatccatcaatctttgtagtgaccatcagagagatgttagggtaatatatatttcagatctatcttggtgcttttcacgattccggtcttaatcaataactccgtatgctagctgactttaatttttgaaggacccaacatgattcatgacagctgacttagtattaacgagaagaaaactgtataacttgccctgttgtgcatgctaaatgtgcagaggcgtgttagctgataaaaaaaatgactctgaaactatctaatgttcgctgataaatacatgtgctggctgctgttggacacaataatcatcagaactgtgctatgatcagtgatgttttctttacagaaactacagttttcagtcaagtatgtatgtactaattaagtttcatatgtccttaccacctcagagaattcagaaacatagcaggagggttctgacagatgttcaggactatgactatggaggacccaaccctagacatgaaccacgtaagaagcctggaaatggacactaatcgcctcttctccacactgaaaccttgacaaagataagtcagatactcagatgatcccaaatgctacaatcaccagaccactatcttactgtaatgtactagaattaagcagaactgttaggtactattgtgtcgttaattaccttgtaatatgttggtcaggtgcatggagttcaggtcattttagacagtacctgcgtgtattcaggtgtgtgcttatataactagcaactggtaaaatacaactactgaggacattttgtaagttgagacttcagatatgtgagctatcttgtttgcaaatcttcggttgtgttttgaataaaacgagcattttggctccgtataaagtttgaatgttcagagtactcgtcaagttgagagcgttgctcgtaaaattcagttaagctgtatgtattaccctccacagccagcgaagatgtaagaatatcagtagcaaaaaatctgaaacacatcttctctcttaacaaatgtgcccttcttatatctgataaaaaaacaagataatatttcacgtgtaacagacatccttagctgctgaattcagaaccgagcagtcatactcatctgcagtagttcagcagcagcagatcctctcgtcctcttctgaaacacaaaacagacaagcttctctcgttactccaccctacaccatccatttatttcttcattcacctcgtcattaggaagccatgcaatcctaactagtttagaccaattcatacatccaaagaaaacgctccaatatatataatatattcaggaagcatcttagtacttgcgacaaactctgaagactgttagctaggtctgaatctatttgatggcgtgctgaattttgcctgtctcttgatttttcatttttgcataaatccgtcattacacacaaggcaatcatcatcaccatactaggacaagtttctatccgttctcgttcttatccgtgatcgaagcagtcgtgcagcaattgactctgcttccagaagttcagatacctgaactctcgagaatgaacagtgctgcatctgtgagcttctttaccctcgcagataggaaatcacaactgcacacaaaagagggtagcaacacctgcagaaaacacatgaagatgaagggggggaaaatggcaactgtatcgttgccttgtagtgcagcaatgctactagttttttttttttttttggaaagatttctaatcaatctctagaagcgttgttcggtcagaaacttcaactgccaaacagtagtttattaatgatttctggtgtttattggctatagaaattatgagcaacggcctcaaattgggacttctaattttgttcagcagagacacacaaagtcatggtcaaaggagatggcttgcagtacttggtcgttcattaagcacatgatgttgagataattacccggacttggactaggctcctaaagcacacctgctctttatgattaaagatgaattaagtactactagtatagtattagctatcggttactagtaatactattttggttagctcattttactattaggaaagcaattaagtacacatcgctttagactccatcaagctcttcaagcaccttgtgatgattcatgcacaaggctcttaatggagatattgccaaattgctacgaaaacaagaggctttccaccgtccacgtccctgaaaaaataatagtgaaaattgatctgtcggccatttctcgtttttctttttcctacgcaagacgtttcctgattggatatctcatcctcgtctcatccgtcgtcgttgtgctggaaggaacaatctgcatgtagtagctttgacacctcatgaggcaaaatataaccggtggatcacaattttctggcaaaaggataaactatttttgtttgataaaattaaagccacaattttctaactcaagataaacaacaaatggtggtttgcattgtgctataagctagacaagcatacgcttttttatttcagatggtggtttgcattggtctattctccaacaactccatgtttttggtggcggcaggtcagctcatccttttcctcatgttgcgtaactgcatagcttcatccacaaatatgctccgtacctgaggtttggaggatggcaagaacattcatcgcaaacatggttcggattcgctgtaattttgcaaacctgtggttttgcctgacaaaatctgacacatttttcgacgcgatcgatcccggcaagttgaatcgttctcttcgtataggcatatgagttcagattccttccttgccaaccctgaaaccggaggagatcgaatctctcaaatctgaacgtgcaaccgttgcagtaacagcgtacgcaagagagagatccccttggagaagacacacgattcagctcaccagttggtggttgacatgaaccgctgatgcagagatcactccacacgcgaaacacaagcgactctgactgacgtacacacggcgatgcgatgcaagtgcatcttaagaaataccgcctcaatttcgaaatgcacgacactacttacttttcgcataatattacactattcatcttattaatttttttaaaatacataaaagtataagttaagattatattttctttggtaataaaacaagttcaaataaaataaataatactccctccgtttttaatatatgatgtcattgaatattttagatacgtttgatcattcgttttattaaaaaaaataattatcatttattttattgtgacttgatttatcataaaatatttttatacatgtaatttttttgaataagacaaatgattaaatatttaaaaaaagttaatggtatttcctccgtttcacaatgtaactcattctagcatttttcatatttatattgatattaatgaatatatatatatatatatatatatatatatatatatatatatatatatattgcgcgagagaaagagagaggattctggtagcatcagcgagacgtgagcatgcatggcactagcggggagggagcggcacagcgcggcgcggggtcccagctgagggcgcagcggacgacagggacggtgcgcgctggggcgagggggcggtggcggcgagtggtggacggcgacgcccaacccgatcgccacagcctcgtcagcgcacacgcgcttcacatgaatttttatgtcgcgcccgcggcccgcccagccaccgcaccgcatcactgagcccgaggcaaggagcagccgctgccggccacacgtggaaagaaataggtgataagagcaaaattaattggatagccaactacttgctctaattcatctatagccaatttaataattcatttatataatagttacatactatactattaatacctggtcccgcctgttatacacatactgtgtcttagagtccgtgctatagccgactacaaatttgtagcccgttgctcttctctcttcttatttatctccttaaaatatgtttgcagctggtttatagcctgttattgtacctgctctaatcctcctgagtggttgggaatttgggtttgtttggtttagtgtggtatattttgaagggtagtattttaagtgggtgtgtttagattatcaaaatttatgttatggtggagaaaattttagaatggtgccaaattaaccataggcattaccattcacttggctctaaactaaaccattacatttactactccatccgtcccattttaaatgcaaccattagtttctgtgcccatctttgatcgtcctgtcttatttgaattttttttataattagtatttttgttgttataagatgataaaacatgaataatattttatgcgtgacttatgttctatttttttaaaaaaaaatttcaaataagacggacgatcaaagttgggtacggaaaatcatgggtacacttataatgagacggagagagcactattaaaaaaaaagggttgttcaaattgtagccaaaataagacttaccaaatttttacattttggcaatattgtcaaattttgtatttcttatatatttaacaaagtttggtaaaaaaaaataaatggatgcaattttttagaattttactaaaaattagtatatgatttaaaatgacattaatctgaacaacctctaaagaaaatggtaagacataatttgacaacaatccaaaataacattttttttcctttgaattgacaatctttttcaccggtccggtgattatcttccaatggttactccttgacttattacttcttagaatttactgtgggctaagatgttgtggatattttagctaattttctgtggaaggtgaaaaagggccggtctttgtcattgctttgtcatctgaggacgaagaaaattgtatccgtttggactgcttttgataactaaaaaaggcgaactttcttttctcagcaggggacagaggtgataaaaaaaatcgaagaacaactccacttggagtgataatgaaactgatcttcatataagaatatgaaccttttcttttcaagtaaaacatgaactgaacttgtttcaacttcatgcagctcagctctacagtaaatcaaacagtaatcacactccaaacaaaaacaaagtgtttcttgggtgcccatctcaaaacaaaatgaacgtctatcgccgggccgaaacaaaatcaactttggaacgagcaacttcgcagatcctaccagtttactccagcttcttaacttcttgatactgactcacaatctgttcgaacaaactctctgtcctccaaacgtggtccaaaaccaaatgccctccttttctcctgatcaagtattccaaccaacacgatcaaggaaaacctcataaaaatgcaagctttctcctcttccttcaattaaaaacgcacaaactttctccaggtcagtacgtaagccacttgatccatccaatcaatctccagtagtattgtactaatctctcacactattacaggcttacagcacggtcctgaaactccgaaattcgccgaaaattctggacctcaagctcacgactctcaagtactccgaattatctcatccttcttctccctcctcccgtccgcgccgcgacgatgcgagcgcaaccacgtttgactcagccgacggcgaccggccgcgtagtacgcgtgtcatcgtcgagctcgagcccatccatccacgtgttcctcctccttcctcgcggcgacgccgacgacggctataaataacccgcgcccccatcccgaccaccgctcctccgcctccgcctctcatatttttcccatttttcacctgccttaattcgccctcctcccataaccgtagtagtaatcgtactcctccattctcgccggaatccagagcgaagctgtaggaaattgttgggaggaggagcaatgccttactgcgaggtggacaggtaccagaacggcgacgagtgggacggcgtccgcctcttctaccgccgcttcggccgcggcgccaccaaggtgctcctcgtcatcggtatgtccgtacgccgtcgatgaacccatcgcctttgccggcgatcgaaaattttctgcgttttttttttgcctttttgttttcttggttctgatttgagaaatggtgggtgtggttgggggcgtgaaggattggcggggacgcacgactcgtggggcccgcagatcaaggggctgaccgggtcgctggagccggccgccgacgacgaggagtccggcgacgccgcggcggcggagggggacgacggcgatggcatcgaggtctgctgcttcgacaaccgcggcgtcggccggagctccgtgctcccgcacaaatcctactactcgtgagtttctctacttcctcctctcatcgtcgtcttctagatccaaatctccaccttgtctcatgatcgaggaggcaaaatcgttcgtcgtgaggtgtagaagcatcgcgcccaatcttgagagagatctggaggagggtaaagattggcgtctcatgtagctttcgatgagaataaatccacgttctactcgattccagccgcgattgctttccacgagaaaatatgtgacggagaggaaaaggacggagatataattttcctcgaacgcacgacgcggctgtgcgggaaaagtcagacgagtggcggcaatggcggtgtactggtgttagttactgtctgaccatgtgaatgtttccattgtcttgacaggacggtgatcatggcgagggacgctctggccttgatggaccatctggggtggaagaaagctcatgtattcggccattccatgggtgagttcatgagtctccatctctgcgacgctgaatgatgatcatcagaattttggcggattgacttcttttgaggggaattgtgtagtaagtaggagtttctgtaagcattgccattgatgttgggtggtctttgcaacacaggcgcgatgatatcctgcaagctggcagccatggcgccgcacaggatttgctcgttggcgttgcttaatgttactggaggtggcttccagtgcttcccgaaggtaccggaatggagaattctgcttgtttatacctggaattttgcagaccttgcaggactgtcgactctaatttcctctgtagttctcatcaatgaagcttgtctgcatttgcagttagatgggcagatgctctcgcttgcattccgtttcttaagggcaagaactccagaagaaagagctctggtagatttggaaacccattatacaaaggtgaaaatgcatccatttgtcatatgccaattgatgtaatttttttcccttgacattttgagtgttaacatccaatgcaccatgctgcgatgcaggaatatcttgatgagaaagttggatcatgcacgaggagaacaatcctctatcaagtgagtttaaaagtgtttgttgttgatggtgtatcacctagatttaaatcttcatcataacttatgtagcaccaaagtccaaaattgtgggaggaggagcttcccaggatttaattttgggaggtggtgagtactaaggagaacagtatgttgttcagctggcaggagctgcaaggagcaagccgctggccagggtttgatccttggtactcattacctcccgacattaaattctgggcaggattaagtccaaaattgatttggacaaaattagttgcgtgtacacatagaatgattcctctatgtctgttcttttgaactgtataaactgtaaagtattacagtcacaagatcacagcattacaactaggcctttgtaccggaaaaaaaaacaaagctttacttatttcattgatgtaccaaatttcaattattctgtactatgtattttcaggaatatgtgaagggcatatcatcgacagggatgcagtctaactgtgggtttgaaggtcaagttaatgcatgctggactcacaatatgacaactaaagaactagatacaattcggtctgccggttttctagtttcagttattcatgggaggttagtggcgacttgagaaaagcacacatcccttccccacagttcgcaagcacactgtgtgtttgtttctcatcacttggtttaaaaatgatgcaggtctgacattattgcgcaattatgtcatgcgagacgacttgcagaaaggcttattcctgttgctagaatggtcgaacttcatggtgcgcatctagtaagccatgaaagaccagaggaggtaagcatggactttgacaaaatgctatattgttaggcagctgaaattatgctggaatgctgaaaatattcctaaatagctgaccgagcgaggcaatattagaaatcatggttccctgcaagcatcaaactctaacatagatgcactaatgggcatgtaacttttgagcccaaacttggaagaatgcttttgcttataccagttagaacgttactagatgcttgtgctgttgcaacttgcacaaattcttccaaagttgccaaaccgaactaaaggcaggccgttctctgaaagcatcattcaccacctaaactgtacaagggaagatgctacttttgaagaaaattgtttggccaactctgaaactgctttttaggcaccaatgaaatggttatcccaaacctgagatggaatcataaacatgtaacttacagagttattttaaggcttataccttctccaaatcgctgttcttttctctcattatttcatcacgcttacagagttgcaggaaattgtaagttgactcatctgagtatttctctattgcaggtcaacaatgcactaatggaattaataaaagccacaaaatctatgatgaaacctgaggaatggtcatcccagccagagaattcatcaggtgagcttagaaaggccaaacacccccgaaatctctttcgaaggctatgttccaaggcacacttcttacgctacgtctttatcagaaaccggggctcttatttctgcaagacctgtttccgtcacaatacgaacagatgatgggggaaatgccgcaatagcagtctataacttacttgccaagctgcaactaagctttctttatgtcataggagtgatactgatggggtttgagcatatgaggaacattgtaaaagtaatgaagccagtaagggtcgcagcaatcgaatcataaggtaggtttcaagaactacatcaaaataccatccagagtgtttctgaaattgtagcaaacacttaaccgagctatgttgctttaatctgcagaaacaaaactcatgtaaattactctcagagccgtcgaggagacctggtattttcatgtctcctcagtactgtggagatgatggttttagaatagcatctccgaagacttcctgagaaaacttctgctctaagcagaataagtgaacaatacggaagaaaattgatgaggtatttggtgcgcgccttggacagaagcgtcccagggcagaaatgcacaaactgatgtacccgtatgagtgtaaatgttgttaccgtatcacggccttatgctgtcgccattcttttgtatcagcatgaaatgtgattattcccatcaataataaacctggttccctgcatgatatatgtatgtaattataagtaacagtaatatgtgtaaacgcccactgaacgacacaaaaagctataaaagagtgcataaatcgtatcataattaactggtctaacaaaacaagaacagtaaccttttcattcattgccaattcacccgatcggtctggcaaacaatctgtatatgaaaaggtttggactaacttgttcctgatccctctttggaacacaaggattggtggatctccttgtctatgattaagcccaaagagcctaaagttaccaaatcttcacaatgtgcaacgtatggctggagagaaacatcttccaggttacataaaagcatgtcggcgaatcaggtggcttttatctgattttcgaaaggatggaccagcaaaaattcatttttgaacctccctaagctgtaatctgaattttttttgtacttctgattatcttcttaacttcaaaggactacgggcctgtttggtttggggactaaagttaccatgcctaaagtaagccgcacttgtggcggagaaaaagaacgccacagatctggcaaaaaaaaaaagacacagcgaacttgcagaaacatgcctatcaagttagggcaagcctatggttagtagaaaagcaaataccaacctaagtacttgctgcaggtctaagcttaggtttggcaaaacgtggccaagaaccaaacagaccctacgtcgtgtaaaagctctgctatggacccttctacaaatttcggcagagcttttgccgccttaccgtttcaaaaaaccaaaaacaagataaaactagaacaggaacttcgcaaatttgtaaactcgatgcaaaatccatgttcattagttagcaatattgtgacgccaaggttgtcaaccggaatctcaaggcaaatttctacgaaaagcccctcatcaccatccagaccacatgtacccaatcggacggctcgtacttttcaatcgctacacgaactgatctgaccaggataataaaaacagtccctttattatttgtatgccatttaaatgattatgaaaaaattaaaaaaatcaacgagataaattaatatatgataaataactttacaacatcaaatttaacttctacaagttacaacgaaaataataaatttaactatgaatatatatattaactagccatagtttaatttgttttttattacaactagtagaaattgaattttaacttacatgttgatagagtgatctatcacatattaatccatcttgttaaatttattatcattctttttataataatttaaatgacatgcaaacatcgagggattagaattcactctccatatagtagtataaagggtttatactctaaacgtacctctaaaatctcaactgttcccaatctgaaccgcgcgtatccgatcggacggtgtaggtgacctcgccgccgctgccgctttgccggcctgccggggtttgccgccgccgccgtgtctcactctcacgtaaaatgtggcctctccaggaatttctagttcaatttttcaactcgaaaaactgctgccggattctatataattatctcatgacctgaagtacgcaaatattaggaaatgacaaaatatcaaataattagaaggggtaaggatttaatctcaggttgtctagcccaccaccttataaaactagccggaatacctctggacgtttctcctccatggcatgaagtctgaactctgaagttgcaaattgtcccaaatttgaatgtggaaaggctgttccaggtgacgtgtgtcacagattaagaggacatcattaacttccacactcgagtggattaatcgaagccaataataatggattcatcattaaaatcgatcctcatccacagcgcctcgctgctcttccaacaagaagttcagaacacactctgacatggctcagtaattctttactgttcgctcaaattgctacatattatacagattgcagatcaaagtaagaaacgctgcagaaacaaactgaaagtttccggcgaaagcacgggagactaacctggacaaaacaatcgatcatggcaaacacgcacggttaatttctcccggcttcgacgacgaggagacatctgaaaacgaagctgagacggaggcaagcgtacaccaccaatggaggaagaagaggggtggagactggagacgacgatgggtggccgtgcgtgcagagcgaggcaaagcgaagaagagtacaaagattcgcacttcgcggcaaaatattcctaccgcgcgagcgaatattcctccgagcgatgctggatatgccctatacgtttccctttcacgaaggcgtcaaatcgttcgaccacgtgatccactggactctctctccatccaaggcccaatttaccgcctacaaaggcccatatttgaatgggccctaaattttgatcggccttaggtgggcctcgcttatgagagcttcgagagggcccacgtgtccactctctctctctctctctacagcgacggcggcggcggcggcgaggtgagaggaaggagaaggggatcgaggaggaggaggcaagcgcagccaccatgggagtgatggagaagctcaagatcttcgcggtgaaggagcccgtcgtcaccgcctcctgcctcatcgccggattcggtgcgcttccctttctctctcgatcctgccgtggccgaaaccctagtagtggcctggtcgtgattcctcgcccccattgaggacgctggtgttgccttgcactgggcgcctctgtttagctcgaattcggtgaccgaggattgattctaggactctctgggctggggtggatgggttcagaacgccttgatgtgattttttcgcttgctaattttctgttggatctagggttctcaaatcgcttcagaggtgttcttctttgcaagccagtagctctgcctgttccccatgctgcgtggctcaagatctcaagtagtctcatagttcatactccataagctatacttttttttttttgggaaagataagatccaattgttccttcccagccaaacagtctggtctgttgaatgccacaagtgttaagcagtgtgttttgttcaaacaatttcattctttagctcagctaaatggagttggcctgtgtaagaactaagatgcaccttgtcgatttggattaaaaaaaagaaggatattctatcagctgcattttttcttcactggtatttactagtaatatatgtctctacgttgtaatgcgccaggcccatataagtagggatgggttataacgagattagggataaaacattggatccggtggttacctatgaacgctactcgtgtaagcggtgcgtgcagtgggaggagggggcagattggcagaaggacttaggaggacgactctgcttttaaggttgtagagaaataggttggtaataatgactgataaaggtcctttgaatctcgtgctgaaatgtagtatccctggggttccctggtaactctgaattggtgttgaaacgcttgcttagtttgcattatgctgccaggggtgaaacttgaaacggtgttgaaaaggttgagggtcttcctttgtctgaactaactaaagtctcttcctaaataccagcactggatgccttctattaatcactggcttgcagaaaatggttgatgcataggaatacattgaggccacatgaacaatgagttgctttgtggcttgggaaagtgaactagctagattccatgtggttttgttctatttgaaaattacaatgattagcaatttttaagttcaatactttgcccgatgtatgggcacactaaattttctttaggaaaccctgattgtgcaaagtatcattcagaatttttttttgaggcaaagtatcattcagaatttcagaaacatgtctggagctttcccgtataatagtaaaattttaatattatgaaagtgctcttaatgtaaaatctaagtatataatttgacgtagccagtttagatagttctacatgtatttggtgatcaagctttagggatgttgagaatggaagcattaatcagtcgatttcctgaaattgcctttaaggcttcaagtttttgtctagttttgttttttgagaaaaaaatttgattagctcttagtatctttctgcttgtatttaccagaatttctgcctttggttagctggtttgtacttcgtatcgcgccttcattgaagttcctcagtagcgcattgttatttctatgttttaggtcttctctgatttgcttcctttagcaagattgtaatattcttccctgagacttttctcagtactcttcatgctagaaatgagtgtgtagaacatccattttgttgcattaagccattaaccagactgctttaatgttagttaaacatttgaacaagaaactagagcaaatttgattcctgagattttctggtatgattggattggtctatggaattattgctcatcagaggagcactctgcatgcttctatcaaataggttcagctgatcttattatttgcaatttcaggtctttttcttccagcagttgtcagaccaatgttggattcttgggagacagcaaaacaagttcctccacctgcgctgaatgatgtatgtgattcctctctgttttttagtacatcagaatgatctgcaaccatatcttagtttctgaccacatcatttatcatgtccttattttgtcatgttcataatgtgccacccaagatatgtgcaagcactagacagtcttatgaaaattatgaagtaaacttattctttgggcgttgttattatttggggcaattgcaaatttaccactactttgaatcgttattgcaaaactgccactagaaaattgcaaaaatgccattagaactgtcattcgagtggcatccttgcaatattaaaaaaaccagtggtaaatttgcaattgccccttacttattatttcaagtaggctgtaaaattccaggattgagcactctgaatattcgactggcaacctagactgaattgcacaggacctttaaaagattgtgccatgttaccgattcctttgttgacgactttgccatgcttcacctggttatctccagattcacattattgaagtactggaatatcaaccccgctccattgagaacaccagtatttaattccttctatttttggtacttctgcaggttgttgcaggcgtcaccggcaagaaaaaggagtgacttggcatcttttccacttgctaatgttgtcgcaacgatttctctttgttttgactccggatgggaagcctctcccagtccagatgattaggatcatccattcatatgtccagcacagtgtgaaaacagtactacatgtgatcggcaaaataatcgtgttgacctgaacttactttcaacataatgaaattaatgctgcaattttcagctttgagcttgcaagcaaagcgtgtggattgattggtagccttaacctatatcgtaaaattgctggtgccgattggttctgtgaagatttacaccagcagattagttgtggcaaacattctcttgtgtgcagcactatcgtcagtggccacgcttgcttgagcaagctgtgaagtcagtactggcttggaagcaaagccttggagcatcagggaagaaaccgtcgtgccagactcttttgatgacgtgcggagcatcgtcgttgtcgcgaggtataagagccagcgagacgccggcatagcttgtacacggtggctgatcggagctccggccaatgtccggcgaccagatgggctcagaaccaccgcgtgtcgccgccggcgatgcgcccaagacggaggggcgcattggcagcttcagccgcctcttgtccgggctcgacgccggcggcgtgctcagggacgtcgagccggagaagatgaaggacgagatccggcggtgggccaagtccgtcgtgtcgctggtgcggcagctcagcttcggcgcgccgccgccggaggatcatcgcagcagcaactcgatagttcacaccagctagctgaagtagcttactcttgttttcttatttaaatttaacattttttattgtagatgaaagatcatttcatctacaattcccctggtttctggcgatggaagaaatactgcaaatctgttagcatgcttccctaactactacatttttttcaaaaaaacctataacttaattaatcatgtgttaattttaaaaattcttcccgaactactactacctttttttcattctgtaacttaattattcatgtgttaatttaaaaattctataacttaattaatcatgtgttaataagccactttgctattcgtgccgaagaggaaaaattttgaacttccttgttcgatcacattattagtgcaacgacgactgcttatggaaatatataagtttgtcgtgatgcaaagtttgatcacgatagcgcgacgcaatatacaagtttgaatacgttaaaaaaaaccatgagaatttgttatagtgtacaatattcctagtggtttaatttattatgtttctttctaatattaatttattattgtatcatcacgcacgggttgatatatttagggggaaacttatattgttattggataatgctctagatctactcatatatagagggttcgagttaaacatagggttaaactgaaatctagagagggtttttacctctcttttttaatcactactcctgtaagcatttgttgtgtaatttagaagaggtaaaaagaggtaacattcactactagtggttttgctatttctattatcaatagtcctgaatttgttgtgtatacagtggtcatgactctctatattgcatgagtgcatgaccttatgggtcttggtttagtaaatcactagaaacgttatatgtgttgtttggttaattttatgaatgttttgaactgaggatatatctcaggacaattgtatttggattttggaggtacaataattggctttaagatattttttgccgttttgtttgtcttacacaatcacccatacagtccaacacaagtaattcatctaattgtgtacaggaggcgcgcccatgatctttcttgccgttttgtttgtcttacataattagttgaattatatgttgtgcctccacgtcacaggtggcatgttgtagcctgagtgaaatgtcatatccaatatactctgttaaaaattgactaggagacctttatactctcaattgtcaaaaaaaaaaaaaaaatcaacctagtattggatttgatgttttctatattcagattctttgtactagaaaacgtctcatccaatactagattgatttttttttgggacgaagggagtaagttattatgcggattatatattctctctccgtcctataatataagagattttgagtggatatgatatatcctaggacaataaatctgtacatgagattttgagtggatgtgatacatcttaggacaatgaatcattgtactacttcctccgtccccaaaataagtacagccatggttttccgcacccaactttaaccgttcgtcttatttaaattttttttgaaaaaaaattaaaaacataagtcatgagtaaagtactattcatgttttatcatctcataacaacaaaaatgctaattataaaaaatttcgaataagacggacaatcaaagttggacgcggaaactcatggctgcatttattttgggacggaggtagtataagatgtgtcacatccgcacaatatctcttatattataaaacagagggagtaggatctagacagagttaggatagaatacaatagaccaggggtgtgtttgagtagaaggagatcggggagattggaaagatacgcaaaacgaggtgagccattagcgcatgattaattgagtattaactattttaaatttcaaaaatagattaatatgattttttaaaacaacttttctatagaaattttttgcaaaaaatacactgtttagtagtttgggaagtgtgcgcgcgaaaaacgaggcgctttctcaccctatatcacacaaacgaaagcagcctaggagaccttatgcgataatacaagaaaaccagtctagcaatcaacgtgcaattttgtacaaatactctcctccaacccttgggctcaattagtggtaactgggctgggcctccgtgggccgcctatttcgcaacagtccagttagtctggtgtttcagcccattcagtaatacatgggccaaggcagattagagcagggtccaataaggtccataaagacccgagcaaacctagggtttatgagcacggagcgtataaaagcgagcctccacgccgccgtccctccctgcagccaccaccaccacccccacaccggagcacagcgaggcggcgccgcagccccatcttctccggtgagtcttcgtccctcaccctcgccttctcttacggaaccctaaaaccgtatgatctctactagtacgatggatggatggatagctcttagttttggtcagttcgatggcatttgctcgttctgctcgttgtctaatatcttctacgatcctatccggctgttggtccagtagtattactgcaagaactgtaagcttagttcgagatttttcttgtagacgatttgttacctacttagattttgtttactagcgggttatttgtttcgctcggttagatctggtaatataaaacgagccatgtagcgattttgatgtgtgggggcacgaactgttcttgtcacgagaaaggttgtaccccagatttcatttgcaatcgatgccaattctgggcaaatgttgcgttataataatcatatatatgggtcactttttcctgctgatcattagttacaggatcttacagtaggttgttggttttggttatgtaggcgaagcgaaatggcgacggttccggagcctttgatctgggagattgtcaagaagaacaactgcttcctggtgaagcagttcgggaatagcaatgccaaggtgcagttcaccaaggagcccaacaacctgtacaatgtccactcctacaagcactctggtcagtagtcgcttcttgcaacattgctggctttttgatggaaaccaagcatttcattcagcatctgcaaagtgctgacttgggtgatgatgtgttttgtaaggcttggcgaacaagaagaccgtgacgatccagccatcaggcgtgaaggacgcggccgtggtcctctccacaaccaagaccaagaagcagaatgccccagcgaagctctaccacaagtctgtgatgcgcaaggagttccgcaaaatggctaaggctgtcaagaaccaggtattagcacgtgaaactacttctttgcatagcttcttgtccttgttatgccttgcgatgctagaagctttaaatgcactgctatgaacataaagcatcctatattttggcttcattactcttttcttatttactgctgtgatgagccgtaacacataaggaggccaaccgatcaattggttcttcaatgaaatactcttgttacgcttggcttctgagcattttgtattgtcttgatatgttgaagtggctctcatttgtggggttcagacgttaggatggaactgtgagatcttcatacggaacaattaaaactcatacaatgttttttacagaagttggtataacttgctgttaaaaaaacagttaggtgtcaatgaactgcaagttagtttgtgagaattcctgtttttcgttttcagaaccatctttttttccctgtttttgttacattgctaattctaactgctgctgtgataagccgtaacacataagaaggccaaccgatcaattggttctttgatgaaatactcttgttacacttggcttctgagcgacttatactggcatcctgcctttttgatatgttgaagtgcctgatctgtgaaaaccttcagattttcaaatggaacattttgatacttaaaacaccagttttagcagcagttgatacaactttatctgaaaattcaggtatttgacaatgaattgcaagttagattttaagtatttgctttttaataaccaagtttttgccctatctgagttaaattgataatgcaagatgcagctgtgatgagacgtaacacataagaaggccaaaccgatcaattggttcttcgatgaaatatatttgttacgcttggcttctgagctgaatctgcctctagtatttcttctctatacggcagctttcctttatgtaccttactgaacaatcatcagtagtttgttctttaatttgctgttattctgcccttcaggtgagtgacaactactacaggcctgacctgaccaagccggctcttgcgaggcttagctcagtgtaccgcagcctccaggtttccaagtctggtgccaagaagaagaacaggcagccaactaagctgtaaatcgcttaaagctcgcttttttttttgtcaaggggcctcgtggtgttcatgtttccagctacctctgttcgtaacagtgattgagacttgaattgatatctatgctagaattggatcaactatgctacaaatctactctagtttgtactcgctacaattttggtctgctgtgtcattgttcacgttgcacttgataatagcagctaagctaatgtcatcaaattgctggtgccgttttgctttgtacacatccccgtgtagcttctgcgaccagattacctatttttgatcaagctgtgtagggttgtggcatgatggcatcaatgtgctgttgccatttgacaaatcattctgcttattacatcaagcacttcatacgttagtgagagcggggcgaggatcttttaccatagggaaaattggttctatgccatcaaaagttttcaagttttgctttataccatcgaaagttccttttcaagttttgctttatacctcgaaagttcctggtgattttcctaccataatgttacatgggtcatatctttatactccctcgtatttgaccgttcgtcttattaaaaaaatttatgaaatatataaaactatatgtgtacttgaaattatatttaacaacgaatcaaatgatataaaaagaataaataattacttaaatttttttgaataagacgaatagtcaaacacgtactaaaaagtcaatagtgtcaaatattttgaagtatttgcaatgataatgttattatggtagagaatgtgaacccgtgagggagatgattttgcattgtgagtttctgacaagcggaagctctagaaagttctgccactctgtgagagtgcaaagctgttgtgatgttgcacttgcacctgctgctgctgctgaggcccgaagcgttgccggaccgagcggtacgccatgagcccgagcttgtgcgccttctcgtacatggtctccggccgcagcggcgcgacgtgcaggccgacggcgtcgagctgccggccgctcctcccccagaacccgacgatggcgccgccgtccaccgggaacgcgaacggcgtgccctccgccgcgccgccgcctaacggcccgtactccctccggttggtcctgaacgccagccacctgatcaccgccggcgcgccgccctgcgccaccgccgcgtagtgcccgctcaccgccgtcaggtactcctccgggaagcccagcttgatctacgtcccagccaaacagactcagggggtatttagatacatggatgtaaaatttttgcatgtctcatcggatatacggatacacatttgaagtattaaacgtataataataataaagcaaattacagatttcgtttgtaaaccgcgagacgaatttattaagcctaattaatccgtaattagtaaatatttattgtagcaccacattatctaataatgaaacaattagggttaaaagattcgtctcgcaatttacacgaaatttgtataattagttatttttttcgtttatatttaatacttcatacatgtgtttaaatatttgatgtgatatgttgaaaatttttgccagggatctaaacaggccctcagctatggctgtgccaagaacattacaaggtgcagatggtattgggtgtgcacctgggtggtctggttgccgccggcgccgccgtgccgctcgccggcgacggcgacgccgttccggtcatactcgacggcgatggagtcgatgcaccggtcgtacgacagggtgatgctacgaacgccggtgtgaccgccgtcgtcccaggggctccctccggtgccgccccatggcccaaccttcatgatcttcttggacacaaccatcttcttctgaggttgctgctcctgcaaaaaaaaaagggatatcctgtataattgaagtgtatgagttgctcactgaacttttggatagaaaaattcagatgatttttctgttctgcaagactgaaaatgaagtgcatgacttgcataccatgtttggttcagatatgttaagaactacaccaagtagtaaggtgagcagctaaacttattcagagaacaagtgcgctaacagataaaaatggatagggatttttttttgtttgcaggaaacaaccagatggaagaacagaaatattaggatatataggaaaaataccacacagtggcaattgggtgataagtgggaatcagaaccggatgctgtaatggcagtacgctgctttctggaaagctaagcatattgtacaggaagtttttgttctccaagagtccaagtataaattccggtaacatgatcctgccaatacctagttttcagttcaatgttaccactcctggtgattttttatttacatatcgcagagctttagtgtagtacaagttttttagggaaaagaaatcaaagtttgatattttggaaaataaagccttcatgttatttttgttcttcttcttatatggaaggatatgcagctctcctgtctattcgagaaaaaaaaagaaaaaatgccttcatgttgaatcatgaattgctcacttaaactccaagttcataagcatttgcacgttaacatcagataaagacctgaaacaaatgttgtacctcatgtcattacagtgctttgaaaaacagaaatgaagatgtagacagtggactcatactcataggtaactcctagaacttagttcgttccaaattcgtctgtccccagtccccactgaacaactcaatcctttgaattttctggaaataaactcagtccaaattggacgcatgaaattcgcataacacaatttatctcacatattattacatgcctattacgcagggttggtgcccagaaataccattcatggccagttgggattgagtactactactgctgaaccaatgttcaatacaaccttgtttgacagcatccagaaagtctgaaaacacaaccagcagttgtcgttttctaacttcagatgtgggcttcacagcatttgcaaattgcaacaatgatgttctctgtgacttcaagaaagtagtatttctgtatacatcaaacacttgtctgaagacaaatgattgaagtgtttgtgataaggcctccgatcaagacttgcatctcatctccataaaaagaaaaagaaaaagagaagtgaaatacaattcaagacttgcatcagtgctgctagtagcacaaatggttcatctcttgccaaccatctactgcacaacaagattcctgaagtggttcggctgtgcaattcatcatcttctcctgaatcctggcctatcagtcagagccggtgcttacactacaaacaattgcattctcttcaactcctgacccaataaaatggcaatttgcagagaagcaagtacaacagcagtggcaaccacattccattggcaatttggcatacattgtagtagcagcagtattgatcttaggtgtacagccacctaaagcttttgctgatctgtcctgagctaatcaaagagctaatcaagttcaagcaacccaaatgacagtgagtcccacaataacaacttgacaggtgtgtatgctgtgtctgggccctgtttggaccatgctgcatctttttcttgcattggctgtcaagtgttaaaagcatactaaaccccaattgcttaattgcttttgcttctttttttttgagctaatgcgccaaattatgaactgctaattatagctttggtatgcatgattaagtgattaacagttagcagtctcctgtctttaagctatggttagaatccacttattgttgcaaatctacaatgagctgtctgatttgaatgtggggcccacagccagtctcctcctctcctatataaag

SEQ ID NO: 38669 - DNA, 7839 bp, Oryza sativa
  unsure (1)..(7839): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatgctttggcgttaatttcattcccagccatttcaaggacctccaactggggtgctgactgtttgagggtattgataattgctacagtgcccttgttctcaagattgagatcactgagatacagctcaacaagatcaggaagttttgaaagggttttgctgagagccaaccctgcctcaactccaaacaagttgtccctgagatcaagtttcttcagacgagtacaagtccctaatgcctcagccagagccaccccaccatcagatcctatccttgttgctgagcacctgaaactctctagattaggagaacgtttaaccatctcagcaataaacatagcaccttcatcccccgtcatattgttgtggaagtggaggatcttaagcttctcagttgaaggaataagttcagaaagagcttgtgcggcttcctctgatataccatcattcatcacatatagttcttccaggttgtcctgtgatttcaggagctcttcaaatgctctgacacccttctcacctaaagcattatcagagatgttcaagtatctcagtacagcgccttctaaagcttttgagaagatgcgcatcacatcaagggcttcatcctcaggtctgccagcaacaaaatctgatatatccacctctgtgagttgctttttgattgattccagaataggtccagcaacattggcagcaccaataccaaagctcctgttgctgaagcaaatccgtttatatgcatttcctggtttgataagcgggctcaaaagttccttcgcttcatctgcctcaataaacgcacgcttgccaccagatatatcaaatacagaatcagcaggctcaagaggtgtatcagcaacaggtacttctggttccacagtggtccttggccctcttttcagaacttccagcatcaacttgctagtttcctttgcgtacagctggacagcagaactcccatccccatcaggctcctccttgaaatgctcgtctgcagaggcaaagcatacctcttcgatccttttagcattatcatgagcctcttccttgcccaaaaggccgtacttgcgagaaaatatggactctgtggaaaggttcttggtcatcctctccacaagcatgagacgagtgctttcacttggtggccacagtttgatggagaatgtccggggttggaaatcttgcttagtcgaatccatgtgaaaatatggcagtaacagcaacctaaatgacagatgatcaattattaggatgattgcaataatagaacatgaggcaatagctgcaacattttaaaaaaatgcaaatagtgtggaaaactagtacttggagttctatccaccaaagcatagtaccaatgggagtaaacctaaacaatagctagcaaaaagaataataaactctgcactgtaacagcaggaaaaataacaattgttataatagcaggaaaaatagctatcaccaagtgatttctctgaaaattcattcagcagttataggatgagttgctataatagaagatgaggcaatagctgcaaatttaaatagaataatgtaagcagtgttgcatactagcaactgaagttctatccgccaaaacatagtaacaatgggaatacaactaaactagctagctgaaaaaaaaagcctgcactgtaacagcagcagcagcaacaacaactgctcttttagcaggcatcaccaagcgcttcgtcagaagattcatttagcagttataggatcatgatatcagagtttcactgaaagaaaagaatcaaagcgaaaacgtgtgatgctgctattccattatcaatcaggctaaacttgcttatgctactcaccctactacaagcaggggcggatccaacttgggacacgagggttcaattcagttgaaccccaaacttttggggaacaaacaaacaaactgttaattgtattaaggctaaggatctgaaattaagagaagagcttcttccagatctagaagagaagctagggttaacgaacgcaggcaaattccaggcaaaggtaggtcgggggagagagatggatcatcagaaagaggatgcggatgctcaccaggatcccctcccctgttcagccgcgagatggcacgaggagcggaggagacgacgaggagggatttacccgcggcggaggcggaggcggcggcgggggatgcggcgcgctagggtttttggctctttggaattttggttgatgcggcgggcgcggacggggcgaggcgaggcgaggcttatagctcggtgacccgggccgtagccactgaaccgtgggtcccacggcccaacaagtagcgggaggggaacagaaaaaaaaaagtaaattttactccctccgtcgtataatgatgcagcaacctaaaatacgatggatctcatcccgtcctaggttgctatattatggggcggagggggagtatagaactagcgatgcttcgattagactatcacaaaactacagaatcgatacattacaatataatttatcataaaactacatattatagagtttaatctgtcatgttatagctatagatgctatggtttggtgattaaattggcactaaatctatagtttttattacttttgtgatactctgtggtgaatttgtatacctcctcactaccaaaatattgcccatcggaaataccccatccgttccattataaatacaatcgtaagggcatgtttggtacagctccaactcctaaatttaactccaggagttgggtttggagagnagnnnngnannngcntanacccagctccacaactccagttcattttatgagagagctccacccaactccactcccagttttggtggagctgaaactatttggctgagctccagctccaggaggggtgaagctggagctggagctgtgccaaacaggccctaagtttccgcgcctaattttgatcgttcgtctaatttgaaaaaaaatttaattagtattttttttgttgctaatgagatgataaaatatgaatagtactttactcatgacttatgcttttaatttctttcaaaaaatctattatattattaaaggaatagaaaaggaagcctccacgttcgctctcatggcctagaaattctcacattaatcggagaaaaagaaaaagcagagtccatatagaaatacaatttagaaatagctgaaattcggaattaaaaataagaaatattagaagaggagactagagtccatatagaaatacatttagaaatagctgaaattcggaataaaaaaaggaatattagaagaggagactagagtctatatagaaatacatttataaatagctgaaattcggaattaaaaaaaaggaatattagaagaggaaactagggtccatatagaaatacatttagaaatagctgaaattcagaattaaaaaataaggaatattataagaggagactagagtccatatagaaatacaattaggaaataattgaaattcagaattaaaaaataaggaatattagaagaggagactagagtccatataaaaatacaattaggaaataactgaaattcggaatcaaaaataaggaatattagaagtagagtatagagcccatatagaaatacaattaggaaataactgaaattcggaattaaaaataaggaatattagaagtagagtatagagtacatatagaaatacaattagaaaataatataaatttggaattaaaaataaggaatattagaagtagagtatagagtccatataggaatttaaaactaacaaaaatttgaaataaacatgataaaattaaaagtagagtttggagtccatataaaaatacaatttataaataactaaaattcgaaattaagaaaaacatgggaagaagagtttaaggtcaatataggaatacaatttagaagtaactgaaattcaaacttaaaaattaaagaatattgaaagatgagtttagagtgaacatagaaatacaattaaaaataataaaaatttagaaataaaaataaataatattggaaaaagagcatagagtctatatagaaatacaatttataaaaaattcgaaattaaaaaaaaagaaatattaaaagacgagtctagagtccatataggaataaatataatttacaaataactaaaaattgatattaaaaatgattaatgactaacagatatataaaatataatatgaaaattcagaaataaaaataaataatattgaaagaagagcatagagtctatatagaaatacaatttacagaaaattcagaattaaaataaaatattaaaagacgagtgtagagtccatataggaatatatataatttacaaataactaaaatttgatattaaaaataattaataactaacacgtatataaaatataatatgaatattacatattagtggttttgtaaagttattgcaaaatttaaaattatgttgttattttaatatatttgaataatataatgagaaaacatatatgctattatatgagagaaaatataatgatgctagcggcgcaatctgcacgggccaatatgctagtttttaaataaaatggacggtcaaagttaggcgcggaaaaccatggctgcacttaaaatgggacgtaaggaatagcaaacattttaagacgtagttctagagaaatttcacgttaaatatatagttttatatatctctagttttttttataatagttttgtgaaatgtaatcaaaataattcctgaatccatctaactccaacgtcgtctccgatctccccgtccatctccctctccgcctccgccaacgcgaacgcccagaggtgcacgagagcgcgcgcgccgcgccgcgcctcgcctcgctgatccggcaagcaaaccgcggcgccgcgacgcgacgcgaaccccgccgcgccgcgagtgtgggggagcacgaatggtagccggccgcggttaggtaggtgggcgccgcggggtgtcgatagctccggagggtgggggtggggggagcagatccagatccagcgagggcgcgagcaatggcggcgggggcggtgtcggcgctgttcctgctcgacatcaagggccgcgtcctcgtctggcgcgactaccgcggcgacgtctccgcgctccaggccgagcgcttcttcaccaagctcctcgacaaggaggtaatgcaatgccccctccatttcacctagatctgtgcaaatgccgggcttctcgatgagctttttgccctgtgtgatcagagcgacgcggaggtgctctcccccgtcgtccacgatgacgccggcgtctcctacatgttcatccagcacaacaatgtgttcctcctcaccgcgtcccgtcagaactgcaacgccgccagcatactcctcttcctccaccgcgtcgtcgatgtatgggttgctgcccccatcttcacagcaacattctgcgtttgttagtatggacaatgccattggattttgttcatatgatttgtgtgtgtgtgggcgtaggtgttcaagcattacttcgaggagctggaggaggaatcattgagggacaacttcgtcgttgtggtatgtgcgcttgcgtgttacgtgaactgagtactgggtctggttcaatcggaattgccgtgtcactgaaattggagggttgatgtcatttgctgtgtgtgtagtatgagttgcttgatgagatgatggatttcgggtacccacaatacacggaagcaatgatcctgagcgagttcattaaaacggacgcgtacaggatggaggtcactcagaggccgcccatggcagtgacaaatgctgtgtcatggaggagcgaggggattcggtacaagaagaatgaagtctgatacactacacctgtatttttatttttttggttcacatgaacgtgtgatggatttagaaaattatcaacattttgtgctgcaggtgttcttggatgtggtggagagtgtcaatatcctcgttaacagcaatgggcagatagtgaggtctgatgtcatcggtgagctgaaaatgcgaacctttctaaggtagtaactgcatggtcattctcatatcacaaattcacattgtgctgataactcagctgcttcagtaataatttaatgggagttgcagttagagggatgcgaaacactgtttttatatgatgtatccaacccattattgtgaacttctagtttaactgtttatcacatcactgaagcaagttgatattgatgaataaagactattaaattgtgtatacaatattctgccaactatgagtctacgacatatatgttgcaaccatgtcaaataaatgtaggtaatgtaattctcatccagataatagcatcaaacagtacataaaaatgaactttgttgcagtatgtaataatgctctaattggactagtcattgacctgactagtttgtatttcagactatctgttggattgtccaagatatcgttagactatatgtttcccaagtacccagttacgttatgaatgctaagtggactagccattgaactgactagtttgtttttcagacgatctggtagattgtccaaaatatatgttcaacttatgcatcatagctaatatccatctgcttgtacagtggaatgcccgagtgcaaactggggttgaatgatagggttctcttggaggctcaaggccgaacaactaaaggaaaagcaatagatttggacgatatcaaattccatcagtaagatactaacatacagtataactatgatggttctttatcaaatgtaattcatttctattacatcatccatgttacaactctgaattggccaaaccttcgttaggtgtgttcggttggccagatttgagaatgacaggactatatccttcattcctccagatggatcatttgatctgatgacttacagacttagcacccaggtttgtccctgcttgatctttgctgctagtatagcgctaggttatgatctatatttcacctaatctatcttcctctggtccctcccacaggtgaaacctcttatctgggtagaagcacaagtggagaaacattcaagaagtcggatacagatcacagtgaagacaagaagtcagttcaaagaaaggaggtgttattttattttattttcttaaaaaagcgataatgtctctgcatcagtgtcttagttccagacaagttactgttattgttttttctcatttccagcacagcaacaaatgtagaaattgaagtaccagtgcctgaggattcgacaaacccaaatataagaacttcaatgggctctgcggcatatgcacctgagagagatgcgatggtctggaaaataaaatcatttcctggtggcaaggtaagtgctgagttgataccaacttaccactttgcctttcacttttgtgctatgtccatcaactctaatttcctagaatctctccattaggaatatatgtgtagagcagaatttagccttccaagcataacatcagaagatggaatgcctgaaaagaaggctccgatacgtgtgaaatttg

SEQ ID NO: 38670 - DNA, 7542 bp, Oryza sativa
aaggcagggtttttcaaactttcccttgatttaagtagtttgcctaagagcccgtgcattgcaatgaaaaacaaattaagtttctagcttattgaatcaatcaataaacacttatttagtctaagtaatactatgatttttcttattgaacaagtagataattttgaaatttggggggagccaatagtgaaatgggggaggatttgttgaaaggtggtgcaatagtatagattgtggggcccaattttagtggtaggggtggtgtgggaatagacaccaccactaccaacattttaactagtatagatatagaaaactttaatcagaaccagttaatatgagtatatgattgaaacaaaaagtttattaaactgttagttgctctttagctaataacattgtttgtttgcagcgtgctaatagagatgttgatagaccctttgttcctgatactgttgggtttgcaggtaatttggaaaaatacattttggtttgctttcttcttgcctcttcaatcttatcagggactacttatacttttttttgtttcatgttacctcaggtgagagagcaggcaagcgggaccacaagcggaaggtttgttctttctcatcctctctgtgatgatgttcttaatatagtttcatctttaatgtgtgtctgtgggacatcctgctgaccttctaatatctagtttgaggggagacaaaattgaattgagacatagttcaactgctctgattttctgaaatctatccatttgtactttaccatcctgataggacatgcagacaggaactatatgttgattttacttatgtgtggcaataccatttaaaacatcaaacaagatgcttcagtgtgttggatcatccagtatcaaaatgaagtgcaatctctattgttaatggccattttggttgaagttgacagtcatattcttgctgtcctaaaatgtttgcattctggaatgctccatattttagaattcaatcagggacttgttttcttctataaaactatatgattacttttacttggttttatcatttacatctgtaacattttcgccagaccactggaagatttatagatgcacctccctcaccaccccagtccaagaggcctcggaagttgaaagcatctgattgatgagtttcagattgagctgcatagaatttcaacaagccaaaacccctggtatgccttactggcttgaattgaacttgcacttgaatacttgatcatttgttgctcgcttcatggttgacaactggaccttgtgtttcagatagtgctatggatcaactccattcttgcttggaagcttcccggcgtgcactttcaccaagagtttgctcccgtcggtagaagccgttcttggcttttgtctgtacagtgcatctgccctgagaaggttttcttcgtactcctcgttggaagatgagacgaatcaggtggaagcagctgctggcgtcactgagaagtgatcgccttgagcccttgacgtctccccctactcaacgaagagtgtaactgtttcttttgtttgtttgagctgtagctaccgtttgtaaaatgagttatctgacaataccgtgtttgttcaagtagaactgtaacacaactgtttacacccaatcaatcctgtaatcttggacaatttaacgaggaaccgcgatcccaatgcaaacctgagcctggtttccatgtgtggttggcgttatagcttatcaacagccttgtgcagttcaacacaaggtactccatctgtctcataaagaaccaacttagtactagatgtgatacattctactactataaatctggatgtatatctgtctagatttatcatactagaaatatgtcatatccaattctaaattcgttttttatggaacggagagagtactcttcgagtcttgataactcagccaacacagttgacggtgaacacacctggagaggagaaagcagaggtgtgcactgtatctgtgtatcaatcaggccgagaccgacgctttgtcctctcatatagacactgatcgacgtctcgagattgactctcgactttgccccgacatgcagtagagcgttgggcagtgacgtggcttaatctctggccgtccgtgtaccgatcgatggccacggatcggatagaatatgccggaacacatgtcgtcaggttggttggcatggatagaagatagattgtgtcacgtcgcggtaggcaaaattttcgcttctcgagtggtccagtggacgttgccacctgcgtgtgtggcacgcggctgagtggacggtttgtacaaggcgatttctacagttctactggctatggggcctatggccaattgaccatgagcagctggttggtgcccagttcaccggagccgccaatccaaacggcttgatgcgtcgcaactgtggagctttgcatgggtggagtcagatgtggagggtggttgttgaattcgttactactactactggtgcatgacaagttaaatcgggagagaaaaagaccttacaaaagaaattgtgagaaaaggtgagagacgtagccaaatacctgatgaactgtgacgtctgaatatatccgagtattctgcccgtttgacgtgtcataaatcttatataattattagtatatcccagtattctgttcacttgatagaatgatagcttacaaagacacaagtatttactatttgtgctgactagtcactcagtatgcaaaaatctgcaggtttggtagagacaacacatttaactttggacagcaactaatcctagcatcagattaatgctgagaatgagagctcagtttcatccatcttgggagtcatggcctcatgggtcacctgcatgggccaccgtgcccaagatcctaaacttgctcccaaatttatgagtagtttttttttccgaggtcagagaggcataatcacaattcacaaagatctcaatcccaaacgaaagagacgcccgacccacctctcctgttaacatcactgctcacttatctcatctcacctcttgatttgaagcagacaatgcatgatcctcagtcacaagataattctgttaaggcaaaaatcttgcaactatttcacagtttaattcattaacaccacatatataagaaatctcttgattgatttagcattgctaagtagtataattaacagggagcttagtgagcttgctgtgaaattgcaaggctcttgttgttcttggcgagtgtggctagctactgcttgctgctgccgcggttgagcatctccttgtagttgagcagcgagttgagcctctgaagctgcagttgctgcctgaatttgttgatgaagtcgtcggctctggcgtccacgccgccgtcgtcggcgtcctccgccgccgtgtccttcctcgcctccgagctcgacttggtcatcgtcttcgcctccgacgccgcctgcttcttcgccttcttgtcctgctcccgcgccggctccgaccgggtcctaccgtagtgcgcttgtgcgggcgttgccgccgccgctgcgtcggcggggatgtcgtcggtggcgaggtcgccggagcggaagctgtagagggtgaacgagcggaggcggtccaggacggacgacgtgcgcgcgagcggcgccggcgccggcgccgggggaggaacgtattcttgctggagcggcagatctcgctgctgcttcggtgtgaaatcgtcttcggccgtcgcgtccacggcggccgcggcctcctccgggaacgcctcgaccaccctcgccggagccctcacgacctctgccctcctcacctcggagctcgagttcctcagcctcgacgccgccttcctctcctcctgcgccggcgccgccgccggctccgaccggctcctcgcgtagtgcccttgcagcttcacctcatccaccggagacgaagacaccacctcctccgtgcgctggtggtggagttggctcgtcgccgccgccgcagcagtagcgtactcgggagggaagtcaccggagcggaagcggtagagtccgaacgagcggagccggtcaagaacggacgacgtccgcgcgagcggcgccggcgccggcggcggagcatacagcgtctcctgcatcatcatctgctggtgctcaccgccgccgtagtattgctgatgcagcagcggcggcggcggttgcaactggtcgtggtggagtatctccccgtcgtggtgatactggtacacctgccgccggcggcgctggtgcgtgcgggaggtgagcgcgatggtgccgatgacgatgttcacgacgaggaacagcgtcgccggcgtgaagtacccgcggatcgccgcccacgcgcccacccccggcgacgccgcctccgccacgtccatctatcacgcggaggctagcaggggaaagcgcggaaacggacgacgcgggcgagagctcggtgagcggctgtggtgtacaggtggggattagcgtttttggggcggtgtacgggggtttgtgtgggttggctagcacgagggcgtcgcggaggcgagcggttaaaatggcgggcgaggcgaggcgggcgggggcgacacgcggcgaggcggggtgggagatggctgacttggtgggtggaaaacgtgggaatccaagctgccgcccaagcaggcaagcagcagcagcgcggggagccgacccgccgggattgcagctgctgcatctgcatggcatcttccgccaaaaaaaagacggcctacgacgcgtacgctgacactgtagtatgtggtggactggagtacaagtcactgttgctactcggctactccagccgtcctatggcacgtgcatatacagtggtatgtacagttgacatttttccatggagcacacgacagaataatgatactacgagtacatgcgtacatgagatgctacaatatactcccttcgtttcaaaatgtttgacaccgtgacattttagcacatgtttgaccgttcgtcttattaaaaaaaatttatgaaatatgtaaaactatatgcgtacttgaaagtatatttaagaatgaatcaaacacgtactaaaaagtcaacggtgtcaaatattttgaaacggaggaagtatattgtacgataaagaaatgttaggtacacatggatatggagtatatcatgagtatatcatcgagcttggcacagaggatcttgtaagagttaagcgttgtcgttgctggtgcacattgacgcacagatgccctcacgtgttgctcgatcgattgatcagtccacgccctgctgcaagtcaacctgctcgcgtcgtggcgcggcgcccgtcagtccttgattagtgcattaaaccgacgttggggataaccgataacctgtccctaaatctccatgcttttcttcttcgatggtcgctttcagcggcagatatgataacgtatcaactccaaatgttccaatcacatctttgcttccaacgcaaccaaccatcatccaggcaggctccaccagatgacctttttaatttaccttcaccgtttaggtagtatgcaactttggaacgatctcttcagattagccatcttgagcttgtacgttatagaaaaaaccgtttttctgatggtgatttggtgacgcagatattctcgtggagtgacgagaggatgggactcactgatggagcagcgcagatcaggggttcagagtgacacacttgcacacacatttacatttttcctagagatggcaattgtgctacagaagttttcgtgtacagcgtttttatggattcagagtgacacgctggtggagcacacgacttggtgatttgagtccgattacagtcggcctggaacggcactgtgatgttaccttcagcccattctagttgggccagaaaggaagtacttaaatgtggccccattatacttgggcctgggagggaatacgagtagggatggcaatgggggggctacacctacaaggctacacccgtcggattttgctatcctgtcccgtccccgtagtagaaaaaaaatcccgtccccattcccatccccgcacgcgggggagtgttttcccctcccccgttcccgcccccgtgcgggtatggggcaccgtcgggtgcccacacccgacaatatctcaatagatttggtagcagcaaagcaagacaagaaatagccaaacaccagtgaataagcaccaaatcttaccgtaatccaagtatccaggctatcaacaacaacaattagcatgattgcataaggaccaaaggcatcatattaggtattcacgttcacatgcgtgtacatcaccacaacacaactacacatgcagtgaatatgcacgctattacagatcgatcggagtaggctgtggcggcagcggcgccgaagcgaggctgcttgctagttgctcccttggaggcggcggcgcgaagcgtctcgcacggcaaggacgacgagagctcaacgccgccttctcgcctggaggtgtggatgcggcgacgcatcagggaggccgagctcgtggcggcgcgcagggagggagtttgagctcgaaaacgaaaacaattttaacatataattaagtctttaattattactttctccgtcccataatataacgtacgagacactcctgcggtccagattcattatgccatgaagtgtctcatccaatactaggttgctatattattggacggagggagtacaaacttaacaaattaacatatttaatatgttaaaacaatttctatatagaaagttttcgtacgtaacaccgtttagtagttaaaaaaaactatgcaaataaaaaacgatgtaaaatccgaatcttaattagaaaataacaggattgaccagagtcgccaccacactcttagcccttggaggcttggagggtactccctccgtcccaaaaaaagacaaaccatggtttccgtgtccaacgtttgaccgtccgtcttatttaaaaaaattataaaaaaaaattaaaaagacaagtcacgtataaaatattaatcatgttttatcatctaacaacaatgaaaatacaaattataaaaaaatttcatataagacggacagtcaaagttggacacggaaatctagaggtggaacccaacgtaataatcttcaagctcctgaagggcgggaacatatatgtccggtccttgcagtcacactgtcgagtcaagttcgggtagtttcgttatatgttttaccatcagccatggtaggctatgctctctccattttaaaaaaaatcaatctaatatcggatgtgacacatcctaacactacgaatctggatatatatatatcgagatttatagtattagaatgtgtcacatctgattttaaatttgttttttatgcgttggagggagtagtggtcgtcgaagcccgagtccgctcagccgggagccgtgtccaactgcctcaggctcgacgagttttgattgaaaaactccatctggctagctcgtgtcgcctactcgccctctcgatcgtccgtgccacggtctcccatgcgatgcgatccc

SEQ ID NO: 38671 - DNA, 4675 bp, Oryza sativa
gacaacggctaactccccctacccccaccacttctcctcctacttccattttgtctctcgccttggcttcttcttcttcctcctcgcgctgcccccacaggaggagtttgtgagctctctcagcgtcgatgggggcgtcggggaagtggatcaagtcgctggtgagcctcaaggcggcgccggaggggacgacgaaggggcggaggtggacccggctgtggcggagcagctcgtcggcgtcggcgtcggcgtcgaccgcgggggacgcgtcggagtcggcgtcgtcggaggccgacgcgttcagctcggtcgtcgccgccgtcgtccgcgcgccgcccagggacttccgcgtcatccgccaggagtgggccgccgtccgcgtccaggcggccttccgcgccttcttggtaagacacagatttttctgatgctgctcttgatgtggcgcggtggtggtgatgctgtgctttgcgtggtgtgtcaatggcgtgtggagttaggcgcggcgggcgttgaaggcgctgagaggcatcgtgcggctgcaggcgctggtgcgggggcggctggtgcggcggcagctcgccgtgacgctcaagtgcatgaacgcgctgctgcgggtgcaggagcgcgcgcgggagcggcgggcgcgctgctcggcggatggccgggactcgcaggacgcggtcggcgagcgcgacggccgcgccgacccgatcaaacaagcagaggtacatgggaacacagcctgacccgcgtgcttctcttacgattgatacgtgcagtgctatatccttcttgcgttaatttctgaatgcaaaaaattgcattggtggcgcttcctctgtgcagtggattaaagaatcgaaatacttgtgtagtggagtatatataaatggtaatctgcatgccatttctgcaaattcgatggcattgctccatttcttgggactttgggagtggaatttggtagagtcagattgaagtgtgccttccattttcctatatcggtatgtaagatgggcctctagctcaacactggtacgtctatggcccatgggctgtgtgagtgtgtggttgaattcactcccatgtaggctttaatattgcaactactccctccgtttcacaatgtaagtcattctaacatttctcacattcatattgatgtaacatcaatctagattcattaacatcaatatgaatgtgggaaatgctagaatgacttatattgtgaaaaaggaagtatttagaacaagatagagcttgcaccaatccaaatcaaagttataaagtaagattttgaattcagtcctcaaaatagttgtcttactgacatacaaaaatgatgtatttatttggagatcatttgaaggcttgaaaattgaaaattgttctttttagttaagttatactactaggtgttataatttgagaggtttgtactggtgccttaatttgattccttaagaagaaagtgatgtatgacttaatatggtgggggtacttttacctgaaaatgacttttcggactgataaggacaattaaggttccttttttagtaatgattgagtccattaagattgttgttttctctctcgtaatgacaacacatgtttgaatcgatcttggaagtgatcctgttaggtaagaagaggcaatgctgacaagaccgataacgccttttgcaattagttattgccaggcaaagttctaagctggaactgtgctggttcttttaaaaagtcctgaggccacacaggaatatattttttggtgttttaattagagagaaaaaaagcgaattttgctttaaaatgagatgtatatcgtattaacatgtcaaagattgtggcattgcaggaacaatggtgtgacagtcaaggatcggtttctgaagtaagatcgaaaatacacatgaggcatgatgctgtggctaagagggaaagggcaattgcttatgcgctttctcaccaggtatacttttgtatcattaagaggaactcttgcgctggacgacgcaagttgatataacatgctgctcacatccattttcctttcagcctaggagttcaaaacaaagtgcaaggccaagctctcctgctagatctctgaggaaccatgagtctaataggtgcaatcacgactggagctatattgaaggatggatggcaacaaagccttgggagagcaggctcatggagcaaagccatgctgaattgaagtgttccaagaacagtggcgaactgaacttagctggcgcccaactttcaaatgcaagctcagttaagatgagagggaacagggtggcagcaaagcctccttctgtactctcagcttcttcttcagacttcccgtgtgatgtgagctctgcatcgacatcgtcagcaactccagcaagatccgacggtggacatggtgaaggtccgagttacatgagcttgacgaagtctgcaaaagcaaggcagagctgcaacagtccattccagattcagagacagcgatctggaggcatgtcatcttacaaaagggttgcactctctccattagatgttcagagcaacgcctgttcagaattttcagtcacctccaggaagttaaacagtctgtctctgaaaggccgtagcatgacaaggagcttggacaaggagaatgacaatctgttctagcttgctgttctatggacaaattagctaatttgcatcttacatatatattatctgatccgttgttagcatttatacatccaagccaagctcaatgcctcattgcctctatcatgttttttgtatgcacaactgagattagtcattagttaaatgtctgaacctctttttatccctaaatgctgtgtagtagtattataaagagctgcagttctaattggagatggtgacagtttcttatgtttgaatatatatcaattatgaatgctagcttggggacaatgagaatgatgcaacgtttatcatcttccgtaaagatcacatgacatgccattgccgatcgtctgattgctcaaacaattgccataactctcgccgattggtcgctctcatcacaatcaccgggtaaacattttaggtttggtgcagcgatcgtccttgattggcttctttatttagtgtccttttgactaacgacgtgatcaattacaataatcctctcctcatttgcttttcaaaaaaaccctacgatttggtcatttgtaccagcatcagcgaccaatacgtggcgtcctgaaattaaaaggacgagagaaaaggattaaagaaaagaattcgaacacgacgagattgtgcagagcagcagcagctgcaactgtaccactccctggttggtcactgcacaagagagtgagagggacgtggtgaaagctatgccgaaaccgaccaccacattaaaccgcacatctaccaaaatccacgttttacatcagtgagagcactattttctgatgtcaaaaccagtctatgttggtttacagaaagccatcgaaagcagcccgtaaaaccaacgactttcggttaattcagtaagaagaagaatagctaaaaccgtttggtttttcataaactgcttctagcggttttatgaaaaccaagtgctttacaatcggtattaaaaaatatcatcaagtataaaaatgtttaatcgatgtcttaaacaaactatcttcggtttataagcgtaaattttgtccccttccgctacttcgatcacatgtctatggcttataatcgtacaactgccttttaagcagcaaatttaactatttgcctttgtcaaaaatattttttaaaactatttgcctctcttgttacaaagtgatatttgttgccactcaccctttcgaaatggcaaaagaaaaaaaagaagttaattacctccattcaagcaggctctctcggtctatctctacatatgctgaagcatgtttgtttagagaaaaaaaggggttaattatctccttttaagcatgcactctcggtttctctctaaatatgttgaagcatgtttttgtttcttaccgcagctggggttgttagtgtcactcacctgatagtaacttggccacccctcactttgtcgctaggaggaggaggaggcaattaattctggttgcgcaagcgacaccggcgcagacgtgccatcgtttcagcgacccaggagcggatggtccagggggggttagtgtggtacagtgccacgcatgccgttatccggagagaagaggaaagtgaattcttttattttcagaactttttttaactcttaatacttactacttgtctgctttgagttttttgtttaaaaaatttaatcattcgtcttattaaaaaaataaaattattatttattttatttatgacttactttattatttaagtattacttatcctttttatatttgtacacatttttcaaataaaacgaatgatcaaacgttgtaaggaaaaaatcaaaacgataactactataagacggaggtagtattttctagatttgtatctttttactaaaacaacgcgatcacatcggtttaaatggcgtgacaacgttattgacatcactctacaagccacgtcattttagctggtgtggcagaataaaatcgccacgtcctttgcgagtggcgtgatagtattattttgccacgtcaaatgttcagatttt

SEQ ID NO: 38672 - DNA, 2591 bp, Oryza sativa
gacgatctgcgtcttatgcggcagcaacgcggggcgccgcagggtgttcggcgacgcggcgctcgacctcggccacgagctggtacgcgtagataacgggcgggcgcgtggcgcggcgacggtcgagctgtctcgctcgccgccgccgccgccgccatcgtacttttccatccttggtttcacactttttttttcaggtgcgagccgtgagattcttctcctttttttgtttttcaggtgaggcggggcgtcgatctggtctacggcggcggcagcatcgggctgatgggcttgatcgcgcgtacggttctcgacggcggccgccgtgtcgtcgggtacgtacgcacgcagccagcttcgtttctgcgcctgagagcgatttcctcattacttttgctgccttgctttcgcggctgcacctgcggatgcctgtgattctcgtgtacgtgctacaccaccatctaatgcggcgtgataaaatttttgcttgatttattcgcagggtgattcctagagctctcatggctgtcgaggtctgcaatctcttcgacttcctttcagtatttcgtagatttttcagggttcagaagtgtcgttgaattcagctctgtattggtatgttttagcgtttgccatgttgtgttcttacttggagaacttgccgttggaatcctgtggtgtttggatcagaattccacatttgaaatgaaccctaaagtctaaacgaaatgatcaagctagacagggctaggatttccgaaagtttggtttctgtccatttttaggtggcaggtacaagccgtatagcagcatacttcaattcattgttagttttcagctgaattaaatagtaggaccagtacacttgctatcttgaatttgtcagggtgatgtttatcttgaatatgtcagggtgaagttacctgatcctaacataattgataatagtacgtgtatgcgatcatttaaaagagatgttttactttgacttggaaggactgtacagctttgtgaagaattttgtaaagggagtggtttgtgttgacatttgcaaatattgcttttctaacagatatcaggtgagagtgtgggagaagtaatagttgtacaggacatgcatgagcggaaagcggagatggctcggcgatccaaagcgttcattgctcttcctggtaattgataattccaatatatgtgagatggactgacgatctgaaatgttcagtaccttctttctaacatcatctatcacactagtaattgataattcaaatgtaacttggttattgatttttatcagggggctatggaacaatggaggagctgttagagatgataacatggtgccaacttggaattcatgacaagccagtaagcataattgagatatttgatactagatatattgtaaacggcaaagtagcataatgctttgttgatggattaaggtctccatcacatataaaaccttggccaattgaacaggttggattgctaaatgttgacggttactacgatccactgctcgcgttgttcgacaaaggcgaggcggagggcttcatcaactctgattgtagacaaatatttgtatctgcaccaactgcaagtgaattgctgacaaagatggaggtaatttgactgacctatgaactctgatgtgagcatttgcaaagcctgagcgacttttttcatgcccccatttggactcagcaatacactcggttgcaccaggaggtggcccctgcaacaagctgggagatctcagagcttggctatggaagaacaccgggcgctgatcaatcctagcccccctcacttcaaaagtgactagtacaagctctactaatgcctttgcttttgttttcccttgcttcttgtgatcaagtgtcaaattaaactcctcaccatggacatggtctccagttgctgtgttcttgatttccatcgatccggtgacgaaccaaagaagccggtcgtcaccgtctacaaatttatttgaagtttgaactgctgcatgaatgcatgatcatgtagtgggagtaatataatttactagtaatttatgttttgattattcgtggaatccggtatgggagcggctgcgggaaaagcagctgcaattttctcggtcgccgacgtcacgggtggatcagtggaatgacatctgattggatttgtactactcatttgaggcttttcttttggggctaagaatgatgatgatgatgatgcgagatcgcgagggtgatgcactggattctcatcgctttgaaggtaggccgcggggggcgtactttcctctgctgggtcggtcggtcttttttggcatttggtttgctttacggagcgcgtcttgtgttggtctcgtcgtctttggttgatgacggtcacgtcggcacgtccacgacgttgtggatggagatccctcgctcctgtgcttttccttttctttctcatttttcgcttggtttggctttgcttgcacccgatcgatcgatgtatctgcacgacacgtcgatacgatcagcggcgaaaccagaaattataagagaatagggctaagatataactctagagctgtatttaattca

SEQ ID NO: 38673 - DNA, 8803 bp, Oryza sativa
taggctgacgaggggcgggcccaacttgtacggcccgaacgtacgtgatactcccgttccgttccggcccaactataatgggccgcaggtgttgttccggctcaattagagggggcctaaacaaacgagagctcactttggtatcagctgcgtctgtgtgtgtcaagctaccactactcgtgtatcaggtggctgccgagccagtggatcagtggatggatgggcaaaagatcgaaaaataccggaaaccactgtagcagcagtccactagtgtgcaggaaatttggtggtcatcgctactactggctgcacctacgctactgttgcatcgtcgtcgaattcgttcgtctagtgcatctcagccgcattctctgatcatctcatcgtcgtccttctctgtagactgtagtgtgtataaatgtacacacgtactgatcaatagtagtagtggcggcatacagtagacaaatagaaaaatacgatatactgtactagctactacgatacacttgtacacgtacatgtgtagtacagcctgcaaaccgtgcacgtggattgatctgtacaagaacctaacaatttaatttcttttttccctagcttactatcacgtgtagcgtgtgctgaaaaggattggtggtagtatgacctaatgtatagaagcaaggtttacgagagtgaactaatgtgacttttggaattgagtttgtttaacaattcagatccacttgtatatactaagtaaaattcatgcttatagtatgagcatatacaccactagtacaaaaacgatgtctagtgcactagtattgtagggacactagaagacatttttctagtactatagagacacttttcaaatgtctttacaatactatagaggcattttaaaaaatgtctaataagtgccttatggtgaattgtctctataaacgaagaggcattttataaaatatctataaggtggtagagacattttctagagacattaaattgtaccacaaccatatgaaaccagtaaaatgagaataaaatattttcccttgtttttgccaatccttaaactcatgatctcttgaacaaatcattcttatcttcaaggcactaaccaactcaaccccatgtcattcattgtatatgtttatgccttaagttacttatatttagtcatttagtatatttttattgtaagaagtgtctctacagagtttaaagtgtctcaagcaaacgtctttacatgttagacacattttaaagtgccgaaagaatgcctctacaagatataatctaataaaatgtgttgaaaatatttctaaagtgtctctagagtaaaaattttctagataattttgaaagtgtctctataaagtgtctctacgctataaactcatgatcttagaggcaatttgcaaaatgcctctacaaaagtgtctttatataatgtttttgttgtagtggggagaaattatgaatggcgtataagtaatttgttaaaccactagcctcaacggaacccctcctcttgcctcgtgtcgtgtacattgctgatccccttccccatcatccacctaaggtggtgctgcaccagtggcggatccagcgcagaggctaaggggcataagccccctacttgttggatctctatggaaagagagggttatcgtttcacaactctagcctaatatatcaccatggcagtgaatgaaggggtcgttcctatggatgttggttccgcgtgtgtcatccgtaatatagttacagcttgacggttttactatagacgttgggccgtcatcttacatcaatcactgaaggatgaagtaatgggcacaaacttcctcttcccaagcctaacgccaagtcgttcaccagttcctttgctgaagtcgtctcaactatctctaagtccaaggcgatgtggttgctcagtggaaacctcctctacttccattgccattccctttctagccaccagcccttctccacccgaggtgatgtctccctaaattttttcctatgttttgggtatgccagtgcacaccgacaatccatgggttcaccctgatatgggataataagaagtggtgtcttaccatctattactgatgagaagaaaatttatgagaggaccgttctcacattggcatgataccgttctggtatgccgctaataacaacaattaatatgtaatttaggctcatagctcgatatatatatggatcggaattaattaatgtaccacacgtaactagaaaagtcagctaaaatcaaagatgacacgagaaactaacgtacacatgctaccttaccactcacgccatagctaaaggagtactacagtgtaaggccaaaatatgccgcatacgcttacacttccatcgccggctagctgagacaacggtgcaatgcagtgattaccggccggtactgcgtcaattcaagccaacacacgaccaaacatttccatgtaggagtataaatttaagtctcgtacatctgattaattgacggtcgttattctagctagcagctggctctcaaatctcatcggttcaattaattcgtctacagtatactaactactcgttgatcatgcatactctctccatacttgtaaaggaagtcgtttaggacagcgacacgatctccaaaacacaactttgacttcttatttctataaaaatatttattaaaaaaattatatatgtatacttttatgaaagtacttttcaagacaaatctatacatataatttttacatttttaaactcaagaacttgaaagttattcatgatttatatttttaaggtttgacttaaacattgtcctaaacgactttctttatgactatggagtagtatatatctactcgatcagagtctgcatgcatgtacctactatataggagtatatgttagcggctagtctctctaaaaagatgacagagtgttagattaatagttaggatttacggcctatcttttcgtttattcttatacttatcagctaaaatttaaattttcaatattaaatttaaaattgattttaatatttttttcatcatagtttatttttcaacatctgtttttagatcactaagaatatgtatataaaagttttattataaattattttccgtttgtaaatatgttgtttgacttatttcttgaataagccaaatgatgggactattagttttctatgggatggagggtgtactggtccatgcagctgcaacaggaaaccggccggtcgatcgagcaaataatacatgggtcgcagcgctactgtgcacgagagcgattgagcctgcacgcatgcagtaaactgtggtccaacacgtctaaaaagaggccgtttttgcacggcgcgacgactgtggcattgcctacctatagtacagccctacatatgctagctaaagaaaatttcgttccaaattaagatatattatatgatacatcatcgacacccaagtgatgaaaaacacacaccattcatacatatatattttttagaaataaggtgttgtctaatatttaagtacatcgacaaaacgatatatatacatgtatatatgtcggattaagtacgggtatagaaaacaattcagtctaatctcgcatgataaaccgtttaattacacagccacctataatctatggcaagtgaaaaatcaattgtttatatagtcgtaaaatcgatcgtctattatagtcttattaggccaagtcctagattgacctactattttaaaccacatttaaaacatgataaaaaaatgaatacaatattatcgactcataggctaacaactctgaaaaattgagttgtccatatattcaacacaactaccctaccacgtggatcggtggatgctacagtgcatccgatagcttataccacttcaattaatgcatatgcttccgtttccatttgaccaaattaaacgaagtgttcgtggtacaaacgtacgttccttcaattaaattcggaaatgattgcactaacgggcgtactttctccgtcctaatttaagtgcaaccataagttttcgcgtccaattttaatcatccgtcttatttaattttttttataattagtatttttattattatgagatgataaaacattaatagtattttatacgtaacttatatttttaaattttttaaaaatagttttaaataagacaaacggtcaaagctgtgcacgaaaaattatgactgcacttaaaattagacggagaaagtaattaagtttacgttaggtgctaaagtagctgtcagaacaacacgacaagtcggtacaatattcctatgaagtttgtcacgtcagagagagagttatggatcaatacgtgtcgtcggttgcattgcatttgcaattaacacgtccatcaatatgtaacagaggtacatcaaacgtacttaaaaacacattacctacaagcctaaaactagctagccatcgacactgttagtgcaacatgcatccaacagcaatgcaaacaaatacaactagacatgtttaatactttatcttgcatgagtaactagaaggtcgtataattaaccatataaaagtacattgaaacataaaccagtagatatcactttcttcattaacatatatgacctttctataaatgcagctatagtgtggacttttaaagctcgaaagttcttaaaatattatcacacattctaaatttggataaaaggataattagccactgttgtttcccttcatcttttgagggattttctctgaagttgttttagaagggagattttctctgaagttaacagttactacatgaacaaccatctgagatatatagaacgccaagtagccacgtaggatatatatatatatatatatatatatatatatatatatatatatatatatatatctgtgtgtgcgcgcgcgcgcgctgatgaggattgaggagacaagagaaggaggagatagtataacatcatgtcaccattaacaagagaaggaggagatgattcaccttattcaaaaatttatttatttattactttgctataatttattttgtcactacaacttacaagtaagggtggatccatcgtgggtgctagaaggactcgactctctcctatctcgttggatcaccattgatagaatgagttaaggagggggggctgaaggaggaaaaagaagatgagccctccctctaatcatctattttatttacaaatgatcgaacgttttgttttcgctgtgtcgctgacggaccttcactcacttgtcacttaatctctaatgggtaacgagggctctaccggtcagagattatatatagtccaagcccgtcagatggacgtaagtagaaaaaaaatcgtcagaaaaaaaatggactagtagattgagtagagactcgtggcatgcaactgtcggaggcggcaacccacgtaccggcggccaagcttccggaccctcgcgcggcggttgcggccggggccggccggagagacgtaccggagacgcgtcgcggagacggagcccccaccgtctctaaatgccgccgcccttttggtactttgatgctgcagacgtacgactcccaattcaattctcatgctgtttccatttaattttcgtatacagattgccagggattctgattaattaagtttgtggtgatcttaattagccccccgccctgctactgctagatgttcctttcaaatacagagaaaaagtcgcctagtagatgcgaatgtgatggaattttgccggaactgaatttaattatgagttggtacgcttgagggggggatgatgatcaaatgctgtaaacactgtacttaattttgcatgttgagtggtgctgtcgagtgtaaactgtatggttgctgtgctatgctgcaatggcaagagcagtaggatgtgtcttgtgaccacagttggtacgtagtacgtgatcctttttttctgatgatatgcatggctgcaaactgagactctgacaaaagagataaaactgcgcatatgtttggagtaatgtgctatatatgtaagcgttatgctgctaattaagctcgtgtgaaggcacaccaaacatatgcatctcaagcaaaggagataaaaattacgagtgctcctagtattcttcacacaggacacacaatagatgatattcaattgacaagagcgtcatgtatgatctatctgagtatatctgaccataggtaacagatatacatagactttatcagctccaaggcaagtagctagcaggcaaccaatttgtgaatgatatatattattcgcttgtgaatttttcagtggatttctttgggtccaacttgtggtagattggtggtggatgcatgtgtaccgggaagcagaattttcatatagtaattaattataacctggaattaatgagagtagacagtggaagttcattacagtatactagtataggattcaagatccatgcaagctcgatctctgtctactccttttgtactgagattttccttaacttttcaataaaaaagcagggttcttagaaaaaaaataataatgagagggccacttgatttttagtattacaattccaaaatggagggcaatatatgttaccatgtgccgtatgcactaattaatctgaagcttgactacttcagtggtactggctaaccttttcttttctgaaaaatgaacgcatgcatgacgaaaaaaccgacatcttgttacaaagaaatgttccatagtagctgagtactgtacatctatcatggattgtatttaaataatggatgtaagtagactttgtgttcttatcttgtcctttgtttattaattctttctgaagaaataggaattcttatcttgcaatcgattgtggttacatatcctcatcaatatgtggtcctcatcttatcatggatatgatgcatgtacatatatatactttgcattgtgtgtggttccttcccttttgaatcaagaaaataatatcaaaataagtatctagtaaggaccttgctctgcattaccgtttgcttgtgtcacggatttgtcttgtttcatctgtttcagagatgtgtcctgccttccttgttatcttgttcttttcaaaaaacggacaggaaatcttgatgtcttcctggaccagctgctagctagattcagcttgttgtagttaaaaactactgctactgctactaaatgttacagaaactatacaagttatcgtgcttaatcattagtcctgtcacatgaagaaactccaaagtttcatgtgatgtagtaccaagtcccaacaaaaaactaccagatacagtacaatccagagataagttacctcaactcctcaaccagacaagaaacaagaagacaagcagaagagggcactggcaataatattcatcaaagcaataaactggaaccatttccacagaagtaaattcagaaatattttttagataatactgagaatctcagaaatcttagcacagtaagatatatacggtctttaatctaaccttgcagaacaaagaaaaatagctagtacagtagttatcacctaaattgactcgactcaagagcagtcaaatgtaactgtcaattagtaattaagcgagtgaaattgttgtgctagtactctctgctgtccccaactgattgcgccccacataatgcaagaaagagatagagagaaaatgacttatcttgcttttttctaaggaaaaagaaccaaatttggccagctatatggattagatttagcccactgctagctcagagccgcctataaaagacgcccatatgcccagccatcccacaggcagaggaccatcctagcaaacgctgcacttgtgctcagttcgtccccatgctacaccaatctcttcagaatctatctcagatcggcacttacctatagctgaaatgatcagatatcctcactaatcaggtactcccaagatgcaataaaacactatttctttcctgtttttgttcttcttcttgatttctactccgttatgttaatcttggcagcaatagattctgttgggctagatatatatcttgcgtatgttgatcagcatttttggttgggagttagattctgaatttattgctaatcatgcagttgcatactcttgcatgtgtttctgctgacacgagctcatttaatttgcagttaattgcagtggtagtagcagcagatagctacaggcgagtttagctagccaatttggaagcctcgccggcggcgaccgcgtcatgtacatggacgccttcgggtggagcgcgccagccgcgccgtgccagccgagctgcggccccggcggcgacgacgacgacgacgtcctcctcgccgccgtcttgggcgcgagcttcgagctccactccctcgtcgacggcggcggcaacggcgccgccggcgccgttcgctctgacgatgcctacggcctcgacgtcgacctgccgtcccaccagatgagcctcctgcgttgccaagatggtctgagtgctcttcacggcgacgcgtccccgacggcggcggcggcggcgttccttgactcggtggatgtgttgccagtgccggccatcgccggcgcgacgcacgacgacggcgggctcctcgataggttcgcgttcccgaacgttgccgagacgacgaccgtgcaagccgccgcgtcgaacaccgccttctccggatacagcagcaacaccaccggcggcggcaacatctcctccggcgagtcgaacacctacacggaggtggcgtcgacgccgtgcgccgtg

SEQ ID NO: 38674 - DNA, 17251 bp, Oryza sativa
  unsure (1)..(17251): unsure at all n locations
cgcaggtgaaggagatgatctaccgcgcggcggcgatgcgcccggtcaccctcggcggcgccgcctccgcctccgacccgtcatcggcggcgccgccgccgccccagcggccgcggcgcaagaacgtgcgcatctccagcgacccgcagacggtggcggcgcggctgcggcgggagcgggtgagcgagcgcctgcgcgtgctgcagcggctggtccccggcggcagcaagatggacacggccaccatgctcgacgaggccgccagctacctcaagttcctcaagtcgcagctcgaggcgctggaaaccctagggaatggcaatggcaacggcaacctgttgcaccatggctactacactggatcaagaaatgctactgctactgctgctactggttctagcaatagcactgtacttgcatttgggcgagatggacttgctggctttgtgaaatccaataggaatttgcaattgtagtactgtgtaccatgcatgattcatgcatgcatgcaaggtgtgtattcgtgtgagtgacatatatatattttatacatgcatgagacaaatctcttgctgttcaagctgataaaaattaatgcttcatttttaccttttgatcgattgagaggattttatatgattaacagtgtgtaactagggctgagttcttattttacttttccgactcatctccctcgtattttacacgcacgctttttaaattattaaatggtgtgtttttttaaaaaaaaattatatatgaaagttactttaaaaaatcatattaatatatttttctaattaatgttagctaatatttaattaattatgtactaaacgctattttgttttgcatggatcgatgcagtaataacgtatagtacatgacattgacatgagtaaattaatcagtgatctcttttttgcccaagtacttcaattccaagggtaaaaatgagagagagaaaaaggtgtatgcactttctgtctgcctgacatcgccgaactttttccatgttggacgatgcaaaaaaccatcagaaagacctgctccttttgttgctaaaatttaacagcctttttttgcaatgcatgcatgcaacgcaagcaagcaaagaaaacacaaagtaaaattggaatcatgatagttctgatgattgattactatagctaccacccctacacatctctgaattggaatcacgccacatatgatgtgagaaaattggacaggaattgatcagacacaattgggacatgtacatatccatgctttgtgtcccttttgacatgatcatctcttcctgggtgttgttgctgtcgaccatgcatctgggcttgaaatgtgccaatgtgccattggaattggaatcgaaatctttgatcttttgccggctgcagggcactgtagcatcttgcatttgcacgcctttagctcgcttttttttgtgtgtgtgggttagctaattgagcttagctaggggaataacaagatgagaaacggaatgcatatgttggtgttggtgtatcggtaccaccacgctttgggctgcccaatgccaaaagacattccctttgggcctgacccccatgtgtggcagtgtacccctgtcccctctctccattctggagtactacacctcgtttgctgccaaagcttgctaccttgagaacaccaccactgtgcactgaccaaagctgctgctgcagcagcattcttcaattctattcctgtgtgctaatggcagtatgcccctccatctctttgtctctgaagaagtctgaaccttttctttcttttaaaccaaccgcaccaaacgagacaaatacgaggttttatatattgctatagtagaaaaaatataaaattataatcctaataggctaaatcataaaagaaaaaaaaacacaacaccacgaactgatgtcttctatacgtcagcttgagaaaagaatcgacaccaaaccaaccatcgctatgtgtgaccgatcaccaacatctctacaaccgtgtataggtgcactttgaagtctgaactttgaaatgtatgaggagtattattgttcatgcttctctctatctatctctgaagaagaagaagtctgaactttcacctgcagtttttgtggtgacatgaggtgagagttcgatgcaagtttccatggtttgatcactcgcatgcatcatgcactgccggcaccgcgtttttctgtgcgtaacaaactcgtggcgtcatggcgaaattaaaggccggcgaagaaattgaagggggctgttttgactggaacgatcgaatcagaattcagagagctgaattttgggcgtggctagctgttcatgagtgtgtgtatatgtattcttgtgacgggagatgcagctgtgtggctggctggctggctgggcagtttgatgatgcttgtaaacggctttgctataaatttcaggaacagatcggcttacgttgttttggttacttatttatttctgtccgttggagaaaacgcactgctgattcagacctggatcagagtgataaaattaaacaactgttaattttttttatatatatatatgaaactccacagcatattaattgatactgtttgttctgtgtaggtgtttgttatggttacgtttaaatatacagagtatcttagagtatcagtacgactatattcttgtcagacatgctaagttacatagctgatggcctgatatatatatacactgctatttttttttaacaaaagctagcttgatgtatatatacagcaagctgttcacgttttgtactgttgaatacactattttagattgttggctaagactttatttcaagtacactgtgcaaaggtcacagtagatttaattataatatccgtaccaatttttatatgctttatatatgtagagcctgtttatgaggactctggatatgctgctcttctaggtgcacatcgtggttcatgaagaatataatctacactatccgtatcgaaacatatatagcaatttttagatagtgacacttgtatatatcatggaggaggttagaaggacttgtttgcattctcatagcaaggttaatagtaccggcgactgctggctgcaaccgagtgccacgtccaacaatagacagctaatctacaatgtatacaacaacaggcaacacttctttattttttttaatcaagctagtgtctactccgaaggaaccagccagtatttcacgtccatattcatttttccattggttgttgtgagagcaggtgggcccatggtaggtaaaatgcataggctcgcgcgaagagccggcgactaaatagtcgctcgcttttctctctacaatttttctttctcagccacatatacaaaaatcatcctatgtaagcaggctattagcccactgttgtacctgctctcagggtgggtgtgtgggtgggagcagacccggaattggttaggatgataataaagctatagggtttgttcgactgcccttatttacactgtgttgcagcttatacgacgatattttatacgtgcagcatgtggcaacaaagagcagccgaacatacccatagttagtacatgcagtttattaataaaatttagaatgaaatttaaattctagaagttgttatttttaagacatgaaatactctataaagaataaaaacatcttaaggaagaatgtctatatatggagataaagtaaagtagcaatttaaactaaaattatataagtactaggtaggtagggttgtgaaagaaaccatatatcttgaccgattatcgcccctacacatgtgactcgaattttctgataagaatcaagctactcgtatactccttgaaggaagcataaaacattttgtatgcccacactagcagcctactacactagtgattaaaaaacaacgagcttgttctaagcaaatttcccattggttcattctatcaaaatcccttacaaacaatgcttttaactgtgattctttaaactcagttagaagttactggaaaaccaagatgaaatcacagtgctctaattatttgtatcttacagatagatgacagagcttgggcttctcgctcttggagagggggaggagttgggggtagcccacaatatcaggcccatctactgtgagatgggctggatatcgcactattaggcccatcaatgaaatcttgccaggtttcacccatgggccttccacattttctattatttatttttttaggcctaatccttcttccctaccgcctcgccgtcgccgctcgccaccggcgccggagccggccgctggatccgccaaaccaccggcgccagagcctcggcggcctcgcttcctatcttcctcctcccatggctccactggattccggcggcgtcaccgcctcatcgcccctcccccccgatccccaaagccacccgtcgaatcgagtccgaatagtatgagcagctgcggcctcggtgcgattccggttcggattccagctgcggcccgcggcggatgctatctagtcgcggccgcggggacgccattgcgatctcagggcatcagatgcgcgcgccaaaccccacgccgccgcgcgactccgccatggctaggaggaggaaaggttcgtcctatcgccgccgccgccgccgccgccggcgggcgcccgcggcttgcggcgacaaccgcatcgacgacctgacggacgatctgctgctgatcatcctgcggaggctcgacacccgctccgcgctcgccaccgcggcgctctccaggcgctggtccggcctcgcgcgcgcgggcctcgaggctctcgatttcatggtcggcgacatcctcccgccgcgctaccaccggtgcatccagctccacgagtccgccagtggtgtgttcgatggcgccgacgagctcagaaccatcgttgctagcatcaggcggcacgagcgcctcgccatgcgaaacatggtcgcctccatcaacaacttcctcgacgccgatgatggttttgcccatggcgacggcggcggcggagctccacggaggaggatcagtaggctgcgggtggagttcatcgccacacactaccacgactgcatcaaccgcttggtcgccaaggctgttgatacttggggagttgaggatctagaggttcttggtaggacaacgtattggcggcatcattttcaggatgcccacatcttccgtcgccatggtctctgcaatgacccgcacagatcccgtttgcgaagcctgaagctggtggactgtgtgattcccccattgcaggggttccaagctctcaccaagctggtcctgcaagacttgcgggactccacacccgcggcagcctacgaagcagtgtgttcagctcatgcctacagttgcaagaggtgcacctcaagtcctgcccctgcaagcgcggcagtagtgttttcgttgatgcccccaggtcaatgatcaggcagcttgttctggagtgttgtggcgtccctgggtttgagctgcacgctctgccaatgcttgagagtatagttgtcatgcagacctgggtacggtacaagcttggatccttcccgcgcctcgtgcgcctgaacctcaaacgcgatggtctcaggcataaacttaacttttgcttgcctgcgaacttggatctcaagccgcatcttggattcactccagacataactgaccaggttatacgattcaccggatatgaaagatggtttcggccttcgtgcccttcgttgctgttaccaaagcttaccaggcttctgattgccgatgtgccttcatcatgggatatctcttggccccgactcctcctagaagcagcgccatgtctggagagccttcatatccatattaccccttgggaaggagagacttgcaatgatattttgtggcagccatccaagttgcagcacaaacggctaaaggagttggtgatcattggttttgaaggaacagagagacagatttactttgttaactttgtcattgaagtgtcaatggtactggagcttgtttccttgagtatggccgtgttcaggaaataggttactgggactggaacattgtgaggcaacaacaccgttggtgtgatgaggagagagcaaaaatactggatcagcttgctgataaaatttcttgctcagcaactccagttcaagtatttcttgagtgatctctcatgttttgtatccaaagcttaagttatcagacctagtaacctcaggaggcttttgaccgctgctgtgtctttttaccatggatgcctagagagtctcttgaatccatattgcccccttgaagttggcatgctcagctaatagagttgatgatagtaggatctgagggaacagaaagactgttttagtttgttaattttgtagtagaagtatcgatggtactgtagcttgttgctttgttaaaaagtgagcatgtatacatggttcatagagcctgggagatgactactgatgcagcaataccagatttctgatagaatttagtgctcaattactctaattcaagtagttttgggaaagccttctcatctatactttgttagttacatgtgaaagatgtcgaaaagcgactgtatattacatgcatgatgtggatatagttttgcctttaataaattgaaatgttgcgactgaaatgagtccatggttttagtagcattattgttttgttttggttgccatcctctgtccaaacttctgctgaagcaattctttcaaaggtaagatggagagtcccgctgcaatagcataaaccatgctatgtgaaacaatttgttcaatgaactgataaagtaataccttcctctgttcttatatatttttaataatattctactgagaggatggattcctacatatatttagatgcttgcagaaatatgttcttacctggtgagagtatgagacaaatttccacgggatgtggatggcatcaatcatgaaagctcttgaactgacaagattctaaggtcttttgcgagtagatccacccctctgatcttttcctcaacctcctttgttttccctcttttttcaggggccgcgtctttacttagtcgctagctggcgtatgtattctctccctttcccacccccagtgcttggttgtaaattgatttttttatagcttctaatacaaatgacatgcaaagtttttacgtgttcgaaaaaaaaaactactatgtacaaacctgagtggaatcactatgccttcctgttcaattctggttgttccgatggtttttaatcacataatgaccatttcccgtctatttatttttttggttgctttaactgtctattactgaattgcctggcagactgcacatcttcttataatccatgatactgcatttcttctgtgaatgcgcaaaaatcttacgcatcgatatattagcaaggaaaaaaaagattttacaactatgatctttggggggttacagggaaaagggagggcacagtggactaactcggaaagataaccggactcctgaaaataacaagagaaatggagaaaagagtttgtgtcacatggtactgcatttcttacatgtgatgtgagaactcacgagaactgtattgttatttattctatttttttgttaccgcttgagtgtcaaataattatttggttctgataaacaatgttggaaaaaaaatgtacattgcgaagttgtggttactggcatttcatacagtgattgagaagtgtcattttgttaaccatgcatattgggaaggaaaattcggaagactaaacaagaacatatgtatctattattttgcaaggctaaggaattaattcaccacatgtatgcaacttagggttcaatacgggtcctaatcgcatacatctcttcactattaatttcagtaatgcaagtaccaaaacttacatcttacattaattgtttgaaacttacaaatctatttcacatataataaaattaacattgatgggtgcaaagcctataaaaagttatacctaagaacttaataagaaacataattcaatcttgttagcacaagtataatagcatactataagctaactataaacatatatgtggaggagataacataggagagagaataaaaacggactacaaatttaatacgttgtgtgtatgtgagagatgtttttttaatgtgtatgagagatatgaccagatattaataatataatatatatatttacagacaattattatatgaatagactattagattagcaatagatgatttagagctattagttgactacactattaaacttactagctagtcaacatgagaaatcactcccggactaactgaaccggaatatctgtgcaagaaactctctcaccgatctgcttcagtacatcagctctgtcgtcactgctccaacgacgatcttcacgaacaatgtcgtagtcccagtaaacacctgcatatttgcacagactcacagacttcagagctaatgatacctccatcacaaagttaacaaagtaaacctgccttcccgtcccctcgaagccactcatccccaactccttcagcttcctgtgtcgcgactcgcatcgccgccacgagatctcgccgcggggctcgtcctcgcaggcggcgacatggacgtggaggatctcaaggcatggcgccacctccaagaggaggcgcggccatgagacgtcccacgacgatggcacgacgaccacgagctttcggaggtttggcagcgacggcaatggcgatgatggcggcgcatccatcgtcgccgccccgcgtccggtgaactccaggaacagctctgttatttctggggtgtactcagcaatctgcatcaggttcatgccccaaggcatggaggtggagtgatgatcatgcttgtatcgaaagatgaggttcaggcgtttgaggcatggcatggagccacgctggaaccatacgcaggtctgcaccacggccatctcctcgagctttggaagagcgtagagaatgatcaggccaccgccgcagtggtcgaacacaagctgctcgatcgatgaacacggagcgtttacccgtagaacgccatcgaacatgcaggatttgaggtgcagcactcgcagctgtgtgcaagaagtgaacaccgattcgtagtctgctggacgcgtggagcttggcagatgctgcaagacgaggatcctcagagcttggaacccttgcaatggcgggatcgtgcagttagccagcgtcaggcttgtcagagtggagctgcggggatcagagcagataccttggtgagggaagatgtggaggcggtccagcggccgtagctgatgcgcgggcgtcccagcaagaatctcgagatccttgaccccccaagcatcaatggccgtggcgatcaagcggttgatgctgtcggagtggtgattgatgatgaactccagcctcagcctagtgatcctcctccgtcgatcggggtcgtcgtcgtccggcgccgcgtcgaggaagctgtcgatggaggccaccattttccgcatggagaggcgctcgtacctgccggcgacaaccttggcatcgtcggcgtcgatgcctttagtggcgtgggggtggtggaggaggaggtggtcgcggcaccggtggtagcgcggcgggagcacgtcgctgacgaggaagtcgagggcgtcgagaccgcgacagagggaggcccagcgcctggagagcgcccccgtggcgagcgccgtgcgggtgtcgagccggcgcaggacgaggcgcagcaggtcgtccgggaggtcgctgatgcggtcctcgccgccgccgccgcagtccccggcgcgaccgacgacgacgacacccttccgcctagccacggtggccgcgcgcgacgtcgccgtccggaggcgagagagcgcgcccttcttcttcatcctagccatggtggtcggtggagagagcggcggcgagccggcgaatatatatggattccgcagaggcgcgattccgattccgatcggaatcatgaaatcgagtggccgaatcgcatcggaaacggccgggaattggatcacggcaggcccacggtactcggcccacgtcatacggcccatggtccacggcccacattctacgggccatgtagcggcccagcccattagtgggagcgaggcaattgcacgttttaccgcggagaggagcgcggtggggcgatctggaccgtcgatctgtagatcaacggctgaggacgggccagcgaggcgctgataggatccggatttggtgtgctcatcccgagacgggtcgagaagtgggggagagagagagaggggaggagatggcatataaaatgggcttcatcttcttcttcttcctctggctctggcttctggtggtgggggggaggaacaggaagaacacggccggccacaaaggcgtcccgattttctctctctgggttccgtactcttctcaccgcagcctgaggaatccattttgtcggttcttctcttgatctgtcggtgttcttgaggaggaggaggagaggagtgaggaatctttggctttgtcaggtgaattggagcgaggtgttcgcaggtactgcccttaacagtttgattcgctgcgtttttggttgtctctgtggtgttttgtttggtaaaatttttggtggggattggagttggaaaagttttactttcacagtgatggataaattttcccttctgaattgttgtgagttctggcttgtggtttgttcgaattctggattcttcggttcttgctaattggttgtttgatctggaagattcagttccctctttattcccccgggattaaattcctttttgcggctgctttttcctgtgctggaattcttctgccgttgtctgcgcctctgtctgcgattgggaatggagtgagggatgattcagactgggtaatttgaatccaatttcgccaagacgcattagttgcatcaagtgtgcttcatatctgagctgcctaacttgggatttgcgcggttgggggttctgattgggatcgacttgatttcgtcacaaatcttgtcagttttaatttggttttccttgtagtaggtcgattggaaagagggagctgattttccttaggtaggatgctggtaatgatttgggtcatcccctgtgttttgcttctctcgtgttgatgattttgtatacctcaccaagttagcacattttactcttgttttttctgctcccaaattggcttgttcgtctgctcgccgttttcttgttctcgtctcaaattttgtccgatttgttgtcccctctttctaactttttcactgtccatttctgtgttgaattttcaatattggttctctactgtaggattaccgaaaattgtatcgttctgttttttctcccctttatctaggttgctttttctttccagaatagatgagttaaattgaactgaatatctaccttcatcttaaattcgatctgttaatttgtctgattcttgcccgattttgagttcgttcagtctgaattttttttaaggtttcagtctgaatttttgaaagcaaagtggtcgcaaaactcccaaaagtttgcaactttatctggctgatttcctcggccccttaaaattgagttgcattttagtggtgtctcatcttgttccggtcatttgatcgggcagctgagaagattttttttttttttacttttgggtggagggtgaaattgagctaaagtttgttgaacttgcccttctcctagttcgtacggagaattaaagcggaagatttgtaataaaatcttgagattatttttagaccaattggtctgagctgaatagctgatctgtcctcaaagcaatttcctctgcaattcttcactattccaatctgattgaaattctagcaatttcccttcccaccatgaatctttcttccttcccttctgctgctgaatttctgtgttttttttttcttttctttttttttttgttgctgtgacacgtgcagggcgagctctggtccggcaatggagaaggaggcgaggaatcactaccacacgcggggctccacccgcggcggcggcggcggcggcggaacggcggcggagcgcgacctgctcctgcagtggggcaaccggaagcggctgcgctgcgtcaaggtgcaccgccgcgacgtcgacgccgccgccaccgtggccgccgagaaggccgcggctagccagcgccgtgcggccgccgccgcggcggctcaccaccaccgccaccacacaaccgccggccacgcccaccaccgcgctgtcaggtagccattttctctctctttttatttcttttttttttgtttaaaaatcatttttggtatttgcgatgttgccgtgcccgttgcgtgtgctctctgactgctttgttgttaagcgtcagttaaactaatgcgataagatttggagtaactgttgcgttgaaagaacaactggccgtcacgtgattggctgccccgggcacgtgacatcgagcagcgttagtgttcttgatctgattcggtttcactttgggtgtcattgccgttgtgactgtatgatgcagaggttactaagcacaaatagtggtttatatattgatgtaggcacacattataagcaatgaattgatggttttggtttgtaacgggagatgattatggtgtccaaaatcgttgggtttgtctacgggatgtgaaatgaagaccatgatgtttttgtggtcttgacactaattttctttgtttgattctggtgtgctagatactggttttactttttatgggtgattgtgttactttttatgctcaaattgggtctttgaaaggctaaaatattggacaatttgagggatatgttctttcaataacaagcaagatggtacttgctgaattttttggtcaatctatctccaaggttccaacttagctgacttggtttggctgtcgatctctatctaggtcagggccatatgtgaattattaagagttcttttctgaaacggaactgccaattgtgaaggctgcttccgtttcggttgcctcatccagtgtatgcggctttgctacaacgatgttctttgcgaaacaactgtgtatgaggttgacgctaatagcttatcataattacattcggtctgcctttgcatgctagtctcagctaattttctgtcgactaattttggcttgaggggggaacaccatatttatctcaagtcagtcacaaccactcgtaaggtggatggtgacaacttgttcattcattgtgacgttctctttcttcctgtaatactttgtttcttatctggagatgatgaaacatgacataggtaattgctgaaatttattgcctgcttacttgtcccttcccccaaaatgtgatgaatcatgcatttttggtgctccatttctccctatgtgagaatctaagaatgatttgctgtaagaagatttagagataaaaatctatttatccagttttcaccgcgaaatcagtcactgttgttgaatgttcattttgtttctagcaatagattatctgtcaccttattttgcttgactaataagaaaaacacaggactgcctactgaagattaaacatacagttactgtgcttaatggaggttagatgtacacaacctttttatgaagagaattaaatgcacaattttgtcaaagtgttcggtttgtctaattctactactcctcggatgaataggcagagctccagccaagtttttcctctaaaaaaaataatcatttttggctctatgttctccttttcggccagacaagcttcagaatctaacattggttgcttgcaaccacaaccaaaccaaaatcaaaagataacattagcacgttgccattttttctgcatcacttataatagccggtgttctggattggtaggaattcagaggagtctggagcaatgagatcttcagcgcagcagcatcagatgaacgggatccgggcagtcgcctcacctgaaagagaacgccctgcaaggggcagcaacatcatcaacaacaatggaggtccgccgacctccccagatgacaagaagggttcgtcgtcagggagcgaggggtcgatctggcccaaatttgcagtcgccctgacgaacaaagagaaagaagaggacttctgggtgttcaaaggatccaagcttcctcagaggcccaagaagagagccaaagtcatccagaggacagtgaatgtatgcacctttcatcttagctttatatctcattaaattcaatgcattccagttcacatcaatgcgcataggattcttatcttggggcatgtttagttcccaaaacatcacatcgaatatttggatacatgcatggagcattaatatattgatttttaaaaaaactaattgcacagttataggggaaatcgtgagatgaatcttttgagcctaattagtccatgattagccataagtgctacagtaactcacatgtactaatgacagattaattaggctcaaaagattcgtctcgcggtttccatgcgagttatgaaattagcttttttattcgtgtctaaaaacctcttctaacattcggtcaaacgtccaatgtgacaccanaaagtttccttttcgtgaactaaacaggcccttggtgcatatgatatggtaaataattgtgtatatgttccttgcttgttgcacagagattctaaactcattattgcaacatgctattagcctgtagttgtcagctcctaacttactgtgctatagttcagtaacacaagaatttgccatgacatactggctatgcatttttttaaaaattttaaatagatgacatgagatcacatggaacatagggccacctctgcgcacgctgcttgccttgctccttaaccaaacaagacgtgcaaatataatactgatatgcagtggatgcttcatttattaaatttgtttgcctagaggtgtccataattcggtatgcttctgtctgaagcaaacataagacagattaaaagctgattgtgatttccatttgattgccacctcaatgcttgatctgtacggtccctaccattgagtgtgatccttaccttccttcattgaagcagccaaacgaattgccatacttttcatcttgtgactacattacagtttctgtatcaatgagctgatctggcaggcaatttgccaggaagtgctgtgctgtttcagttgagttccatttctaatatatggcagatcaatgattagttagttgtgtcctacgcaggcttaagttatgagtcagacaaccattgatatctattgttttgtcgatatgattctcttgaggttgcatataaccccgtcaccatattattcttccctaagttctgttcatctttggcagcttgtatgccctggaacatggctttgcgacttgacactggaaagatacgaagtccgagagaagaaggtttctaaaaaggtgagttggattggattagtaacatgctaaaatcaatttcagtcttgcaactccctagatgacatcctcgattaaatgagcctccttgattgttttctggtttcacagcgccccagggggttgaaagcaatgcacaacatggacagcgactctgaataataggatcactgaacacgaagcagctgaacattagaaaggagataattgcgcatacccatttagctgaagatttttcagctttctgatggaacaatcacgggctcgccgcttctcgcgcttaatttgaggagatcaagatgactggactgtcgtaatttggaagctgcacagaagaacacagaggctgcaggaaatatgtttgctctgaacactgtctgctgtctgcctaccagcaacgcggctctgaatgttttccaagtttctcatgtatacgtcttgctacctaaaatgtgaagcacactgctcaggccagtccagtttgatcgatgtgtagcttgccctgtgcatgacaatagcagttaacacgaatctgatagtcttcaatatttttatcacctggtgctgtaaattcagagagtgagataatgccaggcgtaaatcttctgttgtaattcagagcagacaaaactgtcgaacgtttcgatttgaatggccattgtattccattgtggtctgaaaccgactgacagctctacgtcgagctaattcttcatgtcgcattcgtgtcattgcaatttcatcgctcgctttcacagtaagggggtgtttatctatgggtgtaaagttttggcgtatcacatcggatataaatatagactaataacaaaacaaattagagatttcgcctataaactgcgagacgaatttattaagcctaattaatccattattagcaaatgtttactgtagcatcacattgtcgaatcatggagcaattaggcttaaaagattcgtttcgcaatttacatgcaatctgtataattaattatttttttcgtttatatttaatactctatgcatgtgtccaaacatttgatgtgatagggtgacaaattttaccaggaaatctaaacaggccctaaaatgtactggagtacttctgaactgctaaatcctgtacatttgcaacgtaggaaactggagatccgatgaaaaatccgacatccgattcatgtcagaattgcaacgcatgtcacttgcaaatctgcaactatggtatatacatttccttttgccagcatatatgttaaacaattcgaaaggaattccaacatgtacgtgtacgcctgctgctttacagccatgagatggctgctttactgatctgcttttacgctttatcccatttgttaacccctttctatcccaactaaagcttcaccttttctctctaggaatgggatgtaaattgtatgagaaaataccaaaaaaaaagaaagaaaaggaagtgatatgtgctttgtccaaacagaaagagcaaagcagactacgacactacagttttttctctcttttttttctttgaaataatacgccactactgattaactatgaaagaaagtgattttacgttttttatcagtaggtataacattctctagtgaaaattttggtaacttaaaatattattttattttattttttacatctctgggtacgccaaaaattttctcatgaaagaaacatcactccaaaagcaacatgtatcaccatcaaaacaaatgatcagtcaagctcttagtgctgaaaacgagggctgcagga

SEQ ID NO: 38675 - DNA, 21610 bp, Oryza sativa
aatgagtagctgtttctgaatatgtcaatacgttaccttttctcttgtagatttatatgatgccagaggggaacaaaaagaaggagctacgactttatcgagctactaagtttcctcttgaatggacattggagaaggtgctcattgataagccacttattgattcctcattagttcaatatgatggactgtggtggctgtttgcctcagattttacacggcatggtatagaaaagaatgcagagcttgaaatttggtacagcaactcacctcttggtccttggagtgaacataagcaaaaccctatttacagatctgacaaaagtttaggagctcgaaacggtggaaggctattcatctttgaagggtcattgtatcgtccagggcaggattgcagtggtacctatggacggaaggttaagctgtacaagattgaaaagctaactaaggaagaatacaaagaggttccggtaaatcttggaatcgaagaggcaaagaaagggaggaatgcttggaatggtatgaggtaccatcacatagatgcacagcaacttgcctctggtggatgggttgctgtcatggatggtgatcgtgtcccttcaggtgattcaacaagacggtctctatttggttacatgggttttttggtagctgttgctctggtcacttttgtaggttttgtaaaaggtgcaatcagttgctacattcctccaagtttttgggttcctctaactaggagaagtgagttatctcgtattttacctgtgcatcgcttcaacctgaaaatccgtagatattcaaccagtattggcaggaatatctctgctaccaaagcaaggctcagtgagaaaacatggtcaaacacactattcttttgtgtgattgctctcataggtattgttaatgtctgcattgctgtgcatttcttacttggtggcaatggcgctgaagaggcatatacacatcaagggcagcactctcaatttacaatggtcacaatgacatatgaagctcgactctggaacctgaaactatttgttgaacactactctagatgtgagtcagtcagagagatagttgttgtctggaacaaaggcaaccatcctaccagcgacgcctttgattcaacagtccctgtcagaatacgtgtggaagaaatcaactcccttaacaaccgatttaggggtgaccctttgataaagacaagggctgtcctggaactggatgatgatatcatgatgacttgcagtgatgtagagaaaggattcaaggtatggagagaacaccctgagaggatggtgggcttttaccctcgaatgatagacggtgatcctttgcagtacaggaatgagcgatatgctcggggcaagaagggctacaatttgatcctcacaggtgctgctttcatggacagtgagttcgctttcagtaaatactggagtcaagaagctaaggaaggcagagactatgtccacaagaacttcaactgcgaggacttgctcatgaattttctgtatgcaaatgcaagctcttcgaggactgtggagtatgttcaccctgcttgggctatcgacacttccaagctttcttcagttgctattagccgagacacgcagaagcactatgacatcagaacgaaatgcttggcgaagttcgcctccatatatggccctctcccccagaaatggctatttggcatgagagaggatggctgggacaaatagtctcgacaaggcggaatagacagccaacacatgcaaattgttgaatatttttgttcctacaacttcctttttggtagaagtgacttgtttagtgatgtaatttgggtagaagccaagaaccttgtaaatcatgatctgttcaaagtggatgattctctgtagcttttgatgaacatgttaaaatagccaaattcaatgcagttttctttgtgagtgaagcgtcaaaactgcatggattcaatccttcctgttttattagcactctgggaattataactgttcgatgtattgtataacctttatgaatgtttaactaatgtacaatcaacacatagtttggtttcattattctaggaccaattcaacttggtccatcgaacagcaaaccccctccatgatctgctccttcacggcgagcttctcctcatcgctccaagtacatttctggctcaccatctcccattcacctgggcctctatcctcgacgtgtccatgcttgatcagcacaacacggcgcaacgccatggatgcttcctccatgacgtacctcacaaactgaacctgcctctctttcttgctctggaaaccaatgaccacaagctcctccagattgtcacaatgctgtgttcttgacggctcattctcccacactatctccaatctccgacgatccgccgccgggtcgtcgtcgtcttggcgatagtgttgggagaagtggacgtggaggcgctcaagcgacggcgccgccgcctcgacgacggcgcggatccacgtcgcgtcccagcgcggcggcacgtcggcgaccagcagcctcctcaggctgggcatctccaggaaagggctctccgggacgacccacatctgaggccccgtgagacgcagcgcgagatccgtcacgttaatggcggccctgcagaggtagccgagcgcggacagcgcggcgtcgcgcttgatcctctcctgcaatggctgcagtccgggggatccccttccatctggccgacgcggaacgcgacggtggcgcgcgcgaggcgcggcgcggcgtcggcgtcggggcggtacagctccacgctgttctggacagcgacgagcgtctcgaggctggggagtccgtggaggaagcgtacgctcatgtcgccgccgccgacgacgacgagctcccggaggtccggcaatggcgcgtcgatcacgaccttggagtagcggcatcggcaggagacgaggtggagggctcggagcgacgggcagctcgccacggcgcgctcgtagacggccgcccgcgtcgtgcggggcaagccgcgcaggaccagcgtggtgagcgcgtcgaagcctcggagatccggaggccggcatctggtgagctcgagcgtccttagccgggagccgtgggggtcgtcgctgatgcggccgtcggggaacctgtaggccgggtgatccagctgcgccgacgacgacgacgtcaggagaacggcggcgacgtcgaggtgctcgacgccccacgcgtcgacggccgtggtgatcaggcggttgatgtggttcgagctgttggtgtcgatgaactccaccgcgagcctgtggacgctccggcgcggcgtcgacggcgagagctccttcatgcaggcggccatggcgcgcatggcgcggcgctcgtaccgtctgatgacggcgtcgtacttcttgccgtagtcgtacacccagaacgacctcttggcctcgtcgcgccggcgaagctctaggtagtagtcgcgcggcaggatgtcggcgaccctcagatcgaggctgggcagctcgcgcgcgaggccggcccagcgcttgcccagcgcggcgcgggagttgacgcggcgcaagatttcgcggagcacatcgtccgggagatcgctgattttgcgaatcggaaccagttaattttgcgcggcaaagccaattttgttggttcttcatacactacgcagcaaccaaaccaacactacaaatccctagtagagaagagagacgtactacatagatgaactagtattagacgaagttctggacttctggtttactaggaacatagaaaacatcagatggaggatgagttacaaacatgggagttaaaattgaaatgacacgtgcaggaggtcttgttgatgaatggcacaatcgaacttatttcttctttccgccggctccctttgttttcttgttagcgactgctttggttggtttttctgaagtgtcctgccattatatcatagaaacaaatcatgagacataatattgctacaaaaatataattatggccacaacatttgcaagcctacatatagtatagcactatggttgcagttttacatggaacagtacaagatctgcgagaaaatcatgccaaacaaggctataaccttctcatagtagaaggattttagcatggcttacaagattcagctttggctattgtatctgcctacttctggctgcttgcaaatatattgttgagtactggtctaatggacatatttttatcattcatctgtgatctgttatttggcaggtacattggacaatcaaaacatcaaaccacgtgattcaacattgttagttgaatggacagataaagtacgcaattcaatgacatgaattggttgtatatcatgctacaatggatgaacctggagaaggctaaaagttctaaatttaagcacgacaagattgatggcattcaggttaaggtacctttcttttcagaggcactgatgtgctaacaactggcttgaagaaggattcgagcctggtcacattaattcaagagttggtatggtttaacaaatgatataggcatgcaacactcttagaaccaaagtataaaaatgtaccacaatgctcacgtctcaccttccttgggaagatttgttcttggcaaatttaatcttctctatggcctacataaaccggagaaacaaattgctgataaaaatatttcaagaatataacatagtaagtcagaagaaaagtgcatgcctttgtcactctatcttggttgaaaccattttctttcaccagaaactctacaagaccctggagaaagaattaaagtattgggacgacatcacttgtaaaatttgaaggcaaggaaaaaaaggtgacaggcatacttcctcatcgggagcattccatttcagctcaggaatatccaatgtaacattgggttccttgaacaagcgtcgagcttcttgataaggccagtcctcaggaatctgatatctgcagtaggcgatagatatgatcaaaatttagcacaaattagcataggaaatggtcttcatcacattacaatacatcattacatctaagtaagataatgcgaccaagaaatgaaataaagtggcacatatagaaaattttgggctgcctttgccacacagctgatatacatgtctcagttgagttctcagtcaagtgggaaatattcaaatagttcaaaagattaacctgtctttatttatgttttccagaatgctttctatggacccatgttgacgaataagtttcagagctgtttgacctccaatacctagcggacaagcacacatagttggttaggaaaaaaagtttgcatggacagaaattcaagcaagcaagaatttataggaatactactcatgagaagagggaaagcaaaaatacctttaatgctatcacaatagtcacatccagataggatgcacaagtcaatgaattggtccatagtgagttcaagctcctccaaaacctgcaatatgaaaattggtcaagtgtgtacaacatcagtgtctgtaccaagcaaatcacagtgctgcatactttcgcgacttcaaattccataactggaattttcttggaacttggatccatcaaatgacgaagaaaccgtggagctccaaaagtaagagagtccatatcttctgatgcaactgcataaacctataaaaaaaacagtaattaataaaaatggaagcaagagatggaaacaagaaggcagaagtccactatgttaacattaccatatcatttatgcaaagtgcagcacattctgcttctgcttcacatggcgcctattggtaccggaaagaagatgtctttggatgagattgagagcatggcaaatacatgataaatcatagattttatgctagcatagtaaaataaacaaatccaacgattatatattgactcattccctgaaaaagcatgtggcaccaaagaaaattggatttacctctacaacaggaacccccataagtcttaatagtcgtttacattcttcattgtgctgcttcgtgacctgctcaaggaaaaagaagatgcaaagataaggttactctcatacttaccttttttgcatcttccatatcatgttattcaaaccaactgttttcattgatatttttctcagcgaatgaatctgttgtccctcaaacatcatagattttttttttacatttcttttagtgtgtaagatcaaccccccttctcaccttcacagttctcttgctgaatttttcaattgcgtctttatctccttcctgcacattaaaagtcatttctctggggatcaaggaaggaaggagaacaagcacaggacagaacataatagaacattgtaaatagcacaacaaactgttagctcacctctactgcctctgttagtttttggtggcatcctccctcttcgagacctgcagaacatgccatgttagaaacagatcatagcccaaaatgggatataggacaagttataagtagcagcaggaaaaacaatctaaggatgaaagaaacatatcatgcctttttgcgagctcttgtttcttcaatcaggaggcttgccgtcaaaaacatatctgcatgagtgtcacaatttaagtgtatttatatggataatttcaataacaacacatgaggaatttgggtttacactggcttgattcctgcctccagcaaccttattgtccggttgaacataccttgcaaatgactgcacagcaaaaagttctaatttataaaagaattaacagaatcctagcactagaaacggtgtaagattaatatttagaacctggtgacttcaccggcctcgttcgtgagggtttccatccccgtccttccaactacaatctatacaagtaaaacataaaaagctgtcccaacttataaagcagtgggtaaggatttcctaatacctcaccaaaacttgtcaagcatttgcacacagaacatatagtgaatgtaatatggaattgctatgctctactcccatttttaaagcaaaacatccaatgctagaggtgtttagtttaatgttaataaatatagccgaccaaagaagaaaatatgaggcacaatggaggtatcccaatttcacccaacccgatttggtctaagagagcaatttgaaatgaggaatccttacaacactgggcagttaaatagaaaaaaatacaatctctctcgcgcaatcaaaggcttaagaaaccctaaaccccaagtaagtgagcacatttcaaagccaactcgcagaatgtgagaggagacatgggggcatacgaggaactggtagatgctcatgctggcgtcgacggcaatgcgccggccgaagtagctctcgaacttctgctccttcatcgccttgggcgcattgtccgccaaaagcttcgtcaaaccctaacaaaaaaaaacccgcacaaaatcgagacgaaaacccatcacgaatcggccgcaaaaacagctacaacccacaccaccggtcacaaatccgaacgaggacggcgcggcaccccccccccctcccgcgctcaccttgatgcccatctcgcctccgacggatgcggcgagcggcggaggcggcggcggcggagacacagagagagaggtcgcgggctatttcgagttttcgtgctcggccccccgcctttgcgttttcacttcccgttctcgggccggtctgggctaaggctgggctgggtagaaccggtctagttgggcctcgagtacgggccgggtcgggctgaaattggactgcaacgcaacgtgcggcccacgtgatctgcagtctcatttcggcccaattgaaagcctaatcaggtgacgtgctgagcggtggcgctgttctttgccggtggcggcgttgcagaggcttgcggcggcgaggggacggaggcggaggcggaggcgagcggcggcggcggcgaggggagagagggatggcgaggcggttgtggaggtggtacgcggaccggcaattcaacaggtgggagaagacggtgctctgggacatggtggagccgtaccgcccgccgcgctcgttcgcgccactcatcggcacctacgtcgccgccttctacaccggcgtcgtcgcctccgccatcaccgagcagctttacaaggtcaggatactctaggaacagaccgctcctccactcctcctcccccctccctgcttcactccttgtggttgccctcggtggggcttccgcgcataaggtgctcgacggaatgcttaggccccttggtctcgaaacttggacatgaatttcgcatgcttcagtgatcaaaggtctgtttagcatatgttcccgtatggtatgattaacatgtactcggtagtagtagctagctggatcacaacaaattttggttgcatactttgttgaactgattaggagtttaggactgtcaatttaccctacaagcaagtttggccaggtttgattggtgatatatatatagaatcagatcgccctattgtcctatatgaatcaggttgtacaaaacaatgcaagcaatatacctttgaaataactaggattggcaatttgacctcaatttacagttgcttttgcctgattgtgaccgcattttggagcaggagaagtactgggaagatcatccgggcgaggccgtgccgctcatgccgcccaaattctactgggggccatggagggtgatgaacggagaagttccacgctttatgcagacaccagaagaggcgaaaccggcataaaatcttcaatgatcactgaatcttttaaatgttgcgtgtctgtaaggacacgatatgtagtgtttgttgcgtgaataaacagtttgcccccatcgatctcaaggcaagtagagttagatacgatctatattatacggtataaacggtttatttccccttatccccttataatgagaaattggaagtgttcatgagtcataaatcttcactccttgtttgtctactttgcattttcgccttcctgataacagtcgagttgtgatgtgtttgaatcagttcgtgcttatgaacatgtgcagcgtacgcacattcaaggagatcaggggagaataattcgttcaggtggtcggacaaatggtggttttgcgcaggcaaaattattgccaaaatgcatagtaaaatattgcagctttcacagtatcaatttcacatatgtagtaatctacaaaatgaggtgctgctccacattagttcagtttacatcagacggattcccaattcccaagtttaaaataaattatatctgtaacgtctttctcccgggccgtgaaattctgtagaaatattaagtactactactgcctttcaccacgaaaagacaactcacgtcatatagctttcaaaaaatcacccctttcatttgaggggcactgccttacatcaggagaagacatatcataaatcatgttacttgctctcaaaaatccatcccgctcatctgcggcatccgactagccattctggcctttgctgctgggggctcagcaacagctgcctctgtcgttgtcatcagcaaagaaacactgaaacaaaaacacaagttattaagcaagtgtggaaattttagtaatgcaaaggaaaaatagtaatcaacttaaggaacgtgcgtaccttgatgcatcttgtagcgctgttcggatgactttcacagggtcgatgatcccagccttaatcatgtcaacatactcccctgtagttggcaaagagcaggaatcagctaatgaatcataaagattactatgcttttgaaggcatatggatagccttttcaaggactatctaaaccgcaataaaggaactcaacataatttttgttacagccagtaatgccaaaacatagctaaacagcacaaacctcttgctgcatcatagcccatattaagattatcttgttcaattagcttcccaatgaccacaccaccatcaatgccagcatttgcagctatagtcatcaaaggagcctacagaaattcagagattattacatgtttaagaaacaagccatcaggcacatgaaacgccaaaaccaatacaggaactaaccttcaaagcattcttgataatttgaactccaatcttttcatcctcatttgctgtgataatcttgtcaagctccttggtggcatacagaagggcaactccaccacctgtttgaagttccaaattggcacaaaacatatggacaagttacacgaaagcaaaacatcaagaaacaagtttaggaaaaaagacaccaaagtggaaaaaataagaaaaccgtcactacacctggtacaatgccctcctccacagcagcccttgctgcatgtaaagcgtctgttaccctatcttttttctcaccaacttcaacttcactagctcccccaatctgcagtcaaaatggatatcctgagaggagcaaagtggggaaaagaaatacagtgaaacatcactgtgcacctgaaaaataacaaaccttgaggacagcaacaccaccagataactttgatagacgttcttgagccttttctttgtcaaatacagcagtgcttttgtccattgattctctaagctgttaagggcattcacataacaaacaatttaatttctatcaaaggagaatccggccactattatctagatagttgggatgaaggtcaagagtgacaattttattgcagcacctgttgacacctctcctctatctgctgtttgtcgcctccaccatctagaatgatagtatcatcaagggatacagtaacctgtaaaggaaattctcactgtctgtttctcaggtgaaataatttgtgaagattgacaaacctttttagcagtgccaagcatttgtagttcgactttaccaagatcaagaccttggtcctcgctgacaaccttgaaattaaattaaacgaaataagcaagccaatttcagtcatattgtatcacttgtgtttaaggacttttatggttgttgatcatgactgacctctcctcctgtcaacacagccacgtcatccagattggctcttctgttttcaccaaatccaggagctttgacagcacatatctataatcgatgcatgataattactaatttaccagaatatcaacgatccatagctctagcttgaagaaggtaagaagcttgcactttaactaacaacggacacatatcatcaagcagcttgtatacgcaattcagtattgtatacagtaggaccagtagttaatatcacctttaatccagcacgatgcttgttcagaacaagcattgatagagcttctccctcaacatcctcagcaatgatgagaagaggcctacgattctgcatacatgagacactggttagtactaaaccaatttaccattgccatattcaaaagaagctgagacattatgggacataatcaccttgatagacatttctaaaactggaagaagtgaattcatcgttgagattttcttgtcatgaattagaataagaggattttccatctcctgcacaaacatagggatacatgagatcgtctcagaccattatttggaatattccatgccagttgatacaactctcatatatattttctctgctctcatcaggtcttttctgggtctaaagctatctaagaaaccaacttaacaaacaggaaataaaaccttgcaaggataagcaccctgagtcatcctataaggtcaacactaagagacataatctactaatgattatatcaaagtggcagaaaaccaaaaccaatcaaaatacacaacctgactcacaattattactgatgtgatccacttccatgcatatttccatcataaagtcaaagcaaatgagggaatgtagcgaactttctacaatgtagttcatgctggattcactgatttgaccaagaaatacagacttacacacttctgagtcttctgatcagtcacaaagtaaggagatatgtagcctctggaaagtttcattccctgtaccgcttcaagctcattgtctaatgtcttgccatcctgccaatttcccaaaataagttgcagcctaggtaagtaggtattaccaaatagaatgattctgcagtatgaggctaataataaaagcagcacttggtactcacagtaatagtaataactccatcctttccaaccttttccatcgcctttgatatcaaatctcctatttccttttctccatttgcagaaatagttgctacctggtttacagaaatatgaaataacatattcttaagcatgcaagaatgcgggataattactatggaaagtttgcagtaatatagagtcaaagtgatatttagcttatttacagcagatgcaaacaataactacagcaaagatgcataagcaactcaatatggtttatacaatgtagctggagggagcagagagatcaaaataccactccaaaccagagcatcccacctgatttatttcttctgaggagttgataatccatgctttacttttgaggtgtgtagtgatagaacttatggccttgtttatgccattacgtaagtccataacattgacccctgctgccacagccttgcagccttccgtaagaatagcctgtgtaagtacagttgcacaagtggtacctgttaccccatacaaccagaaatgcagtgagtgacactgaatattatattcatgctagtaattatgctattcatagggttgataatgtttgcgatgaggcccccaaaaaaaaaaacagaacatgaaaaccacacatatcagaaactattgccgccattatccactgtgagaacttaagtcactgagcatcacactcaagtgagtttacttaagaatcaatattttgattcatgctatcagaatttacctatcctgacgacacattcattactagctgacaagaaggattaacacatatagcagaaaaaacagattaacaatatgcttgtttgcattgagtaggcttacaaatcaaacgggatgctaatctgctatgctcaaagctcaatcgaatatatagttcatatggcagctcaagtaaagtaatttcctagagctcggtccttaccatctcctgcgaccttattagtagcttcagcaacttgcttcaccaggtttgcaccaacattcttagcactgtcctcaaactcaatgctttttgcaaccgtgactccatcctttgtgactttgggagctctatgggatctctcgataatcacattgcgcccctacaacgacacagacaaacacgcccattcagtcgccaaatcgagtgcgaaaatctagcgcttccaccactagatccagcccgatcgctgcaacactctccccaaccaatccacgcatctcggagtctgtcagagagcacgaaccttggggcccatggtgaccttgacggcgtcggcgaggtcgttcacgccctgcagcaaggcggcccgggctccgacgccgaacgccacctccttcgccgcatacccccgcgcccacagccgctgctccccgcaaccgccgcgcgacagctgcctcgcaagcaagagtccccgtccgttagcgtcgcccggaagagatgcgtcaggtgggaaggaggaggaggcggaggtagcgcgccggttacctgcttccgcagcgccgacgaggacctcgaaatcgacgacgccgccgccgccgccgcccggtacatggtggcgagtactcgcgattgctccttcctccggcggctttgcttgcggcttcgcaatttcgattcgagaagagagagagagggttttgctagggaagaagggttttgggttccggaagcttcggctccacgtacggtccatgggcctaagaagtccaatgggcctaggtccagtttgacaaaatgacaaaatggtccccgagaccccgacttcttgctttggtgactgatatcgctagtgaaatagacaatccattatatgccactaacttgtctatgatttgtcactgactttgtcatgttctacaatatgtcatcgacttttgcttaacttctacgatttaccatcgccgtccggttaacctccgttagcactgtataaatttgttcaaatgaccaaaatacccctaggacaaattttgtacagtactacaatactacaacattaaatctatatatagtgaaacattatgagtacactaggtgaaaacatttttgtggagacacatagcaggttggggcatgacaaatggtggggcccggggggcacacgtgcgcgtatgtaggggagtgctcgattttgctccccccgccagtcgactagcagaaggaaaatcggcttaaattaggcaaaagtaaaacttgagaacgaaactggatggcaggtagaaacataaggcttcaactaaatacaaacggatatgtataaataaaaaaaaacagagttcgtgcaaaaaaacacataaaaagtaacacaaataaattaagagcaatatattttcgcttatacttaaaagtcaaaatttaaattttagaactaattttttaagttgcttttgtggttttcttcatcatattttattttacaacatttgcttttgaatcgctaataacatatataaaaatgtcttttttttaatggtcaggctgttatcgacgttttatatatagaagaaggtgtctcattttaatgaggaaaagagaacaaacaatacagtgaacagttacttagggaaaactaggctaaaacggtataaaaaagttttaccagtttagttgctaataagcggtatgaatgcgcataaacataagacaaacagtgactccgtaagatcaaaatgcatgcagtataacttaaagccttgtatacaggtaacacattaatataagagatcactctagaactacttgaactgaagttgtggagcaagaatctctatgggcaaactggttcagaatctgggatctctcctcatcactccaatggtgttggagcctcacgattttccagtcccaacgccccatttcttcaacacgcccatatctaaacagagcaacaagctgcaatgccgttgatacttccatcacaaagttaacaaagtaaacctgtctctctgttccctcgaagccaactacaaccagctccttcagcttttcatgctgcaaagtggatggtttccaaatgatttcatcacaatgctcatcatcccaaggggtaatatggatgtgaaggctctccaggcatggtgctgcttcgagcaggagtcgaggccaagagacatcccatgatgaaggcacatcagcaatcaggagccttgtgagattagccagcaacaatgaggggcaagatggcacgaaccatctcccatatccagtgaatcgtaggaccaggttcgttatgttcttggtgaatccaagaaacctctcgatgttcaagtcccaaccaatacataaatcacgcagacgattaatgtaaccatggcgtaagttcaggtttatgtgcataacacgcgagaaggaggagtgatgtttgtaactcacccaggtctccctgatagctattctctcgagcatcccaagagagtgtagcgcgatgacgctgcagaactccacggtaagctgcttgatccctgacctgggggcgtcgatgaccagaattccctgacccacccagcggcatgatttgaggtgtagaacttgcagctgagggcatgagctgatcacggcttcgtaggatgatttgggcatggagttttgcaagtcttgcaaggtcaattcggtgagagcttgaaacccctgcaatggcggaatgatgcagcctcctagcttcaggcttctcaggcgggacttctgattgcagagaccatggtgaggaaatctgtggacatccggcggtatagaccaataagcagatttggcgaaaacctcaagatcctcgactccccaagcgtccaatgccttggtgatcaatcggttcataagatcggtgtagtgagtggcaaagaactccacccgcagcctgccgatccgacgacgacgacgacgagctcggccggcacggtcatggctgtcatccgcgtcgaggaagcagccgatggaggcggccatgtttcgcatggcgaggcgctcttgccgcttgatggtggcgacgagagccttggcgtcaccgttgtacgcgatggttttgtggagttggacggacctgtggtagcgcggcgggagtacgtcgccgaccacgaaatcgagggcgtcgagctcgcgacggagcggggcccagcgcgtggagagcatcgcggcggcgagcgcggcgcgggtgtcgagacgccgcaggatgaggaggagcacgtcgtcggagaggtcgctgatgcggtcgccgtcgcagggcgccgccgcgggtgtccggcgtcgacggagacagtacagcgccgccgccgcccccttcctcccagcggcgtctccgtaggtcgcgggatcccggtggcggcgccggtagaacgcacctttcctccccttcctcctagccatggcggaggagtgtcgcggagggcgcggcggcgaggttgcctgagatcgcaatcgcggccgcggcggcaacgaaccgcacgtaccagtagcgaaaagcgacaagaactcttgccctgatgtcagcccatgtacacataggcccagtagacttcttggggctgctataggtactgtacggatgagaatctggaaaactgggtttacttttagttcattttctaaattttacaaatatggttttttaaaaatcgaagtgaaaatctgaattgtttggggagtttctggcagaaaataggccctatactaggaaatcagatgaactgctgctgatttgctgaacatgaatttagttatcgaaaaaaaaagagtacatgaatttagttaaaaaaaattcaggaatttactagaacttggtccttaccatctaatgctataacaatcaatattttgattcatgccataagaattaacctatcatgacaacatattcattactactagttgagaaaaaacattaaccgcacatagcggaaaagacaggttaacactatgctcgttggcgaattggcattgagtacgcttagaaatcagatggactgctgatctgctatgctcaaagcacaatcgaatagatagttcatatggctactcaagtacaggattttcctacaactcaggtcccataccatctcctgcgaccttattagtagcttcagcaacttgcttcaccaggtttgcaccaacattcttagcgctgtgctcaaactcaatgcttttttgcaacagttactccatttgtgactttgggtctttgagagacctatgggatctctcaataatcacattgcgcccctacaacgcaacacacaagaacacccattcagtcgataaatcaagtggggtaccatatcacatctgtaattgagcaatagatatgatttcaatgttgaaattgagcatccttttacttctgaaatgtgccagtataatgattagatagctcttgtggaatgtacaatgattagattggggggcattgggaaggcaagcaacagctccatcaatttcctactcctaactcttcaagatttaaacaaaatcaggtcaataacaacccttcattgtaaataaaactgaggggttctgtaatatcaatggactcgtgcgcttaagtattggtaacagttcaataagactaaaattgcttgccacaaaaatgatactttcttatttattgaagtaaacacagtcgttatccccaaataaagggtgtctgattataattaacttacttatagtcattaagcaattcaaactaaaaatgagatccaacaaagcatatgcaagaaaattgagctaccactgcacacttaattagttacaagtttcttctctggcatatgttatcctaagccaaaaaaattgagctaatcccagttttctttgctagcttatattcaacaaaataaaatgatctaaactcatatcacagtaatagaaaaacgacaaccaatatcaacgacatccaaattctcgctaatgttttgttatctattaaatttgattgattgaacactggatcataacagcttcagatgcattgctgaaggcaatactactaaacacaacagtggaaaaagtacactatcataatctactctataaggagatggggacttcagtgcgatcgcgtttgggaggggaggagccagggatataaatttgtattttgcagtgaacaaagatttactaattattggacaaggcattaccacagattcatctgctcaccatacaaccaatctgcaagatgctctctaccattgtgaccctctcactcctgctgtcctgcacacacacacacaaagaacaaataaaaagaaatcagataatggggattcaagtcaagaaacagagatcagcaaagaccaagaagccagatccatgaaaggatcacaactgatggagacacacatatttgcagcaggcacaaaatccctgggcagaagggggtgacgtggtgccgtaactcaccttcaacataggccaacaggaaggggatggtttgcagccattattggagacgtggaagcgtgaagccgtgctgtccatgctcagctatttctgcaaggccaacatgacagatctcatgctgcggctaactggacctcaaatgtgggtcacgccggagagtcctttcttagagatgcccagcctgaggaagctgctggtcgtggacatgccgccgcgctgggatgccacatggatctgtgcccttgttgaggaggctccatcgcttgagagactccacgtccacttttcccaacgttgtgaagacgatgatgagatggccgttcgtcggaagttggagatagtgtgggagcaggagccctcaagagcactgcattctcatctggaggagttggtggtcattggttttcagatcaagaaagaaagaaaggttcagcttgtgaggcatatcatggtcgttgcgccgtgttgttctgctcaagcatgaatatgtcaaggacaagaggctaggtgaataggagatggtaagccagaaatatacctggagtgacgaggggaagctcaccgtgcaggagcagatcagacaggtggtttgttgttcaatggaccaagttgaagcggtcctagaatgaaactaaactgcacattagttagtttgattttatcttttataaatgattctaatgaatatcctgtacacggaagtcgttaattatcaaggcacatccccttgcacaacaaaatatgatcggtgactcagtgagacattgaccccattgtcataagaatctatgaacactaatcatcttgttcacgtcagttacaaaagacatacctctcatgaaatttatgacttggtgtcctatgatgcaaaagtaaaacttgagaacctctaaaaaaatgtaaaaccttagagaagaggagtagagaacaaacagaaggctccacttaaatacaaaagaacatgcatacaaggcataataacaaaaacagagttactgtaaaagtaacttataaaaagtcgcacagaaataaattaagatcataatgcatgcagtataacttaaagcattgtaaacaagtaacacactgacataacagatgcatgctttataacttaaagccttgtatacaagtaacataacagatgcatgctttataacttaaagccttgtatacaagtaaaacattaacataacagatcactctacaactacttgaactggagttattgagcaagaatctctatcagcaaactggttcagaatttgggctttctcctcatcattccaatggtgttgctgcctcacaattttccagtcccaacgccccatttcttgaacatgcccatatctaaatagagcaacaagctgcaatgttgttgatacttccatcacaaagttaacaaagtaaatctgtctttctgttccctcgaaaccaattacaaccaactcttttagttcttcatgctgcaaagtggatggttgccaaatgatttcatcaaaagaatcgtcatcccaagggataatatggatgtgaaggctctccaggcatggtgctgcttcaagtaggaggcgaggccaagagacatcccatgatgaaggcacatcagcaatcaggagccttctgagattagccagcaacaacgaggggcaagatggcacgaaccatctcccatatccagtgaatcgtagaaccaggttggttatgttcttggtgaatccaagaaactgctggatgttcaagtcccaaccaatacataagtcacgcagacgattacggtaaccatggcgtaagttaaggttcatgtgcataagatgcgagaaggagcaatgcttatacctgacccaagtctcccttatagctatgctctcaagcatcccaagagagtgtagtgcaatggcgctgcaaaactccacaataagctgcttaatccctgactttgggaaatcgataaccagaatgccccggtccgcccacctgcatgacttgaggtgtagcacttgcaactgggggcatgacttaaacacatcttcataggatgctttggccacggagtttcgcaagtcttgcaaggtcattttggtgagagcgtggaacccctgcaatggcggaatgatacaaccacctagcttcaagcttctcagccgggacttgtggggctcaatgcagagaccatggtgaggaaatctgtggacaatcggcggcagagaccactcagaccaatatgcaggcttagcaaaaacttcaagatcctcgacttcccaagcatccaatgccttggtgatcaatcggttcataagatcggtgtagtgagtcgcaaagaactccacccgcagcacacgggccctccgtcgagcttggccagcacattcatcactgccatccgcgtctaacaagctattgatggaggccgctatgtttcgcatggcaaggcgctcgtgtcgcttgatacttgcaacgagaaccttgacatcaacgggatacgcagcaaaaccagccgcttggtggagttggatgcacctacggtagcgcggcgggagtatttcaccgaccatgaaatcgagggtgtcaagccagcgcaggagccgggcccagcgcttggagagcatagcggtggcgagcgcggcgcgggtggcgagccgccgcaggatgaggaggagcacatcgtcggagagggcgctgatgcggtcgccgccgcggggagccacctgtgcccggcagcgacgaggcctatccttcctcctcctcgccacgtcgcgtaggcgcgcggagatgctcgccgccgcaggccgcgggcgtctggcggcgacagaacgcacctccggagttgcgaagggtgcggtggagtgggtggagggcggcggcgctggcgccatgggcggatccatcttgggacatgggggttcagttgaatcccccaaactttcttttgtaggttcaaggctgtggaattaagggcttgtttggttcaataccctaccaaaatgttggtagtgccaaaacctaggcaagttttggtactaccaattttttggtagggtagagttgtatttggtttgaggccaatttagaaccaagcattgagtagaata

SEQ ID NO: 38676 - DNA, 4775 bp, Oryza sativa
tttcccccataactttgcaattagtttttttaatctatatttaatactccatacatgtgtccaaatattcgatgtgatgttttgggaaaaaaattgggaactaaaccaggccaaataacgtatgattgattgagttttaattattacaaacttgaaaaatagattaatatgatattttagagcaacttccatataaaaagttttcacacgaaacgtaccgtttagcaatttgaaaaacatgcaacggaaatcttaatctccatccaacttttattggagaaaagaccaggacccagctgtggatgctcaccaggacgacgtcacctccctcttccctggcttctcccctgcactatgctcgatgagagatttgataatttaacactccttaaaatgggttttgattatttgaaatcctgtcccactttcattcactcagatgatcccacatgtcattctcacaagtgtcaactaaaacaattggacaatgaaaaaagtgttaaattatcaaattttcctgctcgatcggcacaggcgagacaatacgggaagaatttttttttttacgcagagaggatgggggagattctcgacgcacaaagaatatatttttatcgtctccgtcccaaaaataattactactatatttgagagggtaatatgcaagttccctctgtctcccaaaataagttattatgagatatggcatattccctctatcttataaaaaaaaactcatccttatatttccattgaaagtttagtactaatgtgaattacctaaatgcccttcacccgaagggcagtttcccaacgaggcaacgatcgagacgatgctagaagcaaacagaatctcatccccaagcggccggaagacgcagcctaccagagagagaaggtgcgtctaccagagagagaaggggagggggaattaccgccggtgttcgccgccgattcaaaccccagcttccacgcccaacgatcgagagcaaacaagcagaatcctacccaccccaagcggccggaagacgcagtctacaagagggagaaggggaggggggcattaccgccggtgttcaccgccgattcgccggagcgccgtgaggggtggcgcgtctcctcctccgctcagctccgcgcctcggcctcgctggttcgccgtgagacacgggaaagaggaaataaaaaaagctaccgtgccaagaagtcggactcggactcggtctagcaaaggccataagaagttgggccggcccaatatgactaggcccatacaatctcaggctttcccttctccaatccatctctctcgcgaggccaagttgaggtagagctcagctcgacgcaacgcagacgcaggcggcggcttcggcctacctcgatctctctcccatggcgcactagaccaaaaccctaaccctaggtccgcctcctccgtccggcggcaatggacgcgaaggacatcctcggcctccccaagaccgccttcccgtccgtccaggagaagaagccccgcgcgcccaaggagccgcagcggaagcccgatggcgtctcgcgcgaggtacggcgcggcctaatccgccatcctcccgcacacttcgaccccgcgtttctcgttgctgctgaagtgctgatggttgttgatgatccaggtgtacgcgctcactggaggggtggggatggctccactcatgccgaccatcgaggcttcgcacctgaagcggcgaccagctgttgagaaggagaaggtgagctgatatgtgctgaaaatttgataactctagtagaagcacatgaactgagctgagagtttagctactcgtatacttaatacctattaggaattaggcattaagggtaaggtgctcatgggattaatatgggacaaatgaaatgatgatttgatcatgtgcaacttctgttttgaaattggtggtcaacccaaataagcagattgaatccacctcacatattcatgtccattgagtcatatgggtaattgcagcaaggtgtttcgtgctcccattttgatggagcttgtactaaatctgaccatttgaagtacttctgcagatagcatggcagtggctacctttcacgtcctctgcacggactgacaaccttcaactttaccattgggtctgtttctcatgaatttgtagtatggcatacatatcttagaaaaaaaaactcagaaagtcacccttttgatctttcaggttagagttgtaaatggtgctccacccactggtgactatcactttgcaaaatacaacaaggtaagaagtatattgtgttgggtacatccttcatatcctgcattgatgcttactcagtttttgcttgttttttcctattgcagaaggcggatgttctcaaatacaccgatgaggagtatgagaagtatttaaccgatcctgtaggtactagttgcaataataaatttttataaatgctatgtttgatcttttgttgaaaatcttatattgctaaaaaccttctgtggatatcattgcgctcttgaatacaattgataacaatgttgggaagttcgaaaattatacataattatgttatcatctcatctttatatgcttgttatgtggcatttgagcattcatttcgaatagttgcaagcctttgtttgaaaatattatatttgcaaacaattttattgaaagcccttctataaataatcagttgttgatttcatttcaggcatggagcagggaggaaacagataaactatttgaactatgtgaacgctttgaccttcgcttcatagtaatagttgataggttcccaactgatcgcagcatggaggatttgaagagccgttattattctggtaccttatatcttgatataacctctatgcttagatagtgtccaccacagaaaattctcctttgttgttaatttttaatgttctacacatgcatttacttggtcaaaaaccaacaagtgatttactgtggttatcatatccatttattttcccattcaatatatgaaacaagaacagttagtaaattgtcagctccgtaaccgttccaccgaatttgtttttatcataacagccagaatattgctcacattacttatgtataatggggacttaagaaaaggttacacgcacacaaattgatataagcaatattctggtcattgtcccattatacatcccctgcccttcttttatgagaacaaggtgattgcatggcttgttatttagaataatcagtcaactgctgaagctgccaattattatatttcaagtttggtataattctatgctcaacaattcagtctgtgcattactatttgcttttgtgaattctacaccagtatattctttgttattgcagttactcgtgctcttctgattgctagagctcggtcatttgatgaagttgctggtaatccccttgtgaaggtacatgttgatctaacctatgaataattgagtaattgttttcttattatgtttgcccttgtacttatttctgtccatatgggtttcttctcaggaaacattcaatgctgctcatgagaccgagagaaagcgtgctttatctgcacttctctcccagacaaaacagcaagaacgaaaggatgctgaggtgagaaatttgttgatgatagtattatgagcagctgacttgtgcagtttatcattccttagattccaatgttttatgtctgattacaagtgttaccttttcagattttagcagaagcaaaacgcattatggaaactcgtgctgctagcaaagtgagtaatcagcacatttaattccatacatctcaccacaaaagtaatctcaagcaagaatgttctggtggcaatttgcattatattgcaaataatgagtttttttttagaattccttctgtgatgcaagagatgtcaaatcatctagatatctatgagactccgatctgttcaagcaaatagcgcttagccttttgggctttcccagatgcctgctgtcatgcagggatgatagtgttgttcactaataaaccttatgaattttgatggtagttagtttgaagtgatatagtctgcctgatctatctgatcagtggtctggaatttacatgtctctaagcgtttgaggctttgtctatagcatactgaggaagcgggagcactggcacactttgataatgttgatggtgtatctcccttgagcaacacacacccattgtcaactgctacacttccagctgcagcagtgaataactccatacctgcttcactgcgaatggtaactctgaaactatggattgttgctttctgtctcttatattgagctgccgatgagttaacattttgtttgttacagtagacattttgttctatttatttaaagctaaccatattttgccccattctgtggaaaccacattgtcctatccttcatcttaccatgccataatgtcactattaaactaagtgtaaaattatgtttcctgagcaattatagcatgtcccatttattcctgaaaaacaaagatagtgtaagttatcttgctcattgcatgggaggtggctgttattaggattgtgccgaactcatcacaagcagaccttatgttaattatattactagcggtcttgttctcattaactgtggatgcctatgaatcacatgaaaattggtatatcactcttcacactgttctttttagatgttttttactcgctatacattcttttacagcttcgagtgtatttgagaacccaagcgcttgatcaaatggtccaa

SEQ ID NO: 38677 - DNA, 705 bp, Oryza sativa
catgatctctgatcagtataacaatagatttttctgtttctaaagaggattctgttactggaactgccaatgtcactgacacgtggcacttgtttgattgacagtatcggaagcttaggcaagaaccggaccactgacagaatagagaacgtgagggtggacacctgcttgctgacaaacacaaccaacggtgtacggatcaagagttggcaggttagttgcaggacatcacacttctgaattctcacaagaacaatctgatgaggggaaaaaacacttgcagttcttggttctgacaagaacaatctattcagaaaaaggagtaattatatgacaaaatgcaactttgtgcttgatcagggagggatggggtatgctcacaacctgaggttcgagggcatcgtgatgaagaacgtctccaatccaatcatcatcgatcagtactactgtgaccaaccaacaccctgtgcaaaccaggtaataatctgcattttcacctgcaaagcatcgtatcatctctgaaactctgaacttttgccattgttcagagcactagttcatcatctctgaaacttgggaatttttcgtctctgtggatgcagacgcaggcggtggaggtgcgcaagatcgagttcgcgggcatccggggcacgtcggcgacggagcaggcgatcaagctggcgtgcagcgacgccgtgccgtgcc

SEQ ID NO: 38678 - DNA, 666 bp, Oryza sativa
aaaatagaccattgcatactacaagaatagcatacacatgttgcaaacataaatgagacttcagatattgtttactagattttccatgcagctttgtttctttcctttctggtgaaaagattgcaaaatttgaagcggtgtatttggcatatacagactttgacatgtaggcagacagcaaaaaacattacatgccatagacaagaattcttataaacatgattagatgtaattacctctcaagagcttgatttttcctcagttgctttcgagagaagttcaaatgccatgcaagattccctggataccaaggcaagggcctgatagcatcttctccatactcatcactaacctttgcaagtaatttatttttataaaaaatacattagaatggcaggaactggtgtttaagtaaagtgtgtaaataaagagggtggcaacctcactctccaaatatctcttgaagtcattctctaactttgagcaaatatccttaaaaaactgggagctgaaaagattaaaagaatacaaactttcagctactccggaaaaagaccagaaggtgatcgagaataaatttagattctagactactattgtgccatactatcatatataagtaaaagcaaataactctttgtgaaaacagcacaacatttactaata

SEQ ID NO: 38679 - DNA, 721 bp, Oryza sativa
attatttactgcaagcttcggaaaatacattttatcaaagaactcttctattatttcgtagaccgtttgtttttagttatttgttaagcttatttatcaaagtatttaatttatctagataatctatagaaacaattcgctcaataatctgtttcaaaccgagattaaggtgaacttgcatttcttatttatatatgacagggtaaatcaagagggtgacttgtttagcagtacatgagtaacatgaaacgaaacttgacaacttgacataacagctagtacaagacaattggatagctcacagcttgcctatggtatttgatcttttcttatcactgtttctgtatatatatgactttcagagccccaaagatgggatgttgcccagatgactgttcttgttcaactgccatgaggcgatcctcctctttctgagccgctcggcgatgatgaacgccaactccagagactgcgatgcgttgagcctgggtcgcagtgtgtgtggtatcgtgagcccagatcgtcgaatgtcaccgtgcgtgacccgccgatgcattctgtcacattttgtccagtcatctccagatgcacccctcctgggtggctgccttcttgttcgtgcacatcaaagaatgcgcgcacctcagcctggtttcaagaaggcaacataagtcatcttagttgatttaagtcgccggtcatgttaatgtcggggtgcagg

SEQ ID NO: 38680 - DNA, 2563 bp, Oryza sativa
cacataggacctcaccacgccctccaatctctgttttcatcacgcgatggcacatgggccatgggtccaaagtgcagagttagtaacagaaagatggttcaaagcaataagtgctggcaaaacctattcaagtactccaaaaaggaagtttactcgatacttcaaaatgtcaaaatacaaggacgggatcacgagattgtgggaggaactaccacacatggatgattttttttttttttttaaaaaatctgcacaagatagtgcaaaaatttatattgatatagtcaaataaattataagactgcaacactaaaagcctgtaaccagataaaagaatttttaaaaaacaaaccacctccacttgctagtagctcaccgcacaacccattagaaggcactagcactaagctggtcaccgctaagcgtgatcgaccgccgatatacctacttggggatcacaaacgctccacaaaacaccgaaacaacaaaagagatcaacgacgggctttcgatcatcctcacagggttgaggagagagagggcaagagagaagaatatccactcatctctcacaacaatctgatcacgaccatcgagaaaaccaaattgagaggagacagaaaaggtggggagcgaaaacttgctaggcaacgccactatgaaggtcgtgacaccttaggcaccacatggatggattttaaaatttccactaactgttttcacctaatttttgacaagttacctgtaccaggctaaaccgatatgcaagagttaatataccattttataactgcaatcgaatgaaaaatatgcagaaaaccacagagctatataatcgtttgatggtcctatagaatcatatgatatattgggaaataatggtactactacattggataagtatagagctaattgaagtgcaagagattaagccgtacgtacgtgcataatggttaagacggctaccgtctctacactactttaactagacatataaaaatactacatatacaaataacatgcatatataacagataatggtgtatcattaaagatcactggtcttacttagaggagaagcatggttactgcagtcggtctcgctcagttgaaaattacaccaattaagtaacaatcaactaggatagagagagaataatgacaccagtacatacgatatgttagtagaaaatgtaacgcatgcttcaaatataaaaggaagtagaggagctatattaaacccatgtccaaattaacttagtcacagctcagacagctagtagattttagaggtaacatggaaccttgggaaactacattcaccatatcaagacaaacatacaagttgcctgacagctttcgcaataaatcatcggatgtttccaaacttaggcacggtttagatgggattaaaacttttaagtccctatcacatcggatgtttggatactaattctaaatattaaacgtagactataataaaatccatccataatcttggactaattcgcgagacgaatctattgagcctaattaatccatgattagcctatgtgatgctacagtaaacattctctaattatggattaattagggttaaaaaatttgtctcgcgaattaactttcatttatgtaattagttttgtaagtagtctatatttaatactctaaattagcatctaaagacacggactaaagttaagtctctggatccaaacaacacctttgactaataagttagccctacatgtctccagtaccctaattctattcagctgctgtccgaaaggaatcacttggactctcggagtaggccctgaaacatccaggaatatataacttcatcagaaaggaatattcctgtatctacacagtatgtcggactaagtatacttctcttaaagcactgggagaatagtagatcgatcatagaaacctgacatcagggtattagatacgctactgaagtctgtaagtcctacagggtattcatcatttggcatattgccagagaccagagcaacatgtgcacagatcagaaaatagatctgacttccctatcagacagcataaaacaacaagttagcttaacgtctccgcaatttgcgtagagtacatctatttttctaattaaaacaaatttccacgatgagagaaacttgagactagcattatacactcaaataggacagatagtctcaaccaatagctgaatttctccatgttttatcaagattcaagaggaaacaagatggttctggcaacatgtccgtataccaataatgccaatggtaaattccattattgattggatgtgatgtttaatcattttggctagttgctagaaaaaaatgacgaaatttccacattcataaaaggactttgaacacgggacgggcacacatactacaataccaaacaattgtactaaggaaggtagacataccacctaacaggaaagcagttcatgaacgtgtttcacactctaatagttagtaagaaaaggataattatgatagcaatacctattatgtctgaaaaagagtaaccaccttgccttttt

SEQ ID NO: 38681 - DNA, 9702 bp, Oryza sativa
ggtgtcaaatatttcgaaacggagggagtatcaatctgcatgacataactagtttagtcacagcctatagtttcagcctaacccaacaggcaacagtgttaatttacatctaaaagccaagctaagaaaaatcagattgcatttacaatctactgagtctactgtagtatcaagtctatcacaaaataaatctgtacatggttgcataatttcttatccaaacaatgttaaataaaccactaaatttagtaaacgagacaataatatgtcagacatatccatctagctgcgatttcaacacaaagatccccaattagctggtttaggaagaacaatggccgcctccactcacctcccggcaactagcacctcgccattggtctcagcctccgcacccagcactgccgcgtgaccagttgaggaggaatgaacggcgacttcgcgaaaccccccgtcgccgtactgttccgccgccgttgcccgcggcggccatggcctccttctatccgaaggagccaggcgagcactcaacccggaggcgttccatcggacaactggcgcgcattccacccgccggccgccgctcggcgagcagccggcgaagcggcgcggtggtcgcagcggcggctagccggcggcgaatcgattggttcgcgaagaataaacgcgattagggaaagcagccgatgggcaccgttggatcgggactgtgcggtctggattgaatctaggaggaactttgcaaaagagaccttcatagcgtaatgttttagcaatggggtctctttctctgtgtcgcaatcaatgatagagcagccgttcgatcatctttcaacggctcagatcgtagcccggttaagcacgccatatcatccacacaagtaatcgatccgatcttctccgaatcgtctccccgtccccaatccattcgagcttctcttctccaatcgattcgcgatttccaatccatggcgactctcaccatgcagccgatcggtcccctaccgtctactaagcaagaaggcacaaggcaagtgaattccttggtccgctttgtactcactgagattgagagcaagaacaagatgggagaaactaggtttcggtgatttgtttgtgatttcttgtcctttgatcttgctgcagcaggggagagaagcctgcggagggtggtgccgatttgagtgacatcgactcggggtatgtggctctgcccaatttattgtattgtctcgcttggttcttggcttataattagttgatggatttgttgttgtggtggcgattctgggcagctgggttgttcttgggaagtcggatatcgtcccggcggatttggcagcccagagcctgcgctcatctccgaagacaattcctacatggtaggagaagcaagcatgcggttgtttcctttttctgtatgatgttttgactaaatttgtgtttgttttggtgttctttcagggctcggtgggtgattggaggtgtgctgcacacagtggtgccattctacgagagagcacggtatgttgaaggtatgtgcgcccaactccgataatcttccacctttacctatgagaaaatgactttgtaatgttgaatgggaggtaatcattattgattttatgaaatcactgtcaagtagtaatccagaaactgctgtgcagttcataaattgctgccaagtagttacaaagtatctgtgtttgcaatagttgggagaattttagggtgcgtttggatctcaagcaaggcctaatttatccttgctgtcaaggtttagtgttttgtagaagctaaaagaccttgctgtcaaggtttagtgttttgtagaagctaaaagaccttgcttttgatggcaccagtccataataacctgaaaaagcctgcctgatgaggagagccaaatcggttctcccccgacggcaaacggcgtgcgtgatgtctcgtgataatcaaccgctagattcggtaaaagctaagtaaacgaaatgatggtcgttgcttatataggctactgccaaaaggagctagataaatctagccgggctaggtaaagtaagcaaatgatccaaacacaccttagtgctgatgtttggttgttcacagatgagacggctcgaaatgtggagactgctgctgaggttgtggagcaaatagctgaggtcacagagaaactggcttctaacgtggctgatcaccttccagagaatggatgtctgcagaaagtagtggagaagattgaatacatagctgaggtagtggatgaagatgcagagaaggttgaggccattactgagaaggtgggctccatgtcactccctgttttgcctactatattttatataggatacataatgtcatttgaatttcagaatattttgaaagcaaattagcagttggatatgctgtatgagttgattggtagtgctaaagataagtgggtagagggcaactctaagtgccaactgtgaacaccagttttcaagtgccgttatatatttctgttggctccacctaaattgtagtattgtagtaaccacatgcatcaagaatatatctattcaactttcttttgtataatagtgttgtaccttcattgtgtgctacatacattttaccattatagtgtttatattgatgataattaactttgttagttgtttctgccaaggattgtttcgctatttctgttttccactacaaaaattctgacaattcaattgttaaaggattttgcttaattggtaaatctttgtaggtattgttgaagacttcaaggtcatagttccacttcaaaagtatattgttgacattaaatcaaaaaaaattaatgcaattttactgtgccacaatttgccaggacatctaggaataacgtcctattttcttttgtatttaaaaagagtctactactatgcagccttgtggcattgcactagttttagaaaatgtatctatatagcaagtagaagagtacaataacagtgaacaaaatgccggattgtaccaatacaaatcaactagtattgttttatcctaataaaactgaatcaggcaaagaaagaaaggattcctacaggtatagagtcattttgcgtaaaactgttgagatatctgcactgttttggaagtattgtgaaagacaaccaaagatgaagctattaacactttattgatcttctcgctaatacagattgagaatttcagcgacaagattgatgctaaagtagaacctatcttcacggagattgagaaggaattcgaagactcaacatcaaatgatggagtaaatgcaaatatataatcactagccctacgtagaaggaaatactctcagctccccattgtgtatagcatatgcttttttttttgaatgattcgttgtacatatgtgtacctttctgtatgagttataccatgcttattgtgacgcatggtggtgttgtggctggtgctcgaaactaaagtagagttagcattgactattgagactgttgagctgtgaaatttcatagactggtacaaaatagaatggttggtactggtaaatgctattatatcacaaaatgaacaatgcctttttggtacatagaactggaaccacgaacagtttcttatgaaatttttatgacatttatttaaagttgggttgtcatggactcgtggatatagtagttattgtgcacgtaatatgaagtgctaattcgtcaacttctaggttcctgttgaactgtccccccaggtcttgttcagtgctcagagtttcagaaatcagaactgctcgcttgtctacctttcatgcaaaatccacccgggttccagggccatcgccggcgagaagccagctcagcttatgatattttgcttgggatattctgctgtgttggatttatatcccccgaccacgaggcgcacgcgagccaagcccagctgccattgcttacactagtcactggatcaacgaacagcgacttggcgagaagcccggccgcgcgaaacgcattgctttggcgccggtcgcttcgggtggaagttggagaaccccgcgaccgcgactccgcgggacgccagccagcctattgctctattccgtactgcgacgaagaatccgacgcgatcacgtagcaaccgcgtgccacggctccgagtccgagtcgcgtacgttggtgccgccgtgccgggagcccgggacctcgatcgagtccgcgtcggggcgggggatcctgcctatatatgcacaagcacgtaggcgtacgaccacaccaaacacacccgtaccgtacgggcgtatcaccaagtcggcaagtcacaaactagttgagcaggagggacgacttgtgcgtggcgggtacgtagatggatcaggaggcctcgttgctgccggcggcgtcgtcgcacacggtggtgaggaggaagagagctctgcagcttaacgagacggtgtacgaggagccggagtacgtggcgaccaagggtggcacatacaacgtcgcggagatgcccgagaggttcaagtccccgaacaacgtcgacgggcaggatgcgtggacgaccgccatgttcgtgcgtggcatgatcctgttagacgcctccttccgagagctccaatcgaggattgcatccgagaaaatgccatccaatgtttgtgattgaagccttatttcaaaacgcgcattaatggaggcatatttattagtattgttttattttgtttttcttagtttattatggtggttatatgttaatttggcatgtacacatctcgtcggtgtttatcttcttttcctagctcatgtaaacaagtttcacgaggaacatttgcggaagcttaagaggccaccctaataagcagagattgccaggaaaacgttgctcaacaaaaagatcttagtaaccaactcgaaaaaggagaccaggcatgacaagtggcgatctctgtactagaatagaacccctgttagcagcgttagcaacttagcaattggatttttccatcccttgggagatgactttggtgctaatctaggaagaacaaaaattcacaaataagcgaacaggaagaagaacatcatcggactctaagcacaaaagatctgctggtgcggcaactggcatctcaccgtcttgcaaaatctgtgcaccgagatggtgcacctgctcctcgagcctctcgtaatctgcaatttgtagcaccaccataccgtggattccctcgatggtatcgtggtttggcctctgagagttcgtgcgcgctaaatcttcttctgtttgcaactggcgtagtagggcctgcacttgttccttcttattcagaacaccttgatgcattttttcgagccttctgttgtccgccgagagcagttgaggcgctggggctggtggggcttgggccggggtagcaacatcggcggcagccgcccgcgccatgtttctatcccgtctacgccgacgacggccgggaccctgtgacatcatgcacacgtaaaagaagtcgatgaagaactgaacatcatgcactcaacagttactgaaccgaacaaatgtagttagtgccttaattactggaccgagcaaatgttcagatgatgagatcaaacatagtaccaagcaaatgttgaagtgaaattacctctctcacaataggttgctgatggccgccgactaccgcaccagcccatccaccgcggggagcaacgccgccatcctgacggtccgcggccactcctccgccgcggcgagcgccgccgccgcccacacgatttgcgcgctgtcctccgccgcagggaacacgatcgccacctcgaccgccaccgcccactcgatctgcagctggtcctccgccgcagggaaaacgatcgcaacctcgaccgccaccgccatgacggactcctccgcggcgaggtccacccggagcatccctccatacctcatcgggaggatgcaaatggacggggaggaaatagcggtggtgtcctccccgctggtcgagcccgataccatcgccgaggtgcccgtcatctccatggacgacgacgatcacccgacctccccaacctttacgaagatcgcggtcgaggggcgcccccaaccaaaactgcgcatctgcagcgtggatgtagacctctccgggtcccccaacgggcacgttcccgaggccccgcagcgcactgcttgggaggcaaccggcgaacgatcccatggcttcaaggaagggaatccagaacgtaggaccgttggtgttggcgatgccgatgctgagtaccggagcccagacctgcaggcgcggagtccgagcatcgcgtcggagctcgcggccgtacgcctggtgttgctggtcaccggcgcttcgggcttggacgccgcgcgcgcccgccctgacgatcgcagaagattcccgatcccctcggccgcaagctggctcggtgttccagtcgcgcgcgcgcgcatgaccgcgctccggtgggtgaggagcagcacggcgctgcggggaaacagtagcgacgccgccgccgccgccgccgccgccgcggcgccctctccctcctccgcgtcgtccacgcccacgagctccaccttcctcgaggaaatggcgctccccttggccgcgcccatcatggccgcgtctgtcgtcacggcggcgagcaaggcgcgcgtgagcagctggtgcctgccggggatggccgcggcccctcattgctgtggccgcggcggcgacggcggggttagagggggcggttgcggtggtggtggtggtggtggtggtgacgtggatttgatcggaggacgacgcgatttataagagatcgccgtgttggaggggagaaggcggaatggcggattgggaagcgagaagagaagagaaaaggggagaagcggtggcgaggttgttgcgcgccgtgttccccacgccgtactaagccgagaaaggaatggcggcgacggtgggtcgggcccttgctggtaatttgtttctccggtaggtcgggcccacaaagcgcgcaccggcggacggcggttgatggagacggtgagagtgctgcgggatttaggctggaggcttgccatgggatggggagcgttgcagcagcagcagcatcatctcaggcgagcccgagaagagagatgagagagggaaccagcgcgcagaccgttgtgctttaaacaagggttccatgtacttggagtcatcttattacaattttactgttattcatctatttcgagtcatgtcattacaattttgctattatttgaaatataccactacttattccttcaatttaattcctaaaatttctaaaccaaaattcctaaaatttctaaaccaaattatccttcttcctcctttatttcctctctcttgttcgtcttctctgtgaactagatctcacggccactgagctgaaccttgaagcagcaggcagcatgcctactacagtggtgtttggatcagggactaaactttagtccgtgtcacattggatgttcggacactaatttggagtattaaatatagactacttacaaaactaattgtataaatgagagttaattcgtgagacaaatttttaagcctaattaatccacaattagcatatatttactgtaacatcacgtaggctaatcatgaattaattaggctcaatagattcgtctcgcgaattagtttagggttatggaatgagttctgtcattagtttatgtttaatgcttctaattagtgtcccaacatccgatgtgtcaaggactaaaatttaatccctggatccaaacaggacctacggtatgtagaagcggagtagctgttgtggacccaatcatgcaggcatatgcagcaacgatgggtcaaatcaacaactactcacaatcaccgggacatgatcccaaggtgaattagctgccatgttgctagtagagatgcaagcaggccaacccacgaacctgcttatatgaaaaattaatgggtaacctgtggattgacccgtgggttatctactaatttgctttgtaaatgagtttatggatcgatccacttgcgtctctaggtgcggcaagctaggctacgacgcgaaaacccatgagttaccacttatttgatatataagtaggttttcgggtcgtcctgcttgcatccctgctacaatgttgcatctaataatctctatccgatccaccaaagcacttgattccccacagaaggattaagatgcagcgtaatcaaacaggtggcctaagttgctgcttggtcgttagtcggtcctcaggcagcatggcttgcgacgggcacggtgacggaagggattcgagcaccagccgtagggcctcatacctaacctccgcctcctcgccaacgaggatatctcccgcagctccagtctgtcacccttcggaccaacggcccgacgtccgaaaacgcctcaccggaaggggctcgtgcgaagagcacgcatcggtgtatcagtaggtcaatatcactgaatgaagaaaggggatgcagatgttggagaagatgaacatgagatggagatggagaatcggaaaatcggccccgaacagcctcatgcttgcctaggctgcaacacaccgccattcggctattcctatcaggtggagggggaaaatggcaccatccttgttagacggagggggaaaaaaggctctatcgcctgctattctgagggtggtgagacaatgaggactttcttcactttgatcatgagtctatgtcaactagcttcctctcttctaccctattcctcatgaatggtttcttagaatcgatcaaactccacatattaggttgcctttgagcaagcttctccctttctcatggaagaatcgtttgattgaagattcagttaaagtcttccccatcaaaataatgagatggaaggagctaggtttgtaatgcaactccaagctctgtcgagacactggatcacggaaaaattggagataggctggaaactattgttttccccacctatcttgaggatgaggtgaacttgaaatgcattcactaataaatggtgtggtataatggtataatgaattgtattctttgtgttgctatacaattggatcggcttatatagcccccgaaattacacatgaaattgcaatcttgccccaagggtgcactggaagttactataatacccccataaagttggaaaacctaaggatgtaactatacattcaagtggtctcccagagctactggcgtcagcttgcacgagtgattggagtgatccccacgacatcttctaagagaatattccatgctccatggtgtaatcatcaagctcctttctcccttgtcgaatactccctctatcctagtttgatcatcacataaggtttttaatgtcttcccaaaatgatcatcctctaacaagtgcatcttttttttatttgtgccatgagtaaatgagcatcattgaatgcattgcatgtaaccaaccaagattaatttctattggtccaactacatgcaatatttaaaatttgatacaatacatggaacacgaaatgacgtagcaccttaaccgatgagaattaattacataatgatgaatgttttattatcattggtctctgtgctctttgcttcggtgatgatcaaaatggaatggagggagtagtatttttgtcttgtaacgaattcgaatactactttccaagccggcattcgtgtca

SEQ ID NO: 38682 - DNA, 1909 bp, Oryza sativa
catcgctatggatgtcaaaaaaaggttttgaggccaaaaaaaggtatacaaacaaaagagaatccaaggataaagttacaccatgtagatatgtttatggaaatgagggtcatcgaggaaaggataaaagagatcatctaataaagtatccttgagctaaaactagatctgattgtcaattacacatgggtgtagtaatggacagaaagacaagaaactatgaaatagctaagttaattttggaacacactcacccttttgtattttcctgaaaccttacacttgatggcattataaagaagaatttcagatttacaagtttttgaaattgaaatagccgatggtgcaggaattgggccaaaggcaacaaatgagttggcaagtcaccaagttggaaccaaatcattcgttgttttattataattagctttcttttgtcattttgcaagcaaacattttggaaccaaatttctttaaatgttcagccctcacatattgaattagcaacaacaacacattttgatgttttttttctgttctgatgtcacaatctcttttgccacactaaattggcacaataatcagtgtcaatctcttcgtatttttaaattgacacaatagtcagaatcttaaatttacaaggacgctcactctcatcacattcagtattgagtcacaatctcaattcaaatagatttacagtttcaaatcaatttacaatcacattcttgatctactgttgttgtcctcctcagaggtgctggtggtggccgccctgacggtccagactttgctagcaacaagctagggacccgctcccgtcctagtgttctcatctaggttggaacgaggtgctcgataaggacaccaccgtgaaagccatcgtcgtcgatgcgagcatatgggtggagcaggcccatgaggcgaggcgatggaagagagaggaggaaggaaaccagagtcgaagtgttaggagtgacgggctgtgcatccgtgggataatttttgttcgcttccgcgcttctcgctagtttttcgtgcgatgcggatcgaacggacgtgcgacgcgccacgtccgtcttgacgtcgcaagaccaacgtcagtcagacgatcgggttccagtccagcgaacccggaaccccatatgtttccccggccgtttgggatattttgccgtggttggtctggtggataaacctccccgcgaccgcgaggtttgcctactgctctctgtgtcagatatccacacgtgccccgtacgccgccatcgccatggctctccccctcgtccgcctccccccgctccccgccgcgcgccacccaccgttgctccgcctccccaagcactccgttccgcctcacggcggccgcgtctccttcgcctgttcgtccggtagccgcgccgccttcgctgcctgctgtgctagcgcctcggtggccccggcggcggaggcggaggcggtggtggaagagcccgaggggccgaggacgcggctcatcgcgcagaacatcccctgggactgcacggcggacgacatgcgcgcgctcttcgggaagcacggctctgtcgtcgatgtcgaggtaaattgttttccgtcgccttatccttgtccgcttcagagagaaggaatgtgcggcgaatttggagtggcagtaattcgctgtgaccgcgccgcagtacgaagcaggcagcagcggcaccccacggttgctgagagcctgagatcctagtgccaagaggatggcgtgaatttgcacaagaacacaaatgcgtttagcgcgtcgatctgaacaccaatacaccatggtccatttgcctgcaagaatgtccaatttagactttaaactattgttcatttcaaagttggttctgctcaagtaggagccaggtatttggggctgcaggaa

SEQ ID NO: 38683 - DNA, 3456 bp, Oryza sativa
gcgcgcacaagttcgtggatctaagtgaaacctgcagacaactctaaggaccgctggtgcattttactctttatttttttgtcatctaactgtctttctactcattttctcttgtagactctaaatgatagaacaattaaggtagactttactagatcgagaaagaagcagtatgttgtgccatcagctcccatgccgaagcacagcgtttttgtgggtaatctgacgtggagagtgagatctcgccatcttcgtgaattatttgcatcaaccccaggtgttcaatcagttgaagttgtcttccataccacaagtccgaggcgatctgctggttatggatttgtttccttttcctcaaaagaggcagcagaggctgccatatctaccttcaatggcacggtaagtattctgaaatgtagcttagaaataaaatatagtacaagttttggtttgtgtacggcccaaattctaatacatgattgtgttttgatgctatttctgacctatgaaatatatcacagaaattgatgggaagatccattaacgtgatgttcaaagatgacaatgccaaaaagaataaatctgctgcaccaacggaagaggatctgaaggcagaatcatctgagcagattgttagctaagcatcaattgtcatgggaacacaccgagaacttaaatgattgaggattgcttaactgacattttcccagtaattactctaactcagtccttaatcttattttttttctaagtacattttcagccatcataacaaaagaaaagggcatcttccgaaaaaaataataatgatgaagcaacattttttctggttgtcatttctgatgacatgtctgtttatttatttgaatgctgaaaattatgtgtttttgccaagttgcattgctcactggttaggttttgtaaacataaaaactactatcatttcatattttcattacattatctctcctgaattattagtttagattttagcaagtgcttgtgccaatttgagcattttaaggtaccagttagttatacattactgtcactttgattgttgatatgatggaatgttgagttatagtttgggcgtcgttgacttaactatggttgtgtgttcctcctgaagatactgaattattggccaccactctctgctaatggtgaaagattctttttctcacaaggtctcccagctgctggtcagttttgctcattcaacgcctcgtgagttctatattacagcgttgtttatgctgtccacttgatatggatgacatatgacatttggaggtcagctttatgccatgagcacaaaatatatgtaagcttttcttgacacccaggttaattaattgtagatagagataagtctcaaggatctcagccgtaacccgatggatttagcgataatttgtttattgtgaaatatttggctgaaatgtataaatcaccgggataactttaaaggctaaaagctactactggtattgttttcagtctgtacttgtcttcgtttttatgtgaccggaagattgtagaggccgggtttaatctaatccattatctaaaataaatgtgaccggaagaactgtgacaactgtcaaattaatatatagccttcacatcagttccaaattgcacgcttggtgtgctatccttaaaggttgccgtgcagtacagacccaaggttcttcagtaaccaaacgggctagtacatctgcgtcacgagcggtccgacgaaacatctgtgagcaatactgaactgtgctgaatcaattattgtccagtcttccgtccccatctgtctattcttagctcagaaagtatcctctttaataatctgataatcttgtagtactaagcttgttgattgtgaatgtgctgcagatatttaggtccattctttttttagtggatttatgttggttctaaagatacgctgaacctccctcttaacctggacctagtcctaagagcaaagttaatagtatagccaactactagctacaattcatctataactaatctaatagttaattcatacaatagttgcttactatactattagtatatagtcccactgtcatatacacattatgtcttggagtccgtgctgcagcgggctacagaagctgttcttctctctcatctttatcttattaaaatatgtttgtagctggctaatagtatgctattgtacctgcttaagagcacccgcaatggtaaagtaaggtgctctctataaaacatgtatatctcagtaatagattagattaatagtaaaccacctcaatagtatttctacatgggtatctatagctctctcatccattgtcttgtttttctctatagactctccaggttagtagatagctttactctctctctccatttaatctcttacaagtaggaaaatacgattatcttttatagagagcatatagataaccattgcgggtgctctaataacactagctaagcgcaaactccgagttatccatttcgcagcatttaccttgacggagtggacctgaaacgctaaacgcatgagcaaacgtgtacggaactcctttggtcaatcgttggattatccatctgaaactccttttgttttcgccgggatacccgtatgaaactcctgcatccgtcgccttcattcgcaccggtgataccgtactcatttggccggcagaccaaacatagtggattagtggacacttatgtgttgagaataccgtgccggtcctttgcgaaagcacatgtaacgcctatgaaagcaaggagcagaagcaatctgcttgtcttgtgtgcgacaacgaggccagtgcgttgtcctcgcaccaagcgaccgcctcgccgccgattgttccgtgcgacgccacaccgaaaccgaaccgggacaacctatttaatctttcaacaaatttaaaccttcaaatcttgaaaagttttcaaccaatggatgcaattcatttaaataaaataattaaaaagcatatcaaaaataataaatctgatataaaaagagttgtataatctaattccactatacttacgtagataaaacactgttttacgtaaaacgatatggcattaatgtataattaatagagttttaattatcataaccttaaaaatttatttatagcaactttcatataaaaagttttttaatgaaatataccgtttagcagtttgaaaaacacgtgattatctaaatttttatccaatttttattacataaaaaagacctaaatttacaagaatattctctctctccgtcccataatataagttattttggagagatatttattttggagagatatgacacaatctaatactaccaatctagagtaccagattattatgatacattcctttaaaattaattatattttgatataaaatcctacgaacgaaaaatacaaggacagaaaaaacgaaccg

SEQ ID NO: 38684 - DNA, 10055 bp, Oryza sativa
gctccccactctgcaaaggtaggcgccgccgcgttcccatctccctctctcacacgatcgatgccgtggaattcgcgagtgtggcattgcttagagcggcgcggtgtttttttttttgttttttttaccctttttgttgatgtggaggttggagaacgcggcggcgtggacgagcacgagcccggatcggaagggcggggacggcgaaggcggtggtggtgacggcggcgaccgcctgatgcgtgcgctgcggctgtcgcagtcgcgggcgcgggaggcggaggagaagctggcggccgccggggcgagcaacggcgagctctcggcgctgctggtgcgggactcggtggtgctgtcggcgcaccgccggtgggtcatgatgctggaggccgagaactccgggctcagaggagcagcaggagccgccggctcggccaaggaaggcgtcggcgaggacgaggacgaggacgacgacggcggcgcccggcgcggggccgctgcgtggtggctcgcgctcgccgtctgcgtcggcattgccggcatcggcctcgccatgggcaagctcctctgaaaactaaccgtttcttcacctttttgttaaggggaaactgcacattggaggatcagatcagacatcatgaaaatccatcgttctacgaaaaaattctgcacaaaaaaaaatgttgctagcatctggaacatgtcgatgattaggaatcacttgtaaatgatgaacatgatgaacagagaggggtgatgactgatgagaactgtagaaacttaggaatcactgttttcagaaggaagttgggttgtgactggtttggttgtgaagtttgtgtagataggattatcatcacgcaaaattggcatcatttctattcccaaagagaagcttggatgatggggaatgggctggaagatgccgtatctattgctgcacgctaccacattcatgactgcgtctgcgtgtaggataaacttttaaaagagagtagtaataccttgtttggataatccgtcccaagataagtgtaggataatccgtcctaaaataaatgtagttttgcatcgttcgtgtctagcggttgaccgtttattttatttatttttttattgttattagatgataaaatatgaatagtattttatgtgtgaatattttatttaaatttttgtcaaataagacgaacggtcaaatgttaggcacggatatccaaagctacacttattttgggatggatatagtatattgtttggataatccgaagaattctatagaatattcattgctccctccattccacaacttagtacaaattctatcttaactatatacttataaaatatggtatttacagctaaagagcatgtctaatggttgttaatactgatctctcagtgttgattaggaatattcgttgacatggaaaaaaaaggagacaaaacatagttgctatgggtaataacggttcaacaaccattcttagtctctataatatggaaacacgattgggtgagagtaaaaaaaagaaagaatagtaaaaggagaatatttttagttaatttagagcctttttgcctttcaactattattataaaaacacgaaaataattttgtattatctcagagattatactcgtctctgccgattgactagctcttggttttattaccaagttaactaatccaggttcacacctcacccacacaaattttgacaatttgatcctttgaaaaagctaattttacaaatgaaccgccgccaaaacttatttaaaaaatgactttttttcagcgccaaatcatatggcactgaatttagacatctcagtgccacgtcaactggcgctgaatgccttgccaccacggatggaaggctaagtcagcgtgccaacgtacattcagcgccgtactatttagcgctgaggtatctaagttcagcgccatacgatttgacgttgaacaaaagggtcatttttgaaataagttttggcggtggtttatttgtaaaaatagtttttgcaaagagttaaattgtcaaaatttgtgcctcaaccactggtggaggcaaaataagtatttccaccctttttaatagctttgtttatgtagaatgttcttttattttattttaggatagggaaagcagctcagccgagtatcgttgctttgattctcttgatggttgtatctctgctgctcatacggcgcaagtatttctacaaaagaaaaacaattgagaatatatctatttgtttaataatttatgtttatatatctacacgggaagaaatgtcacaaatatacgagctccgcagattgaatacataggagcaatcacaaatcgcgttgcgggaatgcgggagcgccaaccagggtgttcccgctgaacgagcaagcagaaccgctagtccgccacggtccggtgggctgaacttgcgggaccatgacggtcctgcggaccaggagtgcggcagcgtggcttcattgcgtggaaccaactctgtgaacagtggcaaacaatgttagacggtactcaatagtgtttttgaacaatattaaaaacgcatgtacgtgttcagatgccggtgccgcggtgccgtgagaccaatccacaggaccacgtcggtcccgcgcaattgccccacgacactacccctcttgtcggtttcgcgccttcgagttgcagtgatggcgcgggccgcgtatgtggaccgcgggaaatgtatatttctataaaattttcatacgcatgtatatatatgcaaaatcaagaaaattacttcttccgtcctaaaataaatacagttttacactgttcatattcaacgtttgaccgttcgtctttttttatttttttatgactgtacttttattgttattagataataaaacatgaataatactttatgtgtgtctaaatttttgttagctttttcatattttttttcaaataagacggacggtcaaacgttggacacgggtaccaacgattacacttattttggaacggagataataatttatattttaaaatttaatttgtatttctactacttaaacatggagtcatcgatcctttccccacctcgtgcaaagcatggaacatccaatggggattttctgcggtaccgctagtgcggtagcagtggctgatgtgtgggtccggacccacatgtcagcctttgctactgcatcagcagtactgcaaaggatctgtatcctggactatcaccctaataaactagaaaaaaaatcaaacgacaaaaaaaagagagcaaagtatatatctacactcacaacccatcctcaagtcatgggtctagttcgttataattcacggatatattactaatgggagataataggatgggcctatacaaagaaatatatccgaaagacttggtggatattttgagtaattgctatctcgatgattaggaatcacctataaatgaaacatagagttgtgagggtgaaatatgtagaaagatactaggaagcgcaattggatttgtggggatccatgccattataaatttatctgtttggaaatataccactataattcgtgaaattaaaactataccattacaatttaacatgtatttaaggggtagcactgcttaccccttcaatgcaatttctaagtttttctgaccaaattaccctcctttctcaatcatcttcttccttccatgtgctctcgtcgtctgctggtcatcgcctcagcccctggcgagctcgtgcagccaaccgcagcgctgccctgacgagctcatgcagcaggcgtccacgacgcacgaagagctgctgctggaagggaccggcaggaactccaacgcatatccagcgaccttggtccaaagcagcatgggcgagttcttgttgcagttggacacgagctcgatggctcccgccgtccctggatgtgctccatggccgctgcccacaccagcaccgacgcccccgccgttgccacccccaccccccacccctcggctgccagatctgagtcctaacagcgacgtgcgtccaggcgtcgctggcgtccgctggtcctcctcgcatcactggcatcatccggccaaccaactcgcgtcgtcgccgccgtccggtctgccatcctcacgccgtcgtccgctcgtcctcttcgcatcgccgccgctgtcctgttgtcctcctcgcgtcgtcgccgccgtccgtaaccattctcacgctgtcggtgtctgcccatcttcctcgagtcaccggcaccatctagccatcctcattgtgtcgccgccaccgtacgctcgccatcctcacgccaccatgttcttctcttcctcctcgcgtcgtgtcctctgctcgtcctcctcggcaggcgggcggggcgcgaaggagcgcctagaggcatggtttaggccggaggaggaggagcttcggtggaggcccaggcctcactaggcgtgagggagagaggagagagaagaggggagaaggaagaaagggaggagggagcaaaaagacgagggtaaaatggtcaaaataatttttataaatacactgaagaggtaagtagtggtatatcttaaactgttgtaaaattataatatcatcgttacaaatatatgaattataacggcatattttcaaactgaagaatttataatgtcatggatccaattaaccctcgcataaagggagtttggttgtggttggtggtaacgtttgtgtagctaggatcatcatcaggcaaaattggcatcatttctatccctgaaccaatcgctgattcgctgcacggtgcacgctacgacgactgcgtgtagccgtgtaggatacactttgaagtcgcatcctgtttggatccataatcggaaattcggaagtctcaacggaacattcaataggttatatctttatgagcctcagttttcaacggaacattcaaacgtttaatatgatagggtgtaaaatttttacgtgggaagtaaacatagcctcagtttgtacgagggaggtcagacactgctaattgtacatggtcccacaagatcgatgtaagtgccgaaccaaagtaaaggtttgctttcgtgcacggccggtaggcctatagggacgatccactgatttggtcatcgacatcttgaggaataagttcatctgaggtcccttaacttgtcaacgaattcgacttttgtccctcaaccgaaaaaccagacacaacgggtccctcaactatcaaaaccggtgtaaattaagtccctcgatggtttgagggtggttttggctgacatggcgcctacgtggctaatttgacttggtcttcatctgacgtggtgcttacgtggcaattcgatctagaaaaaaataataaaacccatgggacccacatgtcagtttcacacacaaattaataaaaaatggtgggggcccacgtgggacccacatgtcatcctcgcccctcctcttcttcttcctctctccccgactccccttcatctctctcccctctcctttgtcctctctctagacgcgagtgaggaggggcggcgcgcggcggacgacgggtgaggagggagcgacgcgcggcgccggcgggagacggaagagttggcagcggcgcgcggcaccagtgggagaggagggagtgactcgcggtggtcgacgagatacgggaaagaagggagtggctagaatgagcgagctcctcgccctctccactgcgccggtgctccacgcgcagctccagcaggcggaggctgcggcacaggcgaggggcaaggcggtggaggacgacgacaacccacgccggcgccgcggacgacgtcgagcaaccggcggccagcccacaaacgacgacacctccttctcccttttcccctctcctctcgtcgccgtggatccaaagggaggagacggcagcctcgctccccagatcagcgtcggcgactcggcggagctcggcctaggcgtcgatgacgccgcgtggccacgatcctagcatttgggatggcatccgctgagaaaggatcgtgtccgcgtaagttgggtcatcgtgcccacgttctgtaatcgcgtatggataaaagggaaagaaacagaaaatgtcgcaagcaagtaatatgcagcgccaaaaagactttcccaattggtttgttcttctcgcgtccaagcgtgtgtgtgtgttgcaggtttcactgcagttgccggagtttagctaacatcgtcccccacctcttcattgacggcggcggggattaagacgacgacgacaatggcgacggccgtgaggcggtgccgtggcgcgaggagaagcacccgaagacggccaatacccatatctacaccaccattgacgcaatcccggtgctgttcaatggtttccctctcctcaagggtgtggacaagccgtactggttcgaggacaccgacgatgacggcggcgtcctttcagcctcatcccgtcgccatctccaggagctcgcctgccactcgccccctctctgcccaccgcccctctgctgtgcccgccacctctcggcgctgcggtgccgccgccccttgcccgtcgcttgtgccagcttgctccagccgccgccgttagctccgccggccggccactccgctcagacctgctccgcccaggtgagagagagagaggatggagagaagagggatgacatgtggggccaaatgggtcccaccatttattattattttgtatgtagctgacatgtgggtcccatgttttttattttttaaaattaaattgccacataagcgccacgtcaatgccacgtgggacgaagacctagtcaaaggagccacgcaagcgccacgtcagccaaacccgagcataatactgccgagggacctcttttgcacggttttgtaagttaaaggatgtgttgtacctggttttgcacttaagggatgaatttcaaactcggcgacaaattgagggacctagaatgaacttattccacatcttgattggtatgttgggccgggcccgtcaggccatgggccaagccgatgccaggtcgtaccatcccggcctgacgcggcctagtcacctgggctagcacaatgggagggctgggctttctgtgccgtgtaaacggcccattcttctcgtctcttcggccttgagctctcgaggttcccttaattattttccgtttgccttttcagttcccttattctacatttggtcaattggctgctttatatattttgagaagaaagtgaggaattgcttcgttcgtgctattatagttctcttgatccttcttaatatataaatccggaccaccagaaaaaaaataaaaaagaaaataaaaagtgaggaattggattctgcatcgaccaatctcctttgatcattttctatatacgaagggcaggcagtggtaggtggcacccttgctttggcagcttgggggcaccttggcagtcaagcgatgccatggccaagactaatagctcgattccagactttcagtagctgcattgcatatcaggttctttgatttttttttcttccttttcttctaaagctgcggtgttttaaccttattctcggcattgctgcattctttataggaaccgaatcccgtgcacattaagtttgacaaatttatactctaaaaattgtcttatattattgtatggctaaaatataatgaatgtgaagctaagacttaacaaatactcctatatacatatatagtacattttgagttcatgtacattatttttttcttgaattttcaataatatttgctagttaggtgtgcacatacatacgtacatttggttttgtgaaaatacactcactgaaggttgatatggatctagaagatgtgtgaatcatgtgtggttcttgtaaagtaaatatatttggattatgtatcagcgtatcactatcaaccatgtatgtcgaatatacttatatatgtacataaacaatggaggagcaatttgcgctcccatgaactgttaataatctgactgaagagtacttataaaaacagcccatattagttcatggcttacgtatgccagacgacgtgcaactgcaattcttacattgacctgcacatttcctcccttcccaagcttcaaggacggtcaacaagagggtatcataaaaaaaaatgaagctaaaaatattattggcaatttggcatgcaactaacatgtgttctagcacagtagcagggaccttatacaaattcaactgggtaaaattattgccaagcaactatcatgtgagtggcactgtagcagaggccttatacaaaataattcgacagtatgcctttttttcccccttcaaattcacagtgctaagcgtgtgcaagaaatggttctttcaggggtgggaaaagggaaatagggtgtacggtacagccagtgaacaatccaaaattttcttctctgaaactagtatttttaaaaacatattcttctcgatcttgaatcatttcatgaaccttccaaaattattcgtctcctgattgaagagactgacataaacctaatctgctgatctctatacagagatgcgttggcactgtttacatacaccctgccggccatgatgttatcccatacggcagatccttcctttcggtcaatgcattaggtgaaaaccgagtcgtcttacatgcatgctatcacatatatagattgcaggagcagatcgaacaaaatgattaggtcaacatgccgtgtgtccatgtggatcggagtacgctagaaatttttaacctggaagctagagttaactgtgccattagcaaaagatcactttattaaccttgcaaacggcaaggtcaaaagctctttccaaaaaacgagaaatatacttttgacattttgacagatgagtgagctagcactagtgttcttcctgcttcgactactaccatatatgttgccttccatttgttgctcatgccactacaggcggctaaagaaacaattcacatgcattatgttattttttttcgcaaattgcatcagttacctaaccactcctcgttctgccatagtttcattagtttaatctctagtttaattgagctttctgtgcgttcattaagtaaagtacaaggacaggcaggccagaagtattctcgttggaccatgcatgtattaataagcagcagtgccggtatgcgtagtatagagtaattcgtctgaacctttctcttttgtgcaatgtgcgcggagaaaagaaatgcatggctgtgcttgatgtcgaccattgacgatgacccacctaccgtgtatgaacaatcgcggaaatagaggataattagagataagggtagacaaacttggatggaccatgatcccgaacaacacttggcattttggcaatgatattagggcccacatgttaatgagcagtattgtagtatgtattgtagtatatctctgtttccctattttgccaattccttttatctttgtcggttatgtttctataaaccggttgagtagataagggaggtttcgtgtctatatgtactccgcaccgatatcaatccaattttgtgttgagtctattccgcttttatggtatcagatttttttcgatctaccgctctaagcctaactccaccaacaccgccatgtcgacggctacctcccccctcttgccagagtccctcgtcaacgttgtttccacgtccgttgccgacgccgtccgcgcgtcttaccaagccctgcccggctcgacaattgatgacgccatggccaagacggtcaccgactccgccgctgatcgacagggcatccgccgccgacccgccgtacatgctgccctcaaacagcacctgccggcgctctccatagcgcccaccgccacctcgtctctccccaccatggacatcgctccttaattatctctctcggttctgtttctataaaccggttgagtggataatggaggtttcatatgtactccgcgccaatatcaatccaattttgtgttgagtctattccactttcagtttggttcatgagatgcattaagtctgaaaagtaatat

SEQ ID NO: 38685 - DNA, 1137 bp, Oryza sativa
aattaatactcgtgactaatcaagcataattggtaatttcccttttcagtgttcagcttcgttggggcgcacacggtgacggaggtgaacaagaacgattacgacaactgcgccgtcgcaagcaactcgatcagctcgaccagcaccagcccagccaccctcgacctcgccgccgccggcatgcactactacatctgcaccatcagcggccactgcgccggcggcatgaagctggccatcaacgtcggcagcggctccggctccggctccggctccgggacgccacccagcaccaccccaggaagcagcggcacgccgccggccaccccttcttccccctccaagccgaccggcggcgcgtccgccggcctgcaggccagcgccgccgtcgccgccgccgccggcgtcctcgtcaagctcgccctcttctgatcgggcccacctgccaggatagaggcagtgcatatgattcttgtttcttgatcatttcgtctgacggccggcatgcatgtgtgtgagagagatgagtggtttgctagctagctagatgatgatggtgatgatgatatggggttgttgttccgttccatcgtgtacttagtactgtaattacgagctgtcatgtgatttgttttctcatctccatggatttgtataattttcctctgaattttatcatctgcatattgatcggacactctatatcactctatatcaatcttgcaaaaagaaaaaccggtggttaaagtgatggttaacggattggtcatgctgagcaatgcatgatctaagcttgcctaggccgatcactgtagtaagaatgggaccagaccgacctgaaagaagagcaatgagacgactactaactactaggacactagcctagaggaaaagaatcgaataatagatcgaagggcaggtagtgcgtcgttttcagagaagggaatacctcacatttctgcttctgttagaacaaaagtttcctgcttcaacacctgctccgggggtaagagtcagacggttagcttaggtaccaaagttctctgatgctaattagccgtgcttacctttgaaatgagcaactgaatctgtcatgtcagtgtctgaaatgagacgacgacgacagtggacacggcg

SEQ ID NO: 38686 - DNA, 5271 bp, Oryza sativa
agcattggaagcatgaggtttttcagtcctcggccaaaaaaaaaagggtatcgaaactacaacttctgaatgactagtttggtacactcccaagaacactaatcactgtatctgtgcctcaccaatcagtgtggctttgtccatgtccaacttagtaatttcattgctgttgcgacccctatcctcaatttacttcacctgcagctattgccttccatttcgtacctttgcccgcaaaaggattttcaggtgatttcaagatttaggataacatattgttacctaatctggaatgctttcttattctctgtttgagacaagaaattagtgctttggggactgggcagtgctccttgtcctcttcagtagtgaggacttgtttttttttttttcctttcaggttctcattcttttgtatttgcctaataatttagagtgggacctttatcctgtttgagatactgagacataactatgggatatcgttactccgctatgcatttacttttaagtaaaaaattgatcctaagtaattttgtatatacctcaaattctcagtactggcggcatgcatgcttgtagtcctgtttattgacatatgaatgttcatttctccaattaacctacaatccttcttttgttaaggtgactaggaaacaaacttttcaccatcggagacatttccctgtcttattgcaatggaagccaagtttttccggtttctgaagcttgtcggggtcggcttcaaagcaaggacagagcgtgaaggccgtgagttgtttctgaaacttggttacagccacgaggtgcagttcactgctccacctgccgttcgtgtcttctgctttaaacccaacttaatatgctgtactggtatagacaagaatagggtacaccactttgctggcgctgttcgaaacagtaaaactccagaagtatacaaggggaaaggcatattgtacattgatgaagttataaagctaaagccagggaagaagcaaaagaagtaattaaatttgatttttagcctgctaagatgctctgtagcacatttttagtggcgcttatgttcttactgtttcattgtgttggatcatctttgtcccggtaccatacttaaaggcttaataattcgctgtatgcaatgtatgtgaatcatatgatgaaactgcatccaaaccattgggataatccaccatttccgatcataataactttcaattgtttttttgttgttactatactatccagcccaactgtcctagacattgaactcagtgtaaaacaagcttagatctttgcatttgagggcgttttttttttttactctgagctaatctgtacctttatatgtatgatgttatttgtgatagtgatgccactaaaggcaaaactcaaaactccgctcgcgaaatttccccatgaaagtaatatcttactctatttggtaaatggagtcatgtagttagacttgaaaaacatttagcgtctaatatgcacaaaaatatgaaaatttgtcttgtaaaactgaggtcaatagatttgggcaaatctattctcatatctatttgaaaagatgagcatttatattttttttagttgtttagacaatagatactacttttgaaaaactcaaaaacttgttcggcatcgagctacattgtagcatcacccaaaccactcttaatttgggccaagtttatagagtgtaagtgtttaataccttagtatttgacaatatctgaatttgaaattcatgatattttttttccaaactttaagtaaagcccagcactataaagcatactgtttccctgttttaatatatttttattaatttgttacatacttttttcctggttttaataactttaatgaacatatgagaagaaaaagtagccctatgtgtgtcctgaattcctgattgataaggaaaaatgaaggacgacagtaccgcctaattaagcaccggatggtgatttgacggaaatgtcaaaatagcctagatgaatgtacagggtagtaggtacaagtatcaaacagccggctgatcattttccataacatatttttgtcaaaattttgaaagtgaaacgcatgactaattggaacagataggtgagttgtccaatatacacgacgcttactccttgtctgcatttacacaattagctaacctgctatcaaggaaaagcatttgttcatcaagtcaatattactacgaatttctccacttaaaagtctatcaacaaataaaactgaaaaaaaagcaaaaatactagtactacaggacaaagctcatcatgaaattaaatggtgtacccctaattacaaacgaagcatagaatcgcacaaaattgtttcaaccaaccataattttttttgcgactttgtaatcgaagaagaataaagttttgtgactttatgtacacacaaattgccgccgaaagagaagagaattaacggtgacgacaaggacgccttcctaatattagtggagtacttctaatactttgactaacaatcagcgggacacgtcatcatacatggtaccaagtggacgtgggcacgcgccgccgccgccgccgtcgcagtgttgctccacggaggcggtgcagtcgccggcgaccttggcgccgtccttccccggagagtcggcttcggcgccgcgtcgagcggagccccacgccggcagcctggccgagaacgtgcgcatcagcgacgacacgttggaccacctcccggactggccgagccggacgctcctcccggcgcgggcgccgccgccggcggcggcggtggtgcggaacgattggaggctcgtcgtgcggcgtagcctcgccgaggtgacgatttcccggagcacgtgatcggggagcctcagcgtgtaccgctccgcggcgtcgtcggcggtggcgggcacggcggcggcggcggcgagcgagtgccccgtggtgtgcgaccgcgggaactgcggcggccggcggccggacttgctccgcagcgcgcgcttcacgcttccgatccgcatcagctcggccgcctcctccctcctgatcctctcctccgtctcctcggcatccgcgacgacgacgtccaccgtcacctgctctggcgccgccggctgcggcggcgcagccgcaacatcttgcccggtggtcaacgcatgcggcggcgccagcggcggcggcgggacgccggcgtcgaaggcgaggttggcgcggcagacggggcacgtgacgtgggacgccagccacgcgtcgatgcagtcggcgtggaacgcgtgggagcacctgggcagcagccggagcgtctcgtcgtcgtcgaactcgctgaggcacacggcgcactcgagcgcgcccttgccggccttgtgcgccttcacgtcggcgtacgccatggtcgggaacgcgcccagcacggcggggtcaagccccctcaccctcctcgaccgcgccgccgcaaacgtgaacccaccacccacacgtccaccgccgccgccgccgacgccataccccccgggcccacccaacggcccgccggcgcatcgccggatgtagatcgagaagaacccgaggaagaagaaggcggtgaccaagaccacgatcacgacggccatggacgggttgaagctcttggggttgaagtagttcgggccgggcccggacgtcgtcggctgcgccgcgccgccgccgaccagcgaggcaatgacgacggcggcggcggcgaggaggaggaggcggccattgtcgccgcggcggcgtcctcgcggcgaccccatcggagtcagtggctttctcctttgcccctttcgggtggggcgaattgatgggagcttagctaaggcgggagggagagagtggcacggcaagtgttgatacgtgagaggacggggataaaaagggcgggagttaacgaggtgcagtggcacgggcaagggtttgttaaaccaccctgaaggaaaaaacggaacgtaccccgccacccattttcctgcacaaaatgtagattttagagggcggctttagagggatggctgaggtgtaaaagatcggtggtggatggtagtgacacgtagatggtgctagagccgtgggatatgagggagggagggaggtgggacaacatcgaaggcgagagcatcaaatgtaaagtggttatcacacagaagcgacggtggcgtctcggcagaggtatcagagaagatgggtgcacctcaccactgctcggttataggaagagaagggttggaatgaaggaggccagtttggtgggccttgctagtactgtcgaggcagaagaaggctatgcacagggggtcattggtggtggtggactggtgggtgaccgggagggggatggggattgcgtcagcggcggtattggggtgaaggaaaggagaaaggaggcagtagagttggggggtatcacacaaatcttaaagtcatcctatccattaaaaaaaatcgactagtgctctcttccagttgaccgactaataataagccttgtaatgtttcattttgaattcccacgaaacactacggtggaagttacttatgtgggcaccatgggtaatatgtcatcacgtgtccaaagtgaccaccacatgtattgaatgattgggatccatgcaggcataaatagccactcatcctcggtgtatctatgatcgggattggcacctttcaatattattaactatgatgccaagtagtgagtacgagagatattcgacggaatagtttatcggtcaacttcaacccaagataggcccatgaaaccactcgaaaatgtcccaggggacttgaaccaagatgctacattcacgatcatcttaattattcaaaactcttactaatgctttgctaggccctaggaacaacgactagcctcgtactttctttacaagcaattgataatcatcgtaaatgtacaaatatggataagaggtttcaacatattacaacttgccctagaattttttaggaatccaaaaactttttttttaaaaaaaacatatatttcaaactgccctggcggtagctaacatctagtctgcatatgaaatagagattaacaaattgggcagaatctttccaaaccgtttccgtttcaaagaaacctaagcataggtgacgagtaagatggggagttctcactaaagtctcatcatcagctctaattcaaagcaatgtttctaatattaataagcgtctttggaaattaaagataccccttaaagttaagatttttttctttgatacttgc

SEQ ID NO: 38687 - DNA, 763 bp, Oryza sativa
aaggctgaactgaatcgacgacgaccaaggatagcgacgacgctgacgacgaccaaaacaaaaaaacgatctttgcgtgaggaggaaagaacggcgacattttgatattctacttacaactaccagttccggtgagggcgtcggccgcgcgttttcgagggtcaatgccgacagctgcggacagccgttggatggtgatcgtggggcatcaccaaaactccaaaatgtgtcaaagaaacagcggccggtaaccgatccgaagccagagaccagggcgtgtggttaccggccagaaagctacgaatttatagatttaaaatttgaatttatttgtttggttactgatcaatttgtttgatttttttagtccagtaagtgattactggtttttacgaaaatcggtaattttggaccagaccaagataccataatctacttcaatgcaaatactactttttttttggataatagaaatcaatctagctgttcgtatctgattcgagattttagattttcgtttgtacatggctgtgttcggtgctctgcttcctaaccctcatcctcgttttccgtacgcacgcttttccaactactaaacggtgtctcaccctcgtttttcgcgcgcacgcttttccaactactaaacgatgtgtttttttacaaaaattttctatacgaaagttgcttaaaaaataattcattttttttaaaacaagataatacttaattaatcacgcgctaatggactgcttcattttccgtg

SEQ ID NO: 38688 - DNA, 1438 bp, Oryza sativa
catctctctcttgtgtgtgggtggtttggtttcttgattggagcatggcgttggaggcggtggtgttctcggaaggatactacttcggatgcggcggtgccatggcggcggaagcagctgcaggaggagcttggagctggagccacgggtatggcggtggcgttgatcaggggaagggggcgatggagttagtggtggacgacggggtggtgaacgccttctgggacggcggcggaggcggcgcaagctcttccccggtgatggccgccgtctcggggtttattgaggagccggacggcggtaattcctccgtcgcagacgcagcgccgccgccggagcacggaggtgcgtctgtcgtcggacgggatggctccgcggcggcgccggcggcggccgcagggaggaggaagcggcggagggcgaggaccgtcaagaacagggaggaggtggagagccagcgcatgacccacatcgccgtcgagcgcaaccgccggaagcagatgaacgagtacctcgccgtgctccgctccctcatgccggcctcctacgtgcaaagggtacgtctcctgccgacccatctagggctcacttcgcccaagaccgccattgatgatcttgttagaattatcaacaattcaagctataaataaattaaattctcatgtggatagggcgaccaggcgtccataattggcggagcaatcaactacgtcaaggagatggagcagcttctccaatccctggaggcgcacagacacgcccgccgcgcacgcaccgacgccgcgccgcgttgccattcgcgggcttcttcacgttcccgcagtactccatgagcgccgtgcccacgacaaccaccaccactgtagcagcagcagcaacggaaaacggcaatgccgtcgccggcgccggcgcgggcgacgacgcggacgcggacgtgtcggggtcgaagccgtcctcggtggcggacatcgaggtgacgatggtggagagccacgccaacctgaaggtgctgtcgcggcggcggccgaggcagctgctgaggatggtggcagggctgcaacaccaccgcctcgccgtgctccacctcaacgtcgccagcgccggccacatggctctctactcccttagccttaaggtatagtaaaaacacactacttcttcctttaaaaaaaaactaacctaaaagatagaacataatcataatctaatacaatgaatttagattcgatttttttaaggatgcagagagagtacgtgtatacgtgcatgcgtacacgtatcctctccccaaaatactctactccattttctccattttagcagctacgagtagctggctactgtagctagatagcctcgttttccgtgcagaaattgtcatgaacgacgcctacaaactcctcgtcattcggatcagtgtcatggctgcttcgattcg

SEQ ID NO: 38689 - DNA, 9403 bp, Oryza sativa
tgtgataaatgaagatattaaatctgtagttttgtgaaacaagttcttaaatatgtagctttgggatatattgtacaaagtacatataattttgtgataaacgaagactttgaatatgtagttttgtgaaacaagttcttaaatatgtagttttgtgatagattgtgctaagtatatgtagttttatgaaatttactcaaaatttaaccaaataaaacatgtgcacaatcaattagttgcctttgacccaaactagcacatttactatttaggttggcaaaaaaatgataaggcatatttagtatagtggtatcaatccaaaattaccctatatataaaaattttacttatataagtcacgggttaaattggccattaaaaaaccgccaagctgcatgaagaacagtaaccaaggaaacgttcactcattgcagaggtgttgccgctggcatagcaaagctctgttgcttctatttcctaataaggtaaaatggtttattggaagataaaaaatattttatagctgaaatttttatatacgtgttattagcaatttaaatatcaatgctaaaatatatgttgaaaatatcttaaaaccaaattcaaaattaagtttaaaaattcaaattttaagacacctttgaatcacatcaataaaaaatagaggaataggacaaacatagaattataatataaatataagtacaaaatagaggattgcaaaatagaggaaaaacacgagaatacgatgatagagatagacttaaaggaaaatttacaagagattaaaattattgctaaatttcctccaaaatctctacagtatggtttatttcatagaaatttcaaaggatactctaggatccaatcctttgttttaaatgtcttcacagaaaatttttcaatagaattaaaacccttcaaaaattttaacgttttctgtccaaatcaaagataggagtacacatgttagggcaaccaatagagctactcagtgggtgtttaggctgtgtatagttcagcgtaaagtttggattttgattaaaattagagataatgtgactgaaaaaattatgtgtatatgtcaggttaatgtaatgaaaaaatactgaagtttaaagtttggatccatacacagattgtgtatgatttagatcagtatcaccaggccctcataggctgtgacctcaaatttacgagctctgctccagcagccgcattcacatttcacactcacggcgccaccccgccattgtgcgtgcagcacgacatgctgtgctgctccactgctcacacctctgtcaacctgcatcccatcacattcaaatccccatcccttctcacgcaaggaaaacccccctacttcttcctcctctgaccagcatggccccaccccacacactctccacacccgggcccacccccacccgcttccccagaaatattgctacgcctcctcacgacacctcctcaaaagtcgcgcccccgctccggcccactggaccaagctcaccgcgctcggcccatggctggacccctccctcccggctatataaacctctccaccaccccgcccctaccaccacggtgtggcgaaggtgtcactgacagccatggcccacaagcgcggccgtcttgttggttgggtgcttctcctcctcctcgccgtggctatcgccggcgccgccgcggccacgccgaggcagctgttcctggtgacccaggcgccggtcacgctcacgaaccaccacggccagctgctcacggggaactactccgtcaacctgctctggtacggccgcttcaccccggcgcagcgcgccaccgtcgctgacttcttgctgtcgatgtcgtcgccgtcggcggcggcggaggctgcggcggtgtctggtggtccggcggcgccgtcggtcgcgtcgtggtgggccaccacggcgcggtaccacccgggcgccgcgcggctcacgctcggccgccaggtgctcgacgcgtcgctctccctcggccggcggctgtcggagacctccctcgccgcgctggccgcgcgcctctccccgcaccggggctccatcgccgtggtgataactgcccccgacgtcctcgtcgacggcttctgcctctcccactgcggcctccacgcgtcggccacctcggccgccgccgccgccgccaccgcctcgccagccgcgacgcgcgggcgcggcaggttcgcgtacgcgtgggtggggaacgcggcggaccagtgcccgggggagtgcgcgtggccgttccaccagccggcgtacggccctcaggcgccgccgctggtgtcgccgaacgccgacgtggggatggacggcatcatcatcaacctcgccacgctgctcgccggggcggtgacgaacccgtacggcggcgggtacttccagggccccaccgaggcgccgctggaggcggtgacggcctgcacggggatgttcggcgccggcgcctacccggggtaccccggccagctgccggtggacgccgccaccggcgccagctacaacgccgtcggggtcgccggccggcgggtcctcctgccggcgatgtgggaccccaagacctcgcagtgctctactctcgtgtagtagtactagtacaaaccctctgatgcgatcgatcgatggaccaaaatggcttgggctcggtgtacggacggctgggattagggagtggagtgacgtggtgtctcgtttcttttgttttgtggatatttcgtggtgaacaaaaaaaatggaaaaaaaaacagaatgaagtggggtaatgtaataaacctaggctttcgttgtcatgttctgtatatattggtaaggcattgttcatgggttcgttgatcgttgacatctcaagcaaaggccgtgtttggattttttttttatataacaatgttgcaccagaatatttggacacatgtatagagcattaaatatagatgaaaaaactaattacacagtttgcatgtaaattgtgagagacgaatcttttgagtctgatttgacaatgtgacttttgagtctaattacgtcataatttgataatgtgatgatataataaatatttgctaatgacagtaattatgacagtaattagatgtcttgtagacggaatctgtaagactatatttaatactttaaatgtgtgtttgtatattaatgacagtaattagatgtcttgtagacggaatctataagactacattacatttctatatactttaaaaaaatttgagcaatgaactaaacagagccgatgtttgcaatgttttcatgaaatcgaccaaatgcaagtacggggtagcaggagtatttgcaaaactcaagacgggcaagtggcaacaaggaaaaccattgtgcttgtgccatcatctaccaccaccttgttggccatcgtggaaagcatgcacacacaaggaagcaaaagcaaggggaggacggaggacggacgacgcgatgcatcatcactatgccccggtttgtccgggcgtggtatggagcacgggaaagagggtgaggacaggacgagaatccatccaggctgtgcaggggataagcttgggcgcacagtggccgcgtgccagccgtggcaggggagagggagagaaggtttgcccgagataaaaaggcttggatggtacggaaggcgtcccgtcgctgcacggagttggggcccgtcagacgtgaccgctctgacctctgagctctgagcgttgttcctcatctccattggcgtaatgacgtggagtaagtacccaaccaaggctgggtttagttaacatcaaaattaaaaattttgttgaaattagaacgatgtaatagaaaagtgagaagtttatgtgtgtaaaatttttttatgcgatgaaaaagttaaaagtttgaagaattattttggaactaaacacggcccaaatgaagttcaggcagagccatagaggtacgtcccataatactccctccgtccctagatataagggatttgggtcataaaaatattcagatatgttgtactaggatatgtcacatcacatccaacaaaaataccttatatttagagacgaagggactataaaggattttggatggatgtaacacatcctccgtccatattcattgtactagaatatgtcatatcaatctaaaatcccttagagtaacgataatgtatatggcaaaagtagtccatagagatgtgacccacatatataaactttaactattgcaaccttcacaatgtatatgtatagcaaatagtattagtaggagagaagagatagtgataaataatatattttactctttatgggtagcccatatgcttatgggtaatttttgttatttctttcttatggactagttccacaatgttagtggctgaatcaaatattatattactggtggaccacttttggagtacattgtgacagagggagtagctagtagtagtattgctactgtatatatgttacggaatttagatcaggtgctgttttatactagctcctttccaaaatatagctatatttagctcagtactttatcaaaaataaaatgccaacctaaaaatgtctatattttaggatgaatgaagtattactactactctctgcaaaaaaaacagatatagttaaattcttagtattacaatatgtcacatcttatgtgaaatttggttttagaggatggataaagtatgtgtaaccgtgatttaatgactattctcttcatcaccgaaataaaccaacttagattgaatgggatataatctgtccaaatttattgtactaggttaagttatggtccgtcctaacttatattatagtgtgcagtgctcatttcgtttcaaaataatttaacctaggatagttgtgatctaacctagtacttactttatcgatccaaaaatatagcaacctagaatgggataagacccatctcatcctaggactatctctgtttggattcatggttattttttaaccctccctcaaatagcctcaaatagcccaaaagtccaaacaggtgagttattttagggctatttgaaaataacccaccaaaaaaactacccccccctcaaagggtgctaattggagctatttcaggtggggcccactaaaaaatgtcttttctctcattctctgtccatgggaaagtgtattaaaggccaaatagctctcaaaataacccttgaatccaaacaacttagggctattttattagagagctatttccttgtgctaaaaatagctctcaaaataactcttggctagttctccaaacagggctatgaatctggatatatatgaggcatttcaaattcattatactaggttatatgacgtcatatcctaatttaatttattttaagatgaagcgagtactccctccgtcccataaaaaacttaatctagggtttgaatctggacatagtgtatgctaagatttaaatctaggattagattttttatggaacggagggagtatgtcacaagtcgtaagattatactggttttaccggtgatttaaatttcaagccccgctggcaagcaactatctcgtccaaactttcggactttctcttttctttttttttttttgcattgcggttgaaattattaaatttttaaatagttttgtgcaaaagaaactgaaactcgtgaaattttagtggcactgaaatcactagaatttcagtctagtgaatgcaaaccttgggaatgtagcaacaagtttctcatcttttttactactagtagtagcacaagtactagtcattcgagcgaaaaaaatagctgtgggtaacataaatgtaacgaacattgtagtcctctagagcttgtttgtcacaactttaacttcaactctaagttaaggttcaaccaaacagtttcagctctatctaaactaggagagaggtggaactagatttaggctgtttcacagcttcactccagatccaacttttagagttaaatttagtagttaaagttctatcaaatatgaccctagtcttctacttagtggaaccaaaaacgtctagaggttttccggttagctccacaagactagcctggattcaaagccccacctcttttatttatttgatatttgattttccctaatattcatctttttttctacttagtggaacgaaagtacggctgtgaatagtcacactcgagcgaattcctagcatgcggattagctgggaccggtattggaaggacatattcgtaaaaatcatacttaaattgtttataaattaatgaaaacatattagagataaatataaacactacgataaaatcgcaagttcacactcaactttatttagtcataaaaaaagatgaattttgggtgaatggtaacacgacaatatttatgtaaaatctattatttttgcttctctcaagtgaagttgagtttaaacttaagattcggcgagaatgtacgtatctacacccgtctctaataactttttcgtgactaaaaaaaactttcgggttgattttcacgagctttcaactcgttgttacacgatatttacccggtatcggagctgagacctgcatggcttcttctccgccagattctctgaaacgacacgaaacattgctggacctaaggatggtggtacgtacgaccagtactcccagtctcccaccgtggtacgtacccccacgcacgcgggtcctactaccctcccactagggtgcgtgcgtgcgcgcgccgagccgcgcgcaacagcgagcgagcattccaacccccgtcgtcacgcggcgcccccaccaacagacgcgccgtgcacacaccggggcggggagcgcatctgcgcatgtgaaccgcgtgtagtaggagtgtaggagcagtgcgtgcgtgcgtacgtacggctcgtcgcgcgatgccgccgcagtgtcacgcgcgcgcagacgagagcgattagcggccgagagcaccgcggagagggaggagaggagagcagtgcgcggcaggggccgacgccgaaccgagccgagccagctgtatcccaccattgcctacctcccccgctgcggcgctgccccctctactggcacacctgcaatagggatactgctatagtgctatgccctctcgagaaaccgagaggccgagtgccacctttttcctggcatcgcctgaaccacagggcgagtcctcgacttgcctctgcaacagcttctctatcttatttagccacttaaactaaaaactcactccaacagaggctgtgtttagatttaaagtttggatccaaacttcagtccttttttatcacacatcatcttcaattttaatcaaaatgtaaactttgcgctgaactaaacacaacaagactctctattaattctctctaaaataaaaatgaacccacgtgtcagcctctccccccaccttcttccttctctttccttcttttcccctttccttccttccttcctgtcgaccacactgatgccgatggcggccgacgcatggcgcgcagtggggcggcgacgcggggaggcgggaggcggcactcaccgaggtgctctccctctccccgccgaccactccccacagccgagcaccgtcgagctcccctcgggctgccggatctagaggccgccgccggctttgcggcgacgaggcgacggagctcagagcgggatggcgacggcggcggcggagctcggggcgggatggcggcggctcgccacgacgacctcgatgacgacgacgacatcagctcgcgacgccgacctcaacgatgccacagttttctcgtcgattccctcgtgtcgtcagtgggtgagcgagcggatctgacggaggcggaggtagcggtggaaatcggcggcgggaagaagccgagtgacgacggtgacggcggcggcagcacctgagcggcgacggcgacgacgacggtgtgccctcgcgcatttgaggcagcggtgagtgcatggcacgagaggccctgttcggcggcagtcgacaatggtggatccgtgcatgcgtgaggtggccccgacggtgaacgacgatggtggcctcatcctcttcgacggtcgtgcgccgcgccccatcccccctccctcgatgccgcatccctccctccgtcgtctctgcgccctctctccctcaccgtcaccatgtcccctccgccgccccattgcatgccttcctccaccgttggtgccaccattggccaccttgcgccgctcgccggccatctcgaccttcaccatgctgcacggatcgacctcagtaggagctggccattggcgccatcggcaaaggcatgggagctagccgtcggctgagagaagagagaagcaaagaaagagataggtgggacccacggtggggcccatcgttcggcaactggaggaggccggccaaatttggccagttgagatgcttgtttggccagccatatgacttggcaatccaagtagctagactattggagggagtttttttttcctgtgttggctaaaatttaacttgaggagtcatttatcaatgctattggagatgctctaatatctccgatctccacaactaggtcccatttggttcaaagaaaagtcataggaattttttttgtagaatttcgttcctataattctttatttctatagaaccctctgaataaaaggaatggaccatatgaaattcatacgaaatgtctccttccatataagtttagaggaaatttaacatgagatataaccttatggaaagtttccgttgagttttttttatctcttcttagacaaataattgataatacatgcgatgcactaatgtagaattttcttctctacatcatcaatatttagttttatattagtaacaatccaagtatgtgtaatactacacctctatcctatcatataatttatattaccaaaacttgtctaccaaatatttggtaggctagaaaaacaaacagctccattcaacgcttcagtgcccataaattcagatcaggtgtagttatacttataactataagttaactactacatataattttgaccgtcagtttttattaatggtttagatttgatgctacattaacaatgtaaatactccatactacaatattctacggtgatacgaactgtgaagtgtgcgatatagaccgtccgattcgcatccaatggtgctcattgctactgtttaagtgcagctgatccgaatccaacgtccatatatatggtggttcttctaaaagcacaataggttggccttccttctccgtttcataacgtaagtcattctaacattttccacgttcatattgatattaacaaatctagatagatatatatgtctagattcattaacattaatataaatatggaaaatgatagaataac

SEQ ID NO: 38690 - DNA, 2005 bp, Oryza sativa
acgttagggggcaatgaattgttgacaggcacgcacgcatcattgcgaacttccctgtgcgaagctgtgagagagtccatgaaagccatgagtgtgtgacgctgtgtaccatgaggccatgaatttgccttgaatagtggctgggtaatagcagggcagcagtagccaattcatctcaacgtagagtaccagttgaattaattcaactttttttttcttatgaataaaccttcagtcatcagtactagtacaatcttagagcatcctaagtttgccgttgttcgtgcattgtaacagtaataattaatggctatgtaagaccagaaatacaacgctctttcagatttatcctaggacgccgtacaaaacctaagaaaataccagtactatgtactgatagtgctttcattttcttgtttgagattagtagtagtgctagtgctagtacaagtcgtatacagtttgcaacattttagtgcttgtgtatacggaagagggtggcgaggagtgatgcgtgagacttgacgagaaaagggttctgaattctgaaactgaaagaactggaactgaaaagcttggccacacttggttaaagttgcatacatcacatgatgaaagaagccaaagactgggcatcttaaaagcgtgtatgacgaactggcaaagtggcactcgcttcttttctttcggcttactgttcacaggcgctgttccagtctttgtttttagctcgatgatttaatgacaatgtcggtctactcatcttggatgcaatcacgtaattagttctcagcaaccattgatagaattcctaccttgtggtgagtaaccaaccaagtatcatccatttattagtggtctcagtttaatagaaaccggataaatattggtagtactgtcacacagtcaccaactcaccaaccaaacgaaatggaaatatctctatactagtactaaggcaatagcattatagcattaacaaaagaagtctaccattgttcgcaccaaaaaagaagtccatttcatgactccaggacaggcgtacagcactagatcgtgtgaagctaggaagcaagaggacaaccacccatgtcgcactttactcttctacagaattacaggaacatgtcgaccagcggacaccataaattatagcatacaccaggctcctagatatacggatagatttccaccagacattcatctagacatttgcttgaccggcatgtacatgtcgaacacatttaaaaggtcaatgtaattacagcttacgaagttacaagccaatgagaaattcgttctttaccaggcaggtaccatacagaaatcttatggaacccaccagcttgccctgtacaagtcatgtgttacagtgttaggacgcagttgctctggccagtgtttatgaacagcacattgaaatgttaccaacgatcccatttgaagccacgaatatattcatcatgatggcgcattggcacttcaaccattcattcccacccaatattggatggaacaaaaccaaaagatacctcctggtttgttggagaggattttgaagttcctactttctgtttttagttcatgaaatcagggtctgttattgcctcctgtaattgtttcgacttttatatctgtctgttcattctctttctccataatcgtgctggaagtatcgttgcctggcaaatcctctttatcatctaatatcctgcttgcctccccgattgcaaggattagttcaagttgcttctgttgttgttcctgcagaatagattaatgggttccattggtcaaaggcaaaaattgcataaggctaagctccataaggaaacgattatttactggggtgtattggctagtcattagtatttcggagggcaacatcagctatgaaaaacaagtgagtcaccttgaaaagacaacaaaaacattgatgtaataattaaccaaatcatgatgttaagctctagtcggtacatgatggttactaaatttgtggtga

SEQ ID NO: 38691 - DNA, 2862 bp, Oryza sativa
cctgcacccctgcagtctgcaaaaacagaacactgtaaacttatatcaaaagtgcaaggcttaatattcacttgcagaaaaaacattaaggttcctgaagttgtgaatggaggatgcattcaggatggcagtatggacgatatgttgtgattgtaggaagaactacagcatgaatgcaatgatatactggcactttaggaggagtagtataggttggccttgtcttccaaagttccgatgcccattgcactatgatttgcagcttttaaaaaggtagggtgctttgtttcctccgaaatttatgtggaagttgaatggggtccgttctctgaaattcatgtctttgcttgaatggtgctcaaaaagagcgtactgactaaagataatgagattggaagaggtctaaaagaagagaaatgacagttttttaggattgatgagagtagttatcacctgtttttcagttgacaagcttactagatagttctgaaatgcaacaatgcaaacatttgttttcagtaataaagacaatgagattgggagaggtccaaaagaagagaaatgacagttttttaggattgataagagtagttatcacctgtttttcagttgacaagcttactagatatttctgaaatgcaactatgcaagcatttgttttcagtaataaaccttttagttctcctaggctgtttagatagctggttaagatgacttaggggaaagatgacaacccttttaggtgcacttgcttctggacaatttagtaggcacaaaaagctgcatgtttcagatataaaatgtatcattttatcattaattagttgaatttctagatagtaccacagatgctggagtatgatagaatctctagtgctgaggaccaagcttgtcgagcaagtggtatctgaagtttcagatgtgtgttggagtagcaactcaaagttccaaggattcagggctgacaagagtacaatactgtttttctgttactgtggaggactactgagcagttttagctggctgtgttttaattgtcctcctaatgttatgtcttgatccatgcagcagttgtttgctggatcaagacttggtatcctactgtttatttcgttatgctaaagatttctcaagtatataacttttgacggttcagattctaataagagatatcagaagagagtttcctttctgggctaaataaaactgtgtgttgaaatgtcagatttggagctcttacaaaagagttaagtgatatccagtcaatgatcaagaacatggatgaatttcaaacattgggcaaagtaactgtccatagccacaccaagattttcatgaccgattggaacgcactcgtagaaatttcatgtcactgacacgttaccaagtcccctttctaacaccatttttgacagttcaattctaactggttgtttctttaaacgaattctaattggttgctactaaaccaacagtgaagcaaagcttaaattcttaaatttctctaagtaggacgaggtaggtatcctggaagattaagcaatactcacctcattgataggatccctcagcgtcctccgcaacaccctaaacctgacgccgagcttctcgacggtcctcgacagcacaccgacggccgccaccacgcccctcacgctctcctccacctcgccaatcctccccgcgaaatccacacccctagccgcggcgccaccgccgccgtcgacacccacctggcaaagccgcccccactgcctccggcggatcaggcttccgatcgccaccgcgcccaccataagcacgtactgcacgacgaacatcctcccgcccacgagccccgacgcgggggcgcccgtcgtcgtcggcggcgggaagacaggcgggccgcgcataccaccgagcagatggcgggcggcgcgaggcagagcagctccgcggcggagaggagcgcgtcgagcgccgagctcgtcggcgcggcggcggcggaagcgcccccgcgacctgcgaaatgtgcaaaacgaactgtctcagctcgaatcaagaaggtcgtgggggggagcagaccgcggccgcggcgagcagccaccagcgcatgcgtttaccggaggcggaggcgcggagaggcggaggccatctgcgagagggagctcgcgagaggagaggcgatggcgagggcgagggcgagggagggaggcggcaatggaggcggaggtgcgcgcgggagcggagcggcgcgaggggagcggggggcggcatgagcgaggaaaggtgaggtgaggtgaggacgaacaaggtgagcagcgcgcggatgcgattggaagggagccacacccagacacgggccgttcttgttacctgggctcccggcccaccgccccggtagttgtccatgagggtaaaagaccgcgatagcaaggataacagtagactataagtcaactataaacttatataaaagaaaaattaaaaaataagtgagaagggttgactctcatgtaagagctaaaacattttcattattaattttatagtgagagaaagagagatgggagaaaaaaataatgccatccttatagttaacctattatacatgttatttataataaggattaatagccaatagtcacctatactattaaacttgctatgaacaaaaagaggctttttttaactagggatgaagacataatgaacctttccaaaatttaactgtgctaaaactttactccctctattgccaaaatataaagcacaaccacctttgacccaaagactaagaaacaattattatcacctcattgtttgaatcatcttaactaatacaatacattcacccaataaaattaaacacctccatttaaa

SEQ ID NO: 38692 - DNA, 3633 bp, Oryza sativa
atggagggagtaataaggtgacagcattgtcaagttttaatatgaaaggataaatgtgatgttaccaaaatttcttagatattatcaatgtttggtacttcctctatttcatttcctctatttcatattataagttgttttaatttttttttctaatcaaatatttttaaatttgactaagtttacagaaaaatttaataacactttgacggagcgtggggctcctcaccgggagaccgcgcaggcccccctttgccggttcggccgggggccctgggtgagattctaagctcctagtctatgtgtggaaggttcgcgagaatggaaacacacaagacacgggcgatgtatacaggttcgggccgctgagaagcataataccctactcctgtgttttggtggatctatgtatgaagaagctacaaaagagctggagaaccagagagctcttactctctccctctctgatcgttctggatccgaaaaaatctcctttctaagtgggcaaggtcctccttttatacctcaaggggataccacatgcaccatctctctcttttttgtggggacttatcctatcttttcataaacagacggagacttgtatggttgccgtccgaatgaccttctgatgggacggcccatacctacctccacttccgccggaagcaggcgcgacgtgggaacatggctgtctgctgacgacatgaccagtgtcagaccggtcacaaatcggtcattcttgtccaccacgtgtcagtttaacaatctgcatgttcgcccttcttcatacaatatcttgcctgtaatggttaggatgaagcctggcatatatctgaccggaaccaacgtgccatctccaggagctaacacgccggctccggctagggacgagtgcttggaggctctcgtcctgacgggatggggcgaggcgtgcgtcagaccgcctgtcgccacctaacccgcaatctgaccggtctgtgaccagtcacagaccggataaacgagcgcgctgtactgcattacgtgtggcgtgacgtgctcacccaaaccgcaataaatgcggttaggtgagccccgctgcgctcacctaacccatacacgcggcgcaaaacccacaaggggtcggggcgcctcggccctcggggccgaggcgggagcggtccgaccccctcggggagacaaagaggagggcgaacacatcaccctcgggcccgacgccccccgagggtgccaggccacgtgggcgattgtgtctgcctcaagcctctagtcatgatactcccggttccatgtcaccgacacacttacaacatcaaattagtttcattaatagcaaaattgaatatatctggttagaatgttttatgttcaaaatatcactatatttttctaaaatttggtcaaaactaaaaaaagttttactaggaaaaaggtaaaaacaacttataatataaaacagaggtagtaacaaactaaatacatccatatcttcgtcaatttcaccaaacaatggcatagtttaaaataacaccaatctgaacaaacctgaaattgtatcatttatacggaaacaatttttggatggtttggtatttttatactttccaatttaactatttggtggagattgcattactgcactgaaagaaattagaattatcaaaatttcatgtggttagacttaggatcggaaactatcactttttatagttcagttgggtgcccgttgtaatccctatttgtagcgttagaattttgcaagattttcgcagggattagtttaattcctgtaaagtttgtctaaaattgatccattgcaaacaaggcctagagctgttttcactcaagaagagtagcagagctgaggtacaaggccactttggaatggagaaattttgtgagaattgaatttcttttttttaaaaaagatgtacgaaacttctgctctcaagcgcttggaagttggaacattaattacacaaattactgtactgtaccctacaaaacagacatgaacactacgatgtagtacttcaggattcataagcatgtgggagttcttatctaaactgacatcctatgtgaaaagaacgggttgtcaacagggtttcctaaaccgtcggggccggggttaccgcgccctggcggtaagcacggttaccgcgcgataagcgcggtaaccgtgaaaaaccgtacgaaaccgtacaaaatttatctaaaattcaaattatttttaaaatttatttaaatttaaggaggttaccgcggtttttctattaccgtaccccgcggtaaggccggtaaacacggtaaccgcgcggttaccgacggtaagtcaaaccctggttgtcaaaaggaagtgaactacttattggaggatttgcagaaacagatagagcacgttggcaaatactactctaccccagcaactgtccaagtgaaactttcatgtgcagagtaaaagaggtcgagcatgcttactctgtcagacaggaagatcctgccttcctgaggattgaagacaacaaaaaacctagagaaggcgcctaccgaaagacacaagatctgtcagaatcgaagttaaaaacaacaggaatcacataatacaagacagagagcatacaatagaagtaaataaatgcaataccagaaaaagactaaaaatgatagtggtttgatctcggccacacatctataaccaaaattattttgtgattccatggcctttcgagtacttatcatcaaagcacattccttgacccagactcttggcctcttgtgtttgctagtatatcattagtaagaatatgtcagacttcaggtcatttataaagatgttgatcacgtgacattttttttctagcctcaaggagtcttccatttatgaacaatttcgcctcaaggagagtcttccatttggattttggacatgacgaccaaagttgtcagttgtcacactagaacctcacatggcaatccaacatagaactgatagtcaacaggatggcatttattggaagttccataattttggctgtatttagattcaaacttccaactttttccatcacatcaacatgtcatacacacacaacttttcagttatatcgtaccaatttcaaccaaacttcctactctggaaggaactaaacacagcctttatcagaacatcactgctaatcaaccaagtcactatcacttaccccctgcaatactcatgccaaacatgtagtaactcccttctcaactctcacctgtcaccagttctcatcacagtgctatatataatagtactagtaaaagcaaaacatttgtacactagaagcaaaaacatggagaaaactgtgaaacacaagcacaagtgagatgtaaccaaattagcaaactaaatcagtactcctcaccatgcaaacacatcacctggacagagtgcataggcatcacagatattttttttgtcaactttgtaaggcaaattagcacatatactaacgataagtacagcctgataaatacatcctgctactgaatgcatcctgaacatactaggagacaccccctcactcaccatcacaccaccaaattaagctaagcagctgcaagtccgcaacaatcagctgcaacaatggg

SEQ ID NO: 38693 - DNA, 3759 bp, Oryza sativa
ggtggtggcgcgggtcacgtgtaggagagcgcgcgtggtggcgggcgtggtggatgggagaggcggcggcgcccgttccgcccggccgcgtggtcccgtgcgccgctgcgggtttgcgccgccaaagggggcgtgggagtccgcggctggagtggatgaccgggggagccgggctccgggaggggggagggggccacctgtaagggcgtggtgagccggcgggaggggccgaggggggaggagagctcgcgacttggcgagtcgcgtcgcgggaaggcgtttcgatcggcacgctgtggctggctgtgggcgaagtcgcgaggttggtacgatgggccgatggccaaccggagtgccgaaccacacgtcaccaccacgatgatgatgagtttgagaaaacggacataacggggtttggctgtaatgccactcagagcaagtttaatagaatagccaactactagctctaatttatctataaacaatctaatagctcatctatacaatagttatatactacactattaatatctggtcccacctgtcatacacacactgcgtcttggaatccgtgctacagctggctataaatctgtagcccgctgctcttctctctccttatttatctccttaaaatatgtttacagctggcttatagcctgctattgtacctgctctcacaaaagtggttttgttaaaatatcaccctcaaatagaggcaacatgtttttttttacttgaagtgaggtaacatgttgtaatgccatttcatccatttcttctcagtttaatgatttttttaatgtttttttcttgctgagatgaccaaaatacccttggatcctatctcatctctccctctatttcttcctcttctttgttgtagatggtgggtggcgctggcgtggctggggacggcggcggcgccgacacggttggggtaggtgggcgtggtcgccctggcgctgctgttgtgacgaacttggcggtgagccccctcatgcctcatctcagccaggaactggggcgagctcggggcagtgtgaagatggtgttgtggctggagacgagttgttggacaagtcaatggtggtgagcgagatgaggtcgccgataaggtggggaagttctcctacgtcgacgcagatggcaccgccgcccctagccataggggcggagctagtgtatattagggggtgcccagaaacatggtcaagaaaattttttagctatacctcatatgtattcaccatgtaagcaccccctcaatacaaacttaggcacccacattagtttaaactcgatctaaagtagagtaaattaagcaaatgacaccaccctccatttcgctctagctccgcctctgcctagccacgccgccaagccgagcagccttcctcacccacgccaacgccgtccccgtccccgtccccatccccagtcgtgccgtcgagtcgggccggccggcgccacccaccatctgcaatggagaggaggaagagatagagggagagatgaataggatccaagggtattttggtcatctcaacaagaaaaaacattacaaaaattattaaactgagaagaaatggatctaatggcattgcaacatgttgcccctgtttgagggtggcattttaacgaaaacactttcgggagtgacattccgtgaaacctcattttgacaatggcaaaatgtcaattttctccttccatttcaatgaaaaatgaaaagctactcaataaattgcacaacatagaatattactcctttatattatctacatgttaaaaatattattttagtgggttttcatacaaaaatccctgactaacatgcagagtgagagagacggggggggggggggacagagagcggtgggtgcgagagcgagcggcaacgaacaacgtgtgggcgggtggtggcaagcaacacatgggtaggcggcgctagaggccgtgccctcgccgctcctccaagaagtcaaagagtgtagtcctccctatcccaagagcgcatgttgtcgcatcctcatattccctccaccctatcgttcctccttccaccaccgcctctagccctcgccctccaacgtggggggcactagaggcgatgtgcaatgagcgtgcgagctgtgtgcgacaagcgtgcgggacgggcaacgctggagactgtgccctcgccgctcctttgaggagccaaagagggcggtccacgtccccaccatcccgtaattcgccttgtcctccttcctccaccccatcatcccattatcaccgatggccaaccgtccagcgacatgcgcctactgcctccctctccctctcctcgcatgccaacctagggtttttttggcccgaaaaccctccaaagtggcattttaaccggtagacaatgtaactcgcccagcgccgtcatcaccttccttgcacacaggtccatcctagcgactatcgtcttgccgtcgtcaccgagccctccttgcgcacagattcattgtcgctggcttctcccctctcttcgccaccgctgtcgtcgccgccgtagtcttcattgtccctcgctgtcaccgtcgacacgcgcgcacggatctgccgtctcgtgcacgagcgcgcctcgcgcatgcacggatttgccgtcggcggcttctcacctctcgtcgccaccgcagctacatcgcgtgcacacagttctgtcgccgtcatcgacgtcgccaagagggcaacttggcgatggttgcgggagaaagaggaggaagaagtagaggttaatatgtaggtcccaacggcatatacttaaaatagagtgtgtagatggagagactgttggaacgaggaacatgtttggctctccaaatcagttggagaggtgactatgggtatttggagagtctaatttggccattctattggagatgctctaacaagtgaaagtaaaacaaagagtgaaatacatggccggtccttaaacttgtggtgtggtgtcacttagatccatgaacttgaaaattgcacgtttagatccgtgaacttggtttgatataccaccaccggtccaatcctcctttaaccacgtttgaccgccaacatggcattacaacatggcaatgccacgtaggcaacatttttgtgctcaacccctccacatataccttgcacataacttgcccttaccagtgtatttcaacccaaatcccctaaaatatccctaaatcggcaagggtttcaacggtgaggttagcggaagaagaccgagaggtagcggctgtgacagcctcagcggtgaaattagcggaaggaggcagtgtagtgcaacggggttaacggtggcacagtgcggccggattagcgacgggaggcagcgcaatgcgtcttgcacgccaggcatccccatggattccccaagctcttccccgtcttgaagtcgccggaagaagatgttgttgatcaagtgcccgttgcataaggataaggttattttggagcagggagcaaaggcaattgctaatcgggaccgcgttttctatacatacaaggagaagaatgagagggaagaatgatttgatgattgttttttttgggggattctggtgtcaccatatagctacaagaagatatatgcgtcatgttgtgatgtggaatgagctaagagcaaaaatgttgcctacgtggcatgccacattggcagtcaaacgcagtccaaggacgtttggaccgggtactacattaaaccaagttcacgggcctacacgtgcaagg

SEQ ID NO: 38694 - DNA, 881 bp, Oryza sativa
agatagcttatcaagatctatatactatgtaagcctgtacaaccaacattttggtgctcaacataacactagtcactcaaacaacaaccttctctatctaagggccgggaagaaagtcacagctgcctatttacatggtgtcctttattcattattgcagtgaaaaaccgcacatgataaaaccctaggtttggttattcactgaagccaacacggggtactatagaaccctcagtttggtaaggaaggctgcacagaagtccaggaaaaggagctgaggccccgtaactctctgcatatccagcagatacttctcgtctctgctcttgtaaagctgaagaaaagaaacggaatcagtaattcgacagccagatatacaaaaaatatataatacataccaaatacaacagctacaccattcgaatgatactatactaggctaaaagtataatatatggctaactggtactttttagtatttaaagttaaaaattgctggttcaaaatggcatgagcagacaacacatattggcaacaatgcatcaactcatgattgaacctaaaaggtgaggcattcttttgtcattccaatgggatctttaatccaaggatttaactatgacaacaatatttagttgaatatctagaaaaaaaaaaatattgctgtaacaaactttttaatcagcagtgctagaatttgaaattgcacacctggatttcaaacttgatcacagcaggtaacctcccgtttacatcgccattatccattataattgagtcatcaacaaagctgtggttgacatctaacatatcagtggcctgaggatacccaacgctccatctgcacttcatgttgtactgtccattcttcttccagcaga

SEQ ID NO: 38695 - DNA, 1175 bp, Oryza sativa
ccccataaatttatctcacctttatctttttgaataggttggggatattctcgtcatcaaatggaagagtaccacaaaggagagcataaaggatcactccacagctccatacatcaacctcgggtccagcatataatttaccagagatcacctgcaaagggaccataatactataataagaaaaaatattgcatgtaaaggagcaagaagatatagtctcacagtgatacaaaaaaaatacctctggagcagcataattcggactcccgcagcttgtctttaaaaaatggccatcatgcatgacattactcaaaccaaagtcagcaagctttacgttatactttgaatccagtagcaagttttctggcttcagatcacgatgaaccaccatgtttctgtggcagtattcaaccccagatataatctgttccataaaattttaccttctaaatattaagagaaataatgtatatgtattcaacaaaatcagagcaatgaaaaactctaagttcccataaaataatgtatgtccctctctccatttcaggttaaaatcacatgccaatgattacaccaacacagtgaagacttaggaattaatcaaaagtttgatttagtacatcactccatcccacaaatttaaaattcaatgataaggttagaagctaaaagcaagccgattacatgtgaacctgagtcaattaattatgaacaccacacacaaaacctccacacgacgaatatgaatggcatgcttatgctccataggttttgaatgatgaaaataagcaagcattgaagttggaaataaatgctaaaagagcacatttaacaagtgaaagaaatgagtaaggtcaagtacctgctggaagattcggcgagcctcatcttcctgcaacctgcctttctcaacaatgtaatcaaacagttctccaaacttgcagtactccatcacaacatatatatccgtaggagtgtatatgacctcataaaggcgaatgatatggggatgaatgaacaacctcaatatcttgatttctctctttgctgtaaacaagaaacaataagaaaaaatgaagtcaggccttagcatttggcaagcatgaaattccagattgtagaatttccagctcaaaagcattcgaagaaggtaaaaccataaaatttcttcttta

SEQ ID NO: 38696 - DNA, 1464 bp, Oryza sativa
tttgtttcaagtgttgatagttattcatatatgaatggcaagtggcaaactctagccactagtgtcctaccacattatgcataaacgagaaccatcattttgacaaagctatgttgtttcagatatattataatgtttagttccatcatgaaacaccctataaacagcttctcactgcatagcagcatagtgcatatgcaattaggctgtccagcaaatataagactattgctcagttacagaccactgagaagtaataggaacaagcaaatactgaaaagtaggctgtaggccatgcaaggaattaccaagattctatcaaaggagcgagtcttgaggccacaaggagccttcattgtgttaccatgcatcggatcagtaacccatgttactatctggccagcaccacggacagcacgtattaggtgagggagtttcactctcatgttttcaggtcccattcttgtaatgatagtaattctccctggtttgttctggggattcaagatatcaatcaacttcacaagttcttttgggtccatcttgtcactgacctgcatttagtttgatgagtttagggtgaattcctttaggacaaagtgtgaattacctgcactttcaaatgaagtttgaacttggtatacattatctatttatctgtcttgacaagtgtaggaatattcctatttaccttgatacccagagggttcgcaattcctcggagaaactccacatgggcacaatcaagctgacgtgtacgctctccaacccaaaggaagtgagcagaacagtcgtaatagacgccagatgtggaatcctcgcgagtaagtgcttgctcatagggaagaagagggcactcatgtgatgtccagaattctgttgttgtcataataggatggtccatatgagaccagcagctgccatgaaccccaaagcctcatcaactcggtgagccagctccatgtacctgttcaacattgtacaagaattgcagtggtgagcatatggctgtggcttaaatgaattacatgaatcaattcatctgagaagcaatcaatgaagaattgggacagtttaagataaaggtaaccacctgtcaccctgttcactatgctctgtgaagtcaaggttccattgtgttaccctctgcatggcagcataacctccagtagcaaaagcccgcagcaaattcagtgttgctgcagactgtgagtatgccctgatcatgcggtgtggatctggcaatcttgatttctcatcgaatgaatccccattaatgttatcccctctgtagcttggcaacttcactccatccctctcctcaaagccatctgaccttggctttgcaaactgacctgccattcttcctacctacatattccatgtgagacagtaagtgatacaattctgtgcgatgtccactagaaatgcattaaaggaacgcaaaaacaacatggtaacagg

SEQ ID NO: 38697 - DNA, 692 bp, Oryza sativa
attatgaaacttactgttaagacaaccattgcctgatcaggcccaagcccattagcaagttggtaatctccatgtaagttgttggcaacaatagtcatttcaaatgttgccataccatcatcccatcctggctgggaaggataatttgaagtaagctgattattgtttgtgacctgaacaatggaatataagtcaactatgtcactatttacgttggtactgatgaaccaaaaactaaaactttttttttctatagcaaggtatctgatgacagggctttctgccatttgacatcatgaatgtatgagattgagaacatgagaaaacctgcagatagcccccatttaaaagcttgatatgaagcattgaattgttcctttcgatgtaaaatgattcagtgtctcctggtgaatctgcagttgctgagatcacatctccattacttgctgttaaaaactgacctttgatgcaccggaattgatattcacggtaagaaactctccaaagctgacaggagcaccaagaaaatgcaattaggatggaaactcggccatttattaaccagtgactcaagcacttgatggtcttgttgatttttttaataacactttgatttctagctgtttcctaacttcaggaacataagtagtgcattaacagaaaaataagctatgggcctaaaaactgatgaa

SEQ ID NO: 38698 - DNA, 6532 bp, Oryza sativa
tctagccaggtatcccactgtccctgttcttctctttcttctcttactataacttagaacaatataaattaaaataattataacttttcaaatcatatattcaacttacgatctgtttgaactattatatttttagtgaaatcaatactttcatattcatattgactatatttaaatgccaacacaaaaattacatcccagacccacatccatcttgaggccaacactaaataaaaaagatattaaaattcatcattgaaaatcggaatatcccaccttaatttttaataaagccggtgcacccattagttatatctggttagacacctaaaaactttctatcaacttaattatattctctcaacatgtatatgggggctatttgcccatacaatttgatatttgagctttttatcaatagatgatcgacttaggagataaataaataatctttagataatcatagcatctaaattatatatatgatctatgaagtcactaataaattagagaaaaactttaaatgatattgtttttagtcataatgtgtaccccatctagtgttatttttttatagacaacataatgaaaataaaaacatgctaagttgaacatcatattgatcgtataagcatgaggtggccttaccaatataatgagtcacttccatataggaattaaaaatcatgtcatttatttcattttggtagaacatgctacgctacattgtaaactcctaacatttagtatagaacaatctagaaatgtgtatttattacatgacctctattttaatatttcttactctattgaagtgagataatttagaagagatgactttaccccatgtcaggttgtaggctcaacccacttatgttttcaacctaaattgcagagatcaaataatttcaaagatgcttcatagaatggaattctccaaaatttctttaaaaaatggacatgaaaacaaacaaaatttatctgttttttttaaaaaatggttttaaaacccattctaaatagaaatattcaaacttttagcagcgctattggaatgaaaatatgtaaaacttcaaatagcatctaacaaaaaaattggatattttgagcaaatgtttgggggtaagttatctctgtaggaaatcaaaatacccaaaattttctcataggaactacatatattatttcgacataatactttctcataaattgagaagtgtactgactcgagtaattttagtttagaatttatgtgctgcaagggtaatcagaagaaaattataactagcattcaaaacacattaaataagttcattttttgtttagatatagtaaaagaatattttaagacaaagtcatccacacatggatattcgtataaaattttacgtacattaaataagatgcacgcgcatacgcgcgggctatcttcctagtttatacaaatgattgtgggaccacctagaaatcattgacgatagaatttataaatattgacctattgttttcaaacaaataacaagctgtatctctctattgattcaacaagctcaatttgagatatttttatatttaggcaaatattcattatcatattcgatctgttccatatttgctctgtatttggattcgataatattttattttgtttctgtatgcggggttttcgattccgattccaattcagaaaagtatgaaaatgaatatgatagttatcattcgtttctgatccattttcatccctacctacggatatctgaaaaaaaaatcagatagtttaggacggttttcgattttcgcgggctactagcctgtttccctttttctttttaagaaactatccatgttcgttcccgaaaccagtgctattcaaaaaaaatccatccaagattatttgcttttgaaaatatatccgaattcaatctgatttcatccctcatcttcctcgagcatcaaattaactccatagttgagcagagaaaacagacattttctttgtcttgactgctcactcaaggcccatctctctggccaggagacatgaagggtcacgtaagccgcccaccgccggcgacgacgacggcgacagcggcgccggcggtccactgccagctcggccgcagaatcgttttcggagcatgattaggtaggcggtcaccgcgcctagcttgtctctagctaagctagctagctactctagctatgcctatgcgtgcctgcactactcacctggtccatgggccgtgggcccatgtccaccacctctacccgtctaaatttatttatgctacgcagtgacgacgacgacgtgcgtacagcgtactagtgcataagctataagctagattttgagcagaatttaagtagctaagctagattttgagcagaatttaagtatggttagccgttgcagtcagtcagtgatcagaaactcggactatatgtggtcgtgcgtgacgaacgtgctaattgtcgggtttggattagattccccggccctaattaagaattaacggtgccaattaacaatgacgggggagatcgaataatttgttggtcgcaaagtcaaaaggtgttcttggatgatgcggctctaaatagtccattactgcatatattctgtgctggctttgtttctttccagagcatggtttggttaattcgctaatccaaacacgccacgacaaagttagcagctttgcatcggctgagagacttactaattaattagttttctcttgttcattgtgaatgacccgcagagtgctagtattgtaaaatgcatattttggcctggcaaagtggcaatcgatggaccattggagcatgtatatatatacgtgcaatacatagttgatgaatagtagtagtactcatttcaaagtcctgctccagctgaattctgttctgttgcacagaggggcataggttcgcaatttcgcataccccaatgagcacgtactacgtactacatacacatacgatgctatcgcgaattggcaaatcatgcatgctgcagaatacttgcaggaacacgcacgaaaagaaacaaatgtggcagctagcgtgcatgcatgcagcgctcacgcaagcaaaaggaccaaaaacgcagcagggcgagctatagctagctaagctatggcgcagcacagcttcactgagaatctgtggcctcgccacggcaagcttatagccggccggacaaacgcgagagaatattttgctcgctagctcgccggccgcgcacggcgcgcgcacctgctgctcgctctggagcgcgcatgtgcgtctacctaaagctaagctagctgctgctacattggcacagaatgaaaaaaaaggaaaaaaaaactggcatgtcacgccgcgcgcgcctgatctgtgcatgcatgcgcgagcgcagccgcgcgggggcgcgggcggtgaacagtacgtacgttttgctgcgttcctgagaccgatcaccgatcacaactgtggccgcgcgcgccagccgtgtcgcgcgcacacgtcccataacattttttgggcggagctaggttgcacgtacacgtacgcgcgaatcgcgacggtgaggcggtggcggtgcacggtggagttcctcgccgttgctgatcatgtgggtggctgcagtggcggcgtcgtcgcacggtggctcctcgatgttgctgggtggtagtgctggtggaggcggcgacgtacgtacgtgggtggcggcgatgacgtgcctccaacaacgatgtgtgttaggtggaataatcctgcgcctgtcaaaaaatcatacgtggcactgtagcgtagcttgtcattttaatcatgcatggcactgtagcatatcttgtcattgttttggtttgttgcatgagcgcgccggcttgttcgcggcgtgagcgtcgtgtgtgagttcttggccatgatggtctggaacgcatctttagcgtgcataccgcgctagtgcttcaacgtgggatcgcgcacgtcattagggagtactggcgcgcatagcggaggccacttcggcacttcctttttcttctcgtttttcagttagcatgtaatcttctttatatatgaagtaaacagaaaacactgtaagttgttgcgcagcaccaaaaaacccgtatcgaacacttggcgatttcactattcatcgtcttcaacctccgatcacgagaggattctgcagtgtagtgagggttgccgctgacatttggtatcagagccatgtcggctcctgtgggtgatcggtcccgcccgccacactggcgtgggcgacggctctcgccgtcccctccgtgcaaccgcggccggcagctcgtcgtgcaacaggttgtcaaggaagggggctctgtcacctaccccacgctcactcgttccaattactctgattgggcggtgttgatgcgggtgaacctacaggctcagggcctatgggaagccgtcgataccggcgacgtgccctttcacgaagatcgtcaggcactttcggctattcttcgagccgtgccggctgagatgctccggccgcttgcggagaaggacaatgccaaggatgcctgggatgcgctcaagtccatgcgagtgggcgctgattgcgtgaaagaatctcgtgcgcagaaactacgccagacgtttgagtccatgcgattcaagcccggcgaatcggtggaggacttcagccttcgcctttagggggtcgttagcaacctccgtcttcacggtgacgacatgaccgaggaaaagatcgtccgcaagcttcttcgtgttgttccccgcaggtatcgtcagatggccttgtcaattgaaacattgattgatctcacgactttatccatcgaggacctgactggccggctcctcgccgttgacgaccatccggattccaacggggaagacgtgggccaggctctgctcggggaaaaggaggcacctgctcgcaacaccaagcagaccgggcagtcgtctcgtgacactggtatcgggggcgtcaacacagggtcacgccagcaagggcgcggcgggcgcgggcgcaacggcaacggtggcgacaccaagtctacgccatcacagacgggaagccgcaacgtctccaaagacaagtgccgctactgcggcaagctgggccactaggccaaagattgccacaaggcaaagcgtgatcgcgaaaagctggcccaggctaatctccttgttgcagaaccacagcaggcttgtggcgatgaggagcccacgttgctgatggcacaggtctgcgagctcgcttccgtcgacgaacctgagctgaccaatggtgaagtgcagctgaacgaggaacgcgcgctcgtttctctccgcgacgagggggagccggtcgaccccgactggatccttgacacgggcgcctccaaccacatgactggggcgcgggacgccttctccaacctcgacaccaccgtgcgcggcacggtcaagttcggcgacgcctcgcgcgtgcggatcgagggacgtggcaccgtgctgttcgcctgcaagaacggcgaccactgcgcgctcaccggtgtctactacatccccaagctccccaacaacatggtcagtcttggccaactcgacgaggtcgggtgcaagacggtgattgaggacggaatcctcaccctgcgcgaccaacggcggcgtccgctgtgtcgcgttcgtcgcggaacggggcgcctatatgtgctccaggtcaacatcgcccagccggtctccctcgcggcgaaaagcgtggaagacgcttggatctggcatgccaggttcgggcacctcaatttcgacgctctgcacacgctcgccaaccacgggatggcgcgtggcctccccgaaatggaacgcgttcgacaggtgtgcgacgtactgtgcggcgaagcggctcgatcttgtccacggcgacatctgcggccccatctcgccctcaacgcatggtggtaaaaaaatactttctcctgttaatcgatgatatgtcgcgttacatgtggctgtacctgctaacttcaaagagcaaggctcccgcgacaatcaagcgcttcaaggtaggagttgaggttgagactggcgccaagctccgtgttctccgcacggaccgcggcggggaattcacctccattgagttcgggctgtactgcgcgaacgagggcgtcgcgtgccagctcatagctccctactctccgcagcaaaatggcgtcgtggaacaccgcaaccaaactgtcgtggccatggcaaggtgcatgatgaaggcgaagtccatgcccggagaattctggggtgaggcggtcactacggccgtgttcatcctgaaccgatcgcccacgaagagcgtagctgacaagacaccctattaggcttggcacggacgaaccccttctgtgcattacttcaagacgttcggctgcgtcgcttacgtcaaagaggtaaggccacacctcaagaaactggatgaccgcagcaaagccatggtgtttcttggctatgaaccaggcacaaaggggtgcagggtgttcgatccagcggacaagcg

SEQ ID NO: 38699 - DNA, 1559 bp, Oryza sativa
ccagtggtcgagttcgtctcgctgccggatgccacaccggatggcgatgatgatgacggcgcaccgcgtcgctaccgtacggtggccaacatcctcggcacaacggcgccggtcgagctcgactccgacgagctgtacctggtggccgctgaggagcccagcaacttctccgaagctgagcacgacgatctctggcgtcaagcgatgcttgaggagctcaactcgattgaggagaacaacacctggatgctcacggatctcccggtcagcaagcgccccatcgggttgaagtgggtcttcaagctgaaaaaggacgagacgggcgctgtcgttaaacacaaggcacggctcgtcgctaagggctatgtccagcgccaggggattgatttcgacgaagtctttgcccctgttgctcggatggaatcggtgagattgcttctcgctgtcgcggctcacttcgggtgggcggtgcatcatatggacgtcaaatcggcattcttgaacggtgaactggaggaggaggtgtatgtctcgcagccgccgggttttgtcgatgacacgcacccccgcaaggtcatgcgcctgaatcgggcgctctacggtcttcgtcaggctccgcgggcatggaacgcgaagctggatgccagccttcagcaactaggtttcaagcggagcaataccgagcatgctgtgtacacgcgtggcgaagatagctcgcgcctcatcgtcggcgtctacgtcgacgatctcgtcatcaccggcgcacgctctgaagaaattaataacttcaagggataaatgcactctctcttcagaatgagtgatctcggcttgctcagttattacctgggcatagaggtgcaccaaggcagagaaggcatcaccataactcagtcagcatatgccgggaagctgctgaggatcgccggactgggggagtgcaaccccacttgcattcccatggagcctaggctgaagctgccgaagaacagtgacaggctggttgttgcttccaccctatacaggagcctggtgggaagcttgaggtacttagtgcatacccggccggacattgctttcgccgtcggctatgtgagccgattcatggagacgccacatgacaatcatctgatggcggtgaagcacatcctgcagtatgtagcaggtactctgaattttggatgctgctttgcaaactcaggggaaacgggaatacatttgctgggtttttcagacagtgacttggggggagacgttgatgatcggaagagcacctcaggggctttattctttctcggctccagtccaattgcatggcaatctcagaaacaaaaggtggtagccctttcctcttgtgaagcagaatacattgccgccacaggagcggcttgcctcggcatttggctggcacgcctgctagccgaagtgttgggcactgaaccggagatggctatcctcaaggtcgacaacaagtcggcgatctctctgtgcaagaatcctgtgttccatgatagaagcaaacatatcgacactcggtattactttatcaggcagtgcat

SEQ ID NO: 38700 - DNA, 1106 bp, Oryza sativa
atgtattttcgtaaaataaaagacttatttacaaagttcgaagcagatacaggaattagaaagtttgtaaccatgaaaaaactatatgcttaagatgtcattcattttgcacgtatgcaaaagaataagagttgaatcaatatttaataacgatcaatttacaattatatcacacaatcaagtgagttgtattggatttggatcctactacatatgccttgttagttccaaaaattttttacctaaaaacgccacatcaaatctttggacacatgcatagaacattaaatatagataaaaaactaattgtacaatttgcataaaaattgcaagacgaatcttttaagtctaattaatccatgattagtcataaagtgtgacagtaatctacatgtgctaatgacagtttaattaggcttaataaattcatctcgaggtttccaggcgagttatgaaattagtttttttatttgtgtctgaaattcccttccgatatctagtcaaacgtctgatatgacaacaaaaaattttctttttgcgaactaaacgcacccttagctcaaatttcaaaacgagatgatttttggttgatacgagagcagcgtgcatgatatccttgcgtttcattcgtgcgttggaatgctgtgtgtgaatcaatataattccgttgaacggtcttgcttgtgctttggataagataacgacctttgacgacgacccaccaaaccatgcatgcatgaacatgagcacttgctcccacacgcatgggctgcatttcgcctcttaaattaatcaaaacagtcgacttctcaaccttgcgcgtatgctttatccaaaaatgcgagaagagaatgcgcgttgactggacaggctcctgctcctgtccaacttagcggccagtagtccccagctgcagctagtactcatggagtggtcgtcatgaaactctcagtataaaaggaccctgcagcctgatcccctgtcaatacaaccagctgcacgcccattcgtctcaaacacacattctttgattcttccttcaatttccccttttcaactctgtcatcaacttaattgttagaagcgacctaaagattttgcggccg

SEQ ID NO: 38701 - DNA, 1724 bp, Oryza sativa
ttttttatgaaattattgacgaatattttaggtctcttcagtttctgcgtgcttacttcaagtttcggcatggagatgtattgggttttcgcgttgatgttctttgtattgcttttaggtctattgctgatggactgacatctgattgtttaaagtagctagtgcgtatttattcatcctcaatgatgagagatgcattactgaagattttttcctaaaaaaaactgaatgtatatgtggcaaaggcatatccaagtgggcttttaattgtaaatatgttcattgcacttctggtccgcattagtgtgacagcaaacaacacaataagcatattacttttgatctgattgatagaccagcagctgtctgatgcttctattgcctatctcatgcttgattatagcatatttgcattgtggtcttgattgtaaggctgtggttgggattcactagtttcacatacttggaaagaattcttggagctacctttctgggaaaaccctttaataaagcaattctaactcttatccattaacaaaaatgccttcagttgggtgtaaaaatttatgtattttctgcttatctgactataacgtgttatgttttcttggacgtttttatgattggtgccccaattttcaccatcatattttctgaaaacatctgtggtgttttgatgaaatgcaggttgtcagttgtgttaattcttcagtcatccgaattgttgagattccatattgtttggtcataacataaccagtatttttatttctgtcattcaaaactctattgtgctctttattgcttatttatatctaatcaacacttgatatagtgccagcctaaaagtaaactagaaacctactaacctagtgatggcacattgttgtcttgtggccacaaaaggatttccttttttgtcttagcaggtgtgcttgtggcaggaagtattttgacgaatttgttgagttttttcttttggggtttacattgtaaacttatatgtgatttgcaggtttctggaccaaggtccttattgtggattagatttggatgattttaaaactctttaaacacaggatgcagaacagctcaataacagaagcgctggaccctggaggtattcctatttccatgttgatattaatgcagcttgatttttagtgtcatcattttttcattgaaaccaattggctcggtagggctatctccaatgctggtggaatatgaagtccggagcatattgcttagtttaaatttgttgtggtgaatagcgaggaaatcagctctttatgagtttgctcaagattgattgaagccagaccttttggtgaatattatcaaggacagttcatatggctagaggaataaacgcagccacacataaattatctacctgtaggaggataacccctgaggattgacaaggaatcaaggtgatattttgctacctaatgctcttcaaatagttagttgaattttcttccgcctattaagaaaatgcattgcatcatattttgtggtctcctcctccctagtccctaatgctgtatgcgtgtggattgtgattagtgttatggcaatgaggagaaatgaaaggccggtcttacggctgcctcccattcccttcccgattcaattagtctctggtatgggacgggatggtagtagcatgatgtgcagttcggcgaaaggttctctgagccattctttctttacctcca

SEQ ID NO: 38702 - DNA, 451 bp, Oryza sativa
gaagcagcacacggtgacagaggtgaccaagagcgactacgacgcctgcaccgtcagcggcaaaccgatcagtgatttcgaaggaggcgcgcttgtgacattcatagcgctcagccccggcgagcactacttcatctgcaaaatcggcaaccattgcgccagcggcatgaagctcgccgtcaccgtctccaactccagcgacaccccgaggccgcaaccttggattgggccttactccacgccagccagcgcgtccgcacacctgcacgccggtggcgccgtcgtcgcggcggccgttgggatcctcctcaatctcgccctcttctgagatcgcattgacgcgtcgagcggcatggacgttggcagggtggaggcaatgcatgattctttgtagcgtttctgatgaaatttgtttgattattttgtttacgttcgatcgtgtatacgtgcg

SEQ ID NO: 38703 - DNA, 230 bp, Oryza sativa
acagcagaacagattgtggtcctgaggaaaaaagagtggggaaataacagcagcagacagaatagaaggttcagtgctaaccactttctccacatgtcatgacccttgcggatagttccatcaccactacaggggacatcacaaagtacccgatcaaattctaatctttgaggtttgcagtcttttttataaatttctgaaaggtcatttgcaatacggcaatcagggaa

SEQ ID NO: 38704 - DNA, 934 bp, Oryza sativa
ctgcagccctagcaaaccaaatgaatgagataatgaaatgaacaccgaagctgcaagtcgcattgtttcattccagagcaaccagcatcacctggcattgatcctaaaagtcgctggcaatggtttccgcagcacactgatgaagtcatcccactcctcctcgcgaacaattcgttgctcctgcaaaggcacagccatgaacatgcatgatgcaccaacatttccacccacatactttctgtaagcagcattacagcaaaaaacacagcatatcgcctacaaagcagcacaccgaagaacagcactgaaactaaacaattaggcaaccaccgccatgtttcaatcaaaaatcgcgcgcagagtccggttcacctcaaatctccccaaaccgataggcacgggccaacctatggctaaagcgagcaatcattctcaccttgtaatactcctcaaaggcagggttctcgaggggtggcggctgccacgagcggttggcctcgccgcgggcagcggcggcgggaggagcggggcggggagcgtgcctccagaagctctcgagcgcctgcgtgaggtggcggcgctgcacccggccgcgcttcctgccgccggcgccggcgacgcatcgctttccgtggccgccggcgacgaggaggctgtggagcgagacgggcgtcctcgacgctatcatgttctggttgtggggtatgggccgtgtggccgcgggccgcgtgggtttaagccgtcgggtttcaatttggcgaatttcaatcagattcaaatttgtacattatggcattaccaaattggcttaagtctccttatatttatacaaagttacacacagagactttgccgtcattaacacttggaaaaactagtcgaaacggaagaactcaaaagggaaaaaaaatagaagcaaattgttcaaatgggg

SEQ ID NO: 38705 - DNA, 1117 bp, Oryza sativa
ctattacagtatttaacatcaagtaaaggacgcttgtgaaagatttattgtgccaacctaattaagaacatgcactaaatatactcatctaatcgtgtacacaaaccgataaatcctttgtgtgaactgtgtagtgcaaactgatcagaaaaacaaaattgatttggctttcagttcttggtacaacaaaacaagagaacaacaatgtaaacatttgtgattgaacaagtaagttctttcacaaatgcataaaaattataagtacttgtcaaataattcgaggtgcagtaaattagactgcaattcttcctattacattgtgatgctgaatacaaaaatctacagtttttgtagcgagacataattattattattactaggtgaaaccccgcgcattgctgtgggaatttagtatgataacagtaaaaaaaataacatgtaagatagctagataacataagattaagtaaattaatgtggtttatgataatttaaatttaaatagtatgtagaatggtgattcaaacgtaaaaagtaaggtggtatgactttatggaagaagaaaagtagggagatagtttggaccatagattaatcatctaaaggctaaaaacaattgatgtgatatgacttaattagaggaaaaaatgagaaagataatttggaccatagattaatcatttaagcactaactaagtgaggatgaactatataaatatataggatatcataaaacataataaagatatatattaaaacattttgtgaattattttggatgataatttaacatgtttgtatttgaaaagctcttaaattataaaaactatattgcatgatgtttaaatgtgatgattgttagtggatgataatgtggcatcttgttaattagtggatgatgatgtggcatcttgttagtggacgatgatgtggcatctttgcatgataagcttaaggagtttgtggggataactttatagtaagatatgattaaaaaggggaataaataagatattcgggggtaattttataccttgatgataggcatctggcctccaaacatgagcaccacggacatctggaagagcacacggaaggtgtcccggatgttgttcgc

SEQ ID NO: 38706 - DNA, 2151 bp, Oryza sativa
attcgctagtgcatagcgtagtaattgtaatattgggtgagaacgagagggagggctgtcagtggtggttgaggagatgaggtcaaatccaccagccccccgagctcggcgcgctggagatggctaggcgggtgccaatgttgggaggttgacaggatccagatggaggtggcgggagggtgttggtcttcgagctgccgagcatgataaggtcgaatgaagatcagattattgagccaagtggacgaccttgttagcctgctctcctgttggagtttttttttctcatgcgggagaagtagaactataggtggacgaccgggcctgggccgaggtcagttggctcggcacggtctgacctatacgtcggatcgggccgtacctacacacgggctgcacacacggcccatgcacggcccaataagactcgggccatgctggcccggcccgaagacacgatagcccatcgtgcttctccatagaataagtatatttcccctcttacctctttgggttgtgtcttatatggttggaataagtctattttgcatccttctttgggttgtgtcttatatggctaagataagataagtccattttagatccctaactattttctttgatcgtgccgtgtcgggccgggccggcatgggcctaacactagtcgtgtcatgccgtgcttgggtctcgggccttatggccatctataaggcccggtttagttccccaaatttttttcccaaaaacaccacatcgaatctttggacacatgcatggaattttaaatataaactaaaaaaactaattgcacagttagagccttagaggtatgggggaaatcgcaagacaaatcttttgagcataattaggctgtgttcagattcaaggatgaaaagttttggcgtgtcacatcggatattcggacacacatttgaagtattaaacaacagactaataacaaaacaaattacagattttgcacgtaaactgcgtgatgaatttattaagcctaattaatctgtcattagcaaatatttattgtatcaccacattgtcaaatcatggagcaattaggcttaaaagattcgtctcgcaattacacacaatatgtgtaattagttattttttgtttatatttaatattctatgcatgtgtccaaacattcgatgtgacagggtgaaaatttttgccaggggatctaaacatgcccttagtctatgattagccataagtgctatagcaactcacatgtgctaatgccgaattaattaggatcaaaagattcgtcctgcggtttccaggcaagttatgaaattagttttttcattcgtatccgaaaaccccttctgacattccgtcaaatatctgatgtgaaatccaaagattttcttttattttagtgttaaacaatacgcccagcacattgattttttcaagcagcaacacgcagtcgaccatttccatcgtacagtgaaatgattgaccaaattacaggggaaatatgcttcagcctattggccaaagctggcgagcaagggccacgcttgtaaggctgagttacaattaaggcttgtaattaattaagtccttgtatagttcgctaaatgtcacatcgaatgtttgatcggatgttagaagaggttttcggatacggaatgaaaaaaataatttcattactcacctgaaaaacgcgagacgaatcttttgagcctaattaagctgtcattagcacatgtaaattactgtagcacttatgactaatcatggactaattaggctcagaagattcgtttcgcgatttccatgcaaactgtatgattagtttttatttttatttgtatttaatactccatgcatgtgtctaaagattcgatgtaacatttttgggaaaaatgtttgggaactaaatcaggcctaagtattaacttaaaaaaaacttgaaaatgtacaaatatgatttttttaaagcaactttcttatatagaatttttgaaaaaacatagtagtaccatttaattatttgaaaagcaaatgaacatgaaaagagagagagagagatgagttgagaaaaagaaaggattaacacagtgcgtgccatgatcgtgactcatgagccttttgccattcggtgagtgcaccgtgtgccacac

SEQ ID NO: 38707 - DNA, 1142 bp, Oryza sativa
  unsure (1)..(1142): unsure at all n locations
ttcgccgtcgtcctgctgcttccgccgcatccatcccggtgagcagtcacatcctccgccaccgccgcntgcgccgatcnccatccatccctccagcgagcagggcgggcgccgtcgttcctcctgctgcttccgcccgcatccatcctggtcactggtgagcacatcctccgccaccgccgcntgcgcttgcgccgatcctcatccatagcgcgagcgagcgttcctcctgctgcttccaccgcatccgttacgcacatcctcactttttttctcgaatttgcgttaaccctagcttctgttctagaaatttgcctcaaccttaatactaaaacagtttgatggttcccaaaaagtttcccatgttaagaaagcttggttacgcactaggatttcatgatttgtctatctctttgcaccaccaaaggcaccaagctgatatcctggttgcagcagcaccatgggtggagaagatgagtttcgcagtgttaaaaatgatctagtgatgggggttctgatggcaaaaggatgacttggggcattttggggtgaaggaaggctaggcacaaaccctcttgagaggacagtggtgggttatagctcatgtttaggtttgttctaagggatggtatttatcacacctggacaatacgattttggtaaacctttctagctagatttttggttctagaaagggaataagttgaatgttgtgaggatcattgatgatttggaccacttgtgccgttaactctcctagcgcataaagcttatgtttccctaaatgcaaccgaccagttagatgaagggttgttactatgaattgatatacataacttgtatttgaggtgaacatgttaactcgaacaattacatattgcatggtttctgtgacaaactgtatacatcatcctagtataatgaacaagcttagcacaacttgaatcttgggtcatgttttgccttggttcaaaggtttgcatcatgtcatcaatatgtcatataaagtgtaaaattgtttgtggaatgctagaccttagctattttcttttatattgccagtgaaaatggaaggaaatgctagaggcggtgggcattctgaggcactgaagaactacaatctaggaagaactttaggtatt

SEQ ID NO: 38708 - DNA, 682 bp, Oryza sativa
ctgtattttttcagtagatgaaggagaaaaagaaattcggaattctgaacgttcgtgtgtgatttgactgatttatcatctgaaatatctgaatgaataatgattaggatttctggaggaaacgaagaaacgagcgagcagaaaatgagtgaaaaggaacgaacacaaacgctgaccatcctctgctgcgtgtgtaaaactgcagccctgtccaacaaagcggccggccgcgtcgtccaaaagactgatcgctcatcgatccgtcacatgcaagttgccaaccatgcggtgaaatggtgatggttctctataaaaagagacccttccaacctcaccctgtcaattgtgcagcgagacaccgatagctagctaactaatcttccccttcgtctccggcattattccacttggacgaacactagctcaccggccggccatggcgtcttcttccgttctgatcaagctgctcgtcgtcgtcggctgcgccgccgcggcctccgcggcgacgctcaccgtgggtggtagctccgggtggacgcttggccagaactacgatacttgggcaagtggccaaaccttcgcggttggagacaagctcggtgagtccttgttttcttttggcttaatttggtagtagtgatcagaatgtttggaattcaggctggaatttagtcatattttt

SEQ ID NO: 38709 - DNA, 707 bp, Oryza sativa
atccaaaatgagaagaatacgcgttgacagacaactgcgccagcttgtccatcttggcggccgataatggagtaatggtggtcatgaggctctttttttttttttttttgagaattacatattacaacgcagacactcacaacgcacgcgcactcaaccctctgtcgatgggtacgtcgcctaccactgaaagcacaacgccgttaaatcctagaaaattcgctcccacggggagtcgaacactgaggctcttgtaaccactaggctacatgccctttcgcatgaggctctttctttgatcgacttaggaacgtcctaaggctgtattcgggaactccacctcacctatgaaaaacgcagtccattaacacatgattaattaagtagaagctatttttttaaaaaaggatcaatatgattttttaaagcaactttcttgtaaatttttttttgcaaaacacacaccatttagcagtttgaaaagtatacacgcgaaaaacttttttttttaattttgagaatttaaatcctaaatcgtgaaccatgcaatagaatatttatacctcgatttaaaaagtgagctataaatattctatttaatttaaaagtaaattgcatcgtcggtacacaaacttgtcagatggatacaaacttataaaatactcgttttggtgcacaaacttgtgcggtgcatgcggggctgcagg

SEQ ID NO: 38710 - DNA, 1286 bp, Oryza sativa
ttgttttgtgtcagaaatgttactatttttttaataaacttggtaaaatttttaaaagtttgacaaaatcagtttagatagttttcggtatccgatcttattttcggaaaatgatatctcaaacgaataatttttatttagtaccagatacggaaatgaatacatattgcttttctcagaaatgaaaattaatatggaagacaagtatcagacggaaatccgaaacggtcggaaactatctgtatttgttttcgaatatccgcaggtagtaattagtttttagagaaaacatgtatatatacataactctatcatataaagtcagatgaagacgaactttgtatcaaaattgtagtgctcgatgagatctataattttgttgttgacaatgttatcatttgaaatcatttagagggttaaatattcattacataatctcatatccatttttataaattcgcacaccaacaattcaaacgactttttgatggagccgtgctgcttgataggatttactcctttgtagtttatgaattctttatttgatattatttgaagtgcaaaacagatagtacaagttttggggaggtgaaataaaacaaatagtattttcaatctagacaacatgagcttaataagtaagttggtaagtaaacaatgcatggagaagagatcctgggtttgatcaaaggactgaaaatcagttctcacatgtggatttcttaaagaaataaccatgaaaatcaaatttcacaaacagttgtgagaccaccttaaaaaaaattgacgatatggaatttagaaatgtaacaaactatatctcttccttggttcaggaaactcaatttgacttgtttttataattccaataaatattcgtcaccatatttgttccatttcatatttgcttcgtatatatagtcgattccatttctgttccgggggtcttcgatttcaattttatctctgaagaaaataatacaaacaaatatggtagagctgttcctgtccgtttctaatccgttttcatccggattgaggaggacgtgaattaaattcggtccatagttgaggaacttatgttgaacttctttactaagaaatgtcggcctttcgagaagctgggcctcacggcctatgaagtattcgaaccgggatagaattgggccgtgccagcaacaactcgctgggcccattaacggggttcaccgtatgctccgtatgttcgaagatccctttccgaccgcgccaccgccaccggcatcgcccattgccatcgccatcgc

SEQ ID NO: 38711 - DNA, 768 bp, Oryza sativa
ctgcacccctactacaatctgtttgatccgttttttgagaaacttaatgcaacagagaacatacagttcatatacaataacagaatgcctcaagtgcaggccttggataaagcgaatggacctcttgtttttattggtaggtcctgcaaaatcaatttcctttgctcttttcttttcataattttttcttcttctctgtaatgaataatggtgctttctcaatttatccaactctgtgcagccattctttccttgtattcggtacatcttaatccccgttttctcatttttcaggagaatgggtaaatgaatggaatgtgacagacgcttcacaaaccgaataccagttgtttggaaaagcccaattagaggtctacggggaagcctcctttggctggtcttattggacagtcaggtgcaacagtgtgcactgggattatgaatggaacaaaaggaataggtacctcattggtaagcaatttatcctgttctaggttctccggagctgctttctaatatccagtcattctatactaaactctattatcaccatatagcatatgcagtgggattgcattagttttgtgattacttttgcttggtttatgccataaagtcacattaagcttggtcgtattaattaacacaggcatatgcgtcatataacggctgatgggtaatagttgctctactagaacttagatgagttgcagcgtctatttcaccttgcagttcgatccagtactctccattttctgtggggctgca

SEQ ID NO: 38712 - DNA, 726 bp, Oryza sativa
aaattaaaaatatttaatcacacagaaagaaattagaaaaaacaaaagtcataaatagacaaaatggtacgatcgagatcgaaaatggtatcccttttacataaacgacttttgatcgatcgggaattttcgtgatagttttcaccctatcggtgagtgtccggttaaaaaaaaaatcgaagaacttattcaacaaaagtctagcccccacctccatctgcatcgtgggccagatgttaggcccaccaggtttgccccacccttaaaccccaccaaggcccaaaacaacccttccgtcacgcgccgccgccgccgccgccgcctctctcctccgtcgagcgccgccgacggccgacccactctgtccgaaggcctcaccgtccgcaggtccggctgcggctggaagtgggggtggctctccggtgacatcaaacagttgcggcgcctcactccatttcgagggttctgcttttgcagagtccgagattttcgttccagatccacgtgagttttcttcggtcatggaggcgtcggattagtccactccgggcacgggattgacgcctcctcttcacaaaagtcggaagctcccttcaaattgggcatctcgtactcaggtggtaatggtattctagttcacttctgaattatgattcgttcaagaaactttgtatgacgtcccttgtatttttagtgcaaatcctttctgaaattctttgaaaatcg

SEQ ID NO: 38713 - DNA, 729 bp, Oryza sativa
tcctgcagcccgatcaaacagattgtagtaatgcaagtctacaacagtgttagttggacccaggtcagcctgataaagctccgttgggtctgcattcccaatcctctggcagaatataacgtaagctttgtccgaataacttcgtacaatctggtatcctgttttgtaatacgacactagagtgcctagtggtaccgcgcctgcagaaggctcattcaatagctcaatacctaggagagaggggttgtttgcatatctgcagataaagagtgtacatcttgttagaactatggaacatgtattatgcatattattttgccgggttgttatgcatattattgcttttcatgttattttggatagatctcggtggatccaatggctccttactttcgtgcattttcttatgaatgaatagatttatcatagtaatcataattcaagtaggaaatgatttcagatgaatgaaaagaaaagaaaagaatgggacatcgattttttccccagagcccttatgacattatctaccctcatgccaccaattgcatattgaagaaacatttcattcacctaaagcaattttttcatgatatacaagaaaatatagtggatggatcggtgctacctttgagccagaaaattaatgacatccagtgttttctcgatgttagctggtgaaagccaatctactgaaccatccctacttgcactgtgttccattccgttttg

SEQ ID NO: 38714 - DNA, 2058 bp, Oryza sativa
tgcgcaaataagaaagtgatggttttctcccaatccatatctcatatggtgttttgtccttatttctgttaggaactctgtttaacacatgattcgaggtcaacaatgcctccccccaccatgccttaggtagtcccgcggtgtccaacatggcattcaccaagtcagtcattgtgcggttcttactttcagcaatcccattagactcaggagaatagggaggtgtcctctcatgtatgatgccatgttcctcaaagaataagtcaaactcatttgagaaaaactctccaccacgatcagacataagcctttttatctttctgtcaagttgattttcaacttctgccttataaattttaaaatagtctagagtctcgtctttcgttttcaacaagtacacatagcaaaatatagtagcatcatcaatcaacgtcatgaaatatcgttttccacccttcatcaacacccccattcatttcacaaagatctgaatgtaggagttctagtggtgccaagtttctctcctcggcagccttgtgaggcttgcgaggttgcttcgattgtacacaactatggcacttaaaacctttgacaatggaaaacttaggaattaaacacatgctggaaagccgagacatcaagccaaaattaatatgacataaacgtgagtgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatctgtctctactcagacgggagccactaacaagattcctgtcgatagaagggacatgctgcacgttcttcagctgcacgatctttcccgaagtaaacttcagatataccgtgtcaacaccatgaacagaagcatgtgacccattccccattaggacggtggaaccccgtgcgacctgataagaagaaaacaatgagatgtcagcacaaacatgtacattggtcccagtatcaacccaccaattagtagactgattaactgaaaaaacagtaggtaaattaccatacccgcttccatctccagtgttgcaaatggtcacattagcagacttagaagtctgccctgcaggtgccttcatccccttgcgctgtggacacttcctagccagatgaccaggttggccacacacaaagcaagtcctctcatcctgattaggattgttgttgttcttcttctgcttcttgaagttggtggtctgttgagctttgtatttccccttgttcttgttctaggccttgtgcacaacattggcactggactgcccaccatcgcccttagacgcaacatctttttctcgagctttctcctcaacatcaagagacgctatcaacccctcaacggagtattcctgtctcttgtgtttgagtgcagtaccgaaacttctccaagatggaggtagttccggagacctgctctcccgatcgccggtgcacgccggcgagcgggatggagtagtttacgagcgacggggcagtacagagtaggaggcaaaccctagattgatttcgcgtgtgttgcgtgaaggcggcggctcggtttatatagagataggtcgcttgatcagggcacccgcgtaacgaaccggataagtcgcgcataacttatcaagactccacgccgttttcacgcaccggattttttggaatgtttccaaaacaaaacaaatccgaatttcccgcagcaaaacaaaactgcaaaaggaggctgcatctgcgcaagggtgaggagccaattttgcggaccattcgacgcgtaggcgagcgagcgcgcgcgtgtgtttcccctcttctctccaccatacatgcttcaagtggctaggagggcatcctcccttttaaggaggtccccctctcgtagaataagtaaggtggtactaaactccacatgcatgctatctcataaggtgggcttttgtgattttccaaagaattaatcttcgaatg

SEQ ID NO: 38715 - DNA, 43116 bp, Oryza sativa
ctaccgaagaaaccatctttatccggtcagataaaatccacaatagcctcggttgcactaaaaaccgggactaaaaagaacttttagtcccggtttataagcgcaacgggagtatatgatctttaagcccggttcaaatgctgtcatgccccctggatctttagtcccggttggtgataccgatcgggactaaagatcatatttttaatcctgattggtactatcaactgaaaataaatctctcacacatcctcctcgattggcacggctgcctaccatatcttatcccctctctctctttccttctttatctcctcctcctccactccttctcaatcctcctcctctttccctcctcctcctccaacgattccctcctcccctcccctctccctttatgtcgcggaggccggcggcaggcggcggaggacgtgcgggggcgaccggaggggaggcagcaggcggtggtggccatcgcgtcgtggagggtggcgacggccgggcaggggtggccagaggggaggcggtaggcggccgcggctgtcgcgtcgtggagggcggctgcagccgtcacgtcgtggagggcggcggcggcggctaggtgggggaggaggcgacctctccctcccctccgccagatccggcgggaggggaggcggcaacggccgggcggggtggcggtggtggcgcgacgacgaagaattttttttcgaggatttgagatgtatttgtttttagaatttgtgatgtattgaatatgtgaagttatctgtgatgtatttgtgatgtttttttttagaatttgtgatgtatttgatctgtgatttagagatggtttggggatttcacaatttggggatgatttggggatgtagtgaaatcaatatgaatgcaataaaataaaatgaaaaaaaactatagttaataccaaccgggactaaagatggtataataccaaccgggacaaaaatccatttttgatcctggttattttaaccaggactaaagatggacatagtcctggattcgtagtcggggttacgaagcatgattgaagatcctttttccagtagtgaatcttattgatacttgagttatttcatggtactctatgatatgtattatgtgtactagttgagctactgttagttggatcggattataaaatcttgatacttgagtgataactgtcagattcatatgtatgggttatgaaaactgcgtaaagtcataccaaattggcacctatggggatctcttcttgttgttattgccaccgttccacgggtgatgctaataggcgcgtaagcgccgccaagcaaagtcgcgcagacgcgcacttgctcccagtcccacgcgagcaccttccgagccttccgctaaaatatgtgttagtgctaatctttagcggtttatactaattgatttttttaatgaaatgataaataaaatagttgggttgaaaattttaaaatacgaattgaaagttttcaatgtttagttgaaagttttcgaatttgagttgaaagttttcaaattttgacttcaaaagttttttatcttgagttgaaagtttaaaaatttcaattgaaagttttcaaatttgagttgaaaattttcaaatcttgactgaaagttttcaaatttaaattgaaagttttcaaatcttgacttaaaagttttcaaatttaaattgaaagttttaaattttcagtataaagttcattcgaatttcaattttttttcatacaccgtgtatataaatgatatgaagctaatcacgtgagatagaaaagagaaagacaaaaacaagtcagacgtgcttgcttccgcttctgtgggccggtgtgggcttagcgccatgcaccgataagcatctcgcgcatacgcggatgaggatgtgggccgcgcgtgaggcttgggccggaaacgcgcgcgagtcgtgcacccattagcaatttcgccgttccactgtccgagcatcagtgtcccctttgcattttttgcactcagtttgccggtgtagaaccaagaaggaagagggggagaagtgttggtataggatcgaacacaagtaaccaagcctaccagaggggggtaaatggtagggaaaaccaaaaacccaaaaacttttagcgaaaataaaagctaccctcaaattcgacggatcacggtctaaccgaagtagatgtgtcggtctgaccgcctggaacacgtcggtctgaccgatgtagatcgatcggtcgaaccgccgagatcgcctgccttcgcctgtcgccgccgccggtctgaccgcctataagctgccggtctgaccgccgggatgccgccgaacccgataaaacacagatcgaagaactctcaaagtagatgacaactttattgcttctctctgtgtttataaagtgcaacaacagcaccccttacaaaaaatctcgactaaactcaaaaccctagctaaactagcagctcaattgctctcaaagcgataccgggagacatcacattccctctctatttataccaaaaaacactactcaaaataggtgtaaaacttctatttccaataggactcaatacccgaaataccttaatttccaaaaccgcaccggccacataaaatccaaaaccgcatcgaaacggactcctctccgctgtcgacgcgtgtcccgtacgcactcggactcctcgtgcgcacgtccttcctgccgcatgggccagctgggcctcctactcctggaccaactcggcctccagccagctgccaccgaagcccaccgagccgctctgccgctgctcggtgcaaccgatcatgcacacatacacgcttcaccatgcatccctttttctcctcaaatttaatccaatctccttcgtgaacaccaacacttgcacacacacctcgtaaatcccgttgcgaagatctcttccacatgatgttcatccaccgtatgccatctcatatccaacttcgtcactcggtatttttgaccgtttggacctcaactcctccctaaatctagtcccgatcccgaccattgaccgaagttaacctccaagaatcctgactctagtcaccttctcacatgatatcctgaccgcactagacctctgctcctccctgagcatagtcgcggtcttcaccattgaccaaggctgacctcaagtcacatgcatataatcagacaaaacaaccgtttctaggcacagatatcacaacctgacccacattagtcacatgtactcacaccaacatccacacatctatttaaaccaattatttattaaatcatttgcgcagccaattattcatcacaaatattaatcatgacaatgatttcattagttgggagcattgttcgaactaaatctagcctaaccacctgatagcactaccgaaatagtcaccgagtctaggtaaaactgaattaaatcagtttacactaaggtttcctatcaattcacctccaagttaaccttctaagctaaatcacttctactcttcactgttatctaggggtgggcattcggtctaaccgaaaattacggtctcggtctttggtctttcgatcttttcggtctttgaaaagtgaagtccgaatttcagcgcgaaaaatgtcaggaccgacaaattcggtctcggtctcagtcctgaccgaaattcaacaacattttcatatatgcaaagaaataatggaaattttcaacacaaaatcacaaaaagaattcataagcacttatgagtaaagactcttattaggttgcatgcctagaagaagtagggatgtgaaaattaaagtttaatcctattaaacatagtggattgtaggttgcatttagtcattttttgataattcggtcttttcggtctattcggctacccgaggagactaaccgaattgaccgaataaaatttggtctttcactacttaggaccgaattgataaccgaatttctcggtctcagtcttttcggttcggttttttttacccacccctacttttatcagctagtacttgatacccataaggtatcagtagtaaggggctatttggttgctaccctgagagaaattgcctgacctaaagccagcctgagactaacacaggtcttgtttggttggtgcccttagattccaaacccttcgcctgccctgacgcagcccttcccgtcattagcgtgagccaggcgaccgaaatcgatcgcctgagctccaggcagcaacagcgatacatacttaccatcctaatctttatccaaagcggccacgcgacgtagattccaggagcgaagctgcgctgcttccgcgaagccgccgccgaccgccatcttgccggatccttgcgaagccgccgccgcccgccgtctttcgtaatccctgcgaagctatgctactctcgctggcgtgcgaagccaccgccgttttgccggatccctgcgaagctgtgttgctcccgccggcgggtgaagctgtcgccgtcttgccggatcccagcatagcagcaccgcccatgctagatgctgcccaggctgcctttcgtgcaaaatagtaagcagatcgatttgcaggttgccagatgcatttgcacatctgggcagaatcatctgaaggttgtgctcctgatgcacggatttgggatctatttgactcttcgattgcgttctcctctctctttttttccctgcttttttttctagatttttatcctcgttatgtatgcaagatttgtgcttgtacatgggaagttgggttcataaatggatcttggcaggaggtttagatgcaatttgtggcaagatttgtgacggccattaataattgatttagctgtgtaataattaaaggcgtaattgcatatttgtttctcaggcagcaacaaacaaccaaacaagcatatactcaggctacctgaccaggttagatgcattgtcttctcgcatgccactcaggcgcacagaaatttcaggcatgttgctcagggcagcaaccaaacaacccctaaatctagtacatggctaccagagctggtacccataaatatcagacctaatacacatgtatcatcccctgctacctatatatcatgtctgatacatgtaagtatcatgcttgatactgtagataacatgatacccttttaggtactataaataaataccgagaggtactacaaggtgtcattggtatcgtacataccatgatacttgcaagtaccataacacttgatgtaccacgagatatcatgatatcctaatggggtgtttgggactgactaaagtttagtccctctgcctaagtaacatgatattggaaaagtactatgatacaaggaagtatcgcgtggtacgaagtatcacgtggtactatggtaacagtgacatgaaatttgaaggcaccacgagatatcatagtaccacataagtttcatgagtatcgtctatatttaatgtttgtatcatagatattgtaggcgtatttagggttaacacttgtagaaacggtcgaaatttcagtaatttcaagacttttggaactttttgcacgacattatttacaatttaacaaattttgactaaattctaataaaatttgacaaaattcgcaaaaacaaattgaagaaaaacaaaaggacgagatatatatcatgtagatacacacgcgaaaaaaagtggattaatgaaatttgagaagattatagaagagttggcctggatagtcgcatttttttttcaggtgatacttaaaaggaagagaatagacagtagcatgcagctagcatgtacactccctccgtaaaaaaaaaaaaagtcaacctataagtcccattctagcactaggttagcttttttttttaacggagaaaatagcttagcttttgcattggcagaaacaacggggatgtttggttcatggcaacactttgccacaccacacttgtggctgccacagtctcttaggcagtctcttaagcatgtgtttagtttactgccacagttgtggcttgccacactttttcaatagcatgtcccacatgtcatagacttaattttcttgccaactttgccacactttgtggctagcaatttgtccaccacacttttgtggctgccacaacttgcctaatgttagttgtggtaaagtgtgaccagcaaccaaacacacccaacgtgtcgtgcggctcgtctcagaggtgtaacgatggatggacatcgttaactacggccgagtttagttccaaatttgagtttagttctaatttttttttaaaacttctaacttttccatcacatcaaaacttttctacacacaaacttccaactttttcatcacattgttctaatttcaaccaaactttcaattttggcggcgtgaacactctacattgtccctccgacgggatacagtttttctgtatgggttactgtaatttccgtagtaaagcacggccccattgctagttacagcaaatatacaaatatacagtgttgcgactcattgtccaaaagcaaatatagattcttctgttattacaatgactagacaaacttgtaacctgaataatgatcccctcctcatccatattaagccttgttcagagggattggaggggttcgaggataaataattccacacctcaatatatgtcaataaatcccctccaaatctaacagcagagctatatcatcaccattgtcttcatcataaaatagagtcgtcattcagaatctttgtaagatttgcattccttccatgatcaaaatatatgaaatctgactctagcaggcctttatctttatctttactaagactgcacgaagcagaaccaaacacatcaatagcagcattaacatcataaacttcaatggcgtcatcaacatcatcctcaaaaagatatccagatggtgggtgcaaaattgtacttgcattgccctcacaagtggtgcaaagacctgttcataaagccaaaacaaagacatcaacatacatgccaatggcaataatggttgctacaatttgtgtactacttgacgaaaaataaattaggagcaccacaacttagagttcagtgactcaccaaaacatgtgctatcttgaacagggcagcagatgggcttcgagtttgattcattaaatcgaccaggttgtgagtcccagaattgagcaaagaagagtgtgcgcttagggtttggtgttgtggttgcctcacgatttagtttgagcacagtgccatgggtgcttgccaagaagttagcatggtagcatctccagtagtgggattgaggttcctccactccacatatgaggtcaagcttatatcttggttcctgcaataacaaacaagggtagacgaagtcttagcacactggaagaaagcaaatgcagcaatcaaacaaaaataaaaaaacgtttatactctaaatttacccaaggatgctgtctggagtatgtgactagcaattcttccagcttgctgcgaacaaacctttgccggttcacatagtctgaccttctcctcgataatgctgctaaagcttgtgtatcaaatggaggcagtctttttctgccaatcatcgtggttagctgctcttggatcattgcgttaagctgctcccaatcagcgttggagattacacagccggagccatcactaatggatctcagcaagtgctgcaggcgatcaagcttctcgccgcagagggacatgaggaatgacccaagcatggtgtgctgcgggtgctctgaagccttggctgcagcagagtaggggttcttgttcgtcatcaccgtctgctgtagcttgtcagtgaggtcacactgcctggaccaaaggtactccacggcctcatgcttggagagcgagcagccagtggtggtggtggtgatggcacggagtagggcgacaaggccgttgagggaacgggatgcaatgcgagacatggcttgggtgtcagagatatcctgcggcaactcaacctcacaatcgccgccaccgccatcctttggatacaggggagggtatgcggcgtcgtaccagagggtgttgatgatgatgtttgatacgggatccaaggggccgaagcattgtccagacatgaggattgcgcggaggaggcgtccgcggcgcatggagtcatctgatacgggcaggggcagcacggcaagtgccctgatgtagaagcaatggatggtgtcgaggaggcacatgttcagggacaatatgtgctcacatggcggggaggcatcatagttcacatgtccatgttcttcacaaccaccaagcactttcgctacgcattttgatagctttgtctctatggctgcgctatctatcgtaagatccgagatgtataggagtttctgaaattgaacatgatttggtgagattccagcaaaacggtcgggggcggcttgagcacaagactcaccatttgggcagcacaagaagtccatgttgggcgggggccattggaatgcgttgaggagcaggtccttgatggactggacgtcatgggtggtgagcaggtccgacccctgaagcttgtggacgataggggagagtagatgagaggggtactgcgcggtcatggtgcgcgccaggtcgtcgggcgcggggtggcctgctttgagcgcggcgatccggagggcgttcttcatcttgccaccgtcggggaggaggggggatggcgggagtgggagatggcggtcatggtggaccaacttgatggcgaggaggaggtcgtaggaggcgaggtagaggtagcgcctggcctggtcgccggtgaggtagcggaaatagaccttcatgaaggcgatgaggccgttgagagaggtggatgagatgaacccccaccactcgctgtagctcctgcgggtcctcttccgggggagcggcggtgggtggtcttggagttggaggggcggtgatccggaaggtgggcgatggcgttgaggatgatgttgctgacggggtcggcgaggccgaagcagtgtccgacctcgccgaggcagtcgacgagctccgggatctcgtccaagggcagccgccgcgccgcctcgtcgtacagcttctgtatggaccggaggatttcgttggccggagggtgccatcgcttctcctcctccccgtggtaacaggtgaatctgccgaagcgggggccatcggaggaggaggcgccgctccgactcgctgctctcttccctggattttttggggattgcacgccggatctgagcccccggcttgctgtcgatttgtgaatttttcgccgcttcatatctcctactgctacgcctaccgccgccacaaacaacgctagccgcaccgcacctgcccggcctcctctctctttatacgccgcggatacctatcctcgtaggaatcggatacggtgtaccctggagccaatgcccagcccacttaactcgctgggctggattacccaacaccaaacggacacggtccctttccttccttcctagtagtagtaaggaataagttcacttttcctccctcaacttatggccgtgtatgaatagcatccctcaaccgcaaaaccggctataacccatcccccaactccgaaaaccgttgcaaatcaacttcccggacggttttggaagcggttttatcctatgtggcaattgacttgcttatatggcagttgacttgctgagtcatcaagcaggacccacatgtcagcggtctccacctcatctcatcttctccctcaccatgattcccttcaagaaacgggaaaggaaaaaaatcaagaagcggaggcgaggcgatagaatcgagcagcaagatcaacggcaagacaagtagcacatgatggttgccgaattcagagaagacgccggtgatcacgcgaaacaagaaaggagaacgaacaaaacaaattagagaccacgaaatcgtcgaagaacacgagcaaacagcaaacaagctagcggagttcttctagcgtgcgcgcgacgcggagcgggtgtccgccatacgcagctgctggcaatgccgccgtcgtccccgtgccggagcctctccgtcctcatgctgcagcacaacccggccctcggcgacatccccagtggcttccttctcggacggacggcgagcttctcccgcgcgcggacggccgccgagctatttccccgcgcgcggacggccgccgagctcctcccacgcgcaaggacgcccggcaagatcctccccgcgcgcggccggccggcgagcttctcccccgcgcgtggccggccgacgagatcctccccgcgcaagccctgccggcgagatcctccacacgcgcagatggccggcgacttggaggggctgcctcgtcctccacgaccccctctcagacaatgccccggcgtcctcccgcctcctctgcgtgctcgagccgggccactcccccgcgcgcggcgtggccaaccgacgagctcgtcccccgtgcgccgtcgtcgccgccctgctgatagaaggtgagaggtggaagatatgaaagagaaagaggggaagagatgaggtggagactgctgacatgtgggtcccgtttgatgactcagcaaatcaactgccacgtaagcaagtcaattgctacgtaggacaagaccgcctccaaaaccgtccggggagttgatttgtaacggttttcagagttgggggatgggttatacccggttttgcggttgagggatgatattcatacacggccatgagttgagggaggtaaagtggacttattcctagtagtaattagcaataagcccacctgtcagttcctggacttttacatcgtgttttttttacctctaaactgtacacaaccgtgcaatttggatcccacagcaatatagatgcctgcttttaatgatgtggcatcctagtcagcaaaataaaaataaaaatattatgtggggcccatgtaagtgacaagaaaagacatagggcccacgccctcttctttcttctcttttcttccccagcctcggtgttagccacgcaaggggaggcggccgacgggagaggtggggagaggtggccggcaagtctgagagggtaggggagaggcggccggcaagccagcaagccgaagctcgtcgacaaggagatcatcccttgcgacgcccatgtttgccaccgccgcccagttcggactggggacacgggtgaaagactgagaaccgatgagagggtaagagggggtctggcccctcaggagcgattgaagatagaaagggatttagacaggttcgggccgctgtgggagcgtaacaccctactcctgtatgtggttgatttgagtggaagaatactgttggggaggtatgtcatgagggccttcagccaacctgccgaaaccatctaggccgtcaaaacaacggctaagttcattggcccaagcccttgggcgaagaatacagacttacgaaggaatgggtcaagaatacagaattgccacgacccaataagctcaaaattcactgatttggatataggaggagataaggaggccgccatccgaaaatgggctggattgggccagcccatgttcggccgaaccctcatctgcgccgttggatgcagggtttggcgtggacgtccaggattgcatcccaatgacggttggagggcatattttcgaccattccaactgccacaaccgttattggcagctataaaaggacctcccatcctcacttcttccacacactcaagcaaggagcttctcatattctctcaagtttaatatactctctagagtacagtggaatagaaatagaatagagtctccggtcctcggagttttcggaagagttcgggtatggctctagtagcttttccttcttttgtaagacttgcaatatttatagaatattattcttaatatatttatggtactatacttcactctgatcatacgagtaccgactttccgatatattattcgagatataattgtctagctagcttactcgggagatgcgactgtgtgggtataatattcatctatatgattgctctatgtcatgacgatgattgtagattagtatttggtagcataagcgaggtgcttaggctattgaatatcattatttagggttatatgctgcgggacagtagaggtgggccgctgatggtgatagctcagtacgggtattcctccacgttagtatataatcctaggttactttcctggggagggtacttgttgacggtcgttatcgatcagtttcgaccgtcaatattaccaaaatagaggagaaccagtgatgcttgcaatgcatatacatgttagaataataatattccactagtattaggtttactaaccttttgcagagaataaccataaagtggaggagaatcgacattaactcagacgataaatcaatcggacgatgtcgacaatcagacttatgcatgaatgggccaagagctcagaattgacatgatgaattgggccaaaattcacaagtctacgaagtgaaacaatagagcaggtcgcctgccgaatttgggccaggttggctggcccctggttcggccgaacctccctctccaccgttggatatggggtttggcagggacgctccagatcttctcctgatggcggttgcggggtacttcagacatttcgcagcagttacacccgtcatacatgcctataaaaggagctcactctcttcacttcaacacacacctcaagcaagagctctgtcatattctctcaagttagtttagtgttattaagctagtagaataggaatagagtagaaatcgggaatccggaagccttcggaagagttcgggtatggctctagtagctcttctcttctctattgtaagctttgtactagtattagaatactcttctttatacatttatggtattgaaatactttttgaatatataaatgactactttacattatgttcatattatactgaatatgttgctaacttatctgggagatgctttagtgcgggtataatgtttgcatatgtaattactctatgtcatgataatgatattagagtagtatctggtagtttagacgtggtgtctagattacgggatattattatttggggttatatgctgcggatgagaggtgggccgctgatggtgacagctcagtacgggtattcctccgcgagtgtatataatcctaagttaattccctggggagggtactcctccgtatttagccccggttgtatggtcatgacgggctgtcgtaaggaactcgacagccaggggtagcttctcgaagtaccaggagggcatcagatagagggtattagctagtatatcagataactacccttggaatactctcgggtgaaacgctacaatagtatatccatgcgcttgcggatgaactctataaccataatataccaggagtatttctgcgccattgctgggaattatatttctagtaatgtcgttaagaaataccaacaaacatttctggcccgttgccggggaagattcataatagagattacctgaactaatactttataattacctctgtataatcatttccctttgcaggctaaccttggttgttttcacttttgttgtgaaaacagggtagtgcatgactggtttcaacttgccgaaaaacttcaaagaaaatccagaagctttcttccggagcgtcagaccgcgagtcactgctccgtagaaaactctaccgactaagaaaccagccgtagcagcgccaaccgactttcaagactatggctgacaagactccccgcgagttcattgctccctctgctgagaatgtggccattgggccgcagatcaacatgggagacgtggatttcgacttgaagtccagcctcatcactatggcgcaggctagcccgttctgcggcaagcctaacgaggatgccaatgctcatctgcagcagttcctggagatctgtagcatgtacaccataaaagggtgtcagtccagacaccgtcaggctaaggttgttcctgttttccctcctcgggagagcgaagcagtggttctacgccaaccgtgctgctgtcaacacctgggacaaatgttctacgacattcctctcgaagttcttctcgattggcaaaaccattgcccttcgtggaaggatttccagtttccagcagacaagggacaagtccattcctgaagcatgggaacgacttcaggagtatgtggctgcctgtcctcatcatgggatggacgactggctaatcctgcagaatttttatgatggactcactcccatgtcccgcgatcacctggacgcggcgactggaggagcattcttttgtaaaacggttcgaggagccattgatttaatagagaagatggtctccaatatgggttggagcgaggaacgactccagacccgtcagtgaggtatgcacaccgtcaaggagacgaaattactcgctgccaagctagacctcctcatgaagcgcttggatgaccacgacaaacggcctcaaggcactgtcaaggccttggactcacacgttacatgtgaggtctgcggcaacatgggacattctgggaatgactgcccagaaacccgtgaggaggcgatgtacataagcaacaacaacaacgggtaccgtccacaaggaggccaggggtggaaccagccacgcccgtattatcaaggagaaaccaatggggtagccaaggaagcgccatccagtgactcggctgacaaagagattcagccagaaaaggtcgtgccgcaggagtactgcgacacatgattgctgccatttcctcaacggagtaggaaatagttcgtggacgagcagttcgctcgttttttaaagtgcatctagggccctaatgattttgatgattgattacaatgcgattagagaggactaacatttttattgaagcaaatgtgaaggttgttatgtcctcgacgtgttgtaattcaatgcatatcccgtaaatgcgacatcgcgatgcaatggggcaatgatcaaatggtatattgtatcttttaccttgcattatatcgtaggaaagccgtgctattaagggggataatgcatagacatataaggagtgatggccggacatagatagagagagagacagagcttgaagagctcggttggtgtggagggaaaaggaccgacctcgtcgtctatttataggccgcggaagtcggttcggacaggagaaggagaagaaggacatggcaatggaggcgtggagaagaagagcacggcgccggctctgtccgctgattggccggtgatggcggttcgctccaggggctgacgtcgatggcgtgaggtgacggatgacgtcggcgatggttgcttggcgtcgagggcaagatggcagcaacgtcggtggcagaactgcgggcgacggcagcggctgcgcgtgcgagcgtgcgccaagcgcgtccatggcacacggcggtggcgcccacgggacagggaggaggatcggctgtgtggctgggccagcctgggtcttggtctgttagggttagggagatgggccgagaggagacagaagtagatttcggcccaaaggaattgtttcttaatttctaatagaatttgaaggagatttggatggctaggtttgaaaggaatttatatttggaggaatttatatgtggagatgaatttcaaaataaagaccttctaatttatttgagtgcaatatatttagaggtagagtggaatttgaaggaatttatttggaagcacttaaataaaaaaagaataatattatgaatgatagggctcctaatttggatatattttgggggagtatgataggaaaatagatagagaaaaataaataggatcttagcccccaaaatatatgatatgggttttagagaattatttgaggcaaaaaggaaatttggatttctggatgagaaggataaaatctattttcttagcacaagagcaattattcacaatattgcaataataatattctcatgccgataaggggatcaagccatataaattaaattggcggctaggtaaaaggaggaatttgaatatgggaatgttggaaggagaactaaggataggtttaagatcaaaggatgggttaacaattaattccaataaaattggaattgctttggtttaggttgtagcgcaatattgagaggttccttggaccatagttcataaaagtaaaaagggttttcaaactaaatttgaataaaaggaattttgtcaaaagaaggttttaaattaaaactagatcaagaaatacctccagataaattttaaatggagatcgcaaaagaaattaaacaaaagagaggttttatgcgagttagttttaggaggtccctctaattataatatcctaggtttaggaggttaataaaaacataaaaaccggtatgatgtataattagaaaatagctagttttcacgatgttacatactccctccgtttcatattataactcgtttgacttttttcgtagtcaaacattttaagtttgaccaagtttataaaaaaaatatagtattatttttaacacaaaacaaacatataataaaaatatattcaatgttagatttaataaaactaatttgatatttcagatgttgctaaaatttttttataaacttggtcaaactcaataaagtttgattagaaaaaagtcaaatgacttataacatgaaacagaaggaataattatttttgacatgtatcatggcatacgacctcattgtttgcttattggcttacaagtcacaaccaaaaattgaatttttcatatgcttgaattttactctactcttaacactttaggccatgtttgtttcggctttcgattattataatatgaattactagcattaatctgaaacaaatagaaatattattatattctataagtcagattagtataatctggtaatctcctataaacatgctttttcagattatagggtggctaaagacccactaccctttaatttttttttgcaaattacccaccactgccatcgaacccaacaggttgaacgcatccgcttcctctctgcccagttgcacgcgaatacagcgcctccccgcgtgcatctgcttactctctccctagtcgcgcgcaaatccttcccccagcccccaccctgcgccctggctccttcccccaagcgcaaaaatccatcccaagccccccaccctacgggccccttccccaagccacgctgccgccgccgtctcatattcctcccactccacaatagctgagggcatccaaaatagccaagggcattatagacattggcttgtcaaactcaataatccatgccattaataatccagataatcaaataactcatagcttattctactattgcttattataatctagcttatagtaatctggcttaataatttagattataatagtcttaagttgaaacaaacagggccttagaagccaaggttccaaggtagtcgcaatgaatcctatatatacttataaagttagtcatcactaagtgcaattaattttaattctctattctcacagccatccacgtcaccttaaattaatctagccaccggatttgcatcagacgtccaagatcgtcatcgttgatttgcccatccaaatagctgatgtgcactgaagagtccaatatgtttgcatatcccttccgtcctaattgggccaatgcattcgagcccattctgttttcttcctttaattgcaccatttagaggaaaatttgcctataataacaaaatttgctaaaattgcaccatttagaggaaagtttcatctagtatgtactccctccgtttcaaaatatttgacaccgttgactttttagcacatgtttgaccgttcgtcttattaaacaaattttgtgaaatatgtaaaactatatgtgtacattaaagtatatttaacactgaatcaaatgatatgaaaagaataaataattacttaattttttgaataagacgaatggtcaaacacgtactacaaagtcaacggtgtcaaacattttaaaacggagggagtattagagaggactattacaatgtaaatttgttccatgcctctggcgactacaaatttacagctcaaaactgatattatctgcaatattaagtatttatttgtgttttctcggattttgaagtcactacatttaaatggtgcatccatagagcaaatgctttcagggattatatgacgtttgcagttactctaatgtaatattggactttatcagctgcatgagggatactaggcacctgcttaccatacgatgtctcattggttgatcggtacagaggactgcatggtcaaatgagcaaaaattaaaaaaacatcgaactgctaccaggtagaaggtaactcattacaaatccaaaagtccgccctttaagctactcggagagaataaaacaccatggcatcatccttgtggtctcaaccttctgaataatcaaaacagtggtgcatcaaacattttcctcttcctattcgtcttcgtcttcctcttcatcttcttcttcgtaagggtctccaaaagagtcttcatcttcgtcttcgtgagagttctcatcttcatcttcctccacttcgtcctggtcattgtcatatccttccaaaatctcgatttccttacaactaaaaactgcacaaagaaacaaataagaagagcacagtaaatttcaagaggtccaacctgaaaattcactccaaaataaaaacttcaaatccattgacaaacttagtgtattggaccaacccttcaaaatacaaattgacataaatacttcattacttctccagatccaaaatcagattatgtccactacttcattcaaagaaagggaaacataataaaatgccgtcacttggagaagcattggtcctttataatatggttgcatcctatgcggcataattgctggattctctatagtatagcacacaacaagaagaaaattgtatggtctagggactatatgggtacttatggcaattcataaacaagatttttggacacaatggccaggagctgtgagcccaacataacaaatataatttagtgtcaccggagaacattaccttaggcaaacaaaactactaagcaatcttgcccaattattggttactagctgctatgatataaccaggatggctagtgcagcaagctggcacactcagcacctctagtacggtaaactgatggttacagaataacaaagttttctcacaataatagagttcaacaacgagataaaaagtatgtgaggtacttgcgtacatggaaaatggcatgcgagctataagatggcaatatcgactctcacaaatatacaactaatgggaaagaaaatcaaatcaaatgattgaaagatataattacatactacacacatgttgacatacttgttatgttatgcaagaaaattttagaaatcttaatatgcttttttgaatacaaccagccaaaagagtagtctagataatgtcttcccaaccataccaaatgcagtgcatatgctttcaattcccaattaatccatgatcctaacatccatttcccaataacttagagtttcgatactgcttactacatttcacgcatatgaaggcaaaggaaaatttcagaattgtacaaagaatgaagaatgtttaagtatgttgaatgtagacagatttcaaaactttgagtactctcttatcaaccgcttcgcatttgatttcaactatctcaaggtgtgttgatattacaagtgatctatccattgaatggcagtttcctttgattttcattctatgtttaggtccctgtcagaaattaaacattttaaagtcaatagaaaaatgccccaaaacttcaacaagtaatcaattggccaattagataaggtataccttggaatagatctgaagaatgagattctctagaaccagtgcatgttcaagaatgcaagatagtgcactaaaatcatcaggcacacaccagtattcattgagtaacaaagtctttaacttggtaaatgttgggcaccattccaaatcccttttgaaaataaactgggtaaaatgcaaacaagaagataaacaaatcctcagagttcaactggatataaacatagtataatagaataataagacaacataaactacttaaagatggaagtgcaagcataccaatctacgttcatttatcagcaccaacgtcttagcttctgataaaccttccaaacgcatgcatttgtggtccttgatatcataacaaggttcaaagccctcacaacaacaatccccaaagtcataatgactacacgattctttataacagtagaggactctaacaaatgcgtcaactaacgatggcatccactcaagcactggagtcctgccatggaaatcatccagcttcagagaaacaagactcgggatagcgatacgtatccgagacgtctcactgaaataggaattggttatgctcaaacgttttgcagagctagatgagatcttggcacagtcaaatttgcatgactcaaacactagatgctccaatgctggacagctcgagaagttaagaaagctgtcgtttaggcctatgttcttaagctgtagcctcgtcaagtgtcgggagacaagtggcatctcatctatcagaaacgggaagcgataccatatatcgacatcgagcaagaggaaccgaaccttgtggagcaaagcatgcctgaaccagtggttcacccgtactgtgtcatcgaggccctcgtctctgtaccaatcgagccaacggaaccttagcacgcacgtgtcgagaggtctccatcacggagtagcatcagacggtcgagaaactccttattgtccttcacgcagcgcagatagatatcgtcttcgccaatgcgcagcccggtggcagactttcagaggtggagccatcgccgggctagcaggcacttccggacagcctcctgcgccggtaggaaggagagcacgtggtggagcacctcgtccgggagggtcccctatgcggtctcccccagtcgagggaggcgattccttggccatcttctgcggagacattccgtcgaacaggttgcgggcgtcgccgcggcgcccccactggcgtagcaagaaccgctcgggcgacacgaggagcgccaaatcctagcgtgaacgagcaggagagagggctgtgctgttcgggtaagcagctcacatcgccgccggaagctttcccccggccaccggagaccaaagagaagagagtggaacgcgcggcagcaaggatacgcacgccgacggcgcgacactcgctagcccgacgaacggtcaggtcgcgcggggggtgggggagagaattccggcggggcgaggcggatggagaagcagcgctgcgatgagcggaggaatcgccggatcggagtggagatggagaagacgacggggtcacagactcagagtctcacggaggagatgaaagttttttttttcttctgtttttttttttgacgggaaggagatgaagggatatggctgggtttccagattttttacttatttttaaaaaaagatttaacaaataaattttcaattttaaagttttacagaactatactctttccaccctatcacacggcgggacataaatcgtcatacagtagggcaatccatgtgacgtggcaccccgtaggagaggcgcaccaacggagagcttggcagcggcgcaaggtgggcggcgagctcggcggcttcctgcggtctgtggcgacgagggtggcaatggacggcggcagcggcctcttcctagcgacgacggcgtcttcgagtcccttccacaggtgaggttcttcgttcaaccaccccccccctcctcccctccccttctctctccatagaccaccttctctctccctttttttcccaaaccacccgtgcttccgcaaatcacactaatatgtttgaaccgctgccttttgtatttccttttattttgaatctaacgtggagcttgagaccgctgtccatgatggtacattgaacatgatcttagtagtagtaccctttgcagtggtcaatgtacctttataagaaatcctcctgagcaaaagatagcatagcggtaaaagccatcaccttttttcatgcttctgcaccaaccatttcttcaagctgaacaagagcattgtagcatgcttaaaggccaactccgcgcttcagtaaccaaaatctcacgttcttatatttataggtcaaattttaaattcaaaacttaattttggaggtaattttgtggttcttttcattgtggtttatatttacagaatttgcttttgaatcgctaaggacatgtatctaaaagttttacttataaattattttttgttgccaataacccatatggataagtataagcgaaatgttagcttatatttctacgcaggggcggaattagagtatattagggggtgcccaggaaacctgattaagaaaattttttagctatatctcacttttttttcaccatgtgtgcacccccgtccatacaaacttagacaccaacatcaatttaaactcgatttaatgtagagtaaattaaacatgtggcaccccgtccatttcattccagctccgcccctgtttatgcggagtttcttgtaaaaaaaatgcctagaacatgtggtccctttgcatgcttaacaatgtcttaactctggtcattctcttatgtttagtatgcacatggaatactttgttattgatcggccagtaatatttacaagtttacatgagcaattagtaacatgaaagtcttgtgcccctcaaataacagactcccaattaggggtggatgtcgagctggctcggctcggtctggctcgttagaataatgagctagctcggctcggctcgttatcctaacgagctaaaaacccagctcggctcggcttggtctggctcgttagaataatgagctagctcggctcggctcgttatcctaacgagctaaaaacccagctcgttaggctcgtgagctttgggggcagccgacgaccacggaggcacggaagcagctcaacctcgccggcaccttgacagctcaccggcgaccacggggaggagcttgacggtggaggaaacgagctcgagctcgccggcgaccacggggaggaacttggcggtggaggggacgagctcgagctcgccggcgaccacggggaggagctggacggcggaggaaacgagctcgagctcgccggcgaccacggggaggaacttggcggtggaggggacgagctcgagctcgccggcgaggcggcgaccacggggaggaacttggctgcggaggggacgagctcgagcttgccggtgccgtcaggcacagggggaggggcggagagcggcgacggcgtgtgggacgagctcgagctcgccgacggcgtcgggcgtgggggcagggagagtcggagagcggcgggccagcggcgtcgggcgctggggttaggtggcggcgtcggtcgctagggtggaggcgcagagcggcggtgttgggcgtggccgcgtgggccgcgtcgcgtggcgccggcgtgtgggggagacggggagctcagccgccaccactagggaagggggaagggaagctagggttttggtttttggtctattgggccttctaaataaatgggcctatgggctttgtggtctggcagcctagctcattaaagctcgcgagccagctcgagctggctcgttatctctaacgagctaaacttccagctcggctcgctaggaaaatcaaacgagccgagccgagcctgtcacgagccgagcgagctaacgagccacgagcttcctgtccacccctactcccaatcatatgcatactatgttttgagattacctttaggttaaatgaaatgaacagggagcattctgtcaataatagttaatttgcgtttaatggtatttctgcttaagccagtattaatttgcgtgcgtatctaagcgcggccgtgtattccctacgcactacatttataaacagagtagatacagaactccccacaaaataaaatagcaagtattacagcaagcccgtaattaactggtgattacgaattttaggattagagaggactattcaagagtaaatttgttcggtccctcagcctctggtgattacaaatttctaggtgagctcatgaatatgttgatcagtgcagaagactacacggtcaactgagcaaagactactagaaatgcataataaaacgtcaaaccgcttctgggtagatgacctaagtaacctagggactggtttagttcccaactttttcttcaaacttccaacttttccatcacatgaaaactttcctacacaaataaacttctaacttttttcttcaaacttccaattttagtcaaacttccaattttagcgtggaactaaacacagccctactacaaatccaaaagtctgccccttcaagctacttagagggagaaaaacaccaatgttaccatcctttaggtctcaaccttctgaataatcaaaatggtggtgcatcaagcatcttcattgtcatcctcatttccctcttcgtaagagtcttcgtcttcatcttcatcatcatcgtcttcgtaagagtcttcatcttcatctttatcatcatcgtcttcgtaagagtcttcatcatcatctccatctctatcttcgtcttcgtcttcgtcatcatcaaaaatcccgatttcctcaaaattgaaaactgcagaaataacaaatacgacaagcacagtaaatttcaagatgtctcagctgaaaattaacttacagaagtttcagttacttcaaaacgaaaacattgaatcagttgacaaaggtagtccattagatcaatctttccaaatacaaattgctacaaataccacattacttctccataaaaaattctgattatacccactacttcattcaaagaaaagaaacataataaaatgccctaacttggggaagtattgaccctttatttcctggttgcagcttatactgcagagttgatggattctctatagcctggcacacaacaatagagaaatatgcatgctctagggactataagggtacttataataactggtaaacaagatgcttggacttcaggcctcaatggccaggtgccgtgagtagagcccccacctaacaaatataatctagaggcaccgaaaaacattatcttagctaaacaaaagaactaagcaatcttatgcagttattggcactagttgctatgatgtgactaggatggttagtgcagacagctaaagagcacattcaggcattcagccctatggtaggttaagctgagacttcagaagaacagtattctctcacattagtagtttgacaacgtgataagcagtctgtgaggtacttgtccacatggcaaatgacatgggagcaataagagcaagtaataaactggaattcaagatggcaacatcaacataaactgcaatatgcaactgatgggaaagaaaataaaatcaaatgattgaaagatataattacagccatattacataaaaattatcatgctggttgtgtgatgcaaggaagttttaagaaatctttgtatggtttttcttctttggatactaccagccaaaagagttatactaggtaatttcttcccaatcagaccaaatgcagtgcatgctttaatttctgaatcaatccctgttcctagccatttccagtgaacttaagagtttcaatactgcttgctatgtttcacgcatatgaagaaggaaaatctctgaaatatagaaaaaaatgaagtatgttctttacgtatgttaaatgtagacagatacttcaaaacttcgtctacaaagttatcaatcatttcacatctgatttcaactatctcaaggtgtgctgatattgcagctgatctatccactgaagagcagtttccgttgattttcattatatgttcaggtccctgtcagaaattaaaacatttaataagaacaatagaaaaatgtttaaaaccttcaacaacgaattatatgtcaaattagagaaggtatacctcagaatatatctgaagaatgagattctccagaaccggtgaatgttcaagaatgcaagctagtgcactataatcatcaggcacacaccaatattcattgagtaacaaagtctttaacttcgtaaatgttgggcaccatttcaaatcccttctgaaaataaactgtacagaatacaaataagaagataaacaaatcctcacagtttgagtggatataagcacggttatagaaatgatataatataaacgaactaaagatggaagtgcaagcgtactgatttttgtttatttatcagaaccaacgtcttagcgttcgataaaccttccagaagcacacatttgttgtccttgataccataacaagattcacagccctcatgactacaatccccagagttagattcactacaaaagtctttagtatagaagaagattctcacaaatgcgtcaactaatgatggcatcctctcaagcactggagcccggttgtcaaactcatcaagccgcagagaaacaagacttgggacatctacacgtactcgcaaggtcgcattgaaactacagcaagtgatgctcagacgtttcaccgagttagatgagatcttggcacactcgaagaaacaaaactcaaacaatagatgctccaacgctggacagctcgagaagttaaggaagctatcatttagacttataccgtaaagctgtagccttgtcaagtgccgggagacaagaggcagctcatctatcggaaccgggtcataaaactcccagttttcaagctggaggaaccgaactttgcgaagcatagcatgcttgaaccaaaaattcagccgggctgcgtcctcgatgagctctttgctgggctcactaaaccttagcacgcaggtttccataggcacactatcacggagtaccaacagatggtcaagaaactcctggtggtccttcacgcttcccggatcagtctcgccctcgccaatgcgcacccccgtggcggacttccagaggtggcgccatcgccgggctagcaggcacgtccggacggcctcctgcgccggtaggaaggagagcacgtggtggagcacctcgtccgggaggtcccctatccggtcgccgccggtcgagccgggcgattccttggccttcttccgcggagacattccgtcgaacaggttgcgggcgtcggcgcggcgccccccctgcggcctgcgcggagcaagaacagctcgggcagacacgagggcgcgccgataactagcaggaacgagggatctcctgggtcagcaccaagcagctcgcatcgccgccgcggcagcttccggccaagaggccaccggagaccagagtagaacgcgcagcaccgcgtggcgcgtgcggcagcaagagtacgtacgccaatggcgagaagcccgacgaagagtcagctcgcgcggggagagggaatccgtggggcaaggcggcttgcagctggcggcggcggcggcggcggcgcgcgcgaggatgagcggaggaatcgctggatcggaggaggtcagcctcgatcagtttgaggcggcgaggagagagagagagggaagggtggggaaatggaggtgattagtttcaccctatttgcaacgatttgccactgccccacatgtatagacacatgagagcccacatatcacagtgagtggcgactcgttaattaccatatccaaaagtgacaattaaaggatgcatgtgaaaatatacccactgcattgttcatgtataattctaatgcttctttctttgggtgaaaatactccaattgacatcctaccagggtttcccaaaccgccggagtccgggttacggcgccccggtggtaagcacggttaccgcgcggtaaccacgataaccgtgaaaaaccgtacaaaatttatcaaaatttcaaattattttttaaatttatttgaatttaaggaggttaccgcagtatttatattaccgtacccccgcggtaagcttggtaactgcgcggaccttgcatcctatgcagttcctttaaatcaattcgaacacataggtgttcttctctcgtcaacttatagatttttcctcgatttccgttagcatgtgttttcaaactgataaacgatgggtttcatagaaaaaactttctatatagatgttactttaaaatataaataaacacatatttcaagtttttgataattaaaagtcaattacccatgcactaatagctttctcattttatgtgccttaacttcatattcatcctaatcaatctcaaaaaccacctagcccttcggtaattaaacgagcaaactactcccatcgtcgcgaaatataagggtttttggctggatgtaacatagactacgaatataaacagccgagtccatattcatagtactaaaatatgtcatatccgactaaaatgtttgttcgaaatacacccccaaacttcaaaattgggtatcaacccccctccctcaactattgaaatcgtctaatttacacacctaagtggttttcttcacggggtcgaggtcgccccgctgaccccgtcccctctgcaagggacgcaagcacccaacgccgtctgcgtcctactatcacaacacgtctaatatgtgacaggaaaacaaatggagggagctagacggggatggaggaagggatgaggccggggatggagggaggtatcttgccggcagcttcggctcctccgtggagcttatcgagggaggggagaagagagtgtgggattgacaggtgggacccctatgctgacgtggaactacttgttgaatggcatccaactataccaaaaccagcttaaaaaccactccaagagggtaaaatgtccagtattgatagtttaagggtgcaatatacctagtttcatagttcggggtgtaaattagataacatgaagagttgaggaatgtacaatgaacttatccctatattttggtacagaagtagtagtatgctagtatttgacaagaactgatcttttaagatcgcataacagctttatcagctattatttgataaggctctaaaagaaaagctatgtttcgacaagaatgaagtaaaaatgtcaatttaaaacaacacatctgataaccggcttaatcattgataacactttttccccccaagtatcagaacaagaacatagttgcagaagcaataagacatcacatgagcactaggaatcaaaattaagacaatcaggttgctgcatgacatccacaaattggacccgaaaagcattaggagggatcggatagttcttgtactgctaaaatcaagattcgagacagacattacaaggactgacatcaaggctcacagcaaaaggtgttttcatgtgatgttgtcttactcttagctatgagcctgaaaaataaaatgaaccttatatcttaagctaagacttttgcaggcattttcccagaacaaactgcagcaaaggcatctgcaaatccatgaactaatgtagtgccctttgctagtttgctgtggtcaatgtagaagtatcttgctagcaaaaatgatactactatattgctgtaaaattcagcaccatttttttatcaatcccttcaccccaggtatctctactaacataagggcacccacaatggttatctataggctctctataagagatccatatcagcatattttcctacatggaagatattaaatgaagagagagagcaaaactatctactaacttagagatagtctatagagaaaaacgagacaatgcatgagagagttatagatactcatgtagacatactattgtggtggtttactattaatctagtctattgctaagatgtacatgttttatagatagcaccttactttaccattgcgggtgctctaatgcctcggcatgaaccgcttctccagactgaaacaaaagcattgcagcctcaccatgcagtccaactttggtaaccaaattaactcttatatctccttgcagagtttattgttacccaaaaaaaaaaggatagaatctgtaatcccttggttgcttcttggcatgctgcacgaagccctttgcttggcctggatagaagttgggtcagctctacttgtttcatacttcctccgtttcacaatgtaagtcattctaacattttccacattcatattgatgttaataaatctagatatatctatctagattcattaacatcaatatgaatatggatctagattcattaacatcaatatgaatgtggaaaatgctagaatgacttacattgtaaaacggagggagtatcaatcataaagccgaaatcctttcaaccctacaaaacacaagggaaagatttctgtcaaccctgccagtactacagaaccaagtgtgagacagtgcacttagaagctccacacatcgcatattattaaggggcgcgggctggggcgatgttggtgcgggccacgtcgcccctttttcctcccgccgtccgatcaggcgtgggcggctgggattgaggcgcgcggtggaaattttgcgaaaaatccctccgatttatatataattcaatatgggtccctagcgaacagttcctatgagccgatgttttacgtgaaagcccttgtagtagccggatattccgtgcgtgggagagaaaaaacgcgaatcgggaccgcgctgtacaatcttaaagtcgaggggattttttgcataatgatccccattagcccacccacccccaaaccctagccgccgccttccgtctcgcctcctcccactcgtccccatcctctcgctctcctgcctccgcctccgcctccccctcgcgccgccgcctccgtcccgcgcgaccgcctccgcctccgcctccgcctacgcctccgcctacgcctctgccttcccctcgcgccgccgcgtccacctcatcgccgccgccgtcgcttcgtcgtctcccagcgcctcagcctccccattgcgtcgtcgccgccgctgtcgccccgtcgtctcccagcgcctcagcctccccatcgcatcgtcgccgtcggcgagcgcacccatctccgcctccactagcgtcgtcgcctcgcgccgccacttccaccttcgcctccctccgtccctgccgaccgccgtctccggccaccagcgtccggatctggcccccatgtggtcgggggacggggatctgacatcccccgtgcgccgggcagcatctccgcctccgtcaccaccgtcgtcgtcgccgagcgccgccacttccgccaccgcctcgccccgttgctgacgagcccgccgcccctgctgcgtgcttcgccgccgtcgccgacggtcggtgctccaccctccgttgcggctgccatcgaagaaacggcggtggtgacggagccggcgccaaggaaggcagtggttgcgtcgagaagaggaggaccgtacgtcgccaggcggctccggctttctctagaggagtggagttgcagagtgacgtggaagccggtggcacacaggagctagccgacgagcttgacaccgagcagcttgggctggagagcaagattatggccatcaggaacttcttggaaggaccccgaccatgtcctccgtgatcccatttttactttctcgcagaatatgctccaaatatgcaactttcttgacatgaactgtgcatgttttttgtgttttgtctcagcccaaccgccccaacgacgtgctggtgaaatagtgagcttactgcaaaaccggctaaacatgaacatcaccttcaaggagctgcaggtaaagcttttttgtccttctgttaattttattcctaagcacgtttgcttttctcatcgggggtaggacggtcctgctgcggctcaacctccactggggccacatgctttgactggccatcatcagcagggtcatccagcctcctccgccggcgagggcgaccagcctgtactgcaggcttggaccgccgtaggggactgcgggcgccatggaggggccgtgctgtccctgtgaccaatggacgatgacagttgcggctgccgcgagtccacgccgactgcgaggcggttaatgtcgatgacatgttcagcctgcgtagggatagccagatcggcaaggatcagtttcatggtaattttttcttgcagctcctccctgtcagcatcttcttcctctaatctattctagattttcagtgtatcaacatgattgatttcgcagccaaatataatccattccttccgtcccactcctattaaaaagcttgacctttttaccaaccgatgtcatgttgttagccacatcctgttcttagttttttctaattgtccattcgctcattgggttatgttaaatatttttgaacgggttacgaattttgcaatatagtactaataaaacacataacgtctctccttttgtggagttgtctgattattatctaggatcattcactgttaggcctcaacacatttttttaattcctccataatgtgagagatactaatgactgttctcaagcagtaaaggaaaaccacatatttagattagttagccttccttttctactcttctcccgccatgtattgtttagtttatagaggagatcagatggacatatgctaccaagtctgtcatttcaagttctaaaaaaaaagtcggatcatttcagtggtagttgggcaaaaatatctgttggcatgcgagaacttttgcctacttattttaagaatgtttttgaaacctaattaggctataactcatatatcttggaatgtcctatttgttatatttagcgttgttttcattactcactgatgaaaaatttaggcaggggtgcatggattcacatgtttggaatgagatcatgaaaggatagatggcatcccaaggaactgaagaaaaacaaaaaactgtaggatcagcaatagcagttagagaggctttctggttttttgaaagggtattttagaagtttactcaagctgaggttttggatacagttaagcatttcataaacctttctgatgtgctaatacactccacatgtaaatatagaaagttactataatggacttttccaattgtagctatagctgagtgctaataccataaatttgcaggtactaatgaatacataatgaattgatctacccctccactcaaagcctcaaatcatgtcgctccatacaagtcgaatggccttgacaaggcatcagagatatcggtttgttcggattctgctgatcaaagttttagagtcgaggtctaatatggttgatcacagggccaatcttgtgcaggtatcacagaacatgtttcaggcattatcttatcacatattccatatgcttatattatcatcctttttttggcataaatgcttgtaccatattaccagtagacatctgctagcccactagaatctcttgatggagacgttacaaccgccatggatgatcatttagttgtctgtttctgcttctgccgacataaagaaaatcacaagttcactaaacatctcccacctgtggtgactgagaaataggagctcaactgcacctgcttcaggtggtcggctttcctccatgggacatggacagagctatcatccacaatgtagaaaaaaaattaatattagctgggttagctgaaggacaaggccaactaaatttcattaatatttaggagagtggttacaaagattattacaccaacaatagggtgtcaaaaccgggtagaaaaaacaagggatcaaaacagccggaatcggtactgtctctacggaaatggccctcggtcagttggtaacaggccatatttatcaattaaactattgtttatatgtagctaaaaaggacaacggtcaaaaaggtaccaatgatatgaaacgacactcagtcggcagggaatttccgtggccattttcatccctagaaaaaaaccgacctacaagtgtcaaagccctcaaggaaatttaaaggtcatatcatgtaatatgcaacaatgcaacataactaaaatgggagggagggagggagggagggggttgttaaaaccaacttttttaccacaaaaaggtttcaaatttggatctgcatatgaaatttagttgacacgaatttttttgacaggttttgtttgctcgttgtgtgatcattgttgcagcagtacatgccatccatctgataaattaccttgaatgtctcaatgttgaccacttaacattagcaatttgcttctttagattcttattgcactccgaaaatttcactatatgctcaattctattgttcctatatctaaaagcagtatcatctctaaatgattatccacttaaagcagtaccatctctaatgctattgttgctatctctaaaatgttgtgagtggaacactctgaattgcttgtgaggagcaggtaaatggttgttgtagttaacctaaactgcaaccgttttttagtgtttttatcaatgaatgattctcctattttagtgccactaaggctaaagctatttggtagagagcttggtaaaaagactacttcctccaatcaacagtatttgatattgggagtaataagttagtactcctgatgtcaaatattattgctaggagtgaattcaaaaagttagtactccctacaatcaatagtgttattgtcaaatattattctcgtgtaatgcattagagatcacaattctttgcttagtagtcatttaccatgattttttttcattttctggcaaagttgaaaaattaagcgaccatgctcttatttgcagcagtttcatggatgcagagctattggaatttgcaaactaaaacatggaccccaatgaacgtcacgactttaaaagtatgtcttgtgcacatgattttgccctactcactttcttttttgcagatatattggcatcggttttctcgtatcacatttgatagatgaattgtttgtagtgttggtgcataatttgttatatacatatagcttccatgcatattggtaggatagaaggcattaatatggactttgcctgttgtacatgagcacacttgaggcctaagttagattttcagtcagccgggaggtccttatgcactatgaggaataaactagcacacttggaggtattgaggtgttcttctacctgtccatttttggttaacatggatagctactcatgtggtgttcaaactgccttgtaggattctcatagctagattaaaattcacagatattttctatgttgtcaacttctttttctaatggcaaatcgcaagtgttctcctacttcctggtgataagtataaccttgcttcttcttgttattaacaatcctgaaattgttcagtacaatggtcgttaatgtatatgatataactttgtgagagtgttttggcgattttttattatgtatgttttggtctgagattgagaatacatcttataaactgaaatcaaggcccaccttggcactaatggatcttcatcctctgtttatgtgtagtattgtatttctgatttcctaaagtggtcttggtgaaggttgatgatttgtatgttttcactatagtctcgttgtttctctgtttattgaattatactaagatatgactcaaatttaatagttgaaatgagcttaggcttttaaacctttcttccattatgtgtactgtatgcattattaatgtattaaattctttataagataatatccatgtttagtgacacttaaaaaagaatcacgaagaaatttaaccctactggattttctcttatgtatcatgaccaaataacgaaccatatcctgtgccataaatatatcttctgagaattaatatactaaggataaaatctgtcatatagtattaataaccctcctcagaggacaattgcatgcctgcatctttttttatgtacttgtttctgggtttcttttattgccatgtcctgtttgggtttcttttattgccatgtcctatttgggtttcttttgtgattgtttgctcttgccatataggctccacggtaccgactgtgacatattatacccacagatgacgatgaaatttggtggagcttttggtgaagaaaaagcaattggaggacgagaagcagggaatgattccatcgaatgtttgaagcatttgttttggttttctgttttcagatttcttgcaagcaaatttaaccatagcatcacaaatgcctagcccttcgatggaaatttagatgttttagtagtttaaagtgcagctataccttttcattgtatttgatttgcgcaagtaccagaactacctgaacaagtggaactctcattattaggagttttgttgtaattatgcccaaagacaaatgattgtgctataactatcactactagcaaatgtggtagtttgtgtctgatgacttttgctacagatattaatgaacattgattttcactaatcatagacaaacgccaattatgcatctgtttgagctgtccacaggcggcgcgccactggcgcgccccagcctctagtctctacaatggcgcggcacaaggagcttggcagatgccatctgttgcagcaaccaaggcaatgccatcctgttccaacttccacatcaattaagggtgtgtttagtttacgctaaaattgaagtttggttgaaattggaacgatgtgatggaaaagttggaagtttgtgtgtgtagaaaagttttgatgtgatggaaaagttgaaagttagagaaaaagtttggaactaaactcggcctaattcatttgagcttaaaattggttaggtgtaattatggcaggcatcaaagctaactttcgaagcatcaaatttatcatactgtagttttgaagtagataattggaaggcttatttagtgctagatgacagaacgatacagactatcagacatacataacttcttctttttcagtaatgagcaaataaagaataagagattgagggaaaggagcattcgaaaaattacccttatcatatttcctttcattctgaatgcatggcatttctagttcaataagaggatatccatgatatttgaccattcaagaatgattaagactacatcggtgcttaatcagccaaccaggccatgcattgtggcgtatgtggactactatctagaaatcgtaaacatgaactgaaggttgagataaatcggaattaggaaatgcagagggggagaaaatgaagcatgaaaaactgcgagaaccctgtttgctcaaagtacgagaacaagaaaatagttgtcaaagaaacaagacatcgtatgagcattaaattaagggcactaggccagcaagcttaaaacaatcgagatgctgcataaatatccatgacttcaaccagcatagcattatcaacaatcagattgtttgtagttctaccgttgatgtcaagatttgaaaatagatgttacctcatcaactgataacctcagaaaatgaagtgttgcattagctatataggccgggagataatagacctgcaacatgagtccgaagatgttgagttagacttgtgcaggcaatttcccagcacgaacagcagcataggcatcagcgagcccaggaagagcatcctcatagtgatcaatgactttgctacaaaaacttcgtcgcgcatacatacacaatggtagaagtcaagaccttttcttatcaatcccttcacagcaagggcttctgcaacataatgcctcgcaccaaccgcttctccaggctgaacgcaagcagagcacaggccttcgcaaaatgtagtcaggctccaatccgaccttggtcaccaagaactcttatcttggcacggagtttcgtctcagaaaatccagaacttgtggagacttgcagatggcatagcggagctcgtccatggagcaaccaagagtgctactcaacaactccatctttgccctttgattttaaaaagtctaacattttagattgcaataaagacacatacgcgtgcacaccactaacatttgataggtcctaaactacaagcagagcactttgcgtaacatatattataaaatatataaccaatgtgaaagtataaaatatttccaaatcatattaaaaacctacttcctccgtttcacaatgtaagactttctagcattgcccacattcaaatagatatatgcctagattcattaacatctatatgaatatggataatgctagaaagtcttacaatatgaaacggagggagtaccgtttattgtcccaaaactttacagtaaaaatcatggtgaagatccaatcctagcagcatttgcatatgaccttgggttgtgcaattccctgggtgaagatcataatatccacaattaaagcaggaatactgtaataatgctgcatttgaactcaaaatgagacagctaagcttgaggcacactctttagctgttctgtaagtaaggattatgctgtttgcagaagtgcttacaaaatcattagcacaatcatgatcatggtgatgtggtcttgaaataaatgagaaatagagcagaaaggatacaaactgacctggacaacagaaccagagaaagagttgcatcgaggcacatttgctaaatgatgaacagtgccatttccagtgcctggataatggtgccaaacaaacaatcacttgatccatatgcctgtctatgagtggcactcttcatacaatcaacttgatgtatcaaatcaacgataagaccatgcttttcgaatttcgactagtttctctagcgcatctccacaaagccaatgccagcacgttccaatttcaacacctcttcctgatcaattcgttcatttgtacttccaattgcttaggtgtaattgtgttagccatccaatgtgttcttttacttcattctagtattatttagctttagaaacaccaaaattaacatactgtcatccaagtagataactgaattcttaatgcgcagtgaaagtataattacagattatgtgacatacataactgattttcagcgatgagcctatcaaatggcatttgaaaaaatcaacctgatcatatttagtttatctctcttacatgatatgtcttgtttataattactagagatccatgccccgtatttcaccagagaagaatgattgaactgggcatggaaaacattgatctgctagcatgctaagcagtgtggtgccatggggatatttttttaatatacccaacaagctattgaaataacaattgaaggttgaaataaaatcaaaattagataataccaaagggaaaaatgatgcaggtagtactgccaaaaccctttttgctcaaagtacctgaacaggagaatagtggttcaagaaacaagtcattgcatcagcagtaaggctgtaagggcactagagcatcaagatttaaactatcaagttgctgcataaatagcaagttagcaacaactcatattacaactgaaatcaaaatatgaaaaaggcatgaccatgcatgaaaaccatcacaccaattagtgatcctcacaacatgaggtatgggcttgaaagataattaacctccaaagatgttatagttggactccagaaggcattctgccagaatgaattccaataactctgtccgaagatgtcagtgttggacctctggaggcactttcccagcacgaagtgcagcataggcatcagaaagaccagggacaacgttctcgtgctgatcaatgaagttttttacaaaacaactttcgcctagctgtacatatgagcaaaagggaacatcttttttcaatcccttcaatcccttcgcagcaaggacttgcacaatataatgcctcgccaccaaccgcttctccaagctgtacgtgaacagctttggcgtcttcaaaaggtattcaggctccaatctgaccttgccgaccaagaactctatcttgctgccaagatttgtctcagataatcctagaatttgtggtaacttttggaccgcagagcggagcttgtccatggagcaaccaagactgcgactcaagtactccatcctcgcggtggcactgccttcgctgatgttagcaaaaatacccaccatgtacttgaattggcctgaggtgcgtggcacgccaagctcatcggcacgccgcacaaacccttccacctgctttggattggacgtgaacatccgtggagcaaacctggccatcttggcaatatcacaaacagttagcccgcactcctggagcagcgcgatgttgggcttgatcaccttctcaaggtcagagagcaccagcacgttgttccccttcaagatcctgaggagcgtctcgaaggatcccaagaaggggatccagaactccagcctcgaggcgacgtcacacgcgtggatgcccttggcgccgcccgcgaggaggaagctgccgatctgggggtccgacaagcccacgcggtcgcgcagggaggcgatgcggcgggcgatgttgtcggccctggcgcagagcagctgcgggtcggaggcgacgacggcggcgaggtcggcgcgggagaggccgacgccggagaggacggcgagcacggcgtcgggcttggcgggcgacctgaggtgggagagcttcttggatgctttgagcgcctgggcgccggtgaggccgcaggtgtcgacgaggtactcctcgacagagaagggggtcgcggcggcggatctggcggcggtggagaggaggaggcggcggcggcggctgaggtccaaagaggaggtggggagatgggtggcggcgcgggcgcggagcagcgggaggaggtggagcatggcgccggcgaggccgccgccggccgtcggccggcagcatgagaggcggagcatgtcgccggcgacggcgaggctgggtttagcgattttgctcggcagtgtggagtgtgcaattttgggcatgttcacttcgatgcaattttcaaccataccaattttttttccaagttaaaaaaaatgtcactaaatatttctatctgtcaaaatttcggtattaccaaaacttggtaaggtttattttggctacaatctaagcaagccctttgctttttaccccccttccatcaaatatatttgtatttgttttttcaagagtaaagtgcattggtgatccttaaacttgtaagcttgtgtcatgtaggtccctaactctcaaaatatatatccaggtcctagaacttgtcaaagtgtatcatttaggtcccaaatcgacacatcccctctaggatcctacgtggcgctaatgtggcatatgctacatggacatgacgtgttattttcttttcttttttcttctttttttcgttttcttctttttcttcttttttttccctttcttctgcacgggttacagtgaaagaaaaagaaagggaaaaaagagaagaaaaaaaagaaaaagaaaaaaatttaaataggtcccatttgttagttaaaataatgccacgtcatgttcgggtagtatgtcatgttaacgccacgtaggatcctgaaggggttgtggagatttgtgaactagatgacacactatgataaatcattttgagagtttagggatctagatgacacaccccctacaagtttaaggaccgccccacctcttttttcagtatgaagattaggaaactgctcctatttttgtttcccctatgccaaaatatatttttttcaggaaaggtcagaagacatggtttctaaaatccactatgtttttttttaaaaaaaaatataaaagcactaggagtaaattgctattgccacactagggatctcaaaagacgaaagttgaaccgtattgcaagattgaagaggttagttaaaatgatagaacagagaagatgcgaataggagcatagggagatgcaaataggagcaaaagaagacgttgtagtttgattatttagggcccctttcattcaaaggaaattcataggaattttagaggatttcattactataggaatttttcctatatagtcctttgaatcaaaggaatggatcctatgaaattcctatggaatgactcttcccataaaagttttggagaaaatttaacatgatgtagaacctcatggaaagaatcctttgagtctttatctttcctcaaattactgtgtttttcctgtggctaaatcaaacaatcattcctatgtttttcctgtgttttgcaatcttctgttttatacttgcattcctgtcagaatcctatgtttttcatattcctctgttttttcattcctatgattcaaatgggcccttagttcttcaggagaagatgtagaaacaaggacgatgcatgttggagctccacaatagcatactcaacctcacatccaaagagatggaagcggtagctagacaaggatcacaagtagtggcaagtgtgtcttagggtaaaagtagtgaggattcagatcatagttgaggcacaaaagggacatgaaaaaacgacggctcgcggagtttacatgttggccataggcatagcataaatcttagcaagaaaaaaaatcaggacaacgagtgacccaaacttttgcatatttttcagttggttaaagttgttcaaccagccaattacataatgtgaaaattttgtttaccatgatttaggctaacaaaaagtctacactctacaaacaaaccaacatattggacatgactgaacttgcatgagttgcatctaagaaatctaagcaaagaaactgcaactatcatctaatccaatgcctgcacaagttgagaagtcaatagcactatgtctgaaaaccatatatcattcctggtgacttggtgagccataggtttcaacaaatcgcagcaagaagaatgaaacgggggcttttcttgcttccagcaataatgcaatatcaataatctaattaaaataaacctccaaatgcgtggcaatggcaaattggcaacccaatgaagagatctccctaaaaacacaccagatgcagccacacagggcatgcatctaa

SEQ ID NO: 38716 - DNA, 10075 bp, Oryza sativa
ctagtcccacttgtttcattcgaaccctaatatatactccctccgtcccataatataagggattttgggtggatatgacacatcctaatacaatgaatatggacagacggtctatccagattcattgtattaggatgtgtcacatactcacatccatccaaaatcctttatattatgggacggagggagtattttctttttcatgatgtacacatattgcttagagagggtacagtacctgatactgtaccttgtaggcaactgaattttcacacgacaatattctgaacttaccaatgtttcaaaataaacggtcctgtgttttcttgtttgtagacttatggggctgtgggtttttagcacttcgcagtgagagctgttaagttaggattatgctgctcacaaaaatgcttaaaatatacttcaattagcagaatatatcctttgatgatggcaaaaccggcctggatgagaccaattacagtgatgtgtctgaaataacaaaaaaatggaagcagaagggtacggtgacaacttacacaccaaccaggccaacagagccattgaaagaattgcatagaggtacaattgctaaatggtgagcagtaacactccttgtgcgtgacaaacaaagctaaatttccctctgtttggtaactttggtttcaattcaagaacatacaattttttaggtgcaactgtggtaagcaaccagtgtgttcttttcctgcatcctagtgctaaggtatctttggaagcaccaaggttaacaaactgtcacttttaagtagctaactgaaaggattaaatgctaaatgacatcataattacagattatctgacatatatactaactgttttcggtgatgaactgatcgaaaatagaataggaaataaaacgacatttgaaaaatcaaccttatcatatatttaatttgtttctcttacatgatccttcctatttttaattactaaagatccatgtgttggacaacactggtgtgctatcatgccatgcagtgtgctgccatgggggatacttcctactttctaatatacccaactatcaacgtaagcatcaacttaaggttgaaagaaaataaaaattagaaaaagcagagggaaaaagggtccagttaacacggcaaaaacccatttttctcaaaataactgaacaggaaaacagctgttgaagcaacgagccatcacatgagacagtaaagctataagggcactagggcagcaagattaaaacaatccagttgctgcataaatagcaataacttaaactacagcagaaatcaatgggtatggaaaaatacaggaccatgaatgaacatcaagtactgatcctcagagcatgaagtgttaggtcagatataggcctgaaagataattaacctccaatatatccatccaaaaatgatatagttggacttcagcaggcaccttgccgaaatgaactccaacatctcagtctgaggatgtcaaggttgcagctcaggaggcactttcccagaacaaattgtggcataggcatcagcgagcccaggaacagcattcttgtgttgatcaatgtaccttgctacgaaatccttctcccgcagtatggcatatgttaaaaagccagcattttttatcaatcccttagccaaaaggacttctacaatataatgcctcggcatcaaccgcttctccaggctgcacgcgaacaaaacaggcttactcaaaatgtaatcaggctccaacccgactttggtgaccaaaaactctatctttctgcaaagattgttcacagaaagtcctagaatacttggcattttgtagaccataacacagatattgtcaatggagcatccaagagcgctactcaagaactttgtattgatgcgaagtttctcctcagaaattgctagaataaatggctctttgcaaaccatatgaccgatcttgtccacgcagcaattaagggtgctactcaagaactcaatcttactgcgaagcttttcctcagaaagtgttataatagttggcattttgccgaccatatactcgaccttgtccatggagcaattaagagtgctactcaagtacttcatcctcgcagatgcattgccttcggtgatgttgccagcaatagacagcatgtactttaatctactggaggcgagctcgacaccaagcttgccagtacgctccacagccgcttccacccgctttggattgaacgtgaacagccatccgggcatcttgacaatatctcgaacagttagcccgctctcctggaacagcgcgatgttgggcttgatcaccttctcaacatcagctctgacaattgcgttgttcctcctcaacatcttgagaagcgtctcgaaggatccccccaagaaggggatccagaactccagccgctcggcgacatcgcatttgcggacggccatcgcgccgccggcgaggaggaacctgccgatttgagggtccgacaagcccacgcggtcgcgcagagacgtgacgcggcgggagacgttgtcgggcctggcgcagaggaggtgcgggtcggaggcgacgacggcggcgaggtcggcgcgggagaggccgacgccggagaggacggcgagcacggcgtccgggttggcggcggacctgaggtgggagatcttcttggacgccttgagcgcctggtcgccggtgaggccgcaggtggcgacgaggtagtcctcggcggagaagggggtcgcggtggcggcggcggcggtggagagaggaaggcggaggcggcgcagatgggcgtagtaggaggcggaggcatggggggaggaggggacgcggagcagcgggaggaggcgtctccggaggtggagcatggcgccgcggcggaacgccgccgtcgaggtcggcggcgggggttttgcccggcggggtacaagatggactctttctttcttttcttttctttttttttaaaaaaagtgcgcgatccaacggcccgactcatgatctcgtatacggatcgacggttgttatagttacatatgtctctagttatatagtttatgagttgcagaactgtatcatatgtttagtagtataaaaaaaatagatttatcacacgattcatacgcttttcttaacggaaaattttactaccgagcatcgtgacttcgtgattttaactctaaaacactgcacaaagtgaatttgagagaatcgactcgataaacatggaaattagctcatggaaactgcacccattaaaatatttatttctagccgggtatgagagagaactcgtataaagaaatacctttgagctcacgtatatggtctttcagtctttcggtctttcatctatgtatctcgctcaagcatatatggcactgtatgtaagcctttagtttttttttccccttctacctcacatgctcctcttgctactctcaatctcgcaagaggacggggcgaggcaaggcttgatggtggcaatagggtaagaagatgtggaggctgatcgttcaagtgttatcctctccatctctttgcatccacctccgaatcatcacttttctagttgcggcgcgtggagggccacaccatcacggaggaacgatgccgtgaggccaggatgaaggatgcatcgtgcggctgttgacagaaaacacgaggcctgggagatctgcttaactccagtgcaggtccaaaactcgccttcggatgtataagtgtgccagttgatttgatcctgtaatcaacaagaaataaaaacaaaagaaccgtggttaaatctataaatgatagccgatcggccagatgccgatgacatatcatttacgtttgagccgatgtcatgtatagatcgatcggcgtttggaaataaataaaaaaggactaaatctattcgatcggctgtagatgttaacgatgtataattcttatgtcgacatatactttaaattaagtgattgggatagatcggtcgccatgccgagacggtataaatcacttaagctgaaatatatgttaataacagaattatatatgtttacagcataaccgatcagatagatccagcatgcatcagctaatactccgatgcaactctatgctaagatattaaaacaaacggaatataccaaacagaagcttaatatacgtgagtgcaataatatcttgacatgaagggcagatttaacatatcaataaagtatatggagcaaacatagttaaatcagataagatcggctgaaactccgatgctaccctaatcggcaaccagaaagcaggctagagattgatattctaaacacgacttaatagatcaaattcaactgatgcagcattaagtatgaaaagaagaacaatatctagacaatcaagccaccggaagtttcatagagtggtagatatcttatataatccaaatcaacagcaagatctaacctgatcgactgccttttgtatgcaaatgttagccgatagtagattaaatagagatattgctaaggattatgtaagatatatgataacttggcgaattatataaacgagattagagtgtcatgaagatgtaagcactaatctatgagaacataattcgtcataacgagtttacctcttgttgaagatcgacaccgatgcagctcaacccgaaagcaagaactcgttgaaatagaataaaagtaaaaggtggcgatgcgccggaattgtattgaatgtgtgtctttaattacatagggttcggggtctatttatacccgaagattacaagatatgcccataccggccatgaccattatctctaacaaacttctaaaatatcacgagtctttgcggcagactcttgcccacacttatctataaggaatttacataaataatctaattaatagatacaattgccttctcagaactctatccatacatggcaatcatcttgaagcacatcaacccgagcccgatgtcgcgcacaagtcgcattactagaatcggctataccaacttactcagcctagctcaaccttagccgatcctagccgtagccgatccagactctagccaattcttgctctgttccagaactcgatctccgcctccaactcttctctgattaattcccttttcctgatacgaatacttaccaaatttggttgtcaacagcggcgtggagggagtggcaacctgtggctgagtcacgccaccatgaaggctaggatggagggagcggcgtgcagtgctgagggttgcgtcatcgcggaggagcaatgactcatggaggccgcgatagagggagtggcatcgccgcaacaacgtatcatggtgcccttaatcaatcgtcgacactgacaagctccttgaaaaccgtgtcattttaccatgctcctccggcatggccactaatctcctcggccgccctaacgacagcatgtccacacatcccattgtgtttggaatggctggcatctacatctccttcccctaacgccgccacccatggttgaccaccatcgagctcaccgcacctcgccccagcctcctgtaggagtgagagaaagaggaagtagaaggggaaaaaatactggaagctagcccatgtgcttgagagagacaaagatagagatgaaagacctgacatgtggacctggggggtattttagaactttcacgtgatttctctctcctattcaaccacaaatgaatattctaatgggcaagttgtccatgagctaatttccacatttatagagtgatttcccctaaaagtcacttcgtacggtgtcctacagttaacaccgcgaaagtcacgattcctgtagtgttgggatgcgaattctttcgttctgtgtccctgccgtctccatctaacagctcatccctcagatgccattgtgtgtcaggccgtcccaagtgactgtagccctctgccccaatcaccaacttgatcaccgtactcacaactgtgaggcactgctcttcaccatcgaggacgtccatctcatctcctacatcattgctatcatcaccaacaaacatatgcaagaaggagctcatgttggggttgtccataccgtactagctcaagccgccgtcaatggctcctaaattcaactcgccacctatcttagtctcagctttgcctcttcctcgctttcctcccggtggcagccccactacacgccactgtgcctcgttgcagtcacacacttgtatcattgccacacatttccttgccaccgacggtctgatctgttagctgtgcttgcactttcactgggatgcaaacgacaacgtcgtgccgtggaagagacccgcccggccaccacgttgcctcattgcctgctaccaccaatgaggctatctctcattgtgcacaccttgccaaggcaggggttgagagttgaggctgcctcgcgatgggcttgcatctagcgcgaggcaacaaagtgggacaatctcattgacgtcctcttagcaggcggccacgtgcgcgccgacaatgtccgcctacacggtgtgaatttatatctttggtgataatttttaaaaagttagtgaattggattgcaaatttcggaatgtcatgaagcttgaaattttcaagagcccctaaatgaagggtaaaatatgtgcttgtcaattatcctagctagtataaacataatagggttaaaaaaaaggagcactacccataatccataaacttccccaaacacaaacaaatcacgccgccggcggctctgctcaccgccagccgccttccaccgccttcgccatgcttcactttcgagaactcctcccgctcctccgctccgccatcgccgccgtggcctctaaccctgccagccacacactaccctctctccacctccgcaccctccgcttatggactccgcaactgcgacatcgcatcgaggctcgagttcttgatccctttgttgggctcctacgaggtgcttctcaagaccgtcaagcgaagctaccgcatcctcacctccgacatagaggaggtcatcaagcccaacttcgcgcagctccaggagtgcgggctaactgtttgtgatattgtcaagaccaacccgaggctgctctcgttcaatccagagcgaatcaagcgctatgtgcatcgtgccgatatgcttggcgtgccccgttgctcgccggcattcaggatggccgtgtgctctaccaatgaaggcagcgtcactgcgaggatggagttcttgagcaggactcttggttgctccatggacaatatccttatcgcggttggcaagaggccaactattcttggcctatcaatggataatcttcgccgcaagatagagttcttggtgactgaggttggcttaaagctagagtgcattgtggagtgccttgggattctcaggtacagccttgagaagcgtatggtgccacggcattctgtcatggagatactgcgggcgagggggttgatgaagaaaggtgcttccttatatggtttaatcatgcaaggtgaggccgatttcgttgcgagatacattgatactcataaggacatggttcatgggcttgcagatgcttacaatgcatcttgttttgggaaaatgcctgtagtgccggattccactgttaaaaagagacacgggaggcgagatatatattgcaggggtaaggttagtatcgggccttagcatctgatgcttacttagatatcaattcatggtggattctcacttctgtgtcagtcgacttccatggtagaactgtaggtgatctaagttctgatatggtgatccatgcttcaaccatcgatatgtgcaaagcagatgagctgtcttgatctgttccctgcacatatcatgtcttattgctttagcacttgagctgacagtgttcaagttgtattaggctattagctttcctttttcatatcctacttgaccaaactcttgtttacatttcaagagattggccttaagaacatcgaattaccattttgaagttcattatgttgaaggaacattcaagaggttgctctgctctgggatcagccaccacctagtttcatggtttcacgcctatgtaacatacattaacctgtcaattatatttgactattttggttaggatttgctatgtttgaaatttggaacctcctgagttacatgcttgacaattacacttgtaggtcggctttacatctagcagacactcttttggagttttctgagttgcaacagtgatagaatgtatgagctcttggactgctttcttgttgtaactttgcaaaaaaagcaaggtgaataaatttcagacattatattttctcgaagtgcatataagattacaaatggtaggatccatacggaacatgcatacatttggagataggagaggagaaatgaggaggacgaggaagactagggggcaattttgatatttcactccgtgctgtggtaaaagagtgaaattgtaatgatgtttgcgatacaaagccaaacaactttgtgacttttaaagaaggaaaacgttcgaattaccctctgaactattgcagcagtacaagttactgcttaatctaaaaaacggatacttgacacctctaacttttcaaaccggataaataaccccctggtacttttaggcggttttagctagagctagcacacatgacaccaacgtggcaaaccaatcaaaaaatctataggacccactcgtcatatctctcacccatctctttctctctgttgtgtcttgcgatgaatttggagcggcgcctcatcgatcctgcccattggagctcgagcttgcttggggaggtccccaaagggtagcggcgaggaggcctttggaggtgttggctgggggtgagctcgagcactccttagggaggtggtacttgatcactccttggtgtggtgggcagtggttggagattgaggaggtgacacgctactgccgaggagcctaggaaggggaacttgggttcatgtgtggtggccggttataggggcttgttagctccccttctcctcgaggtggtccaactgtgagaactcaaggatgtggagctagagacgagagtactagttgacaatggcgggcgaggggagacgaacctaggtgcagatctagagcggaagagcattgaccatcacttccgaccaatgtctccattgacctccccaagtgagctcaagcatggcaagcgatattggcgagttgttgcctccatggacctccccgagcaagatcgagctgccgttccgagtagccgcctacatcaccctttatgaaagctcaacttcgccttcaacgccctcctgagaagccccttcctcgccaccgcccactgcgcccacaacacccttgcgccaatacagagtggggtgatgaggctaataggtgggccctatgatttttaaaactccattactgattggattgtcacattagcgttaagtatgactgaaacctcttcgattgagtcagcgcatattttgtccggtttgagaaggttagaatgtgaaatgtctacttgtacagtgggtataattcaaatgtaccaacattttaggggtaatgcgggggtattttttccttgaagtatgctgaaaaacatttaaaaaaacaaaattacaggtccaagagaaatgaccggtctcccatatttaggggtagggggtggttagatccaggggtgtaaagttttagcgtgtcacatcgggtattataaaggttgtcgtatagggtgttagggcactaataaaaaacctaattacagaatccgtcggtaaaccgcgagacgaatttattaatccgtcattagtaaatgtttattatagcaccagtcaaatcatggagcaattagccttaaaagattgggtgaatagccaatgtggtccctgaagttttgcttcgggctcagtttagtccttgaggtttcaaatcatccaaacaagtcctccaaattaatcatttgggttaatatagtccttggacccacaaaaagtaccacgtgagcatgccaagtcatcctcacatgcaacggtatgaatgaaatgaccattctacccttatataccatatacaaaagaaa

SEQ ID NO: 38717 - DNA, 4813 bp, Oryza sativa
atacgtattaaaagttggatgcgacaggccgaaaaactttggggtggtatttaaacagggctagcgaaagatcggtttgactgctcctagcggctctctctctctctctctctctcccctcttttttaagcagccgcctttccccggcggccggcggccggcgacgccatgctccacctccggcagtgcctcctcccgctgctccgcgccgccgccgccgcccatccccacacctccgccgcatcctcctcctctctccacctcagccgccgcctcttctccaccgccgccgggcccgacaccgcgccccccttctccgtcgaggagtacctcgtcgccacctgcggcctcacgggcgcccaggcgctcaaagcgtccaagaagctctcccacctcaggtcgcccgccaagcccgacgccgtgctcgccgtcctctccggcgtcggcctctcccgcgccgacctcgccgccgtggtcgccgccgacccgatgctgctctgcgccagggcgcgcaacgtcgcccgccggctgcattcgctccgcgaccgcgtcggtctgtccgatgccgacgtcgcccgtttcctcctcgccggcggcgcaatgggcctccgcaaatgcgacatcgccccgaggctcgagttctggatcggcttcgtcggatcgttcgacaagctcctaccggcactgaaggggaacaacggaatcctcatgagtgacctggacaaggtcgtgaagccgaacatcgcgctgctccaggagtgcgggctaagtgtttgtgaaattgccaagctgtctacgctcaagtggacggtgctgtcgttgagtccagagcgagtcaaggcgtcggtgctgtgcgtcgagaagttggtcgtgccccgctcctcggatcggttcaagcacgtgctcaagtccgcctgttggatctccgaagatatgctcgccatgaaaatggagttcttgaggagcactcttggttgctccgaggacaagctccgtgccgcggtctgcatttcgccacatattttctacctgtccgacaagaacctttgccgaaagatagacttcctgatctccgaggttggcttggagcgtgagttcattgtggaaaggccttgggtgctcggctacagcctcgagaagcgtatggtgccacggcattctgtcatgaagatcctgaggaccatgggattgatgaaggatgctgttgacttcagcagttcacttgtttactctgagaaaaaattcgttgcaagatacattgatccttacaagcaagcagctcccacgctcgcagattcctacgctgctgcttgtgccgggaaaatgcctgctcatgttcaccgttgaatgtagattttcccaggttcgtcctttatctgatgctaattgctagcattgtgccttatgttgttatgctcatcactaaatgtttattcatggcaaattaaatattggcttttatccgtagaactaatggtcatccggagtactcataatgtgatcttctctttatgtttcaatcttggatatctgtatctcatgttatgttgctttcttttacttgagaagcagcgattgagcagtatcattaatatatgtaactcttctagcattttctgcttcctaaggatgtgccctgtttttaatcagatattggctttccttattgtgattatctgcacggttgtgggcttttggcatgggtaatttatatagggatgggacattccatcagactatcatgtagagctggtatttaccgaatcatcatataaagctggtagctaaacataaattaaatatttatgcttgatgacaaactgatgtagtgctgtacagattttgaaaggctaggagctaagaatgactaatgttgctaacttgctatcaacaacaacgtgggaatcctttaacctgttgagtcttgtaatatcattcctcaaaatattccttctgttacaattttgtcctaattactacaggtgggggattattttcgtgtttattttcctccaaagacccaatttgaaaattcagttattagttgatggccccttctgttggtggcaatgtggaaataacacttccaatattatatttgaaaaacccattcttggtggcaatgtggaaataacacttccagtattatatttgttccattatctacttttcttctgttgaactgttaattgcttaaactctcttttacattatttctctaatccaatgtggtcttaatagtttccattgttcatctctaatctttttggaaacatgaaaagaatcgatcaaactaaatatatagtaatggtcagttaagtgaatataaacatgtggcaagctgtttgaacgaggtaactcattcatccatttcaagatgctttcaaggaacctcaagatacttggctgacattataacttttcatcgacattgtttgtaccttctttttgtgcgtgtattttgttgtgagatgattttttttgaattgttcataaccatttagataacatacaggaaacgagtgcatgtgcacttaagttataaattgacttcccccttggtttttttttctatacatgtagcattatacatcttgtttcttcaggttgctgctaatatcttgtgctgttttttgaggcgggctacagaggaggcaagcttgtaggtataccttatcgtatgtgttacacaaatttaggctgttctcattcgaaggttggttatctgttgcatgaactgcagaaaccttccaagatgaccaagcatgtaacatttgatcgttttgctacctaggatgcatgtttgatgataaatatgatagcaagttccttgatcaagaaaagaaaaacaacaagaagaaagcaagttggggggccatgcatcaactgttgtggtgaaatgatgttcctgtatttttctccccattatctgataagtaaagagtataataaaaaaaaattgtgatggaagatttgacaatctgtctgaaatcttggtgtgaaatattcatgggctccaaattcaaccttggaataccattacgtttttcctaaaatcaggttatcagattttcgaaatgtctgagttgatgtggatttttttaattcatattaatattaggcaactatgtgatagcataatgcaataaaaaatataatttgaaacaactgtaatggagacattttgaagatgtcgctgtgtaaagccccaacgataaagttattgttgcacgtaaaaccaacaacttttcagttcatgatatatgaaaattattcgcctcaaaactgtgggttggcagaatatagaacacattgttaaaacactactgtaactgtttgtcaacgttcaacaatctctcaaaattttcaaattgaagtacaaatttatgaggaaagagtgtgcagatcccactccttccaaaaaataaaaaataaaaacaccccgctctagaaaagacaatgaaaaacaggcataaacaaatatgcgaacgtatgggccgtatttgcacaacttacagggctagtttgatttggagccaatttaacgtatgggccgtatttgcacaacttacagggctagtttgatttggagccaatttttgccctaccaaaatcttggtagcgctaaaacattagcaaattttggcactaccaaattgggtagtattcaatttgaactattgtgagtaaaatttggtagcaaaccaaaatatgcacttgctactccctttatcctataatataagatatggtcaaacgtgacatggtctccaaaactaatttttatcttataatttcttatatattataagttttgtagtaaaaaagttataatcatatgaaagtaaattcaaatgtcaattcaatgatataattcttagcaagtaaaattaaattcatattgtaataaatgttggtcaaaatgtttttaaggttaaatcttaaaattcatggtagcattatattttgggatggagagagtactattgaagttaccaaatttttttttgggagagtaataaattggtatcaaaccaatcaagcccatagttttgctttactgcgataatctaaaatgttgcgtcatggccaatttgatgaatttatacaggaaataaaactttccgtcaaactatgatgttcacctgttgtttgccaaatcattgtgtaaagtcaatagctaaacataaaccaaagttttatacttggtacctgatgttgcgctgctggagattttctgaggctaggaactaagaatgatagtgtcccccataaacagcaacctggggatcttttaattatcacctttttgacatgtattaaataaatcaaggaacatagcaggaagataccctttactaacctactatggagtcttgtagtatcaccctcacgaaaaggggagctaataagcgcacgattcttgatgccttatttgatattctgatgatgcatggatttcttacattcagatcgctctttccgttggtgtccttgtacgtaccatgtcgatttccttgctttgtgggacgctttctccacgacattcttgcatccaggaataccagatgtgccctccttggtagccttctagtttagggcagtacactgccaagtcggcttatgatgctctctttcaggggcaacttattttaggtccttgcctccttggggatgcatttggaaaagctgggctcctggaatgtgtagtttcttcatgttgctatgttgtgcaccgcggatcgtttggaacattgaggttttccgcatcctgattgttgactttaattattttagataatggatttttatt

SEQ ID NO: 38718 - DNA, 8720 bp, Oryza sativa
cccaaactcccagtccgttgtcacccctagggccaccgccaccgccagggtccacatttcttggaaaaaaaactcagtcctctgccgcccacactcccagtcgtttaatgtaatcattttgtaaacaaaaatctaataaaagctcttacaacaaaaatctcgaaacattaaatgtaatcaattggtagttacagaaaaaccaacatgcaatccaactgtgccacgttactgtaagtaaaagaaattttgtaaacaattattttattacttgcatcattttcctatttgcactgaggtggtgtttagatccaggaacttaactttagtccctgtctttagacactaatttagagtattaaatatagactacataaaactaattacataaatgaaagctaattcacgagacaaattttttaagcctaattaatccataattagagaatgtttactgtagcatcacataggctaatcatggattagttaggctcaatagattcgtctcgcgaattagtccaagattatggatgggttttattaatagtctacgtttaatatttataattaatattcaaacatccgatgtgataggaacttaaaagttttagtccaatctaaacagggcctgaaggttgaattcacaactgctttcgaagttgcagatgacaactagtagtcttgaatgtggatgtcaatttatttttctcaacccgacagaacagctgaactgctacatgattttacagctagtgtagctaaggttagttcaccaaacaatatggccactatcatccacacttttgctttttacctttttactggtacaaatcacaaacatatcacacaactttttctttctttctttgtacatttgtttcgaaaaaaattagtacaggctagcgcaacaacaggaccaacggatcctattctcttcaggtgatgaacagcaacaatttcgatcaggataacctgtaaaatcaatatacaaccatatccaatgttttctgtaccaattcggcgaaaggaaccgggcactctttcgccgggttgcaaagaattcgatttcagcagccaatgtcgaattcattctgctcggatgaaaggagaggagctcatttccgtggtgctgtagaacgagtcttccccgccgccatacaagttctcctctttctcatcctcccaccggaggatctccctcacgtacttgaacgcctcgtcgaccgtctggcggtcacgggcacgcgcctgccacacgaagagcttccggcccgtgtgctcgtagtacaggtccttgaacttcaccgctacgtagtagtacgcctgctgggcgagcgactggttgttgtggtgtgtccgcaccggggagaagtcgttgaaccactcgcaggtcgttagaggtgcgcggttgatcttctcctcaaagaggtcatacttgttgagtaccaggacgaaaggagtatcgcagaagcatggttgcctgattgtcaaacagcagggaatatttaattaaaaactagctgactagttcaacagaatccattcgagaacagtttcccatttaattattgcattacccacaacattattgccacatcgttcttgactcagttactatatccgaaatcatggagttgaaataaacttaattgttgtactagttctagaaaaacttgattatgatactggaattattacttcatccagtatttgtgaggttaagaattgccagatgcaggagtggagaaaagacaaactgtactatagagaaatgtaccctaaaagttcttagttttcaatgaaaaatagcagcttaccgaatcgtagcctcaaataactctttgctttgcatcatcttgttcaagagaggccgactgctgccatatacaggaggtcccacttggtcatagtcactgagggctacagagaatatcaccatgcggacatcctcaaacatttccacccacttgcagccatcattcatgcccttggcacttactctaatcaactgatatctgaggagcaaaacatataagaacattaagtgcacatggctgagatcgatttgcacatggcatgaagttaagagattacttggtaagaggctgggaatgtgcttcagggttctcaatgtaaggctcagacatgggactgcgatcatcaagggcgaattcaatgaaagccaacccattcccttgtgttacaccttcagcaaagatcacatctttctctgaaggttcatactcattgctcgatacctcaatggcctgcaaaggtattccatgtataggagaagtcagttgaacagcttgaaataaaaataaagttaactgcacatgacaaaaagtagttttgccaacatcaaaacagcaacaatgaagaataacacgtaatactgcaagataatggggggaacataattttggtttcagtaatatttgaaactggggaagggatttccttcctagcttcaaaaaacaacaaagcaaggagataagcaatccttgaaatattcaaagatggcatcaccagaaagaatagatacagttttctggatgagccaagctgttaccattgtaaataaataaagaagacaagcatatgttctggactagtaatcttttttgtaacaaatagtggtaatcaaacaaatatacttcaatgtgaataatgaagcaccatctctagcaacagtggattatattaataaaaaaaatcaaagatcgtaccctgctcaagaagtactcagcaacatcaggaaggaaatgcaattcgtcctttcttttatatgttgcttgtatggcaggatccttccacatctcatcaacaaatggagcgtattctcgcgttgcggcagggaagaaagcatctagatcgcccatcgctatgatatccaaaagccaatctgagaatttcttcagccttggatttatcgagtatatacaggaatttgaaccatttgctttattttcatctgcagcccagaaaccagttcagcaatacagaattgctgcagaaacaaacaccggagcaaatgaattgaccattttaccttgttgggtttcttcatcctctgaaattgtgcaatttgatctagataaagcttcttcctcaaagcgttcacgaccctcaagcaaaattccaaggtacttgaacatattgctttggataatcagtttgatgttttcaagttcttcttgggtgaatcttgtcccgtacaagtacttagcctggtacatgatacccaaaacatcatcagcatgaccatacaagaattagtatcttagaaaaattgcaggcactactaccaggtagatacaacaaaactactactgagagtcgataatgatgtgtcagaaatcaataaaaacttccaagttttatgctaagaacacaagtccggtggctattggctacaacataaaaacaactcatgccatctctgctctgtgggaagtatctgaagcacacaaacataggtcgccagctacaattaattgatttctacatcgctcaaaagtattactacataacaaagtaatctcatacagatccagttacagtgaattacagagagatagagaccaatcaaatagcaatgaaaatcataagagacctgtttaaaaattgtgcttgtaccagcaccatctggtccaagaagcagcagcttttggattcttttctggtccaaataatcaggaacagttcttgcagaatagtgaacttcatctctcgtttcattagagttcccaggaggcaccggaagtgaaaataatgcgcatgcaaaacgtgtcaaagcctgggaataaaatgatcattagcaacaagcaaatttagcttttaagtttgaggaaatggcaacggactctaatttattttttaaccgagatacataccgactcccagatttttcctttgatgttgttctgtccttcttcctcatagcgaccatcatcataaacccaaaaatgagtatcacgaggacattgaacatttgcaacctacaagcacaattccaatgatgtgacaagcattgcttattttgtggtaaaagaaatctttaaatcttggccattgattcaagggcccagtttagctaaaagaaagcattcaccactagtgccatttagtagcccttgctaacaggaacttctggtcgatgaactaaatagcctgatgtgtaatccttttccattatctaacaaataatagcatgctatctggaatgacaaacccactgcatttagtgaaacttcctaatttgtctaagctgtgaaaaggattacatttagtgaaacttacaaataatagtaagcatgaaaggtgagacttttctcaaaaacgaaggttatggttataccaaaagtgaccattttttgcatatttatagtataattaattggcaagttatgttacagttaatggttgggtatttttattttgaatatttcaaattatataaaataccccttccaagtgtagtggttcatgacctatataaataactgtgtcaaaggtactaagcaattgggaggcactaattttatcattcatgcttttcaccaaaaggactatctacaagcagcttggaagaataaagcatgatcggctaatagcgagaagcagttctaaagaaacagagatggaaatcattggtacctttagaattttcagctcaatctttgttatttcccttccatttatataaacttgggtatttccgttactggcgttagcctgaagcttcccagtaaagctgaggttagaactaataattctttccggtttttctccttcctatcagaacaaaacagttttatcagcacaaaatcctgttaaacttataacaagaaaattgtgtccgtatgctcataatgaatttacctttccccataaacctgactccttgtcataccaatactttccaggcttcagcttctgaggtggccgggagcaactaagcaggtctgtcagctcatctggccccagtggacaaccattcacaataagttgctccggccgaagctggtttgcttggcactccttctcggctttcaatatttgccttacttccaaggggctaagtaaccttgagagtgtccttgagttcttccctagctttgaccgcttggactcatcaattggctggccaatgcaagtgacgcacttgcgcccttccggcatcgaccccatcatcctcagcacacagtagccgcagtacctcgcatcgcacacgatgcacgcttccttgctctcccatttcctcttcccacaccgatagcacgccctcctcctcttctccttcttggtcaccaccacgtactgctcggacatctcctcgaactccttgctctcacacttgctgtccggcgtgaacccgaacgtcaccgtggcgcctctcctcccctcctgcgtccggcggctcctatcctgcggccccggcgagctctgcgctgaatcatgcgacaacgagcgggaatcatcatcatcatcgtcaaactcctcattctgcagtaccgaattgaccgaatccgagctgccgccgccgacctgcgccgacacgggctcggcgcaccgggcaatccgggacactgggagcgggatgggctccacaaccggcaaccctcctccgttcccaagcctctgcgggccggacaccggctccgccgtggggatctcgacggggtccaccctaggtaggtcataggccaccggtgggccgtcgtactctagggctatggagtaatcgagattcggcggcgcctccgggatgggggaccccggcgggaggatcctcctcagcatgtcctcccagctgcccccatccaccgcctccgccatagctgattgatagctcctagtactgcctcgttgagggatggagagctgacaaggttgaatctttccggaggggaagcgaatcgggggaatcaaaatccaatctttccaccaccaaactgaccttttcagagaggagaagaaagctcatttcacggtaatccaaacccgcggctgcgaaatgagggcggcggagggtggatctggaggaggaggaggaagaagggaagaagggagaagaggagaggagaacgtggaggtagcaggagaggagagcagttagcagtatgcctagttgcctaccaaaacccactttaccaaaacagcagtaaaaatttcacctttttttttgtttgtttgttcctagtactaaccaaattaacctgagttgatggattgattgatcaaagctgttgttgtatataaaagggagatatgagaccatgagacgaagggagggctcgctattagagcgagtataataagatgatgtaacaacggggagctaggagttagagttactatattgttaaatttgtttttaggctgtgtttagattggcccaaagtttagaatttggttgaaattggagacgatatgattgaaaagttgtatatgtatgaaaggtttgatgtgatagaaagttggaagtttggaaaaaaaaactttggaactaaacatacccttaatggtgtaactgcgacgataactttattatgagtttatgataggggtgtcttttcaggtacggtgagtaaaaatggttagattagattttcagtttagatgacagcgtgagagagtagataagcggtgagttagaaggattacaatgagaacaaaaaatctagcaaaatgagtgggggcgatagatgatgagtatggtcggtgataaggacaagagagacaatatggttaggagcacgggatggcgtggcggatccgattacgtaagccatctaaggcaaggcgagataaaactcactaaagttgataaaaaggatggtgatgacaacatagaggagaatgaaaaggagagtaaagggagaaaggcagagaagggtgtagttagaggggtacaccaatgctgacgtgtggaggtaaagtttttcgtcatgataccgttagagcaaatgatgtcatgagatgggatcaagaagagggaacgataggctaggcataggtggttgcactagcacacaacttgataacaacataatttgagcatttttaaataacaaatagattattataaatcaagaaattagcaataaataaacatgtaatattttattcatattttgtcacataatttaacatgtatctaaaacatctctagaatggttgtcgtgttaggttgatgaacgtaacttatttatttgttaacatgcaaaatattgtagggaatttattttcagatatgctaaccgtcataaaagaaatttagaaatttaccatatatatttaaaaatcaattcatttcaagatttgtgtttggatcttcttatgcaactttattgacgttatcgactaaagatctcattgcgttaagtctttgccaagttaatgtagaaaaacagaagagggtcacaaaccttaagggtagatgttggtatgaggtggtgattgttggtttcaggatatcacaacctcctctataattgtaggaaagaatggtctattaaaacgatagagaagaagcattgctccttgttgatgccgatggtgacactggtaaggagctcgatggtggtaagtagagagagggaggtgttgtgtggagggtttagtattgatttataaactatccctaaagaaattatcttctgagtattagatgtaatacgtaaagggtgtatcaaaattttctgcatagaaggaagagcaacaaataaagatggcaagaatgacaaccatgttcgatgagccaatagtcggtttcaaggtaaccactaactattgttgtggtaatggcaattgtatctattttatcatattagattagcttctgtaaatgaattgttgtgctgacacaccagtattaattataatgacgtgttaaattattcatataagacacgtaaactttccaaatacatctgtcaccacacatgaaaataacaaaagaaatcgaatatgtaatggacaattaagtactaatagataagaagaaatatttgaagactaaaaaaaatgctcgtgcgttacaatgggtaaatgctattttaattttattattgttatacggtctcgctagggtaaaattcattgtgggaattctcttgaatattttttttagaaaatcatgagctgcaattaggagtctgtatttcatctcaagttagcatgagtttttttaaaagagatttcttatacggctccttttgtatttccaaaagcaaacaagcttaaaatccaactcaaacacggatatgtatttgtaaaagcgaataaacttaaaaactaactcaaacacagatgacgtactaaaataccgataaaacatcttcaatttttgtaacggtagaaacacagacaacgtactaaaataccgataaaaacatcttcaatttttgtaacggtagagaagagatatggtgtgtagtaaaccaaacttgcaaggaaccatgaaacactgttccaactcataaggagcacggtcagagaaggttattgggccaggccagcaaaaattaggcccatcgtccgatcgagctgggagctgggcctatgcgcccacactgcatgcaagtccccaaatgggcctgatttttcactgctacttccaagcttaaggtcaaagtagagattgttttctttttatagttattttttaaaagatttaaaaaataaattaccgttttaaagtttagggctgcaggaat

SEQ ID NO: 38719 - DNA, 503 bp, Oryza sativa
tactacctttcagatagcgcattactcgctcaagcgcacgcagtgatcatctctcggattagaggtaaaccggctcaacttgctcacagcaaaggagatatcaggcctagctgcactagccaggtacatcagcgagccaatgatttgggagtattccagttaattcctagcaattctattgttcttgcgaagcaacaagctagaatcataaagttttagagaaggcttactatcaatgtagccaaagcgattcaagatcttctccacataatgggactgcaagagtgtaatcacattctcacctctaattagcttaatgtttaagataacatcagctactcccaaatcctcatatcaaaattttgagacaagaataatttaacctcgtttatcacctcaaggttgggcccaaatatcagtatgtcatcaacatacaaacacagaataactccctcacccccaccatggcgatagtacacacatttatctgcctcattgactgc

SEQ ID NO: 38720 - DNA, 1986 bp, Oryza sativa
aaacaattagtactacaagttataatcattcacaaagtattaaatacgagccaaatctataaattctacaattacaaattatttcatcaccggaaaagaaagcaaattattaagccattagtagtatatgactttattgcacttacatattcatgatttagtgttggcacgtaatcttccaaaaaaaatcatgtatgaatataaatatttgggtacgcattggtaataaaactcacgccacacccgttaatacctcgaattttaatacctcgaatttgggttgggcatacccataagcacaaaatctaacccatgcctatgcccatcggctgcagtacccgtgggtacctagaccaatgggtaaaattttcatcccaattttcaacttgtactccttcattttccgcgtgcacgctttccaaatggttaaacggggtgtttttttgttaaaattttataggaaagtttccttagaaacatattcaagttttttagcgaatacttaattaattatatgctatctatcgctctgttttatgtgccagagggaaaggtttcccaacccctccaaaagaacataatcttagactaagtttgaactaattttttagcggcacgtaaaataagacaagtcattaagtaaacaagacaaacttgaaattaattaattaatttgttttttaaaaaattcccatatggtaattttatacatgaaatatatcaattagcagcttgggaagcttgctcgtggagaatgaggaaagaggcgttgcaaaatgttgtttagaactcaaccttagtctcatcatgcgggtcaatgaatatataggcttaatttgatcttcgaacacatgggatcgagctaaatcttcagagaaagaaagaaagtatataacagttgaaaatatggagggctattcatcagtcaattattgatcattcttctgaacatggattttttttgtatatgttgttagttaatttggtagcagccgttgatcttctgaacaaacaaactgaacttcttaggattcctagaaaggagaaacgaaaaggaaaaaaaaagaggcaaaagcacgatgcattcggtttcagttggtctgtcgctgttcttgtggtacaagtttgcgatgctttgaggagtcggattattaaattaaattaagaggaccacaaaagtttagaacgctcactggcttctctcccttcataaaagcagtgacggatctagaaacaaatatcaagatctaaataaattagttaaagttaaagttatagtcccatttctatctatatatagaaaaaaaattagtagggattaggtggagactcccattatcctcgcttcaaacttcagtagtagagaccttgggagtcctcgtcgctcctatgatacatccgctcctacctttaaaaatatatcttcaaagaaaattgtcttgtagatagaagctttgttttgcaaagaatgtttagtggggtcattaaacctctttaataccatttctacattttctttgttctagccattggaccaagagatactctatcattttcctcgttaaactatctcttgcgtaagttacttttaactagctaaaacaacaattttttattagagacgttattagagacgtatagagtatttagttaacataccctcccttacttttgtgcttcctgtttacacctaaatttggtatctaggatagaaataggaaaagattatcaaagtttggagttctgccggtttcctccagagagggccggtctgatcgccatgtgttggccggtctgaccgccatgtgttggccggtcagaccggcggtgtgtggccggtctgactggccgagttcgagtccggggctgtttttgtcggatcttgggtttccttactcgggaaggcatgtttcgggtttcctttggattctatcccaagttggacgtggaggagggcctgtagagggcaagaccaacccctatata

SEQ ID NO: 38721 - DNA, 4626 bp, Oryza sativa
atttcacaattttttttaataagacgaacggtcaaacatgtgctaaaaagtcaacggtgtcaaatattttgaaacggagagagtactatacttgcaatgttggtgcatgtgtgtgtttactgtatctaagacaatccgatgtataatagcttagaccaaattcgtgggactgatggtcgaataactttcatcctcaattcatctataacgaacaatccttttgcgagacgtcaaaacctagtttcgattatctcgatgatttttacatcttcaatatatataataccatgctcatgcattgcaacagatgactcatatactaggacaagatccaacttattttttaaaccaactctttttttttctatttttctttctaaccaacaatttgatttttttaatggttttctgaaccaactcatttttttctatttttctttttaaccaacattttaattttttaatggttttctcgagtatggtgtggttgtgcgtgtaatgtgagagggagggatgtgacgacgtgtagtgtttttacagtagtaaaaacaattatgtacttttggttggtctgattttttttcctcaactatacagttatacaattagttaaaatcaatccttcatctccttagaaccgagtataaattaaaagttccttatgcttcagaaaaaaaatctattgtgtgcttggcaaaattaaccaaaaagtaactatctctttgtgtggaaatgtatcaaccttttgaaccaaaatctgcaaccttatgcaaccgattatacaaaatacaacagatgcttcacgtcgaggcttttctaaaggcccaagttctcaagatactattttgcaacaatgcaactttacttgcttagcaagggacaagctagagttagcatgtggtctcaattacccacaatcagagctaatgatctagtgaatacattagtttcaatttgtacctgtgtactactctaccaaccaaccaacatatggccttaatttgcttttgacacaattgactcatgctagctactcatattctaaattataggagtattattattaaggttgaaatcaccaatgacctttgttggtctcattagccatcaaatggatggaaccttccaatgaagatcaaactgggattctctgacaatatccagttaaaaggatagcatcaattaaggaagaggttagttggtgatttaattaactgctagatgtttaagttaaactatgtatgagtaatccagattgttgccagtaaactagggttagcatccaaccaactctaattattattaaattaatgttcataataatacaacagggtacgtggtacacctgtaagtcttaggatggatggaatatcatgatcccagcttgcctgttccatgtgagcataattccttcacccaactacatgcatgcatatattatatgtgtgcttgaaatacttcaaaaaactattagggctcataaacatggagctcgcttgatcctttttctactgaaaagaaaattaatcagctatatgttggctacagtggtagagcctattgggtataattttattactaaatctatggttttatataaattcaacgctaaatctgtattttggtgttgcactttttcgaatatagtttttgtgatagtttgattaaagtatatgtattttttaaaaaataatcaattccaaatgacatagtatagctctacatatgtaaaaaaacatgtcgggctgatatgtctcaacttaaagaataaatatcttgtaaatatccatactaaatgcatctaaaacatacatttagtgccattgaaagtactttcttgttagaattttaccatgttctacaaaatatatcaatatatcataatataaatttgtgactaaaattttatttctaagaccgcatctagtgcattatgacgtgtttttgtgaccataagtattcgacgcgcgagattgattggctactcagccctcatattaccattaaccacaacaaaacaccaacaaattaggatgagttctttcccccaagttcccaactcatttccctcgttttccgcgcgcacgcttttcaaactattaaatagtgcgtgttttgtaaaatatttctatacaaaaattgctttaaaaaatcatattaatctattttttaagttcttttatagctaatatatacttaattaatcatgcgttaatctatcgctctattaagcgtgcggaggggaggggttcccaaccagaacacagccttaatcaggccaccaacaagcaacatgtgccagctaggcttggaaatgaaacccccaaaagtacaccaaaaagggccccaccacaaaacacaaaaccggtactagctgggaagtgggaaattctatttaacagtccggatagacatccacccacaggagccatttgtatcttagttcttgtttttgtttttgactcttttgcattacttcctccaccctaaaataacaagttttacttcttgacatggctattaagacatggctattaagaaaagtgatagatgaggtataagctaggactataataaagacgagtgacaataagaatagtatggatagtttagtgataaaatatgtattttacaactacttgagataaactttgaaccctataagttattatattttgcgacggagcgcgtaccatgtggacattacaatggcaatacaataatagataaacattgtcaactgtcaaatcctccccttggcccttgggacccccatggccttaagctttgcaatcatgcaagatcactttggttttttccaacctagagagaagccaaagggatgaggagattctccatgattctaatttagatcgactatctccatgattctaatttatgaacatcctttcttcttccccttagtataggcggtccaaattggtgtgcctaaaatgcaggaacttcaaaggaaacaattttctttcatattaaaaaaatataacagatacaaaaaaaaaaccaccatgaatttgtgatgatttagtcggaaatggttctcagtcggtcgaaaattttccatatttaattaattattcagtgacgactataaaacctcaccgacaaaaaatagaaaaatcagattttgtatttggctaaaatcggaaacggtgccaccaccgtttcatctctacatgattggtttgcactcactagaacatctgtggagcctgtgctcagccagagtcagcgctaagtcacttggaaattcggaatgaaatgcataagcatgaggtctttgccttgttggatgccggagcatggacagtggtccatccatggtcagagtctgtgccgttggcccgggagaaacggctgcacgcctttgacaatatgaggtgaccaattctccggtttgtgtggatcagatgatcaagtgatggtatatatactggagtataattcaattggcttgactatattcgaagtaacagattgataatgttatagattgatactccctccggtcatctttattagacgctgagagagctataagtataacttttccgtcgtcaaataaaagtgactgaaaggagtatagaactttttttagaaaaaaaaatttgtagattggcattgtaatcatatgagtggatgcaaatggagcaaaggaaggatgatgcagtgaattatgaagaataataataataataagacaaaagtagataagtaaatatgatatatttgaccagttgatcgatgcaagcagtaagcattttaattagttcatattttttttattaaagaagatcatatgtaggccccctccaaaggcaaacttctctagcatatctacagggtggcaaacaaaatcagatcctaaaatgtcaatttaaatgattgcaaatgaccagtttttcctactaaatgtatatactaactactagtcaatttggtcaaatttttgaaagtttgagtacacatatatggtttacatggatgggatatacaaagttctcatgggcagagacttgccttaaaaaacaacaaaatataatggcaaaatttgctataggacaaccaaaaaaacgtgtaattagctaggagacaccacaagaacgcgtttttgctatagggcaccgtaaaaaaactggtaattagctactggacaccctcgggattattttattataggaaaaagtacgaattacacccccgaactatcgtggtcgtccgaattacccccctgaaccacaaaactagacattcttcaccccctaactatgcaaaccggacgaattacccccctcggttcaatccacggtggttttggtctacgcggcgtaagcgtggcagtccagtcaacattgtatttataaaaaaaattgcgggacccacgtgtcatactcttcatccctctcttctctctctgtatgcctcacttttcctctctctctcacgggtgggtcggcggcggcgggcgaccacgggcggcgggcggggccgaagacggcagcgagcggcgggtgggcacgaggctggcgacaggcgggggcggaggaggaggcggggggcggcggtcgaggagccgaggccggcgatgggcggtggcggagaaggcag

SEQ ID NO: 38722 - DNA, 10283 bp, Oryza sativa
  unsure (1)..(10283): unsure at all n locations
tgagatagagaggaaaagtgaggcatagattgagagagagaagagagagaggaagagtatgacatgtggatcccgcaaatttttttataaataaaatgttgactggactgccacgcgtacgacacgtagaccaaaaccaccatggattgaaccgagggggtaattcgtccggtttgcatagttgggggtaaagaatgtctggttttgtggttcaggggggtaattcggacgaccgcgatagttcgggggtgtaattcgtactttttcctttattatatccggaagaattggagagagaaacagctgtgtaagtacagatttaccctttgaatttttttctttttctttttcttttttcttccttatccttttctccctctctcgttctttctctctttctctctctgctctcaaccgtcgccttcaacctcgcccgcggccgccgccgctcctcctatgctcgcccaccgtcgccgctccgccctccgcgctcacttgctgtcaccgctcctcccaggctcgcctgccgttgccgctcctccttcgctcgcccactgtcgccggtgctactgctccatggcttcatgtccttcatgcccagcacggtgacgtagacatgaacgcgctcagccactcatcagtagccgacggcgaccattggcgcgaacgcggtgccgaacgagcagtcagcggcggcctgcgatgttagctaaataatgcaatcttgtgcatctagtttctgtagttgcattgcatatgattggctgtgttagaatctgtcagcagccgttttactttcagttagcatgtagctgttttctagctagtttttcggttggactgaattggatcgtgggatggcacggtcagtagtggatccagatcaatcgggtgttttttctgttatgcatgtaacaaactctgtaattgaggagaataattagaaaaccagaaaagcagcaaggtacttcgctgtgccaaaactctgctcgttctactctgttcttcagttaactattcatatattcgacaaaaggttcagagattgtgagagtgagagtttgatcctgtaaaaatgagaccgtgtgcttcacatccaccatcgtttcttctcctctcttgctctttgcttggtgatgagaatgtaagatgtgtttaagcccgtgattagtgaagactaactaaagaaaatgtttagcggcccacgttggattaacttgagccaaaggcaaactagtttttaatgattgtttctctctcctatttctctaaaaataatcccgccggtgtccaatagctaattaccagtttttacgatgccctacagcaaatacacgttcttacgatgtcccctagctaattacacgtttttcagatgtcctgtagcaaattttgccaaatataatttcatcggcctttcgtagtcaataaaaattcatggtcacataagtgtatttcggagaccaattaagttatcgtccaaagcaacaagtatttgtcaccaaagatagcattacttaatgaatcatagcatgtccttttgcgaagaacatatatacgtacctaaagcttattaacaaaagcaaaagtcatgcattcgatgagtccgtttatagataaaaggaaagacgagaataaatcccatttttccacaacatgtacttttttaagaaaattaaatatgatagcaaaattgagactaatccgcatctagtcatctaccccataaaaggagagatctccctgtcatatacagcactgctatacatacgattgtttttatacgacgtttgtacgatgaaacgtttctctcctaacttctaacgtttttttagcgatgaaacggatcgctcccctgttgagcccatatccaaagcccaagctctgacgtgctggtctgctctctcgttggcatgcttgcgtagccaaccaaagcaatcttctttctagttatatattaagcaattttcgttctaattatatcttatatagtaattgtacttagcgctcatttgttatgtggcaggtgaagcaaattactcatacatatatgttccttacaccttggacagggatagcatcaggggttgctagctggcgcgcgcgcgccagttgctcccggcccatcagccctatttttctttttttcgcgattttttttcgtttttcttttgcgatttttttcgcttttttttccctttttttattactttttttaatctttagcacacttatttttttaaaaaaatgttttgagttgaaagttttcaaatctcgatttgaaagtttttaaatatgagttgaaagttttcaaatcttgagtcgaaagttttcgaatcggagtcgaaagttttcaaatctgggatgaaagtttttaaatcttgagtcgaaagttttcatatttttttcaaatcttaacttaaaaaatttcaaatctgtacttgaaagttttcaaatcttgagttgaaagttttcaaatctcgagttgaaagtttttgaatctcgagttgaaaatttttaaatctgagttgaaagttttcaaatatgagttgaaagttttcaagtcgaagttgaaagttttcaaatcggagttgaaagttttcaagtcggagttgaaagtattcaaatctaggttgaaagtttacacatatatggaaaaattcggaaaaaagaaaaactaaccgtgtcttgccgcccattgggccgtgtgggctggcgcgtgcgcgccgccggtgcgtacgcgccaattaggattcatggatagcatcaaccatagttggaagtagaatctaatggccacaatcagaattggatgcagaaaaagtttatatatatatatatatatatatgaaccaatgttaaacaaggtttgcatatgtttagatacagagagactgtatagtgctgctcagcatattaattgatgtcacatggtaacgaagcagaacttctttcaaacatattccactcttttagtcatgagatagaaggacaaaaatatcttcttttcccttcagattagacagtaaatttagttagattgaatactacctggtagattattttaatataatctcaagtataatataatctcaagtcagatgctgcaaagaggttaattgggctttcgggcccataagcgctcctgccacgtgtgcgtgcgccgtgcgctcgcgttaggttcccctgccatccgcgtcgttatgtttgatcgtacaaaaatcggaagaaaaaaatcgtatgcgtagcattttccatgtcatatatatgtgcctagactcaagtggatagattcatgcccctattgcaagtcttttggagcacatatataacccagctcaataagttgatttttggcaggttcaaataagtccatgcgaatgggataacaacatcatgtggcccaccgaagtgagctttgcacgaacctgaagtccagagtatgacttcagcttttctatccaacaacaatatacatgggtgtactgtgtacaacgccatgcaggcttcacattctccttttgatttcagatttatccaatctcactagctacctcctatgtacttgtttccactttatatcgcagaaattgcttggttcttacaaacggaggaggactatatagaaataaaacatggtacgagaaacaaataacaaaaataaaagaaataaacatggtacgccaaagagaagtatccactatgcaatataaaatctactgaaatttgttagttttgaatcaatcaccaacatctatactatacgttggacattgcagaaaatagtccaatcctataatttgaactattgataagaaaaagataagcaaatgcgagattacatgagtaatagttgggtctttgaacggtccatgtttgataagaaaaatataagcaaattgaggttacataaatgctagttgggtcaaaaggaaatcctaagcttagcaaaagcaacctagaaaagaacaagaagaaaaatgaaaggactagaaagtgcaataagattcttgattaataaaaataaatcaaacttgaagattacgtggacaaattatccctaccaagttctccacataaacaattttgtcaaatttgaattggtcctagttgttgactagcatttaagtagctttaaacataaataattccaaaaagatagttcaaattcccgccaaaacaaagataataattcacattaaaaacacgtcgacggagaaaaaaattcctactatcctattaaataaacaaactgtttaaccccaacaaaaatgatctaatcacagaaccgcaaaatagctacttctgaatcattatcatcctcgtcagcatcagtgagctagagctgctaagaggaacatgaggacatgcatgaactcatacgcattggccaccccatagcatggagcacgcactcgttttgacttattttttaattaatttattattaatcaatcaattaaaacttcataccacacacaaacagaaaacattaccccaaaaaacccataaaaattaaaccgaaaaacgcccaaaccaaaaagataaaaaaaaaacccaacgccccctctctaatcaacccctcccctaaccttaccaccacccaaagccctacccgccccactcacacccacgtgggccccaccacccctggccccacgtgtcagcgagtggcagcgcccgtcacccccgcgttcgctgtgccttcccccttaatcaaatccagcggatatttttgacgtccgcaaggacaaagtctcgccattttctcctccgttttgttttttttttcgttttcttttttcttcctcgctttctctctctctctctcctcctctccctcttcttcttcttctctgccaaatcccatcgcgaaggcgagagagagagagagagagaagaaaaagtgaggggattaacaaactcgcgagtttttcttttttttttttgtttattgtgtgaatttggcccacgtcggcggcggcggcggaggagctaaaccctagccggaggtgaggtggtggtggtggtggtcgggaagtggcggcgccggtggtggggcgggggggcgatttggcgcgcgcggccgagctccggatcgccggatttgtgcgtgagcgcgtggagtttgtggcggtgtgctcgtgttgctgttggtggtgaggtgtgaggtgaggtggggtggtgtggcttctgctgctgctgctactgctgctgctggtgcttaattttgctcgggttcgtggggttgggaagcgagggatgcgatctgggaggtgttcgggagctcggtgttgcttaattccggtgctggtttgcggtggtgcgcgcgcggcttcttctcggggtggatttggtggtggttttttttgttgccctcgttgttgcgggtggatttcggggggagggagagtttgagggatgactgctcgttcttgctcaattccggtggatcttacggtggaaggatggcgagctgagtaaaggcgcgcgatatcttgctgcggtttgtgcggagcttcggagcactttgtcattgctggcaaggatgatgccgtcggggccgctcaacccgatgggtcccgggcagccggtgggcgccgccgcctcgctgctccggacgagctcaagcctgcttagtggtggtcagcaggggatgggcagtggcggaggcatgattccttcgcagtcgcccttctcatcccttgtgtcgccgcgcacgcagtttggtgctaatggcctgctgggaggtggctccaatgtttcctccctgctcaaccggccgtttgggaatggtggacatatgctcggtccggggttgatgccaggtggtggtgggattccaatgaataccctccagcagcagagaggagggcttgatggtgctggcgatttggttggcgtgggaggttctgatcctctctcgtttccttcatcgtcgcaagttagtttgggcaatcagctgggttcagataatctgcatcaaccaccgcaacatcagcaacaacaacagcagctggatgctatgcacgacttgcagcagcagcagcatcatcagcaactgccaatgtcttacaaccaacaacatttgccaccgcaaccaccacagcagccacaggctacagtgaagttggagaatggtggcagcacaggtggggtcaaattggaaccgcagatggggcagcctgaccagaacagctcagcccagatgatgcgccatgctagcaatgttaaaattgagcctcagcagttgcaagctctaagaagtttgagtgcggtgaagatggagcagccgacttcagacccatcagcattcctgcaacagcaacagcagcagcaacatttgctgcagctgacaaagcagaaccctcaagctgctgcggctgctcaactgaaccttttgcaacagcaacggatattgcaaatgcagcagcaacagcagcaacaacaacaacagattctaaagaatctgcctttgcagagaaaccaattacaacagcagcagctacttcgccaacagagtctaaacatgagaactccaggaaagtcggccccttatgagcccggaacctgcgcaaagagattgacccattacatgtatcatcaacagaacaggccacaggcaagtttttgggttattcctaacaagtaatttagtgttatgtgaaggccatgcgcttacagtttagtgtctctatttgttccttttggtgcaggataacaatattgagtactggagaaattttgtcaatgagtatttttctccaaatgctaaaaagaggtggtgtgtatctctctatggaagtggtcgccaaactactggagttttccctcaggtttgatgtgctgtttccgacttgccattttttaatctagaatatagattatcttgttcatatattttcttatgcaaggaagttctgttctattatttaattggcaggtgcagagtagtgacagtgcctcacattttaaatttcctttcaaattgttagttgaagttctctatatttgcccttgtaggatgtatggcattgtgagatatgcaatcggaagcctgggcgaggctttggtaagcattattttaatttgcacatgtttctttgtcaattctgtttttacatccacttatgccactacacctttacagagaccacagttgaggtgttaccacggttgtgccaaatcaaatatgccagtggtacattggaagaattactatatgtggacatgccacgtgaatcgcagaatgcctctggccagattgttttggactataccaaagctatccaggaaagtgtattcgagcaattgcgtgtggtacgcgaaggacatctaaggatagtttttaatccagatctcaaggtattatatttttaatttattatttgtctttttttttggttactggtgggcctttaaaattagttgtataataaatggtgccttttgaactaaagcatgtttccttttcttgaagatcgcgtcttgggagttttgtgctaggcgacacgaggaacttattccacggagatcaataataccacaggtatttagccctatagctatatagagatttttattcaagacaaatgtcttatttcaatattctgatttttgggcaaaatgggaaagggttcaatatattttgtgacgcttggtgtttctaagcaggttagtcaactgggcgcagttgtgcaaaaataccaaagcgctgttcaaaattcgacaaatctgtcaactcaagacatgcagaataattgcaactcgtaaggagattttctctgatgccctcaatactttccatgttcagtttattgcaaaatcattaatgctttatccaccttgctccgatatgcatatttttgtgttcttttgaaatttatcttatttgcaattgcaaagaagccgtgtctactagtgtaaatacttttattaactctatgctagcgtgagctgtcttccaaaatgggacgtagcctctgtctcattcttcgagttcagggccaagctgtacaaatagttaaatactagtattccgtagcctaaccatttagattttgtgtcatagcactagatagatttgcactatataatggatgtacatgaattttcagttagaagtcaaatggtagtgtgagggcatacacaatgtggaagaactccgatctggctcctctttgtatcctgccagttaccttatcttttgcattctggttcgatgtctatatcccccgtaagaaaattgacattatgccgttgtcaaagtgggtttcactggaatgccatcctgcaaatgggtttcgttaaaatgtcattctcaaatagggcaacacaccacaatgccatttcttccatttattctcaatcaaatgaattttgccctgtttttcttgatgagctgaccaaaatacgtcacgctcgttctctctctctgtctcgctgggctgtggctgccgtcagcaatgcggcgccattactgagctctggccaccccgcatcaggaaggatgggaccaacgccgttgtgcacccaccgcacgccaccgcactctcccgatgaggacagctggcggcagagctccatgaggatattcgcgcacgagcatgatgaggttggtggcgtgcaatggagctggaggaggccactgctgcttgaggaggctgcggtggcgctgaaggaggccgctggtgcgagagcttggggaggacaccggcatggaagctggaaaaggccggtggtacgggcggcgatgcaggagcttgagttgttctcctctgtttctgcctcaatccatggcaggtgcaatttcatcaattgaagttgcaaaagagggcaaaattaaacaaatgaattaaaaagggatgaaatggcattctagcaagtagctaccatttgagagtggcattttagcgaatcccacttaagagatggcatttcagtgaaacccacttttgaggatggcatgtattcaattttctcattgcctgcagacttgtctgttggcttgatgctgccaccagtaagcttgagaaagcggagcagcagcagcagcatgtgaagaggtgtcgagagtctgagaaatacataggatcatgagatcaggactttaggagaagatgaggcgaagaggatgatctcctgggttcacttgagagaagagatggctgttgatctggtttgggggcatgatttagggaaggagggagagggtggagatatgggcttgtagattgtgtgtctgagtggttactagtagtaggctgccctgagtaggtgcgaaaataattctccgagaccaagtctctgtttacaccgtcctcaaaacatgacaggtagacataactgccatctacaagtagttaattctagagtacgttagtgctttgagtagggtctaaacagagacctggtctaggattattgttgtagcgggacttttttcctttaacctgttctttttactggctataattggtatatgatggattttcactgaatataactactgctaattgctggctaggcacctgcctagtgtccaagtgcccccaaagtgccaaaacacagtgctgtgcaaatggcgtgaggcatatgtggttttctggtccactggttgagttcctcatggcacggtagttttgtactgtactctgtgatgtatgcagtcctgcatgtaattctctactgaactacacgcattcccccgaggtatttcgattaagacgcatccaaaactgtggccaaggaaggccacggaagaaggtcctacatgcatacagcctttctgcatgtagtagatggaaatttacttatttgaaacattctatggaaatttcatttatttctttttctaattggatctctgagacaaattatgcctgataagaaagttactattgaggagcacttacaatggtctagttagaaggcaagttagagcagcattattcaagtagcgtaacatgtggaattaacatattttgtgttacatattttgcatgtttgacatgtgcattaacccatataggcgaaatatctattaaaatatatagttgagactacagaatgagatgttttacaaatatacaacattcttttaatgccactgtagtgtgtgaaggcgttacgcaaaacaaaggtgtggggataaccactgaattttgaaggtttgcgacccagtgattttggataagtttagctcactgaccatcagccccctaaaaggttnnnnnnnnnnnnnnnnnnnnnnnnnnnnnnnnnnnnnnnnnnnnnnnnnnnnn

SEQ ID NO: 38723 - DNA, 6994 bp, Oryza sativa
  unsure (1)..(6994): unsure at all n locations
attcctgcagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccgtgccctctatcgcccaagcgccgtcgccctccaatccgccgctgccgccgccgctccggtcgccgctagccgccgtgccgtcgacgccgtcgcgttcgccgtcgtgcgggccgtcccgtccacccctcctccgttggaatccgccgccgtgcgccggtgagcaccgccatggccgccgtcctcgccctctcccattttcctctctccctctaatccctctcatcttgttcgctaggtggttccggagctcgtcccgccgtcgccgtcgccctccatcgctcgccgtcgccgatcgtcgccggtgaggcccctgctcccctttctccctctctcccgcgccgcttagccgccgcgccgccgcctagccacttagccgccgctatcgccgtcgtcttccgccgccggccggtcgccgcctcgcgtcgccgctgtgtgcgcgccgcgccgccgcgcgccatggccgccggaccggcttgagccatgcccgcgggcgccggccgcgagccgcatccgccgcccgatctaccgggcggtagatcggggccgtccgttcggccgcccgcgtggccgccgcgtcggcgccacgtcagcgccacgtggtgcgccgccccatccccggtccgtggactcggtccaccgtgaaccaccctccccgagtcactgccatgtggggcccgcatgtcggcgccgcccctctctctctcccgggatttatttattgcgcaataattcaattaaggatttttctgtttatagtaaaaacacagtgaatcttctaaaattcatatctaattcatccgagctccgtttaagcccgttcaagtctcagtaaatcaagaaaaatgtgtagaatccattaaaaatggttttgttctctgtttcagtagtcttatagcctgtttgtattgtttgctttgtatgtcgcttagattccggctctcccgacgctccggtgtacttcgaaatagtcgccgaggttcctccagctgcagagcaaggcaagtcatgcttgtcacttgaacatgttgatcctatattgcaaatgctctattgtttttcttcaaatactgcattgttttataatattactatgggatgtttacatactgtcatagccatgctattttgtaccatgttcctttgttagcttgggatataacatgactagagattggattagagagtgcttagccatgtttagttcaactagcacgcaatgggggaaatcatattaatgtatagactgtaggtcctaatgttaatgttggattagtaccaccgtcctggtgttgcttaattaaaataaatcctatggtgggctattggtgcatggtttgctagtcgcgcccatggcacttaaggaccggttcgcgggaaaccctggaagaattcctcgtacttaccacaagctagcgtgggcaacggctgggcttgtagtgtagctttcctctagccgacgcatccaggcaagggtgggcgtgatggagtttggatgggccccgcgacggcctatgcggcttccggattcacctaggcacgagaggagactgcccactgccttgcaaggagtgggggtgaaacctgaggtgtggtgtgcttggttagagggggttatgcgaagggtcctgtcacggcctctttccggtatgtcgtggtggcatgtcggcgcatggaaacgtgtcgtggggctgtgtcttgtgggtacagttgtacacctctgatcagagtaaaactattcgaatagccgtgcccgtggtcacgggcggtcaaccagattcaccgtgattagtctcaccctagtgtagtctgttggaactgattagttcaggtggatggttgggcctgttgcaacgtggtgtagcgttgaacagtggatggttaatattgattaattattacaactgttttacttctttcaacttctatttataaatgtccgctttatgcaaatgaaccattatagctatcccttgataattccctgcatcatacccctattccggtatgacttgctgagtacagagggtagtactcagtcttgctctattttccccaaaaccccagagtttgagtatgcgtcagatggtgccttctccgaggagtaggcttcgtccgtgccgtcgaggatgcctgtggagtggtgttcccgccgcggtgcaagtcaaggcttagctccagttatctttttattttccgctgcatttatataaaacttttataatgtttgtaagacgtggatttgtatgtcaactttgtcgtttgtgtaccccggccggtcctagacggggattttaatgcacactctgcttggaattctatttgggaatttctgggcgtgacactcctcaggctatgtctctggatcaatcaaacgatctcttctacacttggcaagttgatgaaggtagttggacttggttcttccaatgtggtgcataggagtggtgtcaaatccaagagtcttgtagagccgaacgggattctcacagggaaatcatgagatgcccttccagccccagaactgcgaccaccacctctcccgcgacctcttgtattaggggcatcacttgaccactgtcaacatccctaatctgaacaggacggttactggattgccttgtaaatctaggagaagtacgagtgccactgccactgccgccctcaaccactttctctttacccaaacgaccacgagtataccgaataggaggactctcatcaccggacacatcctgagaggctttctgtcttttctcacgagtcatagtacatactgcaacaggaatcaataaattggagtgcagtagttaggcaaaatttgagagaaacaagaatggcaggctagctggacagcgcccggaggttccgggtgcaagaacaccggaacttccgcccggcaaaaatgaagaacataggtctcaaaaatagccagtgcatgtgaacaaatcctatagatcggtgatctacaaggtagcagaaacaagactatccaagtggttttctccctaggttcacagatttagagatcgggataaaaacacaatgaaccgagagagggaatcaaaaagtgctaccttgagagaagaaactgcgaatcgatcacagaaagaacctcccagccaccaatgtggatgaatccacggagaagaaacgaatttgattggatgaaagtgaaaatcgccactaggagcactttggcggcgactagggctggcggtggggagagagaagaaatgaggagagagaatacggtttctaactccccctgagtatatgtactccccgacaccaggaggttccggacagggaggcccggaacttccggcctgacagataaagggcagtcaggcccaaaaacaaggaagagatgagaattcaacgaggagaaatagggaactatggacatgcatagacttatgacgtatatgaccagccaacaatcaacattacataaccatggtcaatatacatcacaagaagggaataaaagccaaattttcgcaataaaaggcactcaaaggattttgcaaaaattttcataaaagggtttttggatatagggggaatgtttgagctttattcctggtatcaagaccatcttctaccaagaagtgatctcaaggcaaaaaagctctttttttttaatggcaaaatttgctacagaacatccaaaaaacgtgtaattagctcgtggacaccacaagaacgagaatttgttgtcgggcatcacaaaaaacgtgtaattagctcctggacactcggggctttattttattattttctatgaatttggagagaaaaacaccaaataaagacaagtttacccttgggtctcgacctggacaatgacgacgcattgggttggccggcggcggcgacggagccgaacaggatgcagcgcttgtgttctgtccctatgatgggtctgagcagcggcggccatcgccaggatgctccgcactgtggccggcgtgcgtgggctcatccccttggtatggagctaaccgacgtgttgatcgacgacaccgacgcaatgtccggcgaccggagaacacggcgcctggtacgtgggcgatggtggagagttgtgacgtcgcggagctgctcctcgccagcctcgacaccggtgtcccattctcccaccgtgtcaatggcagctgcttcgcaattgcaagggagagaaatggggatcaaacaacaattcatcagcatgtattatgaaagtaaacactgcaaaaatatcaaatgttcagttcaattagtacctgaacaatctcactatccgggaatttcctcacatccttgccgagcggcgcggcgccggagccgattaacttgagagagctgagatcatacttacctgccctcccgtgcttggtgagcgcgataatgaccggcggcacgcagaacaggtgcgtgacgcggtgcctctgcacagcctccatcagggagttgatgtcgaaccgcgacatggagatgatggcgttcccgcgctgcagctgcgcgtatgtgatgacggagaggctgaagatgtggaacatggggaggaagtagaggaacacgttggggccctcccagcgctctaggggcttgtttgagcccgttgagcgccttgtggagcttgtacatatggtttggcaactttggatcctcgaaccccggtggttgctccacatagactaactccaagaggggtccattgagaaaggcgctcttaacatccatttgatataacctgaaatcatggtgagcgacataggctaaaagcattcggattgactcaaggcgagcaacgggtgcgaaggtttcaccaaaatcgagaccctcgacttgggtgaacccttgcgcaactaaccgggctttgttccttacaaccactccatgttcatcttgcttgttgcggaagatctacttggtgccaatgacattttggtcgggtctctccaccaatgtccatacttggttgcgagtgaagttattaaactcctcttgcatagccatcacctaatccagatcaccaagtgcatcttcaaccctggttggttccaaagaagagacaaacgaatagtgttgacaaaagttagcgacacgagaacgagtagttaccccctttcttatatcaccaagtatgttgtcgacgggatgatctctttggacaatgtgatgtattcttggatggtgcaccgaggggacatgagcccgatcaggatgctctacagtgccctcggcatcaatcccatccacttgtgccgtaggcacgccttgactatcctttgcctggaacttcctagcagatggacccagaacttccgggcctggggaggtccggaggttccaatcatctggtcccggaacttccgggtcaactgactcttgacttgttgtagggctattggatgtcgatgacgaaggttgatccctatcttcttcgtcatcctgcgtcttgactggtcgtatgtctccaatagccttagaatcaattgcttgtctaggatccgcatcatctacaacatgtacaacaacttgctctccttgggagccattagattcgtcaaatgtcacatcccttgtaacttcaacaatactggaggttttgttgaagacatggtaggcatgtgcatttgactcatagccaagtaagaatccctcgtccaccttacgtgagaacttagatgaacgaggcctcttactcaaaatgaagcatttactcccaaagacacgaaaatatgaaacatttggcttcttaccactcaagagctcatatgaagttttctttaggattttgtggaggtagaggcgattgatggcatggcatgcggtgctcacggtctccgcccaaaagatatccgaagtcttgtactcatcaagcattgctcttgcggcttcaataagagtttggttcttcctctcaacaatgccattttgaggaggatcataggggggtggagaactcgtgcttgattccctcttcatcaaggaattactccacgtgcgtgttcttgaattctcctccactgtcacttcgtaccctcttgatggtgagattatagaggttttggccttgcttggcgaagcgcttgaagacatcttgagcctcactcttgtcatggagaaaatacacccaagtaaagcgggaaaaattatcaacaatgacaaaaccatacttgttacctccaatacttatgtaggccacgggcccgaataaatccatatgtagaagctcaagagggcgtgttgtagtcatgatgttcttgataggatgtggattcccaacttgtttccaggcttggcaagcactacacacataatctttctcaaatgtgacattagtgagcccgaggatgtgttccccctttagaagagttgccaaattccgcattccaacatgggctagtctatgatgccatagccaacccatggaagatttagcaatcaaacaagcttccggattcactctatccacatcgaaatcgaccagatagagatcacccttcaacttgcctttgaatgcaacggaggagtcatcccttctaaagacggtcacatcctcatcggtaaacaagcaattataacccaacttacacaattgagaaacaggtaataaattgtagcttaatgaattgacaagaaaaacattagagagagattgatcattggagatggcaattttacctagaccaattacctttcct

SEQ ID NO: 38724 - DNA, 895 bp, Oryza sativa
cgacctgcaggcatgcaagcttccccgtgccctctatcgcccaagcgccgtcgccctccaatccgccgctgccgccgccgctccggtcgccgctagccgccgtgccgtcgacgccgtcgcgttcgccgtcgtgcgggccgtcccgtccacccctcctccgttggaatccgccggggtgtttttgcgccggtgagcaccgccatggccgccgtcctcgccctctcccattttcctctctccctctaatccctctcatcttgttcgctaggtggttccggagctcgtcccgccgtcgccgtcgccctccatcgctcgccgtcgccgatcgtcgccggtgaggcccctgctcccctttctccctctctcccgcgccgcttagccgccgcgccgccgcctagccacttagccgccgctatcgccgtcgtcttccgccgccggccggtcgccgcctcgcgtcgccgctgtgtgcgcgccgcgccgccgcgcgccatggccgccggaccggcttgagccatgcccgcgggcgccggccgcgagccgcatccgccgcccgatctaccgggcggtagatcggggccgtccgttcggccgcccgcgtggccgccgcgtcggcgccacgtcagcgccacgtggtgcgccgccccatccccggtccgtggactcggtccaccgtgaaccaccctccccgagtcactgccatgtggggcccgcatgtcggcgccgcccctctctctctcccgggatttatttattgcgcaataattcaattaaggatttttctgtttatagtaaaaacacagtgaatcttctaaaattcatatctaattcatccgagctccgtttaagcccgttcaagtctcagtaaatcaagaaaaatgtgtagaatccattaaaa

SEQ ID NO: 38725 - DNA, 2802 bp, Oryza sativa
catggcccttaaggaccggttcgcgggaaaccctggaagaattcctcgtacttaccacaagctagcgtgggcaacggctgggcttgtagtgtagctttcctctagccgacgcatccaggcaagggtgggcgtgatggagtttggatgggccccgcgacggcctatgcggcttccggattcacctaggcacgagaggagactgcccactgccttgcaaggagtgggggtgaaacctgaggtgtggtgtgcttggttagagggggttatgcgaagggtcctgtcacggcctctttccggtatgtcgtggtggcatgtcggcgcatggaaacgtgtcgtggggctgtgtcttgtgggtacagttgtacacctctgatcagagtaaaactattcgaatagccgtgcccgtggtcacgggcggtcaaccagattcaccgtgattagtctcaccctagtgtagtctgttggaactgattagttcaggtggatggttgggcctgttgcaacgtggtgtagcgttgaacagtggatggttaatattgattaattattacaactgttttacttctttcaacttctatttataaatgtccgctttatgcaaatgaaccattatagctatcccttgataattccctgcatcatacccctattccggtatgacttgctgagtacagagggtagtactcagtcttgctctattttccccaaaaccccagagtttgagtatgcgtcagatggtgccttctccgaggagtaggcttcgtccgtgccgtcgaggatgcctgtggagtggtgttcccgccgcggtgcaagtcaaggcttagctccagttatctttttattttccgctgcatttatataaaacttttataatgtttgtaagacgtggatttgtatgtcaactttgtcgtttgtgtaccccggccggtcctagacggggattttaatgcacactctgcttggaattctatttgggaatttctgggcgtgacactcctcaggctatgtctctggatcaatcaaacgatctcttctacacttggcaagttgatgaaggtagttggacttggttcttccaatgtggtgcataggagtggtgtcaaatccaagagtcttgtagagccgaacgggattctcacagggaaatcatgagatgcccttccagccccagaactgcgaccaccacctctcccgcgacctcttgtattaggggcatcacttgaccactgtcaacatccctaatctgaacaggacggttactggattgccttgtaaatctaggagaagtacgagtgccactgccactgccgccctcaaccactttctctttacccaaacgaccacgagtataccgaataggaggactctcatcaccggacacatcctgagaggctttctgtcttttctcacgagtcatagtacatactgcaacaggaatcaataaattggagtgcagtagttaggcaaaatttgagagaaacaagaatggcaggctagctggacagcgcccggaggttccgggtgcaagaacaccggaacttccgcccggcaaaaatgaagaacataggtctcaaaaatagccagtgcatgtgaacaaatcctatagatcggtgatctacaaggtagcagaaacaagactatccaagtggttttctccctaggttcacagatttagagatcgggataaaaacacaatgaaccgagagagggaatcaaaaagtgctaccttgagagaagaaactgcgaatcgatcacagaaagaacctcccagccaccaatgtggatgaatccacggagaagaaacgaatttgattggatgaaagtgaaaatcgccactaggagcactttggcggcgactagggctggcggtggggagagagaagaaatgaggagagagaatacggtttctaactccccctgagtatatgtactccccgacaccaggaggttccggacagggaggcccggaacttccggcctgacagataaagggcagtcaggcccaaaaacaaggaagagatgagaattcaacgaggagaaatagggaactatggacatgcatagacttatgacgtatatgaccagccaacaatcaacattacataaccatggtcaatatacatcacaagaagggaataaaagccaaattttcgcaataaaaggcactcaaaggattttgcaaaaattttcataaaagggtttttggatatagggggaatgtttgagctttattcctggtatcaagaccatcttctaccaagaagtgatctcaaggcaaaaaagctctttttttttaatggcaaaatttgctacagaacatccaaaaaacgtgtaattagctcgtggacaccacaagaacgagaatttgttgtcgggcatcacaaaaaacgtgtaattagctcctggacactcggggctttattttattattttctatgaatttggagagaaaaacaccaaataaagacaagtttacccttgggtctcgacctggacaatgacgacgcattgggttggccggcggcggcgacggagccgaacaggatgcagcgcttgtgttctgtccctatgatgggtctgagcagcggcggccatcgccaggatgctccgcactgtggccggcgtgcgtgggctcatccccttggtatggagctaaccgacgtgttgatcgacgacaccgacgcaatgtccggcgaccggagaacacggcgcctggtacgtgggcgatggtggagagttgtgacgtcgcggagctgctcctcgccagcctcgacaccggtgtcccattctcccaccgtgtca

SEQ ID NO: 38726 - DNA, 1091 bp, Oryza sativa
cccctttcttatatcaccaagtatgttgtcgacgggatgatctctttggacaatgtgatgtattcttggatggtgcaccgaggggacatgagcccgatcaggatgctctacagtgccctcggcatcaatcccatccacttgtgccgtaggcacgccttgactatcctttgcctggaacttcctagcagatggacccagaacttccgggcctggggaggtccggaggttccaatcatctggtcccggaacttccgggtcaactgactcttgacttgttgtagggctattggatgtcgatgacgaaggttgatccctatcttcttcgtcatcctgcgtcttgactggtcgtatgtctccaatagccttagaatcaattgcttgtctaggatccgcatcatctacaacatgtacaacaacttgctctccttgggagccattagattcgtcaaatgtcacatcccttgtaacttcaacaatactggaggttttgttgaagacatggtaggcatgtgcatttgactcatagccaagtaagaatccctcgtccaccttacgtgagaacttagatgaacgaggcctcttactcaaaatgaagcatttactcccaaagacacgaaaatatgaaacatttggcttcttaccactcaagagctcatatgaagttttctttaggattttgtggaggtagaggcgattgatggcatggcatgcggtgctcacggtctccgcccaaaagatatccgaagtcttgtactcatcaagcattgctcttgcggcttcaataagagtttggttcttcctctcaacaatgccattttgaggaggatcataggggggtggagaactcgtgcttgattccctcttcatcaaggaattacgccgagcgtgcgtgttcttgaattctcctgccactgtaaaaacccccccctcttgatggtgagattatagaggttttggccttgcttggcgaagcgcttgaagacatcttgagcctcactcttgtcatggagaaaatacacccaagtaaagcgggaaattatcacaatggcaaaaccatactaaaaacccccaatacttatgtaggccacggg

SEQ ID NO: 38727 - DNA, 1423 bp, Oryza sativa
actccgtgccaagataagagttcttggtgaccaaggtcggattggagcctgactacattttgcgaaggcctgtgctctgcttgcgttcagcctggagaagcggttggtgccgaggcattatgttgcagaagcccttgctgtgaagggattgataagaaaaggtcttgacttctaccattgtgtatgtatgcgcgacgaagtttttgtagcaaagtacattgatcactatgaggatgctcttcctgggctcgctgatgcctatgctgctgttcgtgctgggaaattgcctgcacaagtctaactcaacatcttcggactcatgttgcaggtctattatctcccggcctatatagctaatgcaacacttcattttctgaggttatcagttgatgaggtaacatctattttcaaatcttgacatcaacggtagaactacaaacaatctgattgttgataatgctatgctggttgaagtcatggatatttatgcagcatctcgattgttttaagcttgctggcctagtgcccttaatttaatgctcatacgatgtcttgtttctttgacaactattttcttgttctcgtactttgagcaaacagggttctcgcagtttttcatgcttcattttctccccctctgcatttcctaattccgatttatctcaaccttcagttcatgtttacgatttctagatagtagtccacatgacgccacaatgcatggcctggttggctgattaagcaccgatgtagtcttaatcattcttgaatggtcaaatatcatggatatcctcttattgaactagaaatgccatgcattcagaatgaaaggaaatatgataagggtaatttttcgaatgctcctttccctcaatctcttattctttatttgctcattactgaaaaagaagaagttatgtatgtctgatagtctgtatcgttctgtcatctagcactaaataagccttccaattatctacttcaaaactacagtatgataaatttgatgcttcgaaagttagctttgatgcctgccataattacacctaaccaattttaagctcaaatgaattaggccgagtttagttccaaactttttcttcaaactttcaacttttccatcacatcaaaacttttctacacacacaaacttccaacttttccatcacatcgttccaatttcaaccaaacttccaattttagcgtaaactaaacacacccttaattgatgtggaagttggaacaggatggcattgccttggttgctgcaacagatggcatctgccaagctccttgtgccgcgccattgtagagactagaggctggggcgcgccagtggcgcgccgcctgtggacagctcaaacagatgcataattggcgtttgtctatgattagtgaaaatcaatgttcattaatatctgta

SEQ ID NO: 38728 - DNA, 1007 bp, Oryza sativa
tgttgtgatgtctccttatcatccatcacaaattttccaagccttccttccaataattcaatcttggcctcacgaacggcgggagatccctcatgagccaattgcaaattatcccacatctccttggccttctcaagtccatcaaccttgttgaactcatccgaactcaaggcggagagaattgcattggaagcttgggcattgcggtggatgagtcgctcttgctccgaagtgagctccatgtcatcatggggtatatcaatacctgtacaaacaactttccaaatacttggatgcaaagagattaaatgcaacttcatcttgtgcttccaagcggcatagtatgtcccatcaaattgaggagcacgcccggaaggcacggagacaaagttgtgagagggaatggtaagtttgctgtaatcaaaaggtatagtagctcccttgtgtggtggagttcccttgctgcttgcttcatcttcatttctattttccccgttctttccccctaagtcttcatcttcaaagcggtgaagcttgaatcaagagcactaggctctgataccaattgaacgtgcagagatgtagcctagaggggggggtgaataggctttcctgaaattttctcaacaatcgcagcggttaaattgacagggcccggaacctcctggtgatgaacaccggaacttccgggcaggatgagtagcctagaacttccggagttcttgagccagtaacttccggacagcagggataaattgaaatctgagaagaaaaacgggtcctaggtagaaagatcaggcgcacagatgcacaagatgaagatcacagaatatcagcagattcaaacaaagaacatgcacaagagagacaaagaagattttttcccgaagttcggatcacacagatcctactctccgttgaggtgctccaaagagccgggtctcgattaaccccttgccttacttatgcaaagatctcagaagaggtccacagccttcaactcaaca

SEQ ID NO: 38729 - DNA, 1149 bp, Oryza sativa
ggtggagcatataagtcatactcataggtctttagtaagcttcctagaagattcacccaaaatctccatagactgcgaccaacagtcaagcctacaatggtgagttctttcaagaatgctctgcaggacagcatcttcgttaattaaagccaacagaactcattaaggcatagccaacctgccttgcagctcacgacagtacatgcatcttcacttagagagggtataaattggtactctcctctagtttactaatggtttgttcttcccagattctaattcacgggatctccgatcacatagattgggttaccaccatagtaaaactcacatgggtctcaaacccatctccttcgatgcattgtctatcacatttcgtgatagtcccttcgtgaagggatccgccaggtttctagctgtttggatgtaatccaacgttataactccggagtttctcaatttcctgacagacttcaatcgtcttttcacatgtctagacgatttcatattatccttagaactattcactttgacaattaccgtttgattgtcacagttcataaggatagccggcaccggtttttcaacaataggcagatccattaatagatcacgcagccattctgcctcaacagtagcagtatccagtgctgtcaactctgcttccatggttgacctcgtcaaaatggtctgtttgcaagacctccacgaaacagcaccaccacccagtgtgaagacatatccactagtggctttgatctcatccacatcagagatccagttagaatcactatatccctcgagtaccacaggatacccagaatagtgaagccacaattccatactacctttcagatagcgcattactcgctcaagcgcacgctagtgatcatctctcggattagaggtaaaccggctcaacttgctcacagcaaaggagatatcaggcctagctgcactagccaggtacatcagcgagccaatgatttgggagtattccagttaattcctagcaattctattgttcttgcgaagcaacaagctagaatcataaagttttagagaaggcttactatcaatgtagccaaagcgattcaagatcttctccacataatgggactgcaagagtgtaatcacattcaaacatgg

SEQ ID NO: 38730 - DNA, 1209 bp, Oryza sativa
gcggacttgagcacgtgcttgaacttatccgaggagcggggcacgaccaacttctcgacgcacagcaccgacgcctttactcgctctggactcaacgacagcaccgtccacttgagcgtagacagcttggcaatttcacaaacacttagcccgcactcctggagcagtcgcgatgttcggcttcacgaccttgtccaggtcactcatgaggattccgttgttccccttcagtgccggtaggagcttgtcgaacgatccgacgaagccgatccagaactcgagcctcggggcgatgtcgcatttgcggaggcccattgcgccgccggcgaggaggaaacgggcgacgtcggcatcggacagaccgacgcggtcgcggagcgaatgcagccggcgggcgacgttgcgcgccctggcgcagagcagcatcgggtcggcggcgaccacggcggcgaggtcggcgcgggagaggccgacgccggagaggacggcgagcacggcgtcgggcttggcgggcgacctgaggtgggagagcttcttggacgctttgagcgcctgggcgcccgtgaggccgcaggtggcgacgaggtactcctcgacggagaaggggggcgcggtgtcgggcccggcggcggtggagaagaggcggcggctgaggtggagagaggaggaggatgcggcggaggtgtggggatgggcggcggcggcggcgcggagcagcgggaggaggcactgccggaggtggagcatggcgtcgccggccgccggccgccggggaaaggcggctgcttaaaaaagaggggagagagagagagagagagagagccgctaggagcagtcaaaccgatctttcgctagccctgtttaaataccaccccaaagtttttcggcctgtcgcatccaacttttaatacgtatataagtattaaatataagctaaaaataattaatggtacaaattgtgactaatttgcgagataaatcttttagggtgaatagctaatatggtccctgaagtttctctttgggctcagtttagtccttgaagtttcaaatcgtccaaacaagtcctccaaattaatcatttgggttaatatagtccttagacccacaaaaagtgtcacgtgagcatgccaagtcatcctcacatgcaacggtatgaatgaaatgaccattctacccttatataccacatagaaaagaaagaaaaaa

SEQ ID NO: 38731 - DNA, 13704 bp, Oryza sativa
gatctttcccgaagtaaacttcagatataccgtgtcaacaccatgaacagaagcatgtgacccattccccattaggacggtggaaccccgtgcgacctgataagaagaaaacaatgagatgtcagcacaaacatgtacattggtcccagtatcaacccaccaattagtagactgattaactgaaaaaacagtaggtaaattaccatacccgcttccatctccagtgttgcaaatggtcacattagcagacttagaagtctgccctgcaggtgccttcatccccttgcgctgtggacacttcctagccagatgaccaggttggccacacacaaagcaagtcctctcatcctgattaggattgttgttgttcttcttctgcttcttgaagttggtggtctgttgagctttgtatttccccttgttcttgttctaggccttgtgcacaacattggcactggactgcccaccatcgcccttagacgcaacatctttttctcgagctttctcctcaacatcaagagacgctatcaacccctcaacggagtattcctgtctcttgtgtttgagtgcagtaccgaaacttctccaagatggaggtagttccggagacctgctctcccgatcgccggtgcacgccggcgagcgggatggagtagtttacgagcgacggggcagtacagagtaggaggcaaaccctagattgatttcgcgtgtgttgcgtgaaggcggcggctcggtttatatagagataggtcgcttgatcagggcacccgcgtaacgaaccggataagtcgcgcataacttatcaagactccacgccgttttcacgcaccggattttttggaatgtttccaaaacaaaacaaatccgaatttcccgcagcaaaacaaaactgcaaaaggaggctgcatctgcgcaagggtgaggagccaattttgcggaccattcgacgcgtaggcgagcgagcgcgcgcgtgtgtttcccctcttctctccaccatacatgcttcaagtggctaggagggcatcctcccttttaaggaggtccccctctcgtagaataagtaaggtggtactaaactccacatgcatgctatctcataaggtgggcttttgtgattttccaaagaattaatcttcgaatgggccttagcccaactattaattctaacatctccaccagtggaagcagttgtgctctcggacgctgtccatgaagttccttctcggtatcgcttcatgctctgcagaccacagctccgctctccgcaccaacatgaggttacctgatagggtattcgtagcagtggtttggccatccgttggctttgggctgcacaaagcacagttatgtgtcaccagtatggctacctatacatggttctggatttattgtaaatagttgtagctactactacaacttgttagctgaataatacaatcactaccgaagaaaccatctttatccggtcagataaaatccacaatagcctcggttgcactaaaaaccgggactaaaaagaacttttagtcccggtttataagcgcaacgggagtatatgatctttaagcccggttcaaatgctgtcatgccccctggatctttagtcccggttggtgataccgatcgggactaaagatcatatttttaatcctgattggtactatcaactgaaaataaatctctcacacatcctcctcgattggcacggctgcctaccatatcttatcccctctctctctttccttctttatctcctcctcctccactccttctcaatcctcctcctctttccctcctcctcctccaacgattccctcctcccctcccctctccctctatgtcgcggaggccggcggcaggcggcggaggacgtgcgggggcgaccggaggggaggcagcaggcggtggtggccatcgcgtcgtggagggtggcgacggccgggcaggggtggccagaggggaggcggtaggcggccgcggctgtcgcgtcgtggagggcggctgcagccgtcacgtcgtggagggcggcggcggcggctaggtgggggaggaggcgacctctccctcccctccgccagatccggcgggaggggaggcggcaacggccgggcggggtggcggtggtggcgcgacgacgaagaattttttttcgaggatttgagatgtatttgtttttagaatttgtgatgtattgaatatgtgaagttatctgtgatgtatttgtgatgtttttttttagaatttgtgatgtatttgatctgtgatttagagatggtttggggatttcacaatttggggatgatttggggatgtagtgaaatcaatatgaatgcaataaaataaaatgaaaaaaaactatagttaataccaaccgggactaaagatggtataataccaaccgggacaaaaatccatttttgatcctggttattttaaccaggactaaagatggacatagtcctggattcgtagtcggggttacgaagcatgattgaagatcctttttccagtagtgaatcttattgatacttgagttatttcatggtactctatgatatgtattatgtgtactagttgagctactgttagttggatcggattataaaatcttgatacttgagtgataactgtcagattcatatgtatgggttatgaaaactgcgtaaagtcataccaaattggcacctatggggatctcttcttgttgttattgccaccgttccacgggtgatgctaataggcgcgtaagcgccgccaagcaaagtcgcgcagacgcgcacttgctcccagtcccacgcgagcaccttccgagccttccgctaaaatatgtgttagtgctaatctttagcggtttatactaattgatttttttaatgaaatgataaataaaatagttgggttgaaaattttaaaatacgaattgaaagttttcaatgtttagttgaaagttttcgaatttgagttgaaagttttcaaattttgacttcaaaagttttttatcttgagttgaaagtttaaaaatttcaattgaaagttttcaaatttgagttgaaaattttcaaatcttgactgaaagttttcaaatttaaattgaaagttttcaaatcttgacttaaaagttttcaaatttaaattgaaagttttaaattttcagtataaagttcattcgaatttcaattttttttcatacaccgtgtatataaatgatatgaagctaatcacgtgagatagaaaagagaaagacaaaaacaagtcagacgtgcttgcttccgcttctgtgggccggtgtgggcttagcgccatgcaccgataagcatctcgcgcatacgcggatgaggatgtgggccgcgcgtgaggcttgggccggaaacgcgcgcgagtcgtgcacccattagcaatttcgccgttccactgtccgagcatcagtgtcccctttgcattttttgcactcagtttgccggtgtagaaccaagaaggaagagggggagaagtgttggtataggatcgaacacaagtaaccaagcctaccagaggggggtaaatggtagggaaaaccaaaaacccaaaaacttttagcgaaaataaaagctaccctcaaattcgacggatcacggtctaaccgaagtagatgtgtcggtctgaccgcctggaacacgtcggtctgaccgatgtagatcgatcggtcgaaccgccgagatcgcctgccttcgcctgtcgccgccgccggtctgaccgcctataagctgccggtctgaccgccgggatgccgccgaacccgataaaacacagatcgaagaactctcaaagtagatgacaactttattgcttctctctgtgtttataaagtgcaacaacagcaccccttacaaaaaatctcgactaaactcaaaaccctagctaaactagcagctcaattgctctcaaagcgataccgggagacatcacattccctctctatttataccaaaaaacactactcaaaataggtgtaaaacttctatttccaataggactcaatacccgaaataccttaatttccaaaaccgcaccggccacataaaatccaaaaccgcatcgaaacggactcctctccgctgtcgacgcgtgtcccgtacgcactcggactcctcgtgcgcacgtccttcctgccgcatgggccagctgggcctcctactcctggaccaactcggcctccagccagctgccaccgaagcccaccgagccgctctgccgctgctcggtgcaaccgatcatgcacacatacacgcttcaccatgcatccctttttctcctcaaatttaatccaatctccttcgtgaacaccaacacttgcacacacacctcgtaaatcccgttgcgaagatctcttccacatgatgttcatccaccgtatgccatctcatatccaacttcgtcactcggtatttttgaccgtttggacctcaactcctccctaaatctagtcccgatcccgaccattgaccgaagttaacctccaagaatcctgactctagtcaccttctcacatgatatcctgaccgcactagacctctgctcctccctgagcatagtcgcggtcttcaccattgaccaaggctgacctcaagtcacatgcatataatcagacaaaacaaccgtttctaggcacagatatcacaacctgacccacattagtcacatgtactcacaccaacatccacacatctatttaaaccaattatttattaaatcatttgcgcagccaattattcatcacaaatattaatcatgacaatgatttcattagttgggagcattgttcgaactaaatctagcctaaccacctgatagcactaccgaaatagtcaccgagtctaggtaaaactgaattaaatcagtttacactaaggtttcctatcaattcacctccaagttaaccttctaagctaaatcacttctactcttcactgttatctaggggtgggcattcggtctaaccgaaaattacggtctcggtctttggtctttcgatcttttcggtctttgaaaagtgaagtccgaatttcagcgcgaaaaatgtcaggaccgacaaattcggtctcggtctcagtcctgaccgaaattcaacaacattttcatatatgcaaagaaataatggaaattttcaacacaaaatcacaaaaagaattcataagcacttatgagtaaagactcttattaggttgcatgcctagaagaagtagggatgtgaaaattaaagtttaatcctattaaacatagtggattgtaggttgcatttagtcattttttgataattcggtcttttcggtctattcggctacccgaggagactaaccgaattgaccgaataaaatttggtctttcactacttaggaccgaattgataaccgaatttctcggtctcagtcttttcggttcggttttttttacccacccctacttttatcagctagtacttgatacccataaggtatcagtagtaaggggctatttggttgctaccctgagagaaattgcctgacctaaagccagcctgagactaacacaggtcttgtttggttggtgcccttagattccaaacccttcgcctgccctgacgcagcccttcccgtcattagcgtgagccaggcgaccgaaatcgatcgcctgagctccaggcagcaacagcgatacatacttaccatcctaatctttatccaaagcggccacgcgacgtagattccaggagcgaagctgcgctgcttccgcgaagccgccgccgaccgccatcttgccggatccttgcgaagccgccgccgcccgccgtctttcgtaatccctgcgaagctatgctactctcgctggcgtgcgaagccaccgccgttttgccggatccctgcgaagctgtgttgctcccgccggcgggtgaagctgtcgccgtcttgccggatcccagcatagcagcaccgcccatgctagatgctgcccaggctgcctttcgtgcaaaatagtaagcagatcgatttgcaggttgccagatgcatttgcacatctgggcagaatcatctgaaggttgtgctcctgatgcacggatttgggatctatttgactcttcgattgcgttctcctctctctttttttccctgcttttttttctagatttttatcctcgttatgtatgcaagatttgtgcttgtacatgggaagttgggttcataaatggatcttggcaggaggtttagatgcaatttgtggcaagatttgtgacggccattaataattgatttagctgtgtaataattaaaggcgtaattgcatatttgtttctcaggcagcaacaaacaaccaaacaagcatatactcaggctacctgaccaggttagatgcattgtcttctcgcatgccactcaggcgcacagaaatttcaggcatgttgctcagggcagcaaccaaacaacccctaaatctagtacatggctaccagagctggtacccataaatatcagacctaatacacatgtatcatcccctgctacctatatatcatgtctgatacatgtaagtatcatgcttgatactgtagataacatgatacccttttaggtactataaataaataccgagaggtactacaaggtgtcattggtatcgtacataccatgatacttgcaagtaccataacacttgatgtaccacgagatatcatgatatcctaatggggtgtttgggactgactaaagtttagtccctctgcctaagtaacatgatattggaaaagtactatgatacaaggaagtatcgcgtggtacgaagtatcacgtggtactatggtaacagtgacatgaaatttgaaggcaccacgagatatcatagtaccacataagtttcatgagtatcgtctatatttaatgtttgtatcatagatattgtaggcgtatttagggttaacacttgtagaaacggtcgaaatttcagtaatttcaagacttttggaactttttgcacgacattatttacaatttaacaaattttgactaaattctaataaaatttgacaaaattcgcaaaaacaaattgaagaaaaacaaaaggacgagatatatatcatgtagatacacacgcgaaaaaaagtggattaatgaaatttgagaagattatagaagagttggcctggatagtcgcatttttttttcaggtgatacttaaaaggaagagaatagacagtagcatgcagctagcatgtacactccctccgtaaaaaaaaaaaaagtcaacctataagtcccattctagcactaggttagcttttttttttaacggagaaaatagcttagcttttgcattggcagaaacaacggggatgtttggttcatggcaacactttgccacaccacacttgtggctgccacagtctcttaggcagtctcttaagcatgtgtttagtttactgccacagttgtggcttgccacactttttcaatagcatgtcccacatgtcatagacttaattttcttgccaactttgccacactttgtggctagcaatttgtccaccacacttttgtggctgccacaacttgcctaatgttagttgtggtaaagtgtgaccagcaaccaaacacacccaacgtgtcgtgcggctcgtctcagaggtgtaacgatggatggacatcgttaactacggccgagtttagttccaaatttgagtttagttctaatttttttttaaaacttctaacttttccatcacatcaaaacttttctacacacaaacttccaactttttcatcacattgttctaatttcaaccaaactttcaattttggcggcgtgaacactctacattgtccctccgacgggatacagtttttctgtatgggttactgtaatttccgtagtaaagcacggccccattgctagttacagcaaatatacaaatatacagtgttgcgactcattgtccaaaagcaaatatagattcttctgttattacaatgactagacaaacttgtaacctgaataatgatcccctcctcatccatattaagccttgttcagagggattggaggggttcgaggataaataattccacacctcaatatatgtcaataaatcccctccaaatctaacagcagagctatatcatcaccattgtcttcatcataaaatagagtcgtcattcagaatctttgtaagatttgcattccttccatgatcaaaatatatgaaatctgactctagcaggcctttatctttatctttactaagactgcacgaagcagaaccaaacacatcaatagcagcattaacatcataaacttcaatggcgtcatcaacatcatcctcaaaaagatatccagatggtgggtgcaaaattgtacttgcattgccctcacaagtggtgcaaagacctgttcataaagccaaaacaaagacatcaacatacatgccaatggcaataatggttgctacaatttgtgtactacttgacgaaaaataaattaggagcaccacaacttagagttcagtgactcaccaaaacatgtgctatcttgaacagggcagcagatgggcttcgagtttgattcattaaatcgaccaggttgtgagtcccagaattgagcaaagaagagtgtgcgcttagggtttggtgttgtggttgcctcacgatttagtttgagcacagtgccatgggtgcttgccaagaagttagcatggtagcatctccagtagtgggattgaggttcctccactccacatatgaggtcaagcttatatcttggttcctgcaataacaaacaagggtagacgaagtcttagcacactggaagaaagcaaatgcagcaatcaaacaaaaataaaaaaacgtttatactctaaatttacccaaggatgctgtctggagtatgtgactagcaattcttccagcttgctgcgaacaaacctttgccggttcacatagtctgaccttctcctcgataatgctgctaaagcttgtgtatcaaatggaggcagtctttttctgccaatcatcgtggttagctgctcttggatcattgcgttaagctgctcccaatcagcgttggagattacacagccggagccatcactaatggatctcagcaagtgctggaggctatcaagcttctcgccgcagagggacatgaggaatgacccaagcatggtgtgctgcgggtgctctgaagccttggctgcagcagagtaggggttcttgttcgtcatcaccgtctgctgtagcttgtcagtgaggtcacactgcctggaccaaaggtactccacggcctcatgcttggagagcgagcagccagtggtggtggtggtgatggcacggagtagggcgacaaggccgttgagggaacgggatgcaatgcgagacatggcttgggtgtcagagatatcctgcggcaactcaacctcacaatcgccgccaccgccatcctttggatacaggggagggtatgcggcgtcgtaccagagggtgttgatgatgatgtttgatacgggatccaaggggccgaagcattgtccagacatgaggattgcgcggaggaggcgtccgcggcgcatggagtcatctgatacgggcaggggcagcacggcaagtgccctgatgtagaagcaatggatggtgtcgaggaggcacatgttcagggacaatatgtgctcacatggcggggaggcatcatagttcacatgtccatgttcttcacaaccaccaagcactttcgctacgcattttgatagctttgtctctatggctgcgctatctatcgtaagatccgagatgtataggagtttctgaaattgaacatgatttggtgagattccagcaaaacggtcgggggcggcttgagcacaagactcaccatttgggcagcacaagaagtccatgttgggcgggggccattggaatgcgttgaggagcaggtccttgatggactggacgtcatgggtggtgagcaggtccgacccctgaagcttgtggacgataggggagagtagatgagaggggtactgcgcggtcatggtgcgcgccaggtcgtcgggcgcggggtggcctgctttgagcgcggcgatccggagggcgttcttcatcttgccaccgtcggggaggaggggggatggcgggagtgggagatggcggtcatggtggaccaacttgatggcgaggaggaggtcgtaggaggcgaggtagaggtagcgcctggcctgtcgccggtgaggtagcggaaatagaccttcatgaagcgatgaggccgttgagagaggtggatgagatgaacccccaccactcgctgtagctcctgcgggtcctcttccgggggagcggcggtgggtggtcttggagttggaggggcggtgatccggagaggtgggcgatggcgttgaggatgatgttgctgacggggtcggcgaggccgaagcagtgtccgacctcgccgaggcagtcgacgagctccgggatctcgtccaagggcagccgccgcgccgcctcgtcgtacagcttctgtatggaccggaggatttcgttggccggagggtgccatcgcttctcctcctccccgtggtaacaggtgaatctgccgaagcgggggccatcggaggaggaggcgccgctccgactcgctgctctcttccctggattttttggggattgcacgccggatctgagcccccggcttgctgtcgatttgtgaatttttcgccgcttcatatctcctactgctacgcctaccgccgccacaaacaacgctagccgcaccgcacctgcccggcctcctctctctttatacgccgcggatacctatcctcgtaggaatcggatacggtgtaccctggagccaatgcccagcccacttaactcgctgggctggattacccaacaccaaacggacacggtccctttccttccttcctagtagtagtaaggaataagttcacttttcctccctcaacttatggccgtgtatgaatagcatccctcaaccgcaaaaccggctataacccatcccccaactccgaaaaccgttgcaaatcaacttcccggacggttttggaagcggttttatcctatgtggcaattgacttgcttatatggcagttgacttgctgagtcatcaagcaggacccacatgtcagcggtctccacctcatctcatcttctccctcaccatgattcccttcaagaaacgggaaaggaaaaaaatcaagaagcggaggcgaggcgatagaatcgagcagcaagatcaacggcaagacaagtagcacatgatggttgccgaattcagagaagacgccggtgatcacgcgaaacaagaaaggagaacgaacaaaacaaattagagaccacgaaatcgtcgaagaacacgagcaaacagcaaacaagctagcggagttcttctagcgtgcgcgcgacgcggagcgggtgtccgccatacgcagctgctggcaatgccgccgtcgtccccgtgccggagcctctccgtcctcatgctgcagcacaacccggccctcggcgacatccccagtggcttccttctcggacggacggcgagcttctcccgcgcgcggacggccgccgagctatttccccgcgcgcggacggccgccgagctcctcccacgcgcaaggacgcccggcaagatcctccccgcgcgcggccggccggcgagcttctcccccgcgcgtggccggccgacgagatcctccccgcgcaagccctgccggcgagatcctccacacgcgcagatggccggcgacttggaggggctgcctcgtcctccacgaccccctctcagacaatgccccggcgtcctcccgcctcctctgcgtgctcgagccgggccactcccccgcgcgcggcgtggccaaccgacgagctcgtcccccgtgcgccgtcgtcgccgccctgctgatagaaggtgagaggtggaagatatgaaagagaaagaggggaagagatgaggtggagactgctgacatgtgggtcccgtttgatgactcagcaaatcaactgccacgtaagcaagtcaattgctacgtaggacaagaccgcctccaaaaccgtccggggagttgatttgtaacggttttcagagttgggggatgggttatacccggttttgcggttgagggatgatattcatacacggccatgagttgagggaggtaaagtggacttattcctagtagtaattagcaataagcccacctgtcagttcctggacttttacatcgtgttttttttacctctaaactgtacacaaccgtgcaatttggatcccacagcaatatagatgcctgcttttaatgatgtggcatcctagtcagcaaaataaaaataaaaatattatgtggggcccatgtaagtgacaagaaaagacatagggcccacgccctcttctttcttctcttttcttccccagcctcggtgttagccacgcaaggggaggcggccgacgggagaggtggggagaggtggccggcaagtctgagagggtaggggagaggcggccggcaagccagcaagccgaagctcgtcgacaaggagatcatcccttgcgacgcccatgtttgccaccgccgcccagttcggactggggacacgggtgaaagactgagaaccgatgagagggtaagagggggtctggcccctcaggagcgattgaagatagaaagggatttagacaggttcgggccgctgtgggagcgtaacaccctactcctgtatgtggttgatttgagtggaagaatactgttggggaggtatgtcatgagggccttcagccaacctgccgaaaccatctaggccgtcaaaacaacggctaagttcattggcccaagcccttgggcgaagaatacagacttacgaaggaatgggtcaagaatacagaattgccacgacccaataagctcaaaattcactgatttggatataggaggagataaggaggccgccatccgaaaatgggctggattgggccagcccatgttcggccgaaccctcatctgcgccgttggatgcagggtttggcgtggacgtccaggattgcatcccaatgacggttggagggcatattttcgaccattccaactgccacaaccgttattggcagctataaaaggacctcccatcctcacttcttccacacactcaagcaaggagcttctcatattctctcaagtttaatatactctctagagtacagtggaatagaaatagaatagagtctccggtcctcggagttttcggaagagttcgggtatggctctagtagcttttccttcttttgtaagacttgcaatatttatagaatattattcttaatatatttatggtactatacttcactctgatcatacgagtaccgactttccgatatattattcgagatataattgtctagctagcttactcgggagatgcgactgtgtgggtataatattcatctatatgattgctctatgtcatgacgatgattgtagattagtatttggtagcataagcgaggtgcttaggctattgaatatcattatttagggttatatgctgcgggacagtagaggtgggccgctgatggtgatagctcagtacgggtattcctccacgttagtatataatcctaggttactttcctggggagggtacttgttgacggtcgttatcgatcaatttcgaccgtcaatattaccaaaataga

SEQ ID NO: 38732 - DNA, 2202 bp, Oryza sativa
atagaggagaaccagtgatgcttgcaatgcatatacatgttagaataataatattccactagtattaggtttactaaccttttgcagagaataaccataaagtggaggagaatcgacattaactcagacgataaatcaatcggacgatgtcgacaatcagacttatgcatgaatgggccaagagctcagaattgacatgatgaattgggccaaaattcacaagtctacgaagtgaaacaatagagcaggtcgcctgccgaatttgggccaggttggctggcccctggttcggccgaacctccctctccaccgttggatatggggtttggcagggacgctccagatcttctcctgatggcggttgcggggtacttcagacatttcgcagcagttacacccgtcatacatgcctataaaaggagctcactctcttcacttcaacacacacctcaagcaagagctctgtcatattctctcaagttagtttagtgttattaagctagtagaataggaatagagtagaaatcgggaatccggaagccttcggaagagttcgggtatggctctagtagctcttctcttctctattgtaagctttgtactagtattagaatactcttctttatacatttatggtattgaaatactttttgaatatataaatgactactttacattatgttcatattatactgaatatgttgctaacttatctgggagatgctttagtgcgggtataatgtttgcatatgtaattactctatgtcatgataatgatattagagtagtatctggtagtttagacgtggtgtctagattacgggatattattatttggggttatatgctgcggatgagaggtgggccgctgatggtgacagctcagtacgggtattcctccgcgagtgtatataatcctaagttaattccctggggagggtactcctccgtatttagccccggttgtatggtcatgacgggctgtcgtaaggaactcgacagccaggggtagcttctcgaagtaccaggagggcatcagatagagggtattagctagtatatcagataactacccttggaatactctcgggtgaaacgctacaatagtatatccatgcgcttgcggatgaactctataaccataatataccaggagtatttctgcgccattgctgggaattatatttctagtaatgtcgttaagaaataccaacaaacatttctggcccgttgccggggaagattcataatagagattacctgaactaatacttataattacctctgtataatcatttccctttgcaggctaaccttggttgttttcacttttgttgtgaaaacagggtagtgcatgactggtttcaacttgccgaaaaacttcaaagaaaatccagaagctttcttccggagcgtcagaccgcgagtcactgctccgtagaaaactctaccgactaagaaaccagccgtagcagcgccaaccgactttcaagactatggctgacaagactccccgcgagttcattgctccctctgctgagaatgtggccattgggccgcagatcaacatgggagacgtggatttcgacttgaagtccagcctcatcactatggcgcaggctagcccgttctgcggcaagcctaacgaggatgccaatgctcatctgcagcagttcctggagatctgtagcatgtacaccataaaagggtgtcagtccagacaccgtcaggctaaggttgttcctgttttccctcctcgggagagcgaagcagtggttctacgccaaccgtgctgctgtcaacacctgggacaaatgttctacgacattcctctcgaagttcttctcgattggcaaaaccattgcccttcgtggaaggatttccagtttccagcagacaagggacaagtccattcctgaagcatgggaacgacttcaggagtatgtggctgcctgtcctcatcatgggatggacgactggctaatcctgcagaatttttatgatggactcactcccatgtcccgcgatcacctggacgcggcgactggaggagcattcttttgtaaaacggttcgaggagccattgatttaatagagaagatggtctccaatatgggttggagcgaggaacgactccagacccgtcagtgaggtatgcacaccgtcaaggagacgaaattactcgctgccaagctagacctc

SEQ ID NO: 38733 - DNA, 2494 bp, Oryza sativa
aattcaatgcatatcccgtaaatgcgacatcgcgatgcaatggggcaatgatcaaatggtatattgtatcttttaccttgcattatatcgtaggaaagccgtgctattaagggggataatgcatagacatataaggagtgatggccggacatagatagagagagagacagagcttgaagagctcggttggtgtggagggaaaaggaccgacctcgtcgtctatttataggccgcggaagtcggttcggacaggagaaggagaagaaggacatggcaatggaggcgtggagaagaagagcacggcgccggctctgtccgctgattggccggtgatggcggttcgctccaggggctgacgtcgatggcgtgaggtgacggatgacgtcggcgatggttgcttggcgtcgagggcaagatggcagcaacgtcggtggcagaactgcgggcgacggcagcggctgcgcgtgcgagcgtgcgccaagcgcgtccatggcacacggcggtggcgcccacgggacagggaggaggatcggctgtgtggctgggccagcctgggtcttggtctgttagggttagggagatgggccgagaggagacagaagtagatttcggcccaaaggaattgtttcttaatttctaatagaatttgaaggagatttggatggctaggtttgaaaggaatttatatttggaggaatttatatgtggagatgaatttcaaaataaagaccttctaatttatttgagtgcaatatatttagaggtagagtggaatttgaaggaatttatttggaagcacttaaataaaaaaagaataatattatgaatgatagggctcctaatttggatatattttgggggagtatgataggaaaatagatagagaaaaataaataggatcttagcccccaaaatatatgatatgggttttagagaattatttgaggcaaaaaggaaatttggatttctggatgagaaggataaaatctattttcttagcacaagagcaattattcacaatattgcaataataatattctcatgccgataaggggatcaagccatataaattaaattggcggctaggtaaaaggaggaatttgaatatgggaatgttggaaggagaactaaggataggtttaagatcaaaggatgggttaacaattaattccaataaaattggaattgctttggtttaggttgtagcgcaatattgagaggttccttggaccatagttcataaaagtaaaaagggttttcaaactaaatttgaataaaaggaattttgtcaaaagaaggttttaaattaaaactagatcaagaaatacctccagataaattttaaatggagatcgcaaaagaaattaaacaaaagagaggttttatgcgagttagttttaggaggtccctctaattataatatcctaggtttaggaggttaataaaaacataaaaaccggtatgatgtataattagaaaatagctagttttcacgatgttacatactccctccgtttcatattataactcgtttgacttttttcgtagtcaaacattttaagtttgaccaagtttataaaaaaaatatagtattatttttaacacaaaacaaacatataataaaaatatattcaatgttagatttaataaaactaatttgatatttcagatgttgctaaaatttttttataaacttggtcaaactcaataaagtttgattagaaaaaagtcaaatgacttataacatgaaacagaaggaataattatttttgacatgtatcatggcatacgacctcattgtttgcttattggcttacaagtcacaaccaaaaattgaatttttcatatgcttgaattttactctactcttaacactttaggccatgtttgtttcggctttcgattattataatatgaattactagcattaatctgaaacaaatagaaatattattatattctataagtcagattagtataatctggtaatctcctataaacatgctttttcagattatagggtggctaaagacccactaccctttaatttttttttgcaaattacccaccactgccatcgaacccaacaggttgaacgcatccgcttcctctctgcccagttgcacgcgaatacagcgcctccccgcgtgcatctgcttactctctccctagtcgcgcgcaaatccttcccccagcccccaccctgcgccctggctccttcccccaagcgcaaaaatccatcccaagccccccaccctacgggccccttccccaagccacgctgccgccgccgtctcatattcctcccactccacaatagctgagggcatccaaaatagccaagggcattatagacattggcttgtcaaactcaataatccatgccattaataatccagataatcaaataactcatagcttattctactattgcttattataatctagcttatagtaatctggcttaataatttagattataatagtcttaagt

SEQ ID NO: 38734 - DNA, 3560 bp, Oryza sativa
aggtagtcgcaatgaatcctatatatgctataaagttagtcatcactaagtgcaattaattttaattctctattctcacagccatccacgtcaccttaaattaatctagccaccggatttgcatcagacgtccaagatcgtcatcgttgatttgcccatccaaatagctgatgtgcactgaagagtccaatatgtttgcatatcccttccgtcctaattgggccaatgcattcgagcccattctgttttcttcctttaattgcaccatttagaggaaaatttgcctataataacaaaatttgctaaaattgcaccatttagaggaaagtttcatctagtatgtactccctccgtttcaaaatatttgacaccgttgactttttagcacatgtttgaccgttcgtcttattaaacaaattttgtgaaatatgtaaaactatatgtgtacattaaagtatatttaacactgaatcaaatgatatgaaaagaataaataattacttaattttttgaataagacgaatggtcaaacacgtactacaaagtcaacggtgtcaaacattttaaaacggagggagtattagagaggactattacaatgtaaatttgttccatgcctctggcgactacaaatttacagctcaaaactgatattatctgcaatattaagtatttatttgtgttttctcggattttgaagtcactacatttaaatggtgcatccatagagcaaatgctttcagggattatatgacgtttgcagttactctaatgtaatattggactttatcagctgcatgagggatactaggcacctgcttaccatacgatgtctcattggttgatcggtacagaggactgcatggtcaaatgagcaaaaattaaaaaaacatcgaactgctaccaggtagaaggtaactcattacaaatccaaaagtccgccctttaagctactcggagagaataaaacaccatggcatcatccttgtggtctcaaccttctgaataatcaaaacagtggtgcatcaaacattttcctcttcctattcgtcttcgtcttcctcttcatcttcttcttcgtaagggtctccaaaagagtcttcatcttcgtcttcgtgagagttctcatcttcatcttcctccacttcgtcctggtcattgtcatatccttccaaaatctcgatttccttacaactaaaaactgcacaaagaaacaaataagaagagcacagtaaatttcaagaggtccaacctgaaaattcactccaaaataaaaacttcaaatccattgacaaacttagtgtattggaccaacccttcaaaatacaaattgacataaatacttcattacttctccagatccaaaatcagattatgtccactacttcattcaaagaaagggaaacataataaaatgccgtcacttggagaagcattggtcctttataatatggttgcatcctatgcggcataattgctggattctctatagtatagcacacaacaagaagaaaattgtatggtctagggactatatgggtacttatggcaattcataaacaagatttttggacacaatggccaggagctgtgagcccaacataacaaatataatttagtgtcaccggagaacattaccttaggcaaacaaaactactaagcaatcttgcccaattattggttactagctgctatgatataaccaggatggctagtgcagcaagctggcacactcagcacctctagtacggtaaactgatggttacagaataacaaagttttctcacaataatagagttcaacaacgagataaaaagtatgtgaggtacttgcgtacatggaaaatggcatgcgagctataagatggcaatatcgactctcacaaatatacaactaatgggaaagaaaatcaaatcaaatgattgaaagatataattacatactacacacatgttgacatacttgttatgttatgcaagaaaattttagaaatcttaatatgcttttttgaatacaaccagccaaaagagtagtctagataatgtcttcccaaccataccaaatgcagtgcatatgctttcaattcccaattaatccatgatcctaacatccatttcccaataacttagagtttcgatactgcttactacatttcacgcatatgaaggcaaaggaaaatttcagaattgtacaaagaatgaagaatgtttaagtatgttgaatgtagacagatttcaaaactttgagtactctcttatcaaccgcttcgcatttgatttcaactatctcaaggtgtgttgatattacaagtgatctatccattgaatggcagtttcctttgattttcattctatgtttaggtccctgtcagaaattaaacattttaaagtcaatagaaaaatgccccaaaacttcaacaagtaatcaattggccaattagataaggtataccttggaatagatctgaagaatgagattctctagaaccagtgcatgttcaagaatgcaagatagtgcactaaaatcatcaggcacacaccagtattcattgagtaacaaagtctttaacttggtaaatgttgggcaccattccaaatcccttttgaaaataaactgggtaaaatgcaaacaagaagataaacaaatcctcagagttcaactggatataaacatagtataatagaataataagacaacataaactacttaaagatggaagtgcaagcataccaatctacgttcatttatcagcaccaacgtcttagcttctgataaaccttccaaacgcatgcatttgtggtccttgatatcataacaaggttcaaagccctcacaacaacaatccccaaagtcataatgactacacgattctttataacagtagaggactctaacaaatgcgtcaactaacgatggcatccactcaagcactggagtcctgccatggaaatcatccagcttcagagaaacaagactcgggatagcgatacgtatccgagacgtctcactgaaataggaattggttatgctcaaacgttttgcagagctagatgagatcttggcacagtcaaatttgcatgactcaaacactagatgctccaatgctggacagctcgagaagttaagaaagctgtcgtttaggcctatgttcttaagctgtagcctcgtcaagtgtcgggagacaagtggcatctcatctatcagaaacgggaagcgataccatatatcgacatcgagcaagaggaaccgaaccttgtggagcaaagcatgcctgaaccagtggttcacccgtactgtgtcatcgaggccctcgtctctgtaccaatcgagccaacggaaccttagcacgcacgtgtcgagaggtgcgccatgcacggagtagcagcagacggtcgagaaactgcttattgtccttcacgcagcgcagatagatatcgccttcgccaatgcgcagcccggtggcagacttccagaggtggagccatcgccgggctagcaggcacgtccggacagcctcatgcgccggtaggaaggagagcacgtggtggagcacctcgtcc

SEQ ID NO: 38735 - DNA, 5297 bp, Oryza sativa
cgagcaggagagagggctgtgctgttcgggtaagcagctcacatcgccgccggaagctttcccccggccaccggagaccaaagagaagagagtggaacgcgcggcagcaaggatacgcacgccgacggcgcgacactcgctagcccgacgaacggtcaggtcgcgcggggggtgggggagagaattccggcggggcgaggcggatggagaagcagcgctgcgatgagcggaggaatcgccggatcggagtggagatggagaagacgacggggtcacagactcagagtctcacggaggagatgaaagttttttttttcttctgtttttttttttgacgggaaggagatgaagggatatggctgggtttccagattttttacttatttttaaaaaaagatttaacaaataaattcaattttaaagttttacagaactatactctttccaccctatcacacggcgggacataaatcgtcatacagtagggcaatccatgtgacgtggcaccccgtaggagaggcgcaccaacggagagcttggcagcggcgcaaggtgggcggcgagctcgacggcttctgcggtctgtggcgacgagggtggcaatggacggcggcagcggcctcttcctagcgacgacggcgtcttcgagtcccttccacaggtaggttcttcgttcaaccaccccccccctcctcccctccccttctctctccatagaccaccttctctctccctttttttcccaaaccacccgtgcttccgcaaatcacactaatatgtttgaaccgctgccttttgtatttccttttattttgaatctaacgtggagcttgagaccgctgtccatgatggtacattgaacatgatcttagtagtagtaccctttgcagtggtcaatgtacctttataagaaatcctcctgagcaaaagatagcatagcggtaaaagccatcaccttttttcatgcttctgcaccaaccatttcttcaagctgaacaagagcattgtagcatgcttaaaggccaactccgcgcttcagtaaccaaaatctcacgttcttatatttataggtcaaattttaaattcaaaacttaattttggaggtaattttgtggttcttttcattgtggtttatatttacagaatttgcttttgaatcgctaaggacatgtatctaaaagttttacttataaattattttttgttgccaataacccatatggataagtataagcgaaatgttagcttatatttctacgcaggggcggaattagagtatattagggggtgcccaggaaacctgattaagaaaattttttagctatatctcacttttttttcaccatgtgtgcacccccgtccatacaaacttagacaccaacatcaatttaaactcgatttaatgtagagtaaattaaacatgtggcaccccgtccatttcattccagctccgcccctgtttatgcggagtttcttgtaaaaaaaatgcctagaacatgtggtccctttgcatgcttaacaatgtcttaactctggtcattctcttatgtttagtatgcacatggaatactttgttattgatcggccagtaatatttacaagtttacatgagcaattagtaacatgaaagtcttgtgcccctcaaataacagactcccaattaggggtggatgtcgagctggctcggctcggtctggctcgttagaataatgagctagctcggctcggctcgttatcctaacgagctaaaaacccagctcggctcggcttggtctggctcgttagaataatgagctagctcggctcggctcgttatcctaacgagctaaaaacccagctcgttaggctcgtgagctttgggggcagccgacgaccacggaggcacggaagcagctcaacctcgccggcaccttgacagctcaccggcgaccacggggaggagcttgacggtggaggaaacgagctcgagctcgccggcgaccacggggaggaacttggcggtggaggggacgagctcgagctcgccggcgaccacggggaggagctggacggcggaggaaacgagctcgagctcgccggcgaccacggggaggaacttggcggtggaggggacgagctcgagctcgccggcgaggcggcgaccacggggaggaacttggctgcggaggggacgagctcgagcttgccggtgccgtcaggcacagggggaggggcggagagcggcgacggcgtgtgggacgagctcgagctcgccgacggcgtcgggcgtgggggcagggagagtcggagagcggcgggccagcggcgtcgggcgctggggttaggtggcggcgtcggtcgctagggtggaggcgcagagcggcggtgttgggcgtggccgcgtgggccgcgtcgcgtggcgccggcgtgtgggggagacggggagctcagccgccaccactagggaagggggaagggaagctagggttttggtttttggtctattgggccttctaaataaatgggcctatgggctttgtggtctggcagcctagctcattaaagctcgcgagccagctcgagctggctcgttatctctaacgagctaaacttccagctcggctcgctaggaaaatcaaacgagccgagccgagcctgtcacgagccgagcgagctaacgagccacgagcttcctgtccacccctactcccaatcatatgcatactatgttttgagattacctttaggttaaatgaaatgaacagggagcattctgtcaataatagttaatttgcgtttaatggtatttctgcttaagccagtattaatttgcgtgcgtatctaagcgcggccgtgtattccctacgcactacatttataaacagagtagatacagaactccccacaaaataaaatagcaagtattacagcaagcccgtaattaactggtgattacgaattttaggattagagaggactattcaagagtaaatttgttcggtccctcagcctctggtgattacaaatttctaggtgagctcatgaatatgttgatcagtgcagaagactacacggtcaactgagcaaagactactagaaatgcataataaaacgtcaaaccgcttctgggtagatgacctaagtaacctagggactggtttagttcccaactttttcttcaaacttccaacttttccatcacatgaaaactttcctacacaaataaacttctaacttttttcttcaaacttccaattttagtcaaacttccaattttagcgtggaactaaacacagccctactacaaatccaaaagtctgccccttcaagctacttagagggagaaaaacaccaatgttaccatcctttaggtctcaaccttctgaataatcaaaatggtggtgcatcaagcatcttcattgtcatcctcatttccctcttcgtaagagtcttcgtcttcatcttcatcatcatcgtcttcgtaagagtcttcatcttcatctttatcatcatcgtcttcgtaagagtcttcatcatcatctccatctctatcttcgtcttcgtcttcgtcatcatcaaaaatcccgatttcctcaaaattgaaaactgcagaaataacaaatacgacaagcacagtaaatttcaagatgtctcagctgaaaattaacttacagaagtttcagttacttcaaaacgaaaacattgaatcagttgacaaaggtagtccattagatcaatctttccaaatacaaattgctacaaataccacattacttctccataaaaaattctgattatacccactacttcattcaaagaaaagaaacataataaaatgccctaacttggggaagtattgaccctttatttcctggttgcagcttatactgcagagttgatggattctctatagcctggcacacaacaatagagaaatatgcatgctctagggactataagggtacttataataactggtaaacaagatgcttggacttcaggcctcaatggccaggtgccgtgagtagagcccccacctaacaaatataatctagaggcaccgaaaaacattatcttagctaaacaaaagaactaagcaatcttatgcagttattggcactagttgctatgatgtgactaggatggttagtgcagacagctaaagagcacattcaggcattcagccctatggtaggttaagctgagacttcagaagaacagtattctctcacattagtagtttgacaacgtgataagcagtctgtgaggtacttgtccacatggcaaatgacatgggagcaataagagcaagtaataaactggaattcaagatggcaacatcaacataaactgcaatatgcaactgatgggaaagaaaataaaatcaaatgattgaaagatataattacagccatattacataaaaattatcatgctggttgtgtgatgcaaggaagttttaagaaatctttgtatggtttttcttctttggatactaccagccaaaagagttatactaggtaatttcttcccaatcagaccaaatgcagtgcatgctttaatttctgaatcaatccctgttcctagccatttccagtgaacttaagagtttcaatactgcttgctatgtttcacgcatatgaagaaggaaaatctctgaaatatagaaaaaaatgaagtatgttctttacgtatgttaaatgtagacagatacttcaaaacttcgtctacaaagttatcaatcatttcacatctgatttcaactatctcaaggtgtgctgatattgcagctgatctatccactgaagagcagtttccgttgattttcattatatgttcaggtccctgtcagaaattaaaacatttaataagaacaatagaaaaatgtttaaaaccttcaacaacgaattatatgtcaaattagagaaggtatacctcagaatatatctgaagaatgagattctccagaaccggtgaatgttcaagaatgcaagctagtgcactataatcatcaggcacacaccaatattcattgagtaacaaagtctttaacttcgtaaatgttgggcaccatttcaaatcccttctgaaaataaactgtacagaatacaaataagaagataaacaaatcctcacagtttgagtggatataagcacggttatagaaatgatataatataaacgaactaaagatggaagtgcaagcgtactgatttttgtttatttatcagaaccaacgtcttagcgttcgataaaccttccagaagcacacatttgttgtccttgataccataacaagattcacagccctcatgggg

SEQ ID NO: 38736 - DNA, 6055 bp, Oryza sativa
ccagagggtaaaatgtccagtattgatagtttaagggtgcaatatacctagtttcatagttcggggtgtaaattagataacatgaagagttgaggaatgtacaatgaacttatccctatattttggtacagaagtagtagtatgctagtatttgacaagaactgatcttttaagatcgcataacagctttatcagctattatttgataaggctctaaaagaaaagctatgtttcgacaagaatgaagtaaaaatgtcaatttaaaacaacacatctgataaccggcttaatcattgataacactttttccccccaagtatcagaacaagaacatagttgcagaagcaataagacatcacatgagcactaggaatcaaaattaagacaatcaggttgctgcatgacatccacaaattggacccgaaaagcattaggagggatcggatagttcttgtactgctaaaatcaagattcgagacagacattacaaggactgacatcaaggctcacagcaaaaggtgttttcatgtgatgttgtcttactcttagctatgagcctgaaaaataaaatgaaccttatatcttaagctaagacttttgcaggcattttcccagaacaaactgcagcaaaggcatctgcaaatccatgaactaatgtagtgccctttgctagtttgctgtggtcaatgtagaagtatcttgctagcaaaaatgatactactatattgctgtaaaattcagcaccatttttttatcaatcccttcaccccaggtatctctactaacataagggcacccacaatggttatctataggctctctataagagatccatatcagcatattttcctacatggaagatattaaatgaagagagagagcaaaactatctactaacttagagatagtctatagagaaaaacgagacaatgcatgagagagttatagatactcatgtagacatactattgtggtggtttactattaatctagtctattgctaagatgtacatgttttatagatagcaccttactttaccattgcgggtgctctaatgcctcggcatgaaccgcttctccagactgaaacaaaagcattgcagcctcaccatgcagtccaactttggtaaccaaattaactcttatatctccttgcagagtttattgttacccaaaaaaaaaaggatagaatctgtaatcccttggttgcttcttggcatgctgcacgaagccctttgcttggcctggatagaagttgggtcagctctacttgtttcatacttcctccgtttcacaatgtaagtcattctaacattttccacattcatattgatgttaataaatctagatatatctatctagattcattaacatcaatatgaatatggatctagattcattaacatcaatatgaatgtggaaaatgctagaatgacttacattgtaaaacggagggagtatcaatcataaagccgaaatcctttcaaccctacaaaacacaagggaaagatttctgtcaaccctgccagtactacagaaccaagtgtgagacagtgcacttagaagctccacacatcgcatattattaaggggcgcgggctggggcgatgttggtgcgggccacgtcgcccctttttcctcccgccgtccgatcaggcgtgggcggctgggattgaggcgcgcggtggaaattttgcgaaaaatccctccgatttatatataattcaatatgggtccctagcgaacagttcctatgagccgatgttttacgtgaaagcccttgtagtagccggatattccgtgcgtgggagagaaaaaacgcgaatcgggaccgcgctgtacaatcttaaagtcgaggggattttttgcataatgatccccattagcccacccacccccaaaccctagccgccgccttccgtctcgcctcctcccactcgtccccatcctctcgctctcctgcctccgcctccgcctccccctcgcgccgccgcctccgtcccgcgcgaccgcctccgcctccgcctccgcctacgcctccgcctacgcctctgccttcccctcgcgccgccgcgtccacctcatcgccgccgccgtcgcttcgtcgtctcccagcgcctcagcctccccattgcgtcgtcgccgccgctgtcgccccgtcgtctcccagcgcctcagcctccccatcgcatcgtcgccgtcggcgagcgcacccatctccgcctccactagcgtcgtcgcctcgcgccgccacttccaccttcgcctccctccgtccctgccgaccgccgtctccggccaccagcgtccggatctggcccccatgtggtcgggggacggggatctgacatcccccgtgcgccgggcagcatctccgcctccgtcaccaccgtcgtcgtcgccgagcgccgccacttccgccaccgcctcgccccgttgctgacgagcccgccgcccctgctgcgtgcttcgccgccgtcgccgacggtcggtgctccaccctccgttgcggctgccatcgaagaaacggcggtggtgacggagccggcgccaaggaaggcagtggttgcgtcgagaagaggaggaccgtacgtcgccaggcggctccggctttctctagaggagtggagttgcagagtgacgtggaagccggtggcacacaggagctagccgacgagcttgacaccgagcagcttgggctggagagcaagattatggccatcaggaacttcttggaaggaccccgaccatgtcctccgtgatcccatttttactttctcgcagaatatgctccaaatatgcaactttcttgacatgaactgtgcatgttttttgtgttttgtctcagcccaaccgccccaacgacgtgctggtgaaatagtgagcttactgcaaaaccggctaaacatgaacatcaccttcaaggagctgcaggtaaagcttttttgtccttctgttaattttattcctaagcacgtttgcttttctcatcgggggtaggacggtcctgctgcggctcaacctccactggggccacatgctttgactggccatcatcagcagggtcatccagcctcctccgccggcgagggcgaccagcctgtactgcaggcttggaccgccgtaggggactgcgggcgccatggaggggccgtgctgtccctgtgaccaatggacgatgacagttgcggctgccgcgagtccacgccgactgcgaggcggttaatgtcgatgacatgttcagcctgcgtagggatagccagatcggcaaggatcagtttcatggtaattttttcttgcagctcctccctgtcagcatcttcttcctctaatctattctagattttcagtgtatcaacatgattgatttcgcagccaaatataatccattccttccgtcccactcctattaaaaagcttgacctttttaccaaccgatgtcatgttgttagccacatcctgttcttagttttttctaattgtccattcgctcattgggttatgttaaatatttttgaacgggttacgaattttgcaatatagtactaataaaacacataacgtctctccttttgtggagttgtctgattattatctaggatcattcactgttaggcctcaacacatttttttaattcctccataatgtgagagatactaatgactgttctcaagcagtaaaggaaaaccacatatttagattagttagccttccttttctactcttctcccgccatgtattgtttagtttatagaggagatcagatggacatatgctaccaagtctgtcatttcaagttctaaaaaaaaagtcggatcatttcagtggtagttgggcaaaaatatctgttggcatgcgagaacttttgcctacttattttaagaatgtttttgaaacctaattaggctataactcatatatcttggaatgtcctatttgttatatttagcgttgttttcattactcactgatgaaaaatttaggcaggggtgcatggattcacatgtttggaatgagatcatgaaaggatagatggcatcccaaggaactgaagaaaaacaaaaaactgtaggatcagcaatagcagttagagaggctttctggttttttgaaagggtattttagaagtttactcaagctgaggttttggatacagttaagcatttcataaacctttctgatgtgctaatacactccacatgtaaatatagaaagttactataatggacttttccaattgtagctatagctgagtgctaataccataaatttgcaggtactaatgaatacataatgaattgatctacccctccactcaaagcctcaaatcatgtcgctccatacaagtcgaatggccttgacaaggcatcagagatatcggtttgttcggattctgctgatcaaagttttagagtcgaggtctaatatggttgatcacagggccaatcttgtgcaggtatcacagaacatgtttcaggcattatcttatcacatattccatatgcttatattatcatcctttttttggcataaatgcttgtaccatattaccagtagacatctgctagcccactagaatctcttgatggagacgttaaaaccgccatggatgatcatttagttgtctgtttctgcttctgccgacataaagaaaatcacaagttcactaaacatctcccacctgtggtgactgagaaataggagctcaactgcacctgcttcaggtggtcggctttcctccatgggacatggacagagctatcatccacaatgtagaaaaaaaattaatattagctgggttagctgaaggacaaggccaactaaatttcattaatattttaggagagtggttacaaagattattacaccaacaatagggtgtcaaaaccgggtagaaaaaacaagggatcaaaacagccggaatcggtactgtctctacggaaatggccctcggtcagttggtaacaggccatatttatcaattaaactattgtttatatgtagctaaaaaggacaacggtcaaaaaggtaccaatgatatgaaacgacactcagtcggcagggaatttccgtggccattttcatccctagaaaaaaaccgacctacaagtgtcaaagccctcaaggaaatttaaaggtcatatcatgtaatatgcaacaatgcaacataactaaaatgggagggagggagggagggagggggttgttaaaaccaacttttttaccacaaaaaggtttcaaatttggatctgcatatgaaatttagttgacacgaatttttttgacaggttttgtttgctcgttgtgtgatcattgttgcagcagtacatgccatccatctgataaattaccttgaatgtctcaatgttgaccacttaacattagcaatttgcttctttagattcttattgcactccgaaaatttcactatatgctcaattctattgttcctatatctaaaagcagtatcatctctaaatgattatccacttaaagcagtaccatctctaatgctattgttgctatctctaaaatgttgtgagtggaacactctgaattgcttgtgaggagcaggtaaatggttgttgtagttaacctaaactgcaaccgttttttagtgtttttatcaatgaatgattctcctattttagtgccactaaggctaaagctatttggtagagagcttggtaaaaagactacttcctccaatcaacagtatttgatattgggagtaataagttagtactcctgatgtcaaatattattgctaggagtgaattcaaaaagttagtactccctacaatcaatagtgttattgtcaaatattattctcgtgtaatgcattagagatcacaattctttgcttagtagtcatttaccatgattttttttcattttctggcaaagttgaaaaattaagcgaccatgctcttatttgcagcagtttcatggatgcagagctattggaatttgcaaactaaaacatggaccccaatgaacgtcacgactttaaaagtatgtcttgtgcacatgattttgccctactcactttct

SEQ ID NO: 38737 - DNA, 4051 bp, Oryza sativa
cccagcacgaagtgcagcataggcatcagaaagaccagggacaacgttctcgtgctgatcaatgaagttttttacaaaacaactttcgcctagctgtacatatgagcaaaagggaacatcttttttcaatcccttcaatcccttcgcagcaaggacttgcacaatataatgcctcgccaccaaccgcttctccaagctgtacgtgaacagctttggcgtcttcaaaaggtattcaggctccaatctgaccttgccgaccaagaactctatcttgctgccaagatttgtctcagataatcctagaatttgtggtaacttttggaccgcagagcggagcttgtccatggagcaaccaagactgcgactcaagtactccatcctcgcggtggcactgccttcgctgatgttagcaaaaatacccaccatgtacttgaattggcctgaggtgcgtggcacgccaagctcatcggcacgccgcacaaacccttccacctgctttggattggacgtgaacatccgtggagcaaacctggccatcttggcaatatcacaaacagttagcccgcactcctggagcagcgcgatgttgggcttgatcaccttctcaaggtcagagagcaccagcacgttgttccccttcaagatcctgaggagcgtctcgaaggatcccaagaaggggatccagaactccagcctcgaggcgacgtcacacgcgtggatgcccttggcgccgcccgcgaggaggaagctgccgatctgggggtccgacaagcccacgcggtcgcgcagggaggcgatgcggcgggcgatgttgtcggccctggcgcagagcagctgcgggtcggaggcgacgacggcggcgaggtcggcgcgggagaggccgacgccggagaggacggcgagcacggcgtcgggcttggcgggcgacctgaggtgggagagcttcttggatgctttgagcgcctgggcgccggtgaggccgcaggtgtcgacgaggtactcctcgacagagaagggggtcgcggcggcggatctggcggcggtggagaggaggaggcggcggcggcggctgaggtccagagaggaggtggggagatgggtggcggcgcgggcgcggagcagcgggaggaggtggagcatggcgccggcgaggccgccgccggccgtcggccggcagcatgagaggcggagcatgtcgccggcgacggcgaggctgggtttagcgattttgctcggcagtgtggagtgtgcaattttgggcatgttcacttcgatgcaattttcaaccataccaattttttttccaagttaaaaaaaatgtcactaaatatttctatctgtcaaaatttcggtattaccaaaacttggtaaggtttattttggctacaatctaagcaagccctttgctttttaccccccttccatcaaatatatttgtatttgttttttcaagagtaaagtgcattggtgatccttaaacttgtaagcttgtgtcatgtaggtccctaaactctcaaaatatatatccaggtcctagaacttgtcaaagtgtatcatttaggtcccaaatcgacacatcccctctaggatcctacgtggcgctaatgtggcatatgctacatggacatgacgtgttattttcttttcttttttcttctttttttcgttttcttctttttcttcttttttttccctttcttctgcacgggttacagtgaaagaaaaagaaagggaaaaaagagaagaaaaaaaagaaaaagaaaaaaatttaaataggtcccatttgttagttaaaataatgccacgtcatgttcgggtagtatgtcatgttaacgccacgtaggatcctgaaggggttgtggagatttgtgaactagcatgacacactatgataaatcattttgagagtttagggatctagatgacacaccccctacaagtttaaggaccgccccacctcttttttcagtatgaagattaggaaactgctcctatttttgtttcccctatgccaaaatatatttttttcaggaaaggtcagaagacatggtttctaaaatccactatgtttttttttaaaaaaaaatataaaagcactaggagtaaattgctattgccacactagggatctcaaaagacgaaagttgaaccgtattgcaagattgaagaggttagttaaaatgatagaacagagaagatgcgaataggagcatagggagatgcaaataggagcaaaagaagacgttgtagtttgattatttagggcccctgtcattcaaaggaaattcataggaattttagaggatttcatcactataggaatttttcctatatagtcctttgaatcaaaggaatggatcctatgaaattcgtatggaatgactcttcccataaagttttggagaaatttaacatgatgtagaacctcatggaaagaatcctttgagtctttatctttcctcaaattactgtgtttttcctgtggctaaatcaaacaatcattcctatgtttttcctgtgttttgcaatcttctgttttatacttgcattcctgtcagaatcctatgtttttcatattcctctgttttttcattcctatgattcaaatgggcccttagttcttcaggagaagatgtagaaacaaggacgatgcatgttggagctccacaatagcatactcaacctcacatccaaagagatggaagcggtagctagacaaggatcacaagtagtggcaagtgtgtcttagggtaaaagtagtgaggattcagatcatagttgaggcacaaaagggacatgaaaaaacgacggctcgcggagtttacatgttggccataggcatagcataaatcttagcaagaaaaaaaatcaggacaacgagtgacccaaacttttgcatatttttcagttggttaagttgttcaaccagccaattacataatgtgaaaattttgtttaccatgatttaggctaacaaaaagtctacactctacaaacaaaccaacatattggacatgactgaacttgcatgagttgcatctaagaaatctaagcaaagaaactgcaactatcatctaatccaatgcctgcacaagttgagaagtcaatagcactatgtctgaaaaccatatatcattcctggtgacttggtgagccataggtttcaacaaatcgcagcaagaagaatgaaacgggggcttttcttgcttccagcaataatgcaatatcaataatctaattaaaataaacctccaaatgcgtggcaatggcaaattggcaacccaatgaagagcatctccctaaaaacacaccagatgcagccacacagggcatgcatctaagcagagcacgttcagcattttcatgaacaccataatgttgacaaaaaaaggaaaaaatcgaaccacccacaaccaaaatcagctacgtttaatcagttgaacttgaacagcacattggatcttgtcaataagagaatggtagcagcccaaagattcacccattcacacatgaatcacccacaaaaggataaaactctgtaaaaagatttgacagtatttttttccccaatcaaatattattaagaacaaaaggcgccccaaatttagactttacctcataaaccacatgctttagaagcaaccaacaacacaaaagctacttccacattgccccattgccatccctgtccatacctcacactgcaagtacccactggaaatcccaccaatggctagggcagatggtggtgccagttgaagccaaggccgactttgcctatacaattcatctatcagcccagtttatcagaagtacaatagcttagaatcgatattatgagttgtatggatgcagttcagttccacttgtacatcatgcatatatattcaaatgaacctcactctctactccaaactgatttcacgctagtcccacttgtttcattcgaaccctaatatatactccctccgtcccataatataagggattttgggtggatatgacacatcctaatacaatgaatatggacagacggtctatccagattcat

SEQ ID NO: 38738 - DNA, 4136 bp, Oryza sativa
ctccaggctgcacgcgaacaaaacaggcttactcaaaatgtaatcaggctccaacccgactttggtgaccaaaaactctatctttctgcaaagattgttcacagaaagtcctagaatacttggcattttgtagaccataacacagatattgtcaatggagcatccaagagcgctactcaagaactttgtattgatgcgaagtttctcctcagaaattgctagaataaatggctctttgcaaaccatatgaccgatcttgtccacgcagcaattaagggtgctactcaagaactcaatcttactgcgaagcttttcctcagaaagtgttataatagttggcattttgccgaccatatactcgaccttgtccatggagcaattaagagtgctactcaagtacttcatcctcgcagatgcattgccttcggtgatgttgccagcaatagacagcatgtactttaatctactggaggcgagctcgacaccaagcttgccagtacgctccacagccgcttccacccgctttggattgaacgtgaacagccatccgggcatcttgacaatatctcgaacagttagcccgctctcctggaacagcgcgatgttgggcttgatcaccttctcaacatcagctctgacaattgcgttgttcctcctcaacatcttgagaagcgtctcgaaggatccccccaagaaggggatccagaactccagccgctcggcgacatcgcatttgcggacggccatcgcgccgccggcgaggaggaacctgccgatttgagggtccgacaagcccacgcggtcgcgcagagacgtgacgcggcgggagacgttgtcgggcctggcgcagaggaggtgcgggtcggaggcgacgacggcggcgaggtcggcgcgggagaggccgacgccggagaggacggcgagcacggcgtccgggttggcggcggacctgaggtgggagatcttcttggacgccttgagcgcctggtcgccggtgaggccgcaggtggcgacgaggtagtcctcggcggagaagggggtcgcggtggcggcggcggcggtggagagaggaaggcggaggcggcgcagatgggcgtagtaggaggcggaggcatggggggaggaggggacgcggagcagcgggaggaggcgtctccggaggtggagcatggcgccgcggcggaacgccgccgtcgaggtcggcggcgggggttttgcccggcggggtacaagatggactctttctttcttttcttttctttttttttaaaaaaagtgcgcgatccaacggcccgactcatgatctcgtatacggatcgacggttgttatagttacatatgtctctagttatatagtttatgagttgcagaactgtatcatatgtttagtagtataaaaaaaatagatttatcacacgattcatacgcttttcttaacggaaaattttactaccgagcatcgtgacttcgtgattttaactctaaaacactgcacaaagtgaatttgagagaatcgactcgataaacatggaaattagctcatggaaactgcacccattaaaatatttatttctagccgggtatgagagagaactcgtataaagaaatacctttgagctcacgtatatggtctttcagtctttcggtctttcatctatgtatctcgctcaagcatatatggcactgtatgtaagcctttagtttttttttccccttctacctcacatgctcctcttgctactctcaatctcgcaagaggacggggcgaggcaaggcttgatggtggcaatagggtaagaagatgtggaggctgatcgttcaagtgttatcctctccatctctttgcatccacctccgaatcatcacttttctagttgcggcgcgtggagggccacaccatcacggaggaacgatgccgtgaggccaggatgaaggatgcatcgtgcggctgttgacagaaaacacgaggcctgggagatctgcttaactccagtgcaggtccaaaactcgccttcggatgtataagtgtgccagttgatttgatcctgtaatcaacaagaaataaaaacaaaagaaccgtggttaaatctataaatgatagccgatcggccagatgccgatgacatatcatttacgtttgagccgatgtcatgtatagatcgatcggcgtttggaaataaataaaaaaggactaaatctattcgatcggctgtagatgttaacgatgtatgattcttatgtcgacatatactttaaattaagtgattgggatagatcggtcgccatgccgagacggtataaatcacttaagctgaaatatatgttaataacagaattatatatgtttacagcataaccgatcagatagatccagcatgcatcagctaatactccgatgcaactctatgctaagatattagaaacaaacggaatataccaaacagaagcttaatatacgtgagtgcaataatatcttgacatgaagggcagatttaacatatcaataaagtatatggagcaaacatagttaaatcagataagatcggctgaaactccgatgctaccctaatcggcaaccagaaagcaggctagagattgatattctaaacacgagcttaatagatcaaattcaactgatgcagcattaagtatgaaaagaagaacaatatctagacaatcaagccaccggaagtttcatagagtggtagatatcttatataatccaaatcaacagcaagatctaacctgatcgactgccttttgtatgcaaatgttagccgatagtagattaaatagagatattgctaaggattatgtaagatatatgataacttggcgaattatataaacgagattagagtgtcatgaagatgtaagcactaatctatgagaacataattcgtcataacgagtttacctcttgttgaagatcgacaccgatgcagctcaacccgaaagcaagaactcgttgaaatagaataaaagtaaaaggtggcgatgcgccggaattgtattgaatgtgtgtctttaattacatagggttcggggtctatttatacccgaagattacaagatatgcccataccggccatgaccattatctctaacaaacttctaaaatatcacgagtctttgcggcagactcttgcccacacttatctataaggaatttacataaataatctaattaatagatacaattgccttctcagaactctatccatacatggcaatcatcttgaagcacatcaacccgagcccgatgtcgcgcacaagtcgcattactagaatcggctataccaacttactcagcctagctcaaccttagccgatcctagccgtagccgatccagactctagccaattcttgctctgttccagaactcgatctccgcctccaactcttctctgattaattcccttttcctgatacgaatacttaccaaatttggttgtcaacagcggcgtggagggagtggcaacctgtggctgagtcacgccaccatgaaggctaggatggagggagcggcgtgcagtgctgagggttgcgtcatcgcggaggagcaatgactcatggaggccgcgatagagggagtggcatcgccgcaacaacgtatcatggtgcccttaatcaatcgtcgacactgacaagctccttgaaaaccgtgtcattttaccatgctcctccggcatggccactaatctcctcggccgccctaacgacagcatgtccacacatcccattgtgtttggaatggctggcatctacatctccttcccctaacgccgccacccatggttgaccaccatcgagctcaccgcacctcgccccagcctcctgtaggagtgagagaaagaggaagtagaaggggaaaaaatactggaagctagcccatgtgcttgagagagacaaagatagagatgaaagacctgacatgtggacctggggggtattttagaactttcacgtgatttctctctcctattcaaccacaaatgaatattctaatgggcaagttgtccatgagctaatttccacatttatagagtgatttcccctaaaagtcacttcgtacggtgtcctacagttaacaccgcgaaagtcacgattcctgtagtgtgggatgcgaattctt

SEQ ID NO: 38739 - DNA, 4288 bp, Oryza sativa
cagctcatccctcagatgccattgtgtgtcaggccgtcccaagtgactgtagccctatgccccaatcaccaacttgatcaccgtactcacaactgtgaggcactgctcttcaccatcgaggacgtccatctcatctcctacatcattgctatcatcaccaacaaacatatgcaagaaggagctcatgttggggttgtccataccgtactagctcaagccgccgtcaatggctcctaaattcaactcgccacctatcttagtctcagctttgcctcttcctcgctttcctcccggtggcagccccactacacgccactgtgcctcgttgcagtcacacacttgtatcattgccacacatttccttgccaccgacggtctgatctgttagctgtgcttgcactttcactgggatgcaaacgacaacgtcgtgccgtggaagagacccgcccggccaccacgttgcctcattgcctgctaccaccaatgaggctatctctcattgtgcacaccttgccaaggcaggggttgagagttgaggctgcctcgcgatgggcttgcatctagcgcgaggcaacaaagtgggacaatctcattgacgtcctcttagcaggcggccacgtgcgcggccgacaatgtccgcctacacggtgtgaatttatatctttggtgataatttttaaaaagttagtgaattggattgcaaatttcggaatgtcatgaagcttgaaattttcaagagcccctaaatgaagggtaaaatatgtgcttgtcaattatcctagctagtataaacataatagggttaaaaaaaaggagcactacccataatccataaacttccccaaacacaaacaaatcacgccgccggcggctctgctcaccgccagccgccttccaccgccttcgccatgcttcactttcgagaactcctcccgctcctccgctccgccatcgccgccgtggcctctaaccctgccagccacacactaccctctctccacctccgcaccctccgcttatggactccgcaactgcgacatcgcatcgaggctcgagttcttgatccctttgttgggctcctacgaggtgcttctcaagaccgtcaagcgaagctaccgcatcctcacctccgacatagaggaggtcatcaagcccaacttcgcgcagctccaggagtgcgggctaactgtttgtgatattgtcaagaccaacccgaggctgctctcgttcaatccagagcgaatcaagcgctatgtgcatcgtgccgatatgcttggcgtgccccgttgctcgccggcattcaggatggccgtgtgctctaccaatgaaggcagcgtcactgcgaggatggagttcttgagcaggactcttggttgctccatggacaatatcctgatcgcggttggcaagaggccaactattcttggcctatcaatggataatcttcgccgcaagatagagttcttggtgactgaggttggcttaaagctagagtgcattgtggagtgccttgggattctcaggtacagccttgagaagcgtatggtgccacggcattctgtcatggagatactgcgggcgagggggttgatgaagaaaggtgcttccttatatggtttaatcatgcaaggtgaggccgatttcgttgcgagatacattgatactcataaggacatggttcatgggcttgcagatgcttacaatgcatcttgttttgggaaaatgcctgtagtgccggattccactgttaaaaagagacacgggaggcgagatatatattgcaggggtaaggttagtatcgggccttagcatctgatgcttacttagatatcaattcatggtggattctcacttctgtgtcagtcgacttccatggtagaactgtaggtgatctaagttctgatatggtgatccatgcttcaaccatcgatatgtgcaaagcagatgagctgtcttgatctgttccctgcacatatcatgtcttattgctttagcacttgagctgacagtgttcaagttgtattaggctattagctttcctttttcatatcctacttgaccaaactcttgtttacatttcaagagattggccttaagaacatcgaattaccattttgaagttcattatgttgaaggaacattcaagaggttgctctgctctgggatcagccaccacctagtttcatggtttcacgcctatgtaacatacattaacctgtcaattatatttgactattttggttaggatttgctatgtttgaaatttggaacctcctgagttacatgcttgacaattacacttgtaggtcggctttacatctagcagacactcttttggagttttctgagttgcaacagtgatagaatgtatgagctcttggactgctttcttgttgtaactttgcaaaaaaagcaaggtgaataaatttcagacattatattttctcgaagtgcatataagattacaaatggtaggatccatacggaacatgcatacatttggagataggagaggagaaatgaggaggacgaggaagactagggggcaattttgatatttcactccgtgctgtggtaaaagagtgaaattgtaatgatgtttgcgatacaaagccaaacaactttgtgacttttaaagaaggaaaacgttcgaattaccctctgaactattgcagcagtacaagttactgcttaatctaaaaaacggatacttgacacctctaacttttcaaaccggataaataaccccctggtacttttaggcggttttagctagagctagcacacatgacaccaacgtggcaaaccaatcaaaaaatctataggacccactcgtcatatctctcacccatctctttctctctgttgtgtcttgcgatgaatttggagcggcgcctcatcgatcctgcccattggagctcgagcttgcttggggaggtccccaaagggtagcggcgaggaggcctttggaggtgttggctgggggtgagctcgagcactccttagggaggtggtacttgatcactccttggtgtggtgggcagtggttggagattgaggaggtgacacgctactgccgaggagcctaggaaggggaacttgggttcatgtgtggtggccggttataggggcttgttagctccccttctcctcgaggtggtccaactgtgagaactcaaggatgtggagctagagacgagagtactagttgacaatggcgggcgaggggagacgaacctaggtgcagatctagagcggaagagcattgaccatcacttccgaccaatgtctccattgacctccccaagtgagctcaagcatggcaagcgatattggcgagttgttgcctccatggacctccccgagcaagatcgagctgccgttccgagtagccgcctacatcaccctttatgaaagctcaagcttcgccttcaacgccctcctgagaagccccttcctcgccaccgcccactgcgcccacaacacccttgcgccaatacagagtggggtgatgaggctaataggtgggccctatgatttttaaaactccattactgattggattgtcacattagcgttaagtatgactgaaacctcttcgattgagtcagcgcatattttgtccggtttgagaaggttagaatgtgaaatgtctacttgtacagtgggtataattcaaatgtaccaacattttaggggtaatgcgggggtattttttccttgaagtatgctgaaaaacatttaaaaaaacaaaattacaggtccaagagaaatgaccggtctcccatatttaggggtagggggtggttagatccaggggtgtaaagttttagcgtgtcacatcgggtattataaaggttgtcgtatagggtgttagggcactaataaaaaacctaattacagaatccgtcggtaaaccgcgagacgaatttattaatccgtcattagtaaatgtttattatagcaccagtcaaatcatggagcaattagccttaaaagattgggtgaatagccaatgtggtccctgaagttttgcttcgggctcagtttagtccttgaggtttcaaatcatccaaacaagtcctccaaattaatcatttgggttaatatagtccttggacccacaaaaaagtaccacgtgagcatgccaagtcatcctcacatgtagcggtatgaatgaaatgatcattctacccttatataccatatagaaaagaaaaaaatcacaaacagaaaaaaataacaggccagcggcaatcgtaagtgacaattctaaaatgatcataca

SEQ ID NO: 38740 - DNA, 5080 bp, Oryza sativa
tgccgcggtctgcatttcgccacatattttctacctgtccgacaagaacctttgccgaaagatagacttcctgatctccgaggttggcttggagcgtgagttcattgtggaaaggccttgggtgctcggctacagcctcgagaagcgtatggtgccacggcattctgtcatgaagatcctgaggaccatgggattgatgaaggatgctgttgacttcagcagttcacttgtttactctgagaaaaaattcgttgcaagatacattgatccttacaagcaagcagctcccacgctcgcagattcctacgctgctgcttgtgccgggaaaatgcctgctcatgttcaccgttgaatgtagattttcccaggttcgtcctttatctgatgctaattgctagcattgtgccttatgttgttatgctcatcactaaatgtttattcatggcaaattaaatattggcttttatccgtagaactaatggtcatccggagtactcataatgtgatcttctctttatgtttcaatcttggatatctgtatctcatgttatgttgctttcttttacttgagaagcagcgattgagcagtatcattaatatatgtaactcttctagcattttctgcttcctaaggatgtgccctgtttttaatcagatattggctttccttattgtgattatctgcacggttgtgggcttttggcatgggtaatttatatagggatgggacattccatcagactatcatgtagagctggtatttaccgaatcatcatataaagctggtagctaaacataaattaaatatttatgcttgatgacaaactgatgtagtgctgtacagattttgaaaggctaggagctaagaatgactaatgttgctaacttgctatcaacaacaacgtgggaatcctttaacctgttgagtcttgtaatatcattcctcaaaatattccttctgttacaattttgtcctaattactacaggtgggggattattttcgtgtttattttcctccaaagacccaatttgaaaattcagttattagttgatggccccttctgttggtggcaatgtggaaataacacttccaatattatatttgaaaaacccattcttggtggcaatgtggaaataacacttccagtattatatttgttccattatctacttttcttctgttgaactgttaattgcttaaactctcttttacattatttctctaatccaatgtggtcttaatagtttccattgttcatctctaatctttttggaaacatgaaaagaatcgatcaaactaaatatatagtaatggtcagttaagtgaatataaacatgtggcaagctgtttgaacgaggtaactcattcatccatttcaagatgctttcaaggaacctcaagatacttggctgacattataacttttcatcgacattgtttgtaccttctttttgtgcgtgtattttgttgtgagatgattttttttgaattgttcataaccatttagataacatacaggaaacgagtgcatgtgcacttaagttataaattgacttcccccttggtttttttttctatacatgtagcattatacatgcttgtttcttcaggttgctgctaatatcttgtgctgtattttgaggcgggctacagaggaggcaagattgtaggtataccttatcgtatgtgttacacaaatttagggtgttctcattcgaaggttggttatgctgttgcatgaactgcagaaaccttccaagatgaccaagcatgtaacatttgatcgttttgctacctaggatgcatgtttgatgataaatatgatagcaagttccttgatcaagaaaagaaaaacaacaagaagaaagcaagttggggggccatgcatcaactgttgtggtgaaatgatgttcctgtatttttctccccattatctgataagtaaagagtataataaaaaaaaattgtgatggaagatttgacaatctgtctgaaatcttggtgtgaaatattcatgggctccaaattcaaccttggaataccattacgtttttcctaaaatcaggttatcagattttcgaaatgtctgagttgatgtggatttttttaattcatattaatattaggcaactatgtgatagcataatgcaataaaaaatataatttgaaacaactgtaatggagacattttgaagatgtcgctgtgtaaagccccaacgataaagttattgttgcacgtaaaaccaacaacttttcagttcatgatatatgaaaattattcgcctcaaaactgtgggttggcagaatatagaacacattgttaaaacactactgtaactgtttgtcaacgttcaacaatctctcaaaattttcaaattgaagtacaaatttatgaggaaagagtgtgcagatcccactccttccaaaaaataaaaaataaaaacaccccgctctagaaaagacaatgaaaaacaggcataaacaaatatgcgaacgtatgggccgtatttgcacaacttacagggctagtttgatttggagccaatttaacgtatgggccgtatttgcacaacttacagggctagtttgatttggagccaatttttgccctaccaaaatcttggtagcgctaaaacattagcaaattttggcactaccaaattgggtagtattcaatttgaactattgtgagtaaaatttggtagcaaaccaaaatatgcacttgctactccctttatcctataatataagatatggtcaaacgtgacatggtctccaaaactaatttttatcttataatttcttatatattataagttttgtagtaaaaaagttataatcatatgaaagtaaattcaaatgtcaattcaatgatataattcttagcaagtaaaattaaattcatattgtaataaatgttggtcaaaatgtttttaaggttaaatcttaaaattcatggtagcattatattttgggatggagagagtactattgaagttaccaaatttttttttgggagagtaataaattggtatcaaaccaatcaagcccatagttttgctttactgcgataatctaaaatgttgcgtcatggccaatttgatgaatttatacaggaaataaaactttccgtcaaactatgatgttcacctgttgtttgccaaatcattgtgtaaagtcaatagctaaacataaaccaaagttttatacttggtacctgatgttgcgctgctggagattttctgaggctaggaactaagaatgatagtgtcccccataaacagcaacctggggatcttttaattatcacctttttgacatgtattaaataaatcaaggaacatagcaggaagataccctttactaacctactatggagtcttgtagtatcaccctcacgaaaaggggagctaataagcgcacgattcttgatgccttatttgatattctgatgatgcatggatttcttacattcagatcgctctttccgttggtgtccttgtacgtaccatgtcgatttccttgctttgtgggacgctttctccacgacattcttgcatccaggaataccagatgtgccctccttggtagccttctagtttagggcagtacactgccaagtcggcttatgatgctctctttcaggggcaacttattttaggtccttgcctccttggggatgcatttggaaaagctgggctcctggaatgtgtagtttcttcatgttgctatgttgtgcaccgcggatcgtttggaacattgaggttttccgcatcctgattgttgactttaattattttagataatggatttttattaatccggtctctgtatccatggacatacataacaaaaaaaatataagagcacttagactcacacctcgataatgaggagaacacataactaaaaaaaataaaaacctacgacctcggcacatccctgctacccgacattctctcctgaaacgactagattcggagagtggaagttgtctagtcaccgtcgtgctgcccctaatccgtcgtcgttgtgaacctccgctagtaccatcttcatccactttaggcgagctgacgtcacacgccgctggttagcccaccttcatatatcgtcgtctagtcagaactagccgaccagacatgagccgccgggatccacttccgtttcgtgggattcctaggcctctgttgcctatagggccaccgtcatcgttgggatcctctttcgcctcccaaactcccagtccgttgtcacccctagggccaccgccaccgccagggtccacatttcttggaaaaaaaactcagtcctctgccgcccacactcccagtcgtttaatgtaatcattttgtaaacaaaaatctaataaaagctcttacaacaaaaatctcgaaacattaaatgtaatcaattggtagttacagaaaaaccaacatgcaatccaactgtgccacgttactgtaagtaaaagaaattttgtaaacaattattttattacttgcatcattttcctatttgcactgaggtggtgtttagatccaggaacttaactttagtccctgtctttagacactaatttagagtattaaatatagactacataaaactaattacataaatgaaagctaattcacgagacaaattttttaagcctaattaatccataattagagaatgtttactgtagcatcacataggctaatcatggattagttaggctcaatagattcgtctcgcgaattagtccaagattatggatgggttttattaatagtctacgtttaatatttataattaatattcaaacatccgatgtgataggaacttaaaagttttagtccaatctaaacagggcctgaaggttgaattcacaactgctttcgaagttgcagatgacaactagtagtcttgaatgtggatgtcaatttatttttctcaacccgacagaacagctgaactgctacatgattttacagctagtgtagctaaggttagttcaccaaacaatatggccactatcatccacacttttgccttttacctttttactggtacaaatcacaaacatatcacac

SEQ ID NO: 38741 - DNA, 2066 bp, Oryza sativa
tagtacaggtccttgaacttcaccgctacgtagtagtacgcctgctgggcgagcgactggttgttgtggtgtgtccgcaccggggagaagtcgttgaaccactcgcaggtcgttagaggtgcgcggttgatcttctcctcaaagaggtcatacttgttgagtaccaggacgaaaggagtatcgcagaagcatggttgcctgattgtcaaacagcagggaatatttaattaaaaactagctgactagttcaacagaatccattcgagaacagtttcccatttaattattgcattacccacaacattattgccacatcgttcttgactcagttactatatccgaaatcatggagttgaaataaacttaattgttgtactagttctagaaaaacttgattatgatactggaattattacttcatccagtatttgtgaggttaagaattgccagatgcaggagtggagaaaagacaaactgtactatagagaaatgtaccctaaaagttcttagttttcaatgaaaaatagcagcttaccgaatcgtagcctcaaataactctttgctttgcatcatcttgttcaagagaggccgactgctgccatatacaggaggtcccacttggtcatagtcactgagggctacagagaatatcaccatgcggacatcctcaaacatttccacccacttgcagccatcattcatgcccttggcacttactctaatcaactgatatctgaggagcaaaacatataagaacattaagtgcacatggctgagatcgatttgcacatggcatgaagttaagagattacttggtaagaggctgggaatgtgcttcagggttctcaatgtaaggctcagacatgggactgcgatcatcaagggcgaattcaatgaaagccaacccattcccttgtgttacaccttcagcaaagatcacatctttctctgaaggttcatactcattgctcgatacctcaatggcctgcaaaggtattccatgtataggagaagtcagttgaacagcttgaaataaaaataaagttaactgcacatgacaaaaagtagttttgccaacatcaaaacagcaacaatgaagaataacacgtaatactgcaagataatggggggaacataattttggtttcagtaatatttgaaactggggaagggatttccttcctagcttcaaaaaacaacaaagcaaggagataagcaatccttgaaatattcaaagatggcatcaccagaaagaatagatacagttttctggatgagccaagctgttaccattgtaaataaataaagaagacaagcatatgttctggactagtaatcttttttgtaacaaatagtggtaatcaaacaaatatacttcaatgtgaataatgaagcaccatctctagcaacagtggattatattaataaaaaaaatcaaagatcgtaccctgctcaagaagtactcagcaacatcaggaaggaaatgcaattcgtcctttcttttatatgttgcttgtatggcaggatccttccacatctcatcaacaaatggagcgtattctcgcgttgcggcagggaagaaagcatctagatcgcccatcgctatgatatccaaaagccaatctgagaatttcttcagccttggatttatcgagtatatacaggaatttgaaccatttgctttattttcatctgcagcccagaaaccagttcagcaatacagaattgctgcagaaacaaacaccggagcaaatgaattgaccattttaccttgttgggtttcttcatcctctgaaattgtgcaatttgatctagataaagcttcttcctcaaagcgttcacgaccctcaagcaaaattccaaggtacttgaacatattgctttggataatcagtttgatgttttcaagttcttcttgggtgaatcttgtcccgtacaagtacttagcctggtacatgatacccaaaacatcatcagcatgaccatacaagaattagtatcttagaaaaattgcaggcactactaccaggtagatacaacaaaactactactgagagtcgataatg

SEQ ID NO: 38742 - DNA, 5200 bp, Oryza sativa
atctcatacagatccagttacagtgaattacagagagatagagaccaatcaaatagcaatgaaggatcataagagacctgtttaaaaattgtgcttgtaccagcaccatctggtccaagaagcagcagcttttggattcttttctggtccaaataatcaggaacagttcttgcagaatagtgaacttcatctctcgtttcattagagttcccaggaggcaccggaagtgaaaataatgcgcatgcaaaacgtgtcaaagcctgggaataaaatgatcattagcaacaagcaaatttagcttttaagtttgaggaaatggcaacggactctaatttattttttaaccgagatacataccgactcccagatttttcctttgatgttgttctgtccttcttcctcatagcgaccatcatcataaacccaaaaatgagtatcacgaggacattgaacatttgcaacctacaagcacaattccaatgatgtgacaagcattgcttattttgtggtaaaagaaatctttaaatcttggccattgattcaagggcccagtttagctaaaagaaagcattcaccactagtgccatttagtagcccttgctaacaggaacttctggtcgatgaactaaatagcctgatgtgtaatccttttccattatctaacaaataatagcatgctatctggaatgacaaacccactgcatttagtgaaacttcctaatttgtctaagctgtgaaaaggattacatttagtgaaacttacaaataatagtaagcatgaaaggtgagacttttctcaaaaacgaaggttatggttataccaaaagtgaccattttttgcatatttatagtataattaattggcaagttatgttacagttaatggttgggtatttttattttgaatatttcaaattatataaaataccccttccaagtgtagtggttcatgacctatataaataactgtgtcaaaggtactaagcaattgggaggcactaattttatcattcatgcttttcaccaaaaggactatctacaagcagcttggaagaataaagcatgatcggctaatagcgagaagcagttctaaagaaacagagatggaaatcattggtacctttagaattttcagctcaatctttgttatttcccttccatttatataaacttgggtatttccgttactggcgttagcctgaagcttcccagtaaagctgaggttagaactaataattctttccggtttttctccttcctatcagaacaaaacagttttatcagcacaaaatcctgttaaacttataacaagaaaattgtgtccgtatgctcataatgaatttacctttccccataaacctgactccttgtcataccaatactttccaggcttcagcttctgaggtggccgggagcaactaagcaggtctgtcagctcatctggccccagtggacaaccattcacaataagttgctccggccgaagctggtttgcttggcactccttctcggctttcaatatttgccttacttccaaggggctaagtaaccttgagagtgtccttgagttcttccctagctttgaccgcttggactcatcaattggctggccaatgcaagtgacgcacttgcgcccttccggcatcgaccccatcatcctcagcacacagtagccgcagtacctcgcatcgcacacgatgcacgcttccttgctctcccatttcctcttcccacaccgatagcacgccctcctcctcttctccttcttggtcaccaccacgtactgctcggacatctcctcgaactccttgctctcacacttgctgtccggcgtgaacccgaacgtcaccgtggcgcctctcctcccctcctgcgtccggcggctcctatcctgcggccccggcgagctctgcgctgaatcatgcgacaacgagcgggaatcatcatcatcatcgtcaaactcctcattctgcagtaccgaattgaccgaatccgagctgccgccgccgacctgcgccgacacgggctcggcgcaccgggcaatccgggacactgggagcgggatgggctccacaaccggcaaccctcctccgttcccaagcctctgcgggccggacaccggctccgccgtggggatctcgacggggtccaccctaggtaggtcataggccaccggtgggccgtcgtactctagggctatggagtaatcgagattcggcggcgcctccgggatgggggaccccggcgggaggatcctcctcagcatgtcctcccagctgcccccatccaccgcctccgccatagctgattgatagctcctagtactgcctcgttgagggatggagagctgacaaggttgaatctttccggaggggaagcgaatcgggggaatcaaaatccaatctttccaccaccaaactgaccttttcagagaggagaagaaagctcatttcacggtaatccaaacccgcggctgcgaaatgagggcggcggagggtggatctggaggaggaggaggaagaagggaagaagggagaagaggagaggagaacgtggaggtagcaggagaggagagcagttagcagtatgcctagttgcctaccaaaacccactttaccaaaacagcagtaaaaatttcacctttttttttgtttgtttgttcctagtactaaccaaattaacctgagttgatggattgattgatcaaagctgttgttgtatataaaagggagatatgagaccatgagacgaagggagggctcgctattagagcgagtataataagatgatgtaacaacggggagctaggagttagagttactatattgttaaatttgtttttaggctgtgtttagattggcccaaagtttagaatttggttgaaattggagacgatatgattgaaaagttgtatatgtatgaaaggtttgatgtgatagaaagttggaagtttggaaaaaaaaactttggaactaaacatacccttaatggtgtaactgcgacgataactttattatgagtttatgataggggtgtcttttcaggtacggtgagtaaaaatggttagattagattttcagtttagatgacagcgtgagagagtagataagcggtgagttagaaggattgcaatggagaacaaaaaatctagcaaaatgagtgggggcgatagatgatgagtatggtcggtgataaggacaagagaggcaatatggttaggagcacgggatggcgtggcggatccgattacgtaagccatctaaggcaaggcgagataaaactcactaaagttgataaaaaggatggtgatgacaacatagaggagaatgaaaaggagagtaaagggagaaaggcagagaagggtgtagttagaggggtacaccaatgctgacgtgtggaggtaaagtttttcgtcatgataccgttagagcaaatgatgtcatgagatgggatcaagaagagggaacgataggctaggcataggtggttgcactagcacacaacttgataacaacataatttgagcatttttaaataacaaatagattattataaatcaagaaattagcaataaataaacatgtaatattttattcatattttgtcacataatttaacatgtatctaaaacatctctagaatggttgtcgtgttaggttgatgaacgtaacttatttatttgttaacatgcaaaatattgtagggaatttattttcagatatgctaaccgtcataaaagaaatttagaaatttaccatatatatttaaaaatcaattcatttcaagatttgtgtttggatcttcttatgcaactttattgacgttatcgactaaagatctcattgcgttaagtctttgccaagttaatgtagaaaaacagaagagggtcacaaaccttaagggtagatgttggtatgaggtggtgattgttggtttcaggatatcacaacctcctctataattgtaggaaagaatggtctattaaaacgatagagaagaagcattgctccttgttgatgccgatggtgacactggtaaggagctcgatggtggtaagtagagagagggaggtgttgtgtggagggtttagtattgatttataaactatccctaaagaaattatcttctgagtattagatgtaatacgtaaagggtgtatcaaaattttctgcatagaaggaagagcaacaaataaagatggcaagaatgacaaccatgttcgatgagccaatagtcggtttcaaggtaaccactaactattgttgtggtaatggcaattgtatctattttatcatattagattagcttctgtaaatgaattgttgtgctgacacaccagtattaattataatggacgtgttaaattattcatataagacacgtaaactttccaaatacatctgtcaccacacatgaaaataacaaaagaaatcgaatatctaatggacaattaagtactaatagataagaagaaatatttgaagactaaaaaaaatgctcgtgcgttacaatgggtaaatgctattttaattttattattgttatacggtctcgctagggtaaaattcattgtgggaattctcttgaatattttttttagaaaatcatgagctgcaattaggagtctgtatttcatctcaagttagcatgagtttttttaaaagagatttcttatacggctccttttgtatttccaaaagcaaacaagcttaaaatccaactcaaacacggatatgtatttgtaaaagcgaataaacttaaaaactaactcaaacacagatgacgtactaaaataccgataaaaacatcttcaatttttgtaacggtagaaacacagacaacgtactaaaataccgataaaaacatcttcaatttttgtaacggtagagaagagatatggtgtgtagtaaaccaaacttgcaaggaaccatgaaacactgttccaactcataaggagcacggtcagagaaggttattgggccaggccagcaaaaattaggcccatcgtccgatcgagctgggagctgggcctatgcgcccacactgcatgcaagtccccaaatgggcctgatttttcactgctacttccaagcttaaggtcaaagtagagattgttttctttttatagttattttttaaaagatttaaaaaataaattaccgttttaaagtttagcaaaaaatatactcctcccacccta

SEQ ID NO: 38743 - DNA, 2050 bp, Oryza sativa
agaatgaggaaagcaggcgttgcaaaatgttgtttagaactcaaccttagtctcatcatgcgggtcaatgaatatataggcttaatttgatcttcgaacacatgggatcgagctaaatcttcagagaaagaaagaaagtatataacagttgaaaatatggagggctattcatcagtcaattattgatcattcttctgaacatggattttttttgtatatgttgtatagttaatttggtagcagccgttgatcttctgaacaaacaaactgaacttcttaggattcctagaaaggagaaacgaaaaggaaaaaaaaaagaggcaaaagcacgatgcattcggtttcagttggtctgtcgctgttcttgtggtacaagtttgcgatgctttgaggagtcggattattaaattaaattaagaggaccacaaaagtttagaacgctcactggcttctctccgttcataaaagcagtgacggatctagaaacaaatatcaagatctaaataaattagttaaagttaaagttatagtcccatttctatctatatatagaaaaaaaattagtagggattaggtggagactcccattatcctcgcttcaaacttcagtagtagagacttgagtcctcgtcgctcctatgatacatccgctcctacctttaaaaatatatcttcgagtaaaattgtcttgtagatagaagctttgttttgcacagaatgtttagtggggtcattaaacctctttaataccatttctacattttctttgttctagccattggaccaagagatactctatcattttcctcgttaaactatctcttgcgtaagttacttttaactagctaaaacaacaattttttattagagacgttattagagacgtatagagtatttagttaacataccctcccttacttttgtgcttcctgtttacacctaaatttggtatctaggatagaaataggaaaagattatcaaagtttggagttctgccggtttcctccagagagggccggtctgatcgccatgtgttggccggtctgaccgccatgtgttggccggtcagaccggcggtgtgtggccggtctgactggccgagttcgagtccggggctgtttttgtcggatcttgggtttccttactcgggaaggcatgtttcgggtttcctttggattctatcccaagttggacgtggaggagggcctgtagagggcaagaccaacccctatataagggggtaaggccggttcattctaacaatcaatctacaatcaatcaattgaatcgtttttcatattgcttttagttttctcttagtttgtccatctttgtcgattgtgccgtaaatcgtccgccgccactgcgagagtgcgacacctctttgtagatttatcctgaaaaacttctgttttacccacgagacgggtagttatttagagtcggctccgctagccggttatctatcaaaacccatctcgatttagcttttgctagattgaggtgattggcgactctaggatcaccgcaagacgtttaggtgttgcgatcgtgcttgtcaacttgtcacaaaaggttgccaacactttcatttgtttatcaggattgctgttgattactactatagctccctccaatttttgtgtgtttagtagcaaacaatgcttgttgcctgatatattcatcagtagtacatgtgtggagcacatcgttttcacttaattaatcgtagctgtatactccctccgtttcaaaatgtttgacaccgttaactttttaagtacttgtttgaccattcgtcttattcaaaaaatttaagtaattatttattcttttcatatcatttgattcattgttaaatatactttcatgtacacatatagtttcacatatttcacaattttttttaataagacgaacggtcaaacatgtgctaaaaagtcaacggtgtcaaatattttgaaacggagagagtactatacttgcaatgttggtgcatgtgtgtgtttactgtatctaagacaatccgatgtataatagcttagaccaa

SEQ ID NO: 38744 - DNA, 3628 bp, Oryza sativa
accaaattcgtgggactgatggtcgaataactttcatcctcaattcatctataacgaacaatccttttgcgagacgtcaaaacctagtttcgattatctcgatgatttttacatcttcaatatatataataccatgctcatgcattgcaacagatgactcatatactaggacaagatccaacttattttttaaaccaactctttttttttctatttttctttctaaccaacaatttgatttttttaatggttttctgaaccaactcatttttttctatttttctttttaaccaacattttaattttttaatggttttctcgagtatggtgtggttgtgcgtgtaatgtgagagggagggatgtgacgacgtgtagtgtttttacagtagtaaaaacaattatgtacttttggttggtctgattttttttcctcaactatacagttatacaattagttaaaatcaatccttcatctccttagaaccgagtataaattaaaagttccttatgcttcagaaaaaaaatctattgtgtgcttggcaaaattaaccaaaaagtaactatctctttgtgtggaaatgtatcaaccttttgaaccaaaatctgcaaccttatgcaaccgattatacaaaatacaacagatgcttcacgtcgaggcttttctaaaggcccaagttctcaagatactattttgcaacaatgcaactttacttgcttagcaagggacaagctagagttagcatgtggtctcaattacccacaatcagagctaatgatctagtgaatacattagtttcaatttgtacctgtgtactactctaccaaccaaccaacatatggccttaatttgcttttgacacaattgactcatgctagctactcatattctaaattataggagtattattattaaggttgaaatcaccaatgacctttgttggtctcattagccatcaaatggatggaaccttccaatgaagatcaaactgggattctctgacaatatccagttaaaaggatagcatcaattaaggaagaggttagttggtgatttaattaactgctagatgtttaagttaaactatgtatgagtaatccagattgttgccagtaaactagggttagcatccaaccaactctaattattattaaattaatgttcataataatacaacagggtacgtggtacacctgtaagtcttaggatggatggaatatcatgatcccagcttgcctgttccatgtgagcataattccttcacccaactacatgcatgcatatattatatgtgtgcttgaaatacttcaacaaaactatttagcggcatcactaacacatggaagcctcgacttgcactcctattttctactgcaaaagcaaaattaatcagctatatgttggctacagtggtagagcctattgggtataattttattactaaatctatggttttatataaattcaacgctaaatctgtattttggtgttgcactttttcgaatatagtttttgtgatagtttgattaaagtatatgtattttttaaaaaataatcaattccaaatgacatagtatagctctacatatgtaaaaaacatgtcgggctgatatgtctcaacttaaagaataaatatcttgtaaatatccatactaaatgcatctaaaacatacatttagtgccattgaaagtactttcttgttagaattttaccatgttctacaaaatatatcaatatatcataatataaatttgtgactaaaatttatttctaagaccgcatctagtgcattatgacgtgtttttgtgaccataagtattcgacgcgcgagattgattggctactcagccctcatattaccattaaccacaacaaaacaccaacaaattaggatgagttctttcccccaagttccaactcatttccctcgttttccgcgcgcacgcttttcaaactattaaatagtgcgtgttttgtaaaatatttgctatacaaaaaccgctttaaaaaatcatattaatgctattttttaagttctgttatagctaatatatacttaattaatcatgcgttaatctatcgctctattaagcgtgcggaggggaggggttcccaaccagaacacagccttaatcaggccaccaacaagcaacatgtgccagctaggcttggaaatgaaacccccaaaagtacaccaaaaagggccccaccacaaaacacaaaaccggtactagctgggaagtgggaaattctatttaacagtccggatagacatccacccacaggagccatttgtatcttagttcttgtttttgtttttgactcttttgcattacttcctccaccctaaaataacaagttttacttcttgacatggctattaagacatggctattaagaaaagtgatagatgaggtataagctaggactataataaagacgagtgacaataagaatagtatggatagtttagtgataaaatatgtattttacaactacttgagataaactttgaaccctataagttattatattttgcgacggagcgcgtaccatgtggacattacaatggcaatacaataatagataaacattgtcaactgtcaaatcctccccttggcccttgggacccccatggccttaagctttgcaatcatgcaagatcactttggttttttccaacctagagagaagccaaagggatgaggagattctccatgattctaatttagatcgactatctccatgattctaatttatgaacatcctttcttcttccccttagtataggcggtccaaattggtgtgcctaaaatgcaggaacttcaaaggaaacaattttctttcatattaaaaaaatataacagatacaaaaaaaaaaccaccatgaatttgtgatgatttagtcggaaatggttctcagtcggtcgaaaattttccatatttaattaattattcagtgacgactataaaacctcaccgacaaaaaatagaaaaatcagattttgtatttggctaaaatcggaaacggtgccaccaccgtttcatctctacatgattggtttgcactcactagaacatctgtggagcctgtgctcagccagggtcagtgctaagtcagttggagatttggaatgaaatgcataagcatgaggtctttgccttgttggatgccggagcatggacagtggtccatccatggtcagagtctgtgccgttggcccgggagaaacggctgcacgcctttgacaatatgaggtgaccaattctccggtttgtgtggatcagatgatcaagtgatggtatatatactggagtataattcaattggcttgactatattcgaagtaacagattgataatgttatagattgatactccctccggtcatctttattagacgctgagagagctataagtataacttttccgtcgtcaaataaaagtgactgaaaggagtatagaactttttttagaaaaaaaaatttgtagattggcattgtaatcatatgagtggatgcaaatggagcaaaggaaggatgatgcagtgaattatgaagaataataataataataagacaaaagtagataagtaaatatgatatatttgaccagttgatcgatgcaag

SEQ ID NO: 38745 - DNA, 10551 bp, Oryza sativa
  unsure (1)..(10551): unsure at all n locations
ctcatgcccccgcccgccgccagcctcgcgcccacccgccgcccgtcgccgcgttcgcccccacccgccaccgccgacccacccgtgagatagagaggaaaagtgaggcatagattgagagagagaagagagagaggaagagtatgacatgtggatcccgcaaatttttttataaataaaatgttgactggactgccacgcgtacgacacgtagaccaaaaccaccatggattgaaccgagggggtaattcgtccggtttgcatagttgggggtaaagaatgtaaagatttgtggttcaggggggtaattcggacgaccgcgatagttcgggggtgtaattcgtactttttcctttattatatccggaagaattggagagagacagctgtgtaagtacagatttaccctttgaattttttctttttctttttcttttttcttccttatccttttctccctctctcgttctttctctctttctctctctgctctcaaccgtcgccttcaacctcgcccgcggccgccgccgctcctcctatgctcgcccaccgtcgccgctccgccctccgcgctcacttgctgtcaccgctcctcccaggctcgcctgccgttgccgctcctccttcgctcgcccactgtcgccggtgctactgctccatggcttcatgtccttcatgcccagcacggtgacgtagacatgaacgcgctcagccactcatcagtagccgacggcgaccattggcgcgaacacggtgccgggcgagcagtcagaggcggcataaccctcttagctaaataatgcaatcttgtgcatctagtttctgtagttgcattgcatatgattggctgtgttagaatctgtcagcagccgtaatactttcagttagcatgtagctgttttctagctagtttttcggttggactgaatggatcgtgggatggcacggtcagtagtggatccagatcaatcgggtgttttttctgttatgcatgtaacaaactctgtaattgaggagaataattagaaaaccagaaaagcagcaaggtacttcgctgtgccaaaactctgctcgttctactctgttcttcagttaactattcatatattcgacaaaaggttcagagattgtgagagtgagagtttgatcctgtaaaaatgagaccgtgtgcttcacatccaccatcgtttcttctcctctcttgctctttgcttggtgatgagaatgtaagatgtgtttaagcccgtgattagtgaagactaactaaagaaaatgtttagcggcccacgttggattaacttgagccaaaggcaaactagtttttaatgattgtttctctctcctatttctctaaaaataatcccgccggtgtccaatagctaattaccagtttttacgatgccctacagcaaatacacgttcttacgatgtcccctagctaattacacgtttttcagatgtcctgtagcaaattttgccaaatataatttcatcggcctttcgtagtcaataaaaattcatggtcacataagtgtatttcggagaccaattaagttatcgtccaaagcaacaagtatttgtcaccaaagatagcattacttaatgaatcatagcatgtccttttgcgaagaacatatatacgtacctaaagcttattaacaaaagcaaaagtcatgcattcgatgagtccgtttatagataaaaggaaagacgagaataaatcccatttttccacaacatgtacttttttaagaaaattaaatatgatagcaaaattgagactaatccgcatctagtcatctaccccataaaaggagagatctccctgtcatatacagcactgctatacatacgattgtttttatacgacgtttgtacgatgaaacgtttctctcctaacttctaacgtttttttagcgatgaaacggatcgctcccctgttgagcccatatccaaagcccaagctctgacgtgctggtctgctctctcgttggcatgcttgcgtagccaaccaaagcaatcttctttctagttatatattaagcaattttcgttctaattatatcttatatagtaattgtacttagcgctcatttgttatgtggcaggtgaagcaaattactcatacatatatgttccttacaccttggacagggatagcatcaggggttgctagctggcgcgcgcgcgccagttgctcccggcccatcagccctatttttctttttttcgcgattttttttcgtttttcttttgcgatttttttcgcttttttttccctttttttattactttttttaatctttagcacacttatttttttaaaaaaatgttttgagttgaaagttttcaaatctcgatttgaaagtttttaaatatgagttgaaagttttcaaatcttgagtcgaaagttttcgaatcggagtcgaaagttttcaaatctgggatgaaagtttttaaatcttgagtcgaaagttttcatatttttttcaaatcttaacttaaaaaatttcaaatctgtacttgaaagttttcaaatcttgagttgaaagttttcaaatctcgagttgaaagtttttgaatctcgagttgaaaatttttaaatctgagttgaaagttttcaaatatgagttgaaagttttcaagtcgaagttgaaagttttcaaatcggagttgaaagttttcaagtcggagttgaaagtattcaaatctaggttgaaagtttacacatatatggaaaaattcggaaaaaagaaaaactaaccgtgtcttgccgcccattgggccgtgtgggctggcgcgtgcgcgccgccggtgcgtacgcgccaattaggattcatggatagcatcaaccatagttggaagtagaatctaatggccacaatcagaattggatgcagaaaaagtttatatatatatatatatatatatgaaccaatgttaaacaaggtttgcatatgtttagatacagagagactgtatagtgctgctcagcatattaattgatgtcacatggtaacgaagcagaacttctttcaaacatattccactcttttagtcatgagatagaaggacaaaaatatcttcttttcccttcagattagacagtaaatttagttagattgaatactacctggtagattattttaatataatctcaagtataatataatctcaagtcagatgctgcaaagaggttaattgggctttcgggcccataagcgctcctgccacgtgtgcgtgcgccgtgcgctcgcgttaggttcccctgccatccgcgtcgttatgtttgatcgtacaaaaatcggaagaaaaaaatcgtatgcgtagcattttccatgtcatatatatgtgcctagactcaagtggatagattcatgcccctattgcaagtcttttggagcacatatataacccagctcaataagttgatttttggcaggttcaaataagtccatgcgaatgggataacaacatcatgtggcccaccgaagtgagctttgcacgaacctgaagtccagagtatgacttcagcttttctatccaacaacaatatacatgggtgtactgtgtacaacgccatgcaggcttcacattctccttttgatttcagatttatccaatctcactagctacctcctatgtacttgtttccactttatatcgcagaaattgcttggttcttacaaacggaggaggactatatagaaataaaacatggtacgagaaacaaataacaaaaataaaagaaataaacatggtacgccaaagagaagtatccactatgcaatataaaatctactgaaatttgttagttttgaatcaatcaccaacatctatactatacgttggacattgcagaaaatagtccaatcctataatttgaactattgataagaaaaagataagcaaatgcgagattacatgagtaatagttgggtctttgaacggtccatgtttgataagaaaaatataagcaaattgaggttacataaatgctagttgggtcaaaaggaaatcctaagcttagcaaaagcaacctagaaaagaacaagaagaaaaatgaaaggactagaaagtgcaataagattcttgattaataaaaataaatcaaacttgaagattacgtggacaaattatccctaccaagttctccacataaacaattttgtcaaatttgaattggtcctagttgttgactagcatttaagtagctttaaacataaataattccaaaaagatagttcaaattcccgccaaaacaaagataataattcacattaaaaacacgtcgacggagaaaaaaattcctactatcctattaaataaacaaactgtttaaccccaacaaaaatgatctaatcacagaaccgcaaaatagctacttctgaatcattatcatcctcgtcagcatcagtgagctagagctgctaagaggaacatgaggacatgcatgaactcatacgcattggccaccccatagcatggagcacgcactcgttttgacttattttttaattaatttattattaatcaatcaattaaaacttcataccacacacaaacagaaaacattaccccaaaaaacccataaaaattaaaccgaaaaacgcccaaaccaaaaagataaaaaaaaaacccaacgccccctctctaatcaacccctcccctaaccttaccaccacccaaagccctacccgccccactcacacccacgtgggccccaccacccctggccccacgtgtcagcgagtggcagcgcccgtcacccccgcgttcgctgtgccttcccccttaatcaaatccagcggatatttttgacgtccgcaaggacaaagtctcgccattttctcctccgttttgttttttttttcgttttcttttttcttcctcgctttctctctctctctctcctcctctccctcttcttcttcttctctgccaaatcccatcgcgaaggcgagagagagagagagagagaagaaaaagtgaggggattaacaaactcgcgagtttttcttttttttttttgtttattgtgtgaatttggcccacgtcggcggcggcggcggaggagctaaaccctagccggaggtgaggtggtggtggtggtggtcgggaagtggcggcgccggtggtggggcgggggggcgatttggcgcgcgcggccgagctccggatcgccggatttgtgcgtgagcgcgtggagtttgtggcggtgtgctcgtgttgctgttggtggtgaggtgtgaggtgaggtggggtggtgtggcttctgctgctgctgctactgctgctgctggtgcttaattttgctcgggttcgtggggttgggaagcgagggatgcgatctgggaggtgttcgggagctcggtgttgcttaattccggtgctggtttgcggtggtgcgcgcgcggcttcttctcggggtggatttggtggtggttttttttgttgccctcgttgttgcgggtggatttcggggggagggagagtttgagggatgactgctcgttcttgctcaattccggtggatcttacggtggaaggatggcgagctgagtaaaggcgcgcgatatcttgctgcggtttgtgcggagcttcggagcactttgtcattgctggcaaggatgatgccgtcggggccgctcaacccgatgggtcccgggcagccggtgggcgccgccgcctcgctgctccggacgagctcaagcctgcttagtggtggtcagcaggggatgggcagtggcggaggcatgattccttcgcagtcgcccttctcatcccttgtgtcgccgcgcacgcagtttggtgctaatggcctgctgggaggtggctccaatgtttcctccctgctcaaccggccgtttgggaatggtggacatatgctcggtccggggttgatgccaggtggtggtgggattccaatgaataccctccagcagcagagaggagggcttgatggtgctggcgatttggttggcgtgggaggttctgatcctctctcgtttccttcatcgtcgcaagttagtttgggcaatcagctgggttcagataatctgcatcaaccaccgcaacatcagcaacaacaacagcagctggatgctatgcacgacttgcagcagcagcagcatcatcagcaactgccaatgtcttacaaccaacaacatttgccaccgcaaccaccacagcagccacaggctacagtgaagttggagaatggtggcagcacaggtggggtcaaattggaaccgcagatggggcagcctgaccagaacagctcagcccagatgatgcgccatgctagcaatgttaaaattgagcctcagcagttgcaagctctaagaagtttgagtgcggtgaagatggagcagccgacttcagacccatcagcattcctgcaacagcaacagcagcagcaacatttgctgcagctgacaaagcagaaccctcaagctgctgcggctgctcaactgaaccttttgcaacagcaacggatattgcaaatgcagcagcaacagcagcaacaacaacaacagattctaaagaatctgcctttgcagagaaaccaattacaacagcagcagctacttcgccaacagagtctaaacatgagaactccaggaaagtcggccccttatgagcccggaacctgcgcaaagagattgacccattacatgtatcatcaacagaacaggccacaggcaagtttttgggttattcctaacaagtaatttagtgttatgtgaaggccatgcgcttacagtttagtgtctctatttgttccttttggtgcaggataacaatattgagtactggagaaattttgtcaatgagtatttttctccaaatgctaaaaagaggtggtgtgtatctctctatggaagtggtcgccaaactactggagttttccctcaggtttgatgtgctgtttccgacttgccattttttaatctagaatatagattatcttgttcatatattttcttatgcaaggaagttctgttctattatttaattggcaggtgcagagtagtgacagtgcctcacattttaaatttcctttcaaattgttagttgaagttctctatatttgcccttgtaggatgtatggcattgtgagatatgcaatcggaagcctgggcgaggctttggtaagcattattttaatttgcacatgtttctttgtcaattctgtttttacatccacttatgccactacacctttacagagaccacagttgaggtgttaccacggttgtgccaaatcaaatatgccagtggtacattggaagaattactatatgtggacatgccacgtgaatcgcagaatgcctctggccagattgttttggactataccaaagctatccaggaaagtgtattcgagcaattgcgtgtggtacgcgaaggacatctaaggatagtttttaatccagatctcaaggtattatatttttaatttattatttgtctttttttttggttactggtgggcctttaaaattagttgtataataaatggtgccttttgaactaaagcatgtttccttttcttgaagatcgcgtcttgggagttttgtgctaggcgacacgaggaacttattccacggagatcaataataccacaggtatttagccctatagctatatagagatttttattcaagacaaatgtcttatttcaatattctgatttttgggcaaaatgggaaagggttcaatatattttgtgacgcttggtgtttctaagcaggttagtcaactgggcgcagttgtgcaaaaataccaaagcgctgttcaaaattcgacaaatctgtcaactcaagacatgcagaataattgcaactcgtaaggagattttctctgatgccctcaatactttccatgttcagtttattgcaaaatcattaatgctttatccaccttgctccgatatgcatatttttgtgttcttttgaaatttatcttatttgcaattgcaaagaagccgtgtctactagtgtaaatacttttattaactctatgctagcgtgagctgtcttccaaaatgggacgtagcctctgtctcattcttcgagttcagggccaagctgtacaaatagttaaatactagtattccgtagcctaaccatttagattttgtgtcatagcactagatagatttgcactatataatggatgtacatgaattttcagttagaagtcaaatggtagtgtgagggcatacacaatgtggaagaactccgatctggctcctctttgtatcctgccagttaccttatcttttgcattctggttcgatgtctatatcccccgtaagaaaattgacattatgccgttgtcaaagtgggtttcactggaatgccatcctgcaaatgggtttcgttaaaatgtcattctcaaatagggcaacacaccacaatgccatttcttccatttattctcaatcaaatgaattttgccctgtttttcttgatgagctgaccaaaatacgtcacgctcgttctctctctctgtctcgctgggctgtggctgccgtcagcaatgcggcgccattactgagctctggccaccccgcatcaggaaggatgggaccaacgccgttgtgcacccaccgcacgccaccgcactctcccgatgaggacagctggcggcagagctccatgaggatattcgcgcacgagcatgatgaggttggtggcgtgcaatggagctggaggaggccactgctgcttgaggaggctgcggtggcgctgaaggaggccgctggtgcgagagcttggggaggacaccggcatggaagctggaaaaggccggtggtacgggcggcgatgcaggagcttgagttgttctcctctgtttctgcctcaatccatggcaggtgcaatttcatcaattgaagttgcaaaagagggcaaaattaaacaaatgaattaaaaagggatgaaatggcattctagcaagtagctaccatttgagagtggcattttagcgaatcccacttaagagatggcatttcagtgaaacccacttttgaggatggcatgtattcaattttctcattgcctgcagacttgtctgttggcttgatgctgccaccagtaagcttgagaaagcggagcagcagcagcagcatgtgaagaggtgtcgagagtctgagaaatacataggatcatgagatcaggactttaggagaagatgaggcgaagaggatgatctcctgggttcacttgagagaagagatggctgttgatctggtttgggggcatgatttagggaaggagggagagggtggagatatgggcttgtagattgtgtgtctgagtggttactagtagtaggctgccctgagtaggtgcgaaaataattctccgagaccaagtctctgtttacaccgtcctcaaaacatgacaggtagacataactgccatctacaagtagttaattctagagtacgttagtgctttgagtagggtctaaacagagacctggtctaggattattgttgtagcgggacttttttcctttaacctgttctttttactggctataattggtatatgatggattttcactgaatataactactgctaattgctggctaggcacctgcctagtgtccaagtgcccccaaagtgccaaaacacagtgctgtgcaaatggcgtgaggcatatgtggttttctggtccactggttgagttcctcatggcacggtagttttgtactgtactctgtgatgtatgcagtcctgcatgtaattctctactgaactacacgcattcccccgaggtatttcgattaagacgcatccaaaactgtggccaaggaaggccacggaagaaggtcctacatgcatacagcctttctgcatgtagtagatggaaatttacttatttgaaacattctatggaaatttcatttatttctttttctaattggatctctgagacaaattatgcctgataagaaagttactattgaggagcacttacaatggtctagttagaaggcaagttagagcagcattattcaagtagcgtaacatgtggaattaacatattttgtgttacatattttgcatgtttgacatgtgcattaacccatataggcgaaatatctattaaaatatatagttgagactacagaatgagatgttttacaaatatacaacattcttttaatgccactgtagtgtgtgaaggcgttacgcaaaacaaaggtgtggggataaccactgaattttgaaggtttgcgacccagtgattttggataagtttagctcactgaccatcagccccctaaaaggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 38746 - DNA, 644 bp, Oryza sativa
actcctaagtgaatttagaagcatatgcatctcctaatgcagattactggaaggtggctgtccgtagtgaaatggattcgattatcgctaacgggacttgggaggtgacagagcgaccctatgggtgtaaatctgtggggtgcaagtgggtgttcaagaagaagtttaggcctgacggtactattgaaaagtacaaggcttggcttgttactatgggctatactcagaaagaaggcgaagatttctttgaaacttactcacctattgttagattgaccacaattcgtgtgctactttccctagcagcctcacatggtcttctcgttcatcagatggacgttaagataacttttcttaatggagagctggacgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattctgtgtttgtatgttgatgacatactgatatttgggacaaaccttgaggtgataaacgaggtt

SEQ ID NO: 38747 - DNA, 254 bp, Oryza sativa
ggcccaaggacgacggcggccggcgacggaggcggaggccgaccgggcgagcggggacgcacggtgggcggcgggctcctcctcctcgcataggcgcgaggtggccgccggcgcgcgggggcagcggctcctcgcgtcgccgccgcctctcctcgtccgccgccgcgggtgggctcgcggcacgctctccaagccccttgcacgcgcgcacgcatgagggcggcaagaaggaggtcgctcgagccacgcccgcc

SEQ ID NO: 38748 - DNA, 725 bp, Oryza sativa
ggctcgggttttctggtggaagtcctgtgtctaagcgcgtgatggtaaatgggaaagaatgcttgatgtttgtgagagaaggtaaagcaccacaagaaagtgaggtgactagtcttgtgaactgccagggacccggaacatccggacagaccgggagaaacctccgggtgggaatctctgtctctcaaaaattcccactaggaagttccggccgttttgccaggaagttccgggccaatggccatgcacaagacatgaccggaagttccgggcacaaagccaggaggttccggccagagggtctttactatgattcatatgtaatttccaaaaattcagagggcaaagtggttgcctattttaatggaaattacaatgatgagtaccgcacttgtgtgtgggtgccaaaggctttggtaactaacatcaagggacccaaacttagacaagtttgggttcctaaatcccaagcttgattttcttgtgtaggcatactcctccggtggttcaagttgggttgtggacagtggttgcactaatcatatgactggagagagaagtatgtttacaagtcttgatgaggagagcggaactcgtgagaatattgtgtttggagatgatggtaaaggaaaggtaattggtctaggtaaaattgccatctccaatgatcaatctctctctaatgtttttcttgtcaattcattaagctacaatttattacctgt

SEQ ID NO: 38749 - DNA, 552 bp, Oryza sativa
gcatatgcttctgaaattgacttatgagtgtcatccacaaggtacacagtgaaatcatcaccaaaggacttagccgtcctttgtctcttactccttcgaggagcttcactgacatcctcctcagtgacatgttcatgtgtatgtttagtttgttctggtggtgtgattgaactgggaattacttcagagggttggctcgaactactatgtgtatccttcattgggaaaaagctctcaaagaaggtagcatcacgagactccataattgtaccaacatgcatgtcaagcacctcagatttaactattaaaaatctataggcaatgctgtgatgagcatatcctagaaagacacagtccacagtcttaggtcccagtttgcgcttcttccttattggtacattgactttcgccaagcacccccatgtgcgcaaataagaaagtgatggttttctcccaatccatatctcatatggtgttttgtccttatttctgttaggaactctgtttaacacatgattcgaggtcaacaatgcctccccccaccatgcctta

SEQ ID NO: 38750 - DNA, 659 bp, Oryza sativa
ccgcagagaaacaagacttgggacatctacacgtactcgcaaggtcgcattgaaactacagcaagtgatgctcagacgtttcaccgagttagatgagatcttggcacactcgaagaaacaaaactcaaacaatagatgctccaacgctggacagctcgagaagttaaggaagctatcatttagacttataccgtaaagctgtagccttgtcaagtgccgggagacaagaggcagctcatctatcggaaccgggtcataaaactcccagttttcaagctggaggaaccgaactttgcgaagcagagcatgcttgaaccaaaaattcagccgggctgcgtcctcgatgagctctttgctgtgctcactaaaccttagcacgcaggtttccataggcacactatcacggagtaccaacagatggtcaagaaactcctggtggtccttcacgcttcccggatcagtctcgccctcgccaatgcgcacccccgtggcggacttccagaggtggcgccatcgccgggctagcaggcacgtccggacggcctcctgcgccggtaggaaggagagcacgtggtggagcacctcgtccgggaggtcccctatccggtcgccgccggtcgagccgggcgattccttggccttcttccgcggagacattc

SEQ ID NO: 38751 - DNA, 1280 bp, Oryza sativa
taccccctcactccctacctccctatgatttcttttgtttttattcatgctaatgtactgttctggtatatgtaattgtaattattatttctttctcttttagcttttaaatattataatttagtaaataagtttttaacacacttctacacttgttttttaggataaaaaaaaatctaaagttcattcgaagactgagccctcatatagcagattctcaacaaaatatttctcaacagttctatcttctttatctcctgatcagaagcgtattattggtgactatggttttaattctttgctgatgtttgacaatgcttatgtcccaaacaaatttgcttcttggattgcaaatcatgttgatgtgaagtcttctcaaattgttttaaaagataaagtcattgcaattaataaagaatgtgttcatcatattttgggtctgcctattggtggtatggagttcccaactgattgtgatgctggaaagtcttttattctttcaaagtttggcaagagcgctcttccatctgtgagattctttggtgataagttcatctgaaaggaaactctctctgatgatgaagttattacttcatttttgattgttgcaatggcttgttttctttgtccaaactcttctttggtccctagcaccaagtatttgactgtgtttgagaatgttgatgagcttcggtcatatgattggtcaaaatttgtgtacgaatggatgatgacttccatcaaaaagatccaaaagtttagtaccttgggtggatgctggtttctctgggcagtaagttattaatttttttttccattctctttgttccatattattattgttatttaattaatttttctttgctttttcatattttattttgctaggtgctttatctggattatgttgagtttggtgacaagaatgttcctattggcaagaatgttcctattggttttcctagaatttctcactggaagaataatatgattactttgtattctaaccttgacaaagttgatgaagaaaactttggccttagacccattaaggatttcaatgatacaacttatttcaaggtacatgttcagttcaattagttttatttatttttacttgtgtttttcttttcataaattaattcttatcattcattcatctttacaacctaaaattttccttgttttaggttgtaccccctgaaaatagaattaatacattcagagataaattggagtctgctattggaaccatgttacctgctttcattaaggagaaa

SEQ ID NO: 38752 - DNA, 1090 bp, Oryza sativa
  unsure (1)..(1090): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgatgccaccgtgcgaggatctgaatagatccctctgaaaaatatcaggaactactttaagaaactactaatcgacttatattgctgggtgaattccttatagaaagtagaaactgtccctcgacttatagtgcaggacatattttgctagcctcaccattgcatcacagaaacgtagttggagtgaggtgcagtagttagatcaaggaattggcgtgacgggattatgagataaaggacaacaataaaaatttagacctgctattctccagaatttgcagtctttactacagcttgtaagttacaaactactccaattttcaccagaagaacctctctcggtgccatgagctacataaatttgttactcctatttgtgtttggatcagaatcttacacagtaagattaaatctgctgcacttaatcagaactttagacaacggagaaatgaaatatatgctaatcataaaccagataatggtagattggatatgcacacaatcatatgcaagatacaagcattagaaatatcattcgagttatccattcatctcttcaaagttttaaccgtaggttactctccatatctggaaatggatacattagtaaatttagcgaatgtgactcaaagttcataacctggaaacctagaatcaagggggttaatcatgtccagaaacaggtaagccattccaacttgtccttcaaacaaggaatacggctcatcaccactgtgcatgatgccatccgcaatcagttgtttagctcggtcaaggagaaagcaagcgaaa

SEQ ID NO: 38753 - DNA, 17640 bp, Oryza sativa
  unsure (1)..(17640): unsure at all n locations
tgtcacatgaacatgggccatactaccatagataacatattgctttgtttagatggatgaactttcaagtgagtaaagagacatacttgggactaacattttttttctataaaacagtgcaaccgatcaaacgtaaaattgttattgcatactgtaataaaacagcagtaaaatttctatggttcagtgttgtttgatatgtggcttcttatttagaaacagcaatttcatttcttaggagctcaagccaagtcctgataattaatctatctattatattattaaaaaagctttgaaaggaggcaccacgttcgctgtgagggctagaaattctcacattaatcggagaaaaagaaaaaaaaaagaaaaggagagtccaagtagaaatacaatctaaaaatagctgaaattcggaattaaaaataagcaatattgaaagaagttttcatataagaacccaatacgagatttatcaaaattcaaaataaaaataaaatcaaatccaaaattagaaaaaggaaagaagagtccaagtagaaatacaatttaaaaatagctgaaattcggaattaaaaattagcaatattgaaagaagtttccatataagaacccaatacgagattaatcaaaattcgaaataaaaataaattaaaagccaaaattagaaaaggaaacatgagtccaagtaggaatacaatttaaaaatagctgaaattcggaattaaaaataaggaatattaaaaaaacagtccatataagaacccaatatgagattaattaaaattcagaataaaaagaaaaataaatccgaaattaaggaaaaagaaaataaagaagagttcaagtaggaatacaatttaaaattagctgaaattcggaattaaaaataagcaatattgaaagaagaatccatataaggacccaatacgagattaattaaaatttcgaataaaaatataataatatccaaaattagaaaaattaaaagagagttcaattagaaatacaattttgaaacaactaaagttgaaaataagaaataaaaacattaaaagaacacaatatggtattaactaatttttttagaaaaaataaattctgaaattagaaaaaaaagatttcaattaggaataaaatttataaataactaaaatttgtgataaaaataaagactattgaaagaaaagaccatctaaaacacacaacgagataaattaagtaacaggcctataaataagtagagttggtggtggttgatatggtatataaaaattgttaatgaaacaccaaatagaatcctaatgacgattaaaaggagggatgtcaggtaggatgtgaagcaaacaagtaaagcggttgcctagacttctagaaagtaaaaagaaaaaaaaaccacattgataattattttcgatttttaaaatcttaatgacaataaaaaggagaagcagtgggcggggtgtataagagtatagttgcagagcctccgacggttgacggaacttctagaaaataaaaaataaattgcaataatagttatgttcgatttttagaatcacaatgaaaataaagagtaggcggcggacgagagctgcagaggggcatagtggcatcgtttgatgggacttctaaaaattataaaaaataaaactacaagtccaatttttaaaggttcggaacttctaaaaagtaaaaaaaaaacaatgataatcatgttcgattttaaaatcttaatgacaataaagaagggaggcagcgggcgagccgtagaggagcataatggcaaaaccgctgacggtttggcgggacttctagaaagtaaaaatgaacccaaactataattatgttcgatttttaaaatctcaatgacaataaagagaagagatagtggacgggagtataatggcaacgtttgatgggacatctagaaattataaaaacgaaacccaacgtgacaataaactctaaaaactataaaatccaatttttaaaggctccaagaataataaatagaaatagtgatagattgagcaagcaaataaagaaggagatgacataagaggtagcaactggtgtgattttaaaaactatgtaattagaaacacgaggatgataaggtttggtcttttaaagtcttaacattgagatagctctttaataaattttaagtaagattatacttaaaaaaatattatttttttctgctagccgcgtaattgcgcgggctacccagctagtttataataagccaaaatagccaatgctcatttctattgccattccagttttaactgagatgaacctgcacctatagcatcatccaagtcaaactacaaatttatcgagttcagaaggctaatcatcacaatcacgttataggcatcatcagcagcagcattttacgcttaatcacctccttaaacgcgctcaggtaatgagcaacgccagcttcatctccggcgtgtttggccaccaccgcaccgagggcgcagactccagctcgcccacagatgaacgtggcgatcctgcacaaatcccccaaaccccaccgagtcaccaccttaccaaaccaaaccaaatcaaaacgctgctgcgcccgacgaagcggctgaggaacgcgcagattactcggcccccatggatgcggcgtcgcaggcggccacgatctccgcgcacgtggcgaggtccgcgcggtcgccggtgaccaggtaggccctgaagagcaggagcgccgtgccgagcgcgccggtgtagagggtgaagtcgcccactgcctcccccgctgccgcggcggcgcgccgcctcttatcccacgtctcgtgcaccacctgatcgacgaggagcacaccagaatatcaatcactcaatcagcgcatgaggtgacgaactagcgatacggtggtggacgagttaaccttctgcttcaggtgaagcgccgcgtggaggaagcgatcggcgaggtcggggtaggggagggagaggaggtggtggagagaggaggagtaggtggaggggatcgccgccgccgccgctgccgccggtggcggcggcgcgccttcgtcggcatagcccggcatattgttggggaagaagcgatcagccatgccggatacccctggaatcgctggatttcttctcagatttctccgggaggagagaggacgggaatggtggtaaggcgccggaacccggcgagaacggcggcgagcggcggagggaggagggctcagtagatcactgatgaatggcctttggtgaacgcaaccgaccagtgacgtgtgggccagagcgttggtactttctcctaaaaaccctcggacattgtttaatcccccggttggccacttttgtctctactgagtactgaccgtccgatggacgttccacggtccagataaaaagggttgattgcttcttattttgtcgtaaaagctctttgacagatatggctgtgtttagtttccttgaaactttcaaaaatttcgtcacatcaaatgtttggacatatgtatgaagcattaaatatgaacgaagaaaaaaccaattgcacagtttgtatgtaaattgcgagacgaatcttttgagcctaattacatcataatttgacaatgtggtattacaataaacatttgctaatggcggattaattaggcttaataaattcgtctcgcagtttacaggcgaaatctgcagatgtcatataatcaaaactagtaaaatggcccgcgtagattgcgcggctagcatctctataaaatatccacgtacaataacatactacctacgtttttcaatagatgataccgttgactttttcttacatgtttgaccattcgtcttattcaaaaaatttacataattataatttattttgttatgagttgatttatcactcatagtattttaagtgtnatttatattttatacattcacataaattttttgaataagncgnatggtcaaacatgtgagaaaaagtcaacggcgtcatctattaaaaaaacggagggagtatatacttcacattctattgtgaaaaaaaattaaaatgacaaatgattttgagatttgacctaacttgaccaaactattgtgaaaaagtctttaaaatgacaaatgcttaatatagtaattcccatgtccataaaacaaacacgatggaatttttagtattctcataacaatacaataaatcaaagatgcataaatcctatggtacattcgtttgtcttattcccctacatatgtattgaaatcataaagttgcatctttccactacctcgaatgacattcttccacctactaaagatggcatattgtattgtatattcataatagtttataaacttaaattaaaaatgtactatcgttatcaatattactatgttactgggtatttttatattttattttgttaatgttgctcacagtttggactttacgaactcttgtcacattggtatagggttaagatccaatctcataagctagttttttagctaatttacgtgagaatttttacttgatagtattaatataaagctaatagaagagctagccttcaattgtaaaactggactcttctatcaatattatttattttaattcacatttaaaatagttctaaatcaacttctacataaaatgtttcctcactaatatttattttctaactgaatttaagatatctgtaaattttatttctacctagattctttccctcaatattatttatttttaatccaattttaaaatatttctaaactgcactcctccccaaaactctttctgctataatatttaccttcaatccgattttcctatgtggattctttatgttagttttattattttcaatatgaactcatggacacctaacaaaaatattaattttttgtaattgttaatcctaaattttgaattttgttaatcatatttcttacatggaatcacttttttaattttctttatttttccctaattatagatatttaaaatttatttttaaatagaccatattttttcctaattgtactcgaactcttttctcaataaatttgtttttaactgaatttaagatattcaaaattttatttctacttgaactttttctattcatactttttgtttgtaatctgaatctanacatttctaaattgttctcctacttgaactctttctccataatatttatatttaattcaaatcttagatgtttctaaatttttttttacatgggctcttctctcaatattaactatttttaatttcacttcgagattcatatttttctctcctaaattgtatttctatataaactctttttaagtaaattccatataactcttgtctcaataacagtatttttttattttttttcaataaaaaatcagaataatctaaattgtatttctaccttgactcctcttctaatttttagtttttattttgaatttcatgtattttaaattgtattattttgacttggagtctaaactcttgttcgtttccacagtaatacactatgaccagagagtccatttcttattcatgtttgacagtttcatgcatctgtccgtttgtttcttcttcttgtcattcatattttcatccaattaacatatccttgcccgtttgacagtttcatgcatccttgtccgtttgcttttttttcttgtcatattttcatccgattaatatatcctgtccgttcgactgatcctaatctcattcaatatattgcccgagtgtcttaatatgccttttttttttccttttttcagtttttaactaatcctaatcgagttctgtttttattttttcttattttttttggattaatgtgagaatttctaggctgtgagagcaaacgtggagactccttttttattactttattaatataatagatagatatatggcattctaaatataagtgcatactctctttgtcttaaaatattttggtaggatcggatacatcatagtactacaagtctgaataggcaatctgtctatatttatagtattagtatatgtcccatccaactaaaacttcttatattttggaacgaaggaagtaatgtttttcatcgtcttaagtcacttaagtatagtttactttaacttacacaagcctttgccaaattttacatttatcatagtttattattagcattggctttaaaccagggataacatagcagttgttcagatttatgccatttcaaaccataccttttctttgggtaatgttaccaaagatgtgcatacatttagtttttttttccaaactttgatcagtacataagaaatcatgccaaaattttgttaataataccaacttaccaaaattttggcaattagatttattttggctacaatttgaacaaccccatatagatataaaagttttactcataaattatttttcctttttaggttcatcaaccataggccaaacgatccatcaacaataattcgtgatcctatcctttttcctcacaaactgaccgatcaaactttaatagccccaatcgattagggaggagccgttgccacccttttatagaacaaccatcaaaacgccatgcattactgactcaactattaggctcgtcaagaatcactcgccggacacctctattgaactccgatgatgcccccagcccaccattaagaataaacatggaatgtgttggcgaagtagaatcgtgaggtatatcaaccacttcttcaagcttgactactttgctctagcgtcggccccttccctccatcaccgcctcactgctagaatcatttccagttcattgtccttaccaactccgataggattcttggctgactggcgaacacaaggaaggaccaaaaggcttggacatgtgcaacataacacgatgggggctaaggagactcgttgcacttagcaatgcgcgaggtgatctgctacaagcatggccacaggttatagcctgggatgaaaacaatcagaaatgttaaaagaaaatatcacttctataaagatgattcatcgctcgggagttttcacatttataccaatttaactatttatattgcaatacgaagttgaaagaaatattaaaagtagactttatacatagctagaaacagaaacggaaaaagaataataccatttttaagaaaacgatgttctgtgggtcatgaatttctgtcatcgttttcatttgtaggctatccaacgcaggcgaaggttgtctgctacagcctacaagaatggaggcctctctcctcgcgagtcttgtcagtttgtcaccctcggaagtgttggtgtttgatgatccttgtatttcctccgatcttaacattcgtagtcgaaaatgctttctgcatagaggaaaaatcatgatgcctgtagccactgtagtcgaggtaccttaaagattcaaagcaagttcactattcttggtatgagccatcacagtttctttttctaattatcttttttgattgaggtgataagaaatacaccctccggcctctatctcctcacggaaatagaaggccaaagtctgcttatctcaagcttacagataaacagaaagagggacaacattgtgcacgtagccaccaagattcgagcttctcataaagatcttcaaccaatgcaggtatatactctgtagcatcaatcagcaattcagcatcatgcatcacccaatgcaggagtatggcaccaatctgtatacatagccaacctccttaagccttggaccaacaccagccgaacccggttgctgtatgaaccaaacatggccatgaagagcagcaggaagcagtgtaaaactggaatcaaagccatgggaattacccccatggaattgaagctaccactacgtagcaaaactgtccaatcaagctaccaccctaaatctaagatctgaagaaacaaattaattcgagcaatacaattggctaatctactgcacgcaaggaagccattttaccaactgtcatgcttctaatatccacactccactggggtatcacgggtaacagagtcagggcaaatcacagccgagcaccgtgtggcgtgagctcactcggaggccaggttacaacatcttcaaacagagcacctgttgggagttaccgagttactagattggaaatgacagcaacacaattctatcaccaaatcgagaacgacagaacgaaacatgcaggcatcatgtgcacagcgatttctccttccatgaccatctcgtccatacttgcagtccttgaagttcttctgggccaacaggttccatgctattgatcccatcaagttcagatgtccagaagacgaacatcaaagaacacgaccattgttcctagagtcccaaccagaaggtatggtttgtagactccgctggaaatctggtttgaagcgattaaaatttgataccgatgacctgtggaaaagaataaatattataaacattggcattgcatgtgcacaaaccaatttagattaaatagaggactaatattgtggagattaaaatcacctttgaaatccagatgatttatgtgcaaagataccaagcatggatttcaaatttcctagagcctcatcagcagcctataaaagaacataatattaagtaaaaaagcagtgcaggaataatgcacaaatgggcgcatacaaagttgtctagtggaagagacaacatctacacaagaaccaagttgagtctgtaaacatttaacatgtgtgcacttttaatattttctagaggcaattgctgcatctaccaacgtagtagtatctttatcattactagaagttttaaataactattatctttgatgttgtcaatgttgtacatgttgtatgttttttcctaaaacaaatacaagagaaaggcagcatcttgctgtacacattgaaaaatgaccctccttataagtcccaaagagaaaagaaaacatttaaatagttactatgagtccaaacagctagtataaagattctttactccacaaatcgaacttagttaaacgaaacaatccctctccctctgctcatagcaaggcagaaactcagacctcagggtttatttgttggttttgaaactttaacaaattgaagtgatcagagtaaatcatttcatctatcttatctatttacaacctgcagcttagcttgttcccatgttgctccaactccttttcccaggatttgaccacctatttcgacctgaaaaaccaaatgcaggtaaacgaaacatgcaaactcaaaaagttctaaaaggataacagctcttgacaagacaacaaaaggaacatcttatactacttccattgtattagtgttaaagggcatcatatcacatcaaatacagattgatcaaagagatcttttgatggcctgtaagttgtaaagttggtgcaattttagttttctaaacaacctactttagaggttaatcatgtaccatatagaagttcgatggacattcattcactgaagtactaacctgagcataagcttctttacctgatgaaccacgaggacgtgatggctgctcttggaaaactaagttgtaaccctcaaccgtacactgcaatgcatcacaacatagttcagtaaataaattgcactcgtctaaaagctgataattaaggcagccacttacaagctctttgagagcagcaacagaaccagcaggttttcttaaagtatcaactctctcgcccatgtatctagactcgtttgaagtgcttgcaactggtgatgtgtcatctctactacctcccgaatatctgaatgagtttgaattactactaaaaccattctccttcagaatcatcatcttatccggatcagacgttagaaatttttctgcaagtgaacatcattggccaatcaggctcaaaatattttacatgggaaagataccaaaacttatataaagctttcatgaggatttctcttggtatagtgttctatattttctatataacaatttgaaaagatcaatcatgaggccaaatggaaattggttaaggacagatatatatacaaataatacaaaggcagaaaataattcaacaacttcagcagagaatagttcagagatgccaagtcagaacaacaatgttttccaatatctcgagacctccatgataccttagaagttgcttaaaacaaaataaccccatgatcaagcaattttcacttgtatcctcgagagtgttctcgtgagatgatctcagtagcggatgcagaaggcagcaaaggggattcgcacacacccggcagccgcacgacccattgcaaccccacccccctagcacctccattgaacgggggctagggtagataatccattatttccagcaaccaagcctattaatccaacaatgaaccaatcccatgaaatccatctgtaagtctgtccatagcaggagacgtgccaggggggcaaggagcagcgtggcacagtgtagcagtatgactttggcaagcaggaagcaattcgtgcttaagcagactcaactcacgcgttaaacatttgccttaattccttaatccaagattccttgtgcaactaattatacacaactgcattataatttctaattcatgtattgactattattgcatttacatttatctattcgtagatttgcaacaattggcgacatcaatattacatagtttgtttccaattaagtctacaagtagtactcctcgtgctaatgataatataagtcaactaataaaagttatggttttaatttcaatggcatcatggcaaaacatataaataccatttactttgatgataatcttgtgtggtagatttaattaactagcacccgctaaattttagtactgtgttcgccattgggtgatcatgtaatttgttggcagcattattgtcagatgtgctatgtgtacctctctgtcttaacaaaattcaacctggacttctctgttgacccaacaaaaatattaaacaccatggccccatactttagttatacatttggcatttgccacgcagaatcaagaaaccaagaagttctcaacgaacttacctgccagatttcttaaggacatattaacagcttggcgttttgctgcttttcttgtttttccaattccttcacctaccttttctcctaaaatcctaacctgaaacatgcacaaagaaagatatgactaaacatgaagcaatcttataagactgcaagaagattagaacaatttgcgtgaagcaacaagttcaaataatttgggaaaaaacaagttcaaataatttgggaaaaaacaagttcaaataatttgggaaaatgtaagttaggccttaagccacatgatctttgtagagatagagaaattcctggtgccaaggttatttcctgaagtccacaagttttcacaatttctcatgataacaaatataactgcccattaacatgatcatttaaataaaactagaaaaaatgcccatgcgttgcaacgggtgaatgctattttaatcttattattgttatatggtttagccatgatgaaattcactgtgggaattcgcttggatatttttttagaagattataagctacaattaggagtctgactttcatctcaagttagcatgcgagtatttttaaaaagatttcttatacgactccttttatattttcaaaagcaaacgaacttaagatccgactcaaacacgaatctgtatttccaaaagcgaacgaacttaaaaaccgactcaaatacggatggcgtaccaaaaataccggtaaaaacatcttcaatttttataataatagagatttatgtggtaataaaggagagtggaattcgcagaagtttttactttacctcaatggagaattgcaactctgcagtactacacaaagttgattggtactccacctaaaaatgaatgaataaatacatcaacagcaaagtaatacaggaagaagataataatactgttatttcacatccaaactaccttaaacccacattccactgcaatttcctccaacacaccagctgaggtctctgcgttttgtacaaactggtgtcctggttctattttactgcttctatgattcgaaggaccaaatcggtttcccatgtcctctccttcacatagcagacagcagacagtttaaaatgatactttttttatccatggaaagtttaagatgctctaaagtgaaagcctaaagttgaagtttaagaggggtcattcatgatactgggggcgggcaacattgagcgagcaagaggcaacacacatttaattgattgaaataaaggaagcagtcatttaaccagttttaattctcaacccattgataacatgtccccgtataagcttgaaaactaccatgtatgcagcccacaagcttcgttaatggcaataagaccaatctaatattattatatgtaataaaagacatttcaatgagctagaatttcagaaattaactggatcgaggaaacacacagaaccattcaattagttgtcatgaataatgaagcattttacataataacgttacactataccaagtgaagagtgggaaaaacaagacatgatgaacacaatagatattaaaatattaaaatgagtcatgagcttcagatgtgttttgaatgggacctcaagagctacaataaattcaacttatcatttctgcagctaaagtacaattacggcaaatcatctctgggccaaaaatttcagtagacttggcagttagatggattcaagtaaacccatgaaatcatgattgatggcatataacaagccagccaaactaactcaaaaaagattaatccagcacttatgtgtaagccataatgtgttgttgcttctgaatcaactcaaaccaaaatgtgatgctaaactagcaaacatattatcaaactaaatataactttagttatgatgacaaaccaaaattttattaaggatctaagacagaaaggttgcatttagacaggtacacaagtactcaactctagaaatatgcaagacaagagactagtagattggcttatgctaacatcttaagcttaatgcagcgagctcaacgggaagacatagatcatgcactaccctatgcagctagtaatcttcagaagaactttagaaccatcagaggtaaaacaaaacataccaggaaaagatctgtaggctatagatgaacgattcagcatatgatgatcctcactgtgaggcagctgaataaatcaggcatttgtcaacagattgtccagatatacttcattaacaaacatatattaattgaataatcgatctggtggatgaccactgacctgtgaggggtatctatggatccgacggttatatctatcagaagttataagattatcctcatcaggaaaatacggtggattatgtggttgctttttatcataatttatatcatcagattctaaatggaaccctgttgaggtcctatttaggcttcttggattcatctcatcctctacatgtgaccaattcccatgagattgcactggcaatactgaggtctgtacgggtgatcctgcaggacagggtggtgcaggatctctcgtgtcttgaccatgctgtaatatgagaagccttctccttgtgtccggatccaactcagattcaggaacctcaccctcttctctagctggagaactttgcgatggatccacaggagcagattgagcaaccggccagcttgaaggaggctgaggaccttgatcattattcaaaggaatcatgcccaatgatggtgcttctggaacagatgatgtaataagttgctggttaggggccacaggcatcacatcagcattagttggtattggattcacagcttgaacactgcaagacacttcctgaaaatagtgcatatacatacgtaaaaggtaaaaacagtagtcattgctaagaaacatgataatataggcttgtaattgatctcagcattttttttctcacaagacgaccagtcaacccattggagtaacaacatagtcataggggcatagctatagcattcgcaattggctggtccaacgaaaaggattaggataacttaatacaccctcttgttcacttcaaataaataaatgatttatgcagattaagatcatgtaaatagagaaacactatgctgaacagtataatatattaaagtattgaatgagacattagattgatctaatgccccaatagtctattgcaactgcatattcaaacaaaattttataatactgttgaccatgagattttgtgcctagcataattcctaatgaacaaaaaaatacacatgaaatattaaacagtgtattttttttgttccaaaatgcattgtgcaaaacctaaaaaataactagagtatattattaatatgcagcatctaatttaggaaaagtacatcttggtattcagtttctattcacatcaatattaaccaagaagaacagggtagtgaactaatggtttgtagaagtgaacaccttcaatctcctctcaacttctgcatctgccataccatcaaaagcaagaggatctttgtttacattcaaaatggcagcattctcgtcctattgaagagactgagtgtaagttggcagttactagggaatcgaacatgcattttacaaagtttacctcggtaatcaaataattgccaacatcaggagcggacggaaaatcatttatttcgtcctcgtagtgaatctcgcttatccgtggcagaaggacctcatcaaattctctgtcaattaaatcgtaaatttctgtatctcaaaataattcacacttggtctatggcacaataacaagaaaaaaaattgtgtggcagaacggagtatattaaatttagctgggactacaatgagtcatggcaatgaatttacttagatcacataggcaaagatggatatccttacttgaaaaaaccacccctgacattgcatgcaacatttctagcaaagcagagaactggaacagagaagtttgcctgatagttcaagacaaggtaccctcaataaccaatactaaaaaatatatatttgtgttggtgtaaagtacagataaaccttacctctgcctggggagagtaatatggagaaaaggcaggaacaacgtgaaccctacactggtctttctcatcccaaactttcaagcgatcatcaatcactagggccatttctgggtggcaagacccatcatggaatacattcagcagagactttcgagagcctataagagtggtgtagcattaacgtcaaaagatggaaaattccaagacattatgttcatgcacatggaaatttgtatgaaggaaattagacaacacaaaacattgattgcggtgtacaaaatataccaaatgacactatattcctttggtagttgtgttgtttgaaagtaatagtaatgctaacacctaccagatttaacacagacaagtctgtcagtaagttgaacagagtttatcaatcttgaatctggatcgagcaacctccacatttccaaagcatagtccctctcagccattgtgcacacatatacctcaaaacgtttgcgacctcttgcaattaagtagctccgaagatcctcccatgcaggcctcaaccgtaccagaacactggtatctcttatctaattaagaaaaagggaaaatcaactaggcagtataacagcatggaaacatggaacatggttgtatcaaagctgaatagacgggaagtgcttagcgctcaaaatatcgcaataggagatcaaattttcagttgccacaccagctaatgcaacttgccctcaacagtaccaaccactaagcaaggcttatttgccaattcaatttgagtcacattaattacatgatttgtaatacattaagaactgacagcaccaaaaccaaaaggttgctatatttttcttttaaaaagcagtgccaaataaaattagtaaaattagagtacaaaatagatttaattgagttatgatggtaaactcaatcaaagcacatgatgcaaaataaagtgaattgtggtatttcatttttatgttaatcaatgtaacagatgtagagacaacagacatctggcatcacatgactctagaaaaaggttgattgaagaaatacataccaatggatttatacgcgtcaggataatatttttctcttgtaatcttatgattggacgtgtcataggctgatgattatcaggtaaaggtgggataacctcagtctgtactttataaaccttgccaccatcaataacctgatcattttctatatactgctttaggatagacttgtcttcttggtacctcttgatctctgccgacataccactaatatgttgaggatcaatctcgttactcaactttctctgaagtgcatcaattctgtcttcaaaggaccgtgtggtattggcgacaagcaatgtttcatcaaggtcaaacacaataccaaggcaacgaagattcaacatgctcaagcaagaattatacaagcccgatggcaccttatagccccaaaaacaagcaagattcggcaagtttctcttggaagtcattgccactaaatggatctcttctgctcctagaggaaaaacagcagtctgcaagcaggagagaatgaaaggaaatgaaaaggattaagaaaaaggagaaatgttcgtcactaatacaaaatgcaatcatgtaaaaggcatggcatctagtacatttgttcacatacctgcatatcagagtaacatccacaaagtagtacagaaaataaaaggtacaacagaaatgcaaaaaaggggatacttgttaaaaaaaaggcatgtgtggattaaaaactctatatccatccaaatcttaaaatagcgaaatcaataccaggaatatttatagcactgtcctgaccacagttaaatgctatttaatccaactatgtaaaggaaatattaggccgaaaatagtgtgtttcttaatatagatgtaattatcaaataattcaagtggaagcaagaaacacattaagttgctagcagatgagttagattaatgcgttcaaattattcaagtaaccttcactcatccctcaaacaatgtctttcaatacgcagagttcagcagttcacggttcatgatcaattgcagcaatgaactcctgatagcaagtgtgtcaagtccaaagtcaagaactattgaagaaaagcaaattcttcgctgcattgggtatgtttcaacaaccattaaaagtgtcacactcaaaaatcaaaacttctccatttctgaaacatgaaatgctgttcctgaaacctctgtcattcaacagcatcaggccagattctgtatttcgattagttcaattattgaaaattgagatagaataaaatcaagtccagtacacacaataatcatgaagaaaagtgaattctggaataggttccagtcagtatcattagtcatgtcaccatcgttgtcaaattacttgtccagagataaattaccaataaatgtttcagggaaaaaaatagactagttctttcatgtgctaaaaaactatttgctgttcgggtaaacttgaccatgtaaaatcaaatgttccattcgttcgttcattcc

SEQ ID NO: 38754 - DNA, 15681 bp, Oryza sativa
gggtgggggagtggggaggaagagcagaagcaagacgctttatttagaagctagacgaggcgggtggggagtaacaccagtcagccataacttcggctgtgcttcactggttgttgtcgcttgtactttcagccgttgctgtctccccttctccaccgcttgcgcctggtgctggccgagagtggccgtgagagtggccctcatttttagggtccaaagtccaaatataaacttgtctcctacggagattagcattgtggaagggtgtatgttttgatttttcttttttacttttaatactatataaagcatcatatatattttctataagtatatctttctcgcgttacttacaatcagtctaaggtaggagggactgatgagaaaaatgttaaagcgggatgagcctcttttgaaatgctggtgtaagccatatttaaaatgaaggtaaattgtattggtgataaataaatttattagataatacgattttgtacatgaacctgtaaaatgttcattttgatacacgaacttatccagtgtatcgagccgtggcaaatggcatggcaagattaattttaccaagttggacactaattatgacatttgcatgagacatgttatatttgtaaacttggtttctactccctccgtcccaaaacagtaacttggtgcacaatatagtaatgtgaatttggatggaatgttcttcacatcccatatctagattcatagtattatgttgtgtctaatatatgactaggttttctatatttgggaaggaggaagtacattattcttcttactttctacccttgcattattcattgattttttatgccttctaaaaaaagacatggctatgcggcgtccttgtcacatactcccactgttcaccggcgtccttgtcacatacttccactgttcacgtttgatcgacgcctaagtaaaacgaaatagtcaaaattgatcagcacattatcctcggtggacgcatggttgtttggtttccatgctaatttgttggccattcaattcgcatgcaaagaggctggtttgaataaaaatgggatgctcacatacaatttttttcttactaaattgttattactaacaattatctcaaccgtttgatttaggtagatgggagttatgaaaaatctagatacactcgtagcataacacatcagtgttagtaaaaatttagtaaaaaaaagttagtacatatagtcttttcctttattttgcatgtaagaaactgcagcaaatactcgaggcttctacgatgtggactttaaataacaaccaaggagatttcctttacacttgtcttgcaagattgcattatgctgatcaaactagccatgtcataaccttttaatcttggttcacatgtatcaaagttcgtgtatcaaacaaaacattttacaacattttacaagttcatacgttatattacacccaagtatcaagtttatatactaaattaatataatttactaagtttatgtgctgataatacaatttactcttaaaacaaggagcacccagtcgtcgcatgtatgtttcactgccatgtgttggagtgcttttgcttcttgcagaccatcttgatccttcaaaattgttctctaatttaacaaccgctctgaaaaccatctcttcgctaccagatttttcacagaaatgattagtttcgacatctcatgcctgctgcttttgattcattattacgtgaatacttcccgaaaatgagggacggcttctttttagaccctgtttagatgggattaaaacttttaagttcctatcacatcggatgtttgaacactaattataaatattaaacatagactattaataaaactcatccataatcttagactaattcacgagacgaatctattaagcctaattaatccatgattagactatgtgatgctacagtaaacattctctaattatggattaattaggcttaaaaaatttgtctcgcaaattagcttttatttatgtaattagttttataagtagtctatatttaatactctaaagtagtgtttaaatatagagactaaagttaagtatctgcatccaaacaccaccttagttccgtgacttctggtaccgacgtaccgtggtccgtggtacgcgactccttgagacgcagggggcgtatatgactggatggcgttttcttgcagctacggtctacacacctacacgagaagttgagagcaatacatggcgcacaggcaaagcatatatggcgtacatgattacaaaagataaaagacactgccagaaacagcaaaagaaaatgctgagcagtagacgattgaacattgaacgagagaacatatacaccagaaatgtaactcaactattccagccttgtccatgagcaaggactacaagctccagaacccaaaattttcatctctttctaattactttacccgcgtaacactaaatactgcaagcctgcgaagctagtgtaaagaatttcaccactctatgcaactccttttttcgcttttctatttgtgtaccactgagatttcttcttacaagaatatataataataaagaaagcaagagaaagaaaaggataaaaaagctaaaacggacttgagcgggggaaaacagagaaaagatggatggcaaagagagagatctcactccgactgcccggcgcccgtcgctctttatgggccattcccatgtacagtttcgggcaaatgaattcagcataccttgtgtgcccaggccgtagtaagttagtcgaagaacggagctttgtgcaccttggtaacaagtaaccagatccaatcccagaccgctgtgcaaattgcccacgtatcctcctagctatacacaaaaaattatctctgccgcaggggcagcgactacagagtacaggcagcatcttcaccaggataatagctgctatactcgaacaggaaacccaaaattctgaaatgctctgatctggcctccacggcctgccgtgacgatcactaaaccccaggccgaccggcttggtgcttggccagcaccgttgggaaggctggtactggacggagggctctgcttacttggtgtcatcaactcttcaggccaagttgcagatgttctgtcaccactgtggtttgaactagtgcttaggccgttgccgcttaggcattggaaatcagaggaatcttgctgtttgtcaggttgagtgtgctgctgcggtatgctatcctgctcctcggtcttcctggaatttgttctggacgtcattgctgatccagcagatggcaaagcaacagctacagtcacatcctggcagtggaagtgttcatacgaatttgtgacagacacaacggccttgcttctgccctgtgcagaattgtcatcgtttctccagaagtacacatgggaatcctcactcgcagagatcacatacctcccgttcgaagacaggcaagctgatatttggctgttggtatttcgaaaacctgaaacggtgcatggtatcagaattcagaagacgttaaactcaaaacaaccaatgatagaaggtcacggggaaaggtatacagaaattggactcatcgaaagatggatataactattttataacatgttaagtgaacattacaactattgcctcaacaaagtggattctgacagttttggcactttgttgaaagaaaacgacaggagaaactagttttaactagtcacgttcaaaattttaatcaatgagcagggaattgcagtatttgtgatctgatgatcacagcatgatttggttactgcagacctattatgacttcctagcataactctatacacctggattccagtgcaacactgcaacaaaaaaaggagtggtaaaagtaacaagtaacaaaggtggtttatggatgaataagaagtttgactgggactgtacttagtacaaccgaaaagaagcaggtaagtaacattcaggagtatttgtatatctgagaaaaaggatactaaaccttgaacaaaaacaatctgatatgaataagttccaaggcacaaaacttaatacctttgaatttatgaactagttcaaaaccatcaacaactcgtattcgtgaatctgcagatgtgatgagcacctttgaagaacttcctgggagaaactattcaaggaactacaattcagtaagagaagatctgtgatctgcacatagtttgcttcatattcaaaagtgtgttagaagcacctgaaaccctgtgattttcttctgattggacttccttttcttattttgcaagtcaatctgtttcttttggagaagcttattatctggccataagatcgagagacaggttattcctgaaggaaaagtaagccaaaaacatacagaaatacactcataagatatgaggatcatgagagggtgagatataccagatgtatcataaatatgacagctgcccttgtgggaaccgactaatgctctcttcagaaaatatgagacaaggtattagagctaacatacaaaaagaccttttcggtcacatacatcagtatatagtgtagaaacctgtccatcaggtgtatagcaagcagcagtgaccatttcatgcagatcattccaatcaacaatttcacgtcccggaatgctccatatgcgaaccttttcatccagagaaccactaatgaagtatctatcatcaacagggttgaattggatgcatgtcactgaaacgcaaagcagcaaaggaaaatttagagtatgttcgcagagtgagaaacgtcatatgtgcttgggggagagagagaacacgcaaaactgctaatgtcaactcgagatcttaccatagtcactatgtgaaaatgttttcaaacatgaagttcttgacatatgccataacttcactgttttatccattgaagatgaaagtaagtactgcacgatgtttgaaaaagaaagaaattaaaatctggaatagctacaaaaccataagaataccactacaagattcatggaattgtagcaatcataatttggggatgcattgctggaagcatgtaactgttgttgacaaatgtgaagtctggatatgtaactagccacataaggtatatagaaaccatatatgtataactagctgcaaaaggtaactaccctctgggtgtgttcaatactccctcttcccatcttctactttctcgttttccatgagcatgcttcccggactactaaatggtgtggttttttgcaaaaaaaaaaagttaatttaaatatcatattaatccatttttcatttttaagctaatacttaattaatcatgtgctaatgagccgctccgttttgcatgcattgggagaagttcctatcttctccagccaaacacaatgtaaagccaattagatactaacatcttcttacaacaagggcccaacaaattaggagcatctgatcatgcatttggactttcaaagggcaatgaactgctagtaggatgaactaacattctctcaatagacatctgaaatttcaatacatagttgatgatgcgagtcctggtttctagaccataactccataagttactgatgcgcatgaaattcaaagtcaattggtcaagcaacatatgtcatccatgttatgcagcatgccatgctgaatatgaaacatgctagaaggatttcctgacagtcctactttggacaaataatgatataacatggtaccaagttaacttcatctatgtatacaggagtcaccagagtcatgcatcgggacctttattgaaacctatatccatcttaaacatgaataaatgaaataacctgtaacgtagtaccaaaagaaggctgaaactcctcaaatatatttatattatctactagtactagtatgggagattatattaaggctaaatggattttgcagaacaacatattttacattgattcataggacataatccaacaaacttatttttctaattgttacattatcgccattttagggattacagcatgctgaaaggtagatcatagcattcctgtgtatcttattagtgaatcatttctaaaatttagtcactaaatgaaaaacaggagtattcatgtcacatcatgtaacagatataatagaattgatgagcttggacatggtaagtaactagtctatggcagaatttgggcagtgcctcttctatatgatgcaatcgataggcaggcaattcgccagattgctgcttatgcacttctaaccttccttccaatgaacaaagaaggattagttcagagctaaaggacaccaatttgcatcaatatgctccatgtttcagaagaactacaccaaagtgtgataaggattgaactgtaccagcccttgactactcgatgccagtgtcttgttctgacacagttggactaacagttatgacaaagatggtttgatggaaaacaatgcacttcgaggtttcaccatagatgttaagactatagttgaaattaactgagagttaagaagcacactctgtcactactaaattttagtggaatttaggttgtgagattatgttcaaccttcaccctttttcctttataggagtattcaaggagcatcaacagtggaggaattttgaatgaacagaaaccttgtaacattacctgagatttagaccagcagagatcaagcacatcctccgaatgcccctcaaaagttttgaccggtttttctgatagtgcgaacacatgctctggaaacatcaaccggtcagagctcgcagacttccgagtttccaagattctagcccgatgcttcttctcccaacagcttccatcaacacttgccaatgccaatatcggctccggcgaaccattgcacacgacggcaacaagttgattgcacaccccatttccctcccgtttcctctcaagctccgacacctcccagacatggatcacgcaatcctccccagcactcgcgaggtaccgcccgtcgtgactaaactttatgctccagatggacccgttgtgcgcctgtatatcctggttcatgaacagcccactgagctccttgcatgtcttcccgtactgccgtaccttgacacgctccgggccacggcgcacggcgctggcactttcctggctgtcgtctgtggctgagctggaccgacgccctcccttttccgaggaggtgtccttctcgtcgctgcttcggcggtcgcgggagccgaccaccatggagccagcgacgttgcggatgctccggagccagctgccgcgccgcctgtggcgcgtcgcgccgttgcttgaatcagagctggacctctggatgagagcggacgctccgttgctcgaaccggagcttgccacgttctggcggcgcatgagctcctggacgatgggggagcgaccgacgcagaggtcgaactcctccatggtgagctgcctccccgtgcccacctcgcggagcgcggactcctccttcaccacgaactcgctgccgtcgtcgaggtttcggattaggcacctggggtccgcgtcatctccccctggcgtggcctcggaggagtcggacgatgtttggcgcgaccgggccgcgagcgggggcttggtggcggaggccggcacgctgccatccgatctggatcgggagatgggcgacaccgtctccggccggatgggcccgtcgtaggaggccgatcgacccatctcgaggcgcgccagagaggggtcaccggagagccccatcatctggagaagcctccggcgtcgttcctgcacgggcgctggctccgacgtccacacgtcgagcgccgccgccgccgccgcagcagcagcagccgccgcatcccgacctcgccgcgggtggtcgtcgtcgtccgaggccgaggtggaggagcatgatgatgaggatagcacgcggtcccgcgcctcatagaacacctcctcctcctcctcctcctcctcggcgccgctcatctcctcgcccgcattgaccaccgaggcagatcgagcaggcgcgcggggaattgcccggccgcccgctaggggcaaggaggcgacggcgacgcacgcgacggcgcggcgaggagaggagcaaccgagcggcggcggcggcggcggtggtggcgtcagatccaccacgattcccgaacgcgcccgcgcgcgaccggttcgtcgtccgcccaatcgcgacgggttcctgccctcgcccccgcgcgcgcgtcagctgctgcctgtctgcgcgactggtggttggtgctggtgccgtcgtcgttgttattgcggtgatgccaacgcctcccctcccctcccccctctctgcccgcctcgcgtcgtcgtcatcgtcggttttgttaccaccgggggttactgtttactgtcgggttggtgacctggtggtacgctcgtccttggcctttcgggggcgcggcctctccttctcctctcctctcttgtccttggggatggagggggtagagggagttaaaattccgcgaccgcgggggcccaggcttcagcgggttgtgcccggccgcggcgcgaggcagtgttaaccgctcgtgccgtttcggggaagtggactaggcaggcaatgcgattttggaaacggagaggaggtggcgcgccgtcgtttggttttacttttcggtttcccgtcaccagcagccgacgacgcgtcctttggagtatgcacataccattgacttgttggcactgtttgatggtgccatttgtcctctcttcgtttcagcgtactaccctagaatagtactcctacccctgagtatgccaacgaaatctccactcagcatctgttaagccttttttttttccaatagacgacctgcagcggtgtgcacgatttgaagtttcgttgcgcagatgcatttgataaaccgaaagaaagaaaggtggaaagaaaagaggagatgctaaacccaagcacgtaaaaagaacggatacacctcccaggctataccagggtagcaccacatgcacagggccaggaccatcacgcgcccggcacactggcgcagtactccatcaaagctctccccctctataccgacaacggcatccgatgcccaagccggcatcaccacggccgagagctctcagtggtgcccgcgttgcgcttgcgcccccgtatacgtgaaggcctcagagaaaagcagaggaaaaccccctcggcccgatcgagcgacgcagagcgcgcggtccccgtggcgtgcagaggagcacggcacggcggcacgcacgcatctgatgtcgctctgcctcctttggcccctgcgcgcgcgagcggtgcataagccgtcggcccgctcgggcgggcgcggcatgattaagcaaagcacaaagcgcaagcacaaaccacccggtcgagtagctgtggtgtctcgtgcgctaatcaagccggctttcatcgagacgcaggccgcggaccacccatggtccggccgggccccgtccatttttctgcccctgtcagccagaggtagtagtagctcctatagtttgcagctggattgttactgctcctatgagattctccttgctagtacgtgccactagctgattaataagggattaagttgtccgtttaatcgggacggatcactccaagtatatgcggtacagccgtgtagtagtagtatatccgtttacttattcgacgtctgtgttactgtgcgatcgatctgtttctatatagacacaaaacacattgtcgctgtctcagtgtctcgaacgtactgaacaccgcgtgctcatgaatggccgagataatttgcagagtaaaatagcgagcgatcggtttcacgttatgcgtctccttgtggagttgtggtgtgcatcgatccgccggagcttggaattgagggaaatgatgcgatgaaaacgaggttaactaccactggattgtctgcctgtacatgcccctgtttttattgcttttgcgattcatgcccctgtcgtttttgacgccatgaccgtccagtgcggtctccttgcgatggatggctacgcaccgagccaccgacccatcgatatagaggtggcgaattattgcggggtcaacaaagcaaagcccatgccttttgatcaagggtttttcgtcctcttttatggattatacagatcctgaaaaggaccgatagaacagcaactgagtttctttagaacagcgaccgagtaggcctgtattttgcgagttgtttgttcttcttaccaagtaattaaaaatctccggtagtaggcgaatttggtaagcagctgcagccagacgttacgcttcttacatgataattactagtatattggtgcaacttgatgcacatccgtaatccgctcctaacctggctcagactgcccttccgctgtacatacatacttgctgagttgtgctctgctacaaagtcagcaccaagccaccaacaattgccaccccaaacctacattagccacgtgaagtaggattagggatgctaattagccgcatttaacaatgcatcaaatcgcgcacatgaggaagacattggcgaatagtatattagtagtcgcaaagcaagcctccaaagagctaggtagatacctttttagctctaagcctgggataataattttacacccacaggagtttgactaataaggtggatgaggaccaggatttgcagtgcgagcacgaattaactttactctaatcaagtccaatcccagtggcaagagtggaaaggcacggtgtgatgacatgtgaacaagagttgccaggattgcaagggaaggtaatggataagataagtatacatctactccgtacatagcaacagcactaggatcctgattaattaactcgctaaccaacagcttagttctaagcaattctttggtttcggtgaaagtagagagtcagagaggaaggtagatcggggaaagcctacctactagctgcatagggtgagggtggtactgggtggaaaaggctgaaaaggatcactaaaaacatgtgtccccatcaatgcatgcccatgaatttaccatggccatggcttattgctgcaatggaagcaccacatgtaaagtgctgccagatgacctgttgctatcttggaaaatagttgcacgtctctgtatatcttgctttcgacttctcccaaccattgactggttacaattaggtttgagactgcctgattaacttacgacacgaatccttcttatatcatgtgtacctgcagcatgatagtctatgcaaactatacgattagcattattatatattttctctcacgtaatagcatatatatttttatattttattaataaaatatatcgaaatggtaacataatttaaaattttgtactaaactaaccaaactaaccaatgggtaatttttatattgtattatttttaaattttgagttttaattatttctaaattgtattcatatataaactctagacccctcttttaatattccttgtttttaattttaaagttttgctatttataaattatattcctatatgaactctaagcccttctttcaatattttttatttataaattgcatttatatatggacactactctcctcttttaatatttttaaatttcaaattttaattattttataattgtattccactacactcttattctaatattccttatttttttactccctccgtttcaggttataagacgttttgactttagtcaaagtcaaattgctttaagtttgactaagtttggagaaaaaagtatagcattttcaatccaagacaaatttattatgaaaatatattcaattattaatttgatgaaactaatttagtattataaatattacaatacttgtctataaacttagttaaacttaaaacagattgacttttactaaagtcaaaacgtcttataacctgaaacggagggagtagttcttaattctagctattttctaaattgtatttctatatgaaatatagactcttcttccaatctttctttcttttttattttaacttttagttatttataaatgatatttctatatagactttaaactctacttttattttactttttattcaattggttctaaatttctacatggacactagacttttcttctaatattccttattttttaattatgaattttcaatatttctaattgtatttccatacgaactctaaactcatctttcaatgttcctattttttaatttataatttcaattaattctaaattatattcatatataaactctaaactcttttttcaatatttcatacttttaaattttaaattttagttatttctaagttgtatttctatatagactataagctctacttttattttttttaattccgaattcagatagttctagattgtatatctgtatggactctagtctcctctcccaatatttgttattttttaattttaaatttaagcttttttaaattgtatttctataaagactctatttttttccttttctctgattaatatgaaattttctaatgcgtgagagtgaacatggaggcttctttttttattactttaatatgttgatagattattgaccatttaatgtgggctttgtgattcatgcacataagtaatcttatcctccctctctcccttcttccccgctcgcacgcgagtgagtgagcggaagatcgtcgtttagccgccgcattccccgcctatcacattaacccccacctcatcagttaatcggaaggcgtgaatagcgttggtgagcccctctcttggtgacgtcgtccccctcctcattctcacatgtccttatcttcaagctagcggtagcgaggtgccccctaccgttgcatccgccaccacaagccatcgcctcctcaccactaacatggctgtgttgttcaccccccgcccccaacaccaatccattcccagctaccacccctgtggctccgcgccgccaccggcatctcaccacccgcccatatcctgctcgctgccatccctctatgttttagagaaagccccatcccctccctcccctaacccctcttactccaacccctatcccaaactctgacttgtatgtcttctgttagagtttgtgccccacaggcgctggagaagagaacatgcttgttagagttggatgagaagaagcatgggcatgcatccgatggtctaaaatccataagatttcataccaaatttctattgagtgccatttagcaaatttgattaggtttttcaacatacttctgcttggagaaacatcgaccagcctgacacgtcaattctactcttccacaactagaagtgagcaaaaatgaccaacactgaaatttaatttcagcttgtgaaatcattgtcatggttaatatttgtgatgaacaattggctttgcaaatgatttaatcaacgaattggtttgaaaagatgtgtggatgttggtgtgagtgcgtgtgactaatgtgggttaggttgtgatatctgtgcccagaaacgattgttttgtctgattgtgtgcaggtaacttgaggtcagccttggtcaatggtgaggaccgggactatactcaggaaggagcaaaggtctattgcggtcgggataccatctgagaaggtgactgagtcaggattcttggaggataagtatatgtgctacagtactctgggtactgtagcgtgacgtgtatgcatatatgtagcgatgcatgtgtggtgtatggatgctgatgcatgtatgtatgtatgccgatggttggcagcagcatgaataggagttctacacttactttgagtaggaggtttttcgtggtataaatagagagggagcgtgaggcttcctgtatcgtttttcagagcgtggagttgatagtttagttagggtttcgagtttactcgagatttttgtaaggagtgatgttgttgcactttgtaaacacatagagaagcaataaagttgtcatctactttgagagttcttcgatttgtgtttcttcggtttcaggtggcagggcggcgatctaaccggtggcgtgcgagcagtctgaccggcggcgataggactacgtcgagatttccatcgatttgagggtaacttttatttccgctaaaagtttttgggtttttggttttccctaccattcatccccctctgataggcttggttgcttgtgttcgatcctacacagctaggctctcactaatcgaaattattaccattatttcagtcatcacacagcaacagccaatgattcaaattattgtgactaactcgttgttttttatttgtataaatgagcaagagaaaaatgtaggaaactttcttccacaaatagtcttgatttgaagggatcctaaactctaataatccaattaacatatttttatgtttattcccataaaatttattcttctccaattctttgttttgcatatgtatttttatcctattcatttgtgtttttttttctatttatgtgttttttcaatcatgcattttaaacggtgttaccctgtgcctactatccatatcaactaattgcaacaatatcttatttattttctccactgaatgatttgtcagtatttcactaatcacaactaccagaaactttttatagtttatactgtactagtttgggatggagtgagtactaccagaaacgttttgctttggacggggcccacgggggaagtaggcagtaaacaacggggcaaattcagcaacagatataggggcgtgaatgttttccgcatatcacagttgtgctttttctaaaaaggtacctgtccggaaaagaagagaaaattaacattttgccattatctaaacagggttttgctgaaatgccactgccaaaagtgatttcgctaaaatgccaccttcaatcaggggcaacgtgcacgttgtaatgccatttcatccatttcttctcactttaataatttttgtaatgttttttcttgctgagatgaccaaaatacccttggatcctatctcatttctccctctatctcttcctcctatccgttgtagttggtgggcagcgccggcgccggtgccagcgccactcggtttggaatgaaatcaatgtagtggatgacaaatctttggcttttttatcactcctccaaagaaatcaatgtagtacacagtttttttaatgaacaacttgcatacatcaataaggaaaaaagaaacagaaaaacaggtgaaaaaattaatccccaaatccacgcatctatcagaaccttcaacgattcctcccagctagctgccaattgattcaatgaaacatgcacatctaacgtggctttagcttctgcttccttcacatgcttcatgcctacgagagctacaagctaggaagcaaagcagcaggatgaagggatccgacgagtcggcatcttcctctgcggatccagcaaggcgaaggctgcagcaggttcgtgagacggctacggcgagaacgactgcccgcaccagcttcgtaagacgacggcggcggcggctgcggctgctgtgctcatgatggttgcggcgacaacaactgtgggaacttccgaagacaacaacggctgctcgcgatgcttcttcctggcggcggaggaagagatagagagagagacgaggacggggatggcgccaacgtgggtggggaaggctg

SEQ ID NO: 38755 - DNA, 7413 bp, Oryza sativa
gccgccgccgccgtcctcgtccccagccgcgccgccgccggcgctacccaccatttgcaacggatagaaggaagagatagagggagagatgagactatccaagggtattttggtctgtctcagcaagaaaaaacattaaaaaatcattaaaatgagaagaaatagatgaaatggcattataacgtgttgtccctaattaaaggtgtcattttagcgaaaccacttttgagaatgacattcaagcgaaactctattttgaaaatggcaagatatcaattttctcggaaaagaaaatgctactcgcccgaccaacaatcatcatttttgagataagtaaaaccataaatgcgagatgaaacgtgtgtagctctccgaggtatgcctgctgccttctcaagaccgtcgccgatttcgttgtccccgaacaggaggcatccttcggcgtagacagtctcaacccatagggtatataaatagtgtttatagtaccatgtcaataagacatcacaatagaaactacattctataactcatggttcttaaagtgggctattaataaatacatcatctctcttctctaccaatcatatttattcttcatttattatgaagacactattctctcccaatacaaaacctgatagtgtctagtgcataggttctcgtgttgaaactgtcttgcatgagacccagtttcttcctcttttcactctctctcttaattaatatagtgccacataagctaaaagtcctacatagcaatgtagttaatgccatatacaccatcctatgtggagggttgggactgccctaagagcatgcacaatagtaaactattagctagctataaacatattttaatgagataaaagatgagagaatagcagtgggctacagatctgtagccagctgcagcatggacttcaagacgcaatgtgtgtatgacaggtggaaccatatgtttatagtataataagcagctattgtatgaattggctattagatcggctatagatgaattggagctactagcgggctatactattaaacttgctcatctataaccaatgtaatagccaatccatacaatagttgcttactatacaattaatatctggtcccactgtcacacacacattacgttttgcagtccgtgctgtagctggctatagatctgtagcccgttgctcttctcttttcttttatctctttaaaatatatttatagcttttataatctgctattgtacctgctctaagttgcaccactctaccaaagtacccggtaataatccagtatgcactgtgccgtatcctcccagacggcggtggcggcggcaggcggcacgtaggcgtcgatccacgccctcggcctcgggccaaaagggcagtgaagtggcgtgggtggcgtactggcgtgtgggggtgtggccacgtttgtgtgtgagacggcggcagtttgcgagagttcggggcactgggagctgtcagtacgtcagtgcagggcgctgccatatgggccccactatgagattagggcattaggcaccgggagtttattgattactccgcggggaaacttactgtaggaaaagtgctggtctcagcaaaaacacattgatttgatatggtattatgctaaaattttaggtcctgtttagatcgcacataaaaattttacatcatgtcacatcaaatatttgaacacatatataaagtattaaatatagactgaaaaaataactaattatacagattacgactaatttgcgagacaaatcttttaaacctaattgctccataatttgacaatgtggtgctacaataaatatttgctaatgatagattaattaggtttaataaatttgtcttacagtttactgacggattctgtaattagtttttttattagtgtccgaacacctcatataataatttatataatatccgatgtgacacgccaaaactttatatgtatctatctagacacccctaactggttgtatagcttgatggcctccaatgtacgcgacagctttctccgcatgtgacggatagatgcattgttattttttggacacttggccagatccagactacgcatttcttttttgcataggaccatccgttgcctataggctatactatagcgtatgctccgtagcactgtggagatgcgcgttgagccatgcaaaacagacagcctccactgtagggagggaatggccggtcgcttggttctgtacttctgtcgttctcgttcttctccaaatactactccagctagctaaggcaatgttgcagtttccttcgaatttttaaaaatttcattacatcaaatatttaacatatatataaaacattaaatatgaagaaaaaagctaattgcacagtttatatgtaaattaggagataaatcttttgagtctaattacactatgatttaacaatgtggtgctacagtaaacatttgctaatgatagattaattaggtttaataaattcatcttgcagtttacatacggaatctgtaatttgttttattattagtctacatttaatattttaaatgtgtgtccctatacttataaaaattttagcacacaaactaaacacggcctaacttaggatgtgtcttgagacatccgtagtccttgtacactctactacgacggatcatctcgttaccttaaatagaatggcatcttatgttttaaatttggaatattgctcatgtactgctactccaaaaccttaaacagaagtcgtggtaggcggaaccactgttttcgtttgcaaatatgatatttcgtttattagctaaaatatcatcagaatggaatattttctgttaggtcgatgtatctagctttaattaataatggttatattgagagaaacaagattatttagaagcttaagatgccacttaagattaagatttttatgtggtacttgcttaaaggggttgtgctaaccaaggataatttggcaagacgaaattggaatggcagtttaagatgttgtttttgtatgaaaaatgagactattcaacatctttttatagagtgtcattatacaaaatttgtttggagagcagtacagttctctcttggtttataccttcctactaccatatctaatatgtttgatggttggcttttggggtagacaagaagaagagtaaactcatacttgtaggagcttctgccatatgttgggctctgtggttgactaggaatgatatggtttctgacaaattaccatctatctcatatatgtatgtaattttcagggcaacatattggctccgattttgggcacagctgcaaatgtatgaagatgatcgagagcttatgaaggttgcatgtcgtaggcttgagacaacggtcatgcaactctttgcaaactatggatggagattcacaaatagacttgaataaatgtgctctccttatcttagtttgattttttattttgttgggtgtgtgtttaattcatttaaactacactcagtgattgggtgttacttttgtaacaattggctgtaactctgatgagtaaaggccgggatgttttatttcattatctaataaaaaatctcgttggcggaaccactattctcacatgcatattggtcatcatcatatcatgctctgattgacatcctcgtcgcgcccaacaaaatcatggggccttgcatgcatgcatatgcctcctctccggcagaacgttaattaggcagcagcctgcgaaccgccgcctggttctatgtcaaccaagttggcgatcgaacacaccgcgttgccgttgatgtcaatcgccttccccgcagtgcaaattgacaccctacctccgatcggtcgacacatgttcttgtagctagcttacggccgtcctgcctgcagtggatcgagatctggaacgaacccggcctatcgtgccggtccacgtatattgtatactccgcgaccgcgaggaagacgctgcgggagcacgagagctctcgtacgacgaccgcgtgtgctggccggcgtcccgccattcttttcttcaaccggttgtgcgtgttgcacgcgcgagtagtcaagcgtttctcttatctcggtcacgcaaccgtgctcgtgccggcggccaggacggtttccttgtagctctcacctaccgtgtgtacccttgcagtcttgcagatcgaccgaggcctggtttagttcccaactttttctttaaacttctaatttttctatcacatcaaaactttcttacatacacaaacttttaacttttccgtccgatcgtttcaatttcaatcaaactttcaattttagcgtgaactaaacacactcctagtgagaaaggggtgaaggcagtggtggaggcagtgtgtgggggcggggggtctttagatccccctaccccctaataaactattagagcccctattaagaccccccctaaaatttaaatccatatatttattacaagagggctaaaatagactttgtctgagattgttataaggctcagaaggctgaggagccccactataattttatcctggcttcacctctggaagaaggctgacaaagctaggcatgcatgcagctagctgcacgcgaaactgcggagttagagatgtgataggtacaatgtaggacacgcatttgctatgtccgggaattagttggaccatgacagtggcattaagggatccaagcatccagtactccagtgagctgagaacatgggttggtgtcacggtgaccctgctgctttggtttattgtctccttcattgtttgagtgcgtacgagcaaattattactgtatgagcgatggccctgcttcagtacgtagatccatacatatacatagtgtatggtgctatttaattaggttgcatgtatggattctcaaaataaatagattcctagtgtccctccaaatctcgtttgttcgttccctagtatcccaacaaaaatttagtttttggagagaagatcaaaataccgttattaatgaaaaaatactattggtagatggatagataacatattgaatggaaaaaagttctcgatttatgagaaaaggtagataaagatgaaaaattaactgattttgggacaatatgattagactctaaaaacaacttattttgagacttatgaagtattaacgatggtatacttaatctatatttgccgcaaagattaaataaaaaaaccatgttaattaaaaaaaatacttactttattactacatcataatataacgaattttactcatataaaatattttatattttaggatgaatataagtagataatgatgagtctagattatgacggtgtaatttatatattgtatctttgaaaacatacataatctaggagttgcatatattaattaactctagttttactttaaaattttattatatgcaaaatattattgtgtacataaaagtttttttttgcctggccatgtaaataaaatatagagtaagatagccctcacagagcacaattctttaaattagtgaatttaacttttagttacatatttttggtatacttgtgcatgttgtagctaggtcccactccctccactccaaaatgtaagtgtattgctagttttgttctaagtcaaactattgtaattctgattaaattcattgaatactaatatttatgatatcaaatgagcataattaagtctattataaaatgtatgtttataatttatttattcattttgatactccatccatcccaaaataaatcaacttctagagtttaaaaattatcccaaaataaacaagtttctaccttcttacctaccaccaatccgcaaaatgagaaattctattacttcaatacccttctcctacatatccgctaatataactttcacattaattaagggtattatgatcttctatttctcttcttaaagtcttattgggatgttagggtttgagacttttagagacatagaaagtatgcagtagatgttaatattacttttctatttgtatagactcgttcaaacctgatttacgatgaaattagaaacacacttaggttgtgttatttcccctcttttcctaactcacctctttttttttccgcacacgctttcaaacagttaaacagtgtgttttttgaaaataaattacaggaaaattactttaaaaatcatattaatctatttttaagtttttaggctaatatttaattaatcatgtgttaatgggtaacaccatttttcgtgctcccgaactcagcaagcgatcataaaaacgtagtggcggatctccggaaagccggaacacgaaacattagctgcatgcatatatatcgtgaaacaatgaaaccaacatataaccacagcggtacgtggctgtcacctatgctgtcccttctgttaataatagatcaactctaataatggaagtgaacattgcttaagcttggaccctcctgcaggcagagtcattctagcctccaacagtacaactgtacaaaattcctgtacgcaccagcgcagaagtttgcaaagaccaagagtcgtcctccacgcctaggctgtggatctttatgcaaccaataccgttgatgcatcctgcacgtcacagggatctggctcgtagtacgtgaactcctgcagagagcttctgtgtgcaaacagtaggaaacatcggatgcagtcagtgtgtggtgggtttaggtctttcgtactgtcccagctttttcttttttactctctttctctccccctctcttagaaaagtattagcatgccgctactaataaaactggttaattagcttctcgttggtatatatatccgcagtgaaatgtcgctcttaaatttagtatcagtatgcttagctgtaatcgaagtccgattgaggagaataatgtgacatggactctgcagaaaaaatcgtatgaaacggaccaattctggacgggtttacttaccgtgtccacgggctccagctaatgcgctccgcggtgttccaccacaattcagcccacgacgaccatgcattattgtaccatcagggcatcacgtaccgtgctcataaagaaggaacaatggatcgaccgatcgaccggcgcgccactccgccaataattccccccatgacccggtctcgatcgctagctttgttccaaaacccaccaccataggtacccatccccatcagggccatcacccggagatcgcccgaacagttcgccggtttgcccgtttgccccgtgcgcgcggcgaaagcaccaactgaaagctagctactacagtagctatgtacgccggcttcgcggccattgcttctcgatagcggcatagcgcgcgggccgcggggcacgggggcacggcacggcaagaggatgatggcgattggc

SEQ ID NO: 38756 - DNA, 9117 bp, Oryza sativa
  unsure (1)..(9117): unsure at all n locations
atctccatgagtgatgtgcagtgacgtcgtcccacggttaaatacgaacccgtttcactagtagcgcaccatcatgagcatatcacatttgacgcagtggcaataagtatttctagggcgtgtttagttcaccccaactaccccaaactttcaatttttcatcacatcacataaaaaactttcctacacacataaacttctaactttttttttcaaattcccaacttttccaaaacttccaactattttcaggagtaaacacacccctactctcacagcgttcacggtgcatatacgtgttatttagattagaccttccacatcatagatttcatgccaccttagtttcagtcgctaccaactgaagaacgcggagccaaacaaaacaccgcattcctcgtcagtgtttgtcagagctgcctaaactttacgcgtgccagatgatgaaaagggagaaagggaagatggcgacggtctagctactgccgccgacgcccaaggctagagccggcggatctggcaagctcggcggtgctatcgtctggtgaggtagcttcatccgctccgtcaaggttcatgctcgacagccgccgaagaagaggaggatgggagggggctaagggaggtgaggatgttgctagcttcatcgggctcgctgccagatcccccgagctcgcacggccgtgaaggagtttagcaaagaaggagggcgtcgtggagcagctagatccactcggcaccgtcgccgcttgaccgccccgtcactcgggctgcccgacgccgtcaccgctcaggtcgcccggccgcctgacgctgttgctactcgaccgccgtgctgcctggcgccggagccgcctgggccgagccggaaatcggcctcggattcccgtgagaaaagaacaagaggagagagattgggagatgaaaagggaaaaatacggtaccggtgggatccactataaggtaactttgcatcgtgaagtatgttgcttatatagtttttatctagttgacgggtgaggttcggtaaaatctcaagacgcgctgctactgcccttagggctgataggtgaattgcatggcagcaattaatatcggaaggctgataggtagtgtacggttcgcatttgtacaaaacatgttcagaagatgaaggaatgtgctacgctacgaggacaatcgcatcggcaaagttataccggacaggcgccacccagctcacacccagtatcgcacactgaatcactgtgcgcatgtgctgcttggacgggacgataacacgcagctcgacgttcaagcagtaatgcagatgctgcagcctgcaggggacaaacatccatacctaattaactgtagccctagcttaaagtagccgtacgtgtgcagaatgccactgagcggatcttacgagtaggagtatattttttatcagatcgatttgcgtggttggtgtacgtgtgatgattgagaagtatgcagaacattacagatcagatggatcgccattcgccacatgcattgtacgcatccaggggattcgtggactttttggagggacaagctgcgatgcatcaccacggctgcattactatatggcctatatatgtacgtgttgttaaactatcaaccaagcacgcgtccttatagctcaaataaaacaagggactatctatacaacattcgactaaaaattagcccaaaaatctgtcaaatgtaattgtaacataattacaatatattttttataattacactatatttatactataattacatatgtaattttcataattacactatatttgtactataattacatatataaactcgcatgtaattatagtataagtaagatgtaagtttaatctagatcataaaaatatagtagcccaatggggcagtcacgccttcatcccatgaggtcacatgatcgattcctaaatatgattttgtttttcttcctaaaagtacatatcttgatgcgtattaaactgttagtatgaatttaggacacatccaacggtttagaaagtgaaagatttagccataaaaatatgtcaacaaatatttagcaattccgataaaacaataacctaagttggtggaatctagcttcctgtgtcaatgagaactagagagcacgagggggtcgatgcccttccctcctgatttggcgagtcgttactaaactaggataaacttgtaccaaaacaagctggtgccaactaatccctcttttgactattacgacctccctaatcaagtaaccggtctacacagaaaagagcaagagcttttgccgcattggatatcttgtatatctaggctcctgtttgtgttcctaaaaggagcttcacgcatataattgggagcaacgagatgcctcgatcatgtgctaacccgccctgatgatgatcgatatatcgccaggccgccagctgccgatgcaaccgcgcacccacaaatcgcaattccaggatagtcagtttgtttcgattgggccctcgcatgcacgatcaccttcacacacgagcgcacgtccaatccggacccggcctcatgcttcaagtgcaactgatgaatggatctgcactctcatccgttcatagctaatcagccaacaaaagatttaacacttaattataaagttgattttaggattaggttgtttttatcgtagtctacttttcagcgtatacttatatggtacctttgaaacgtaagactaagaaaatacaggaatatgaaaaataaaggagtattatacgaatatatcactggtggagaaaccatctttggtcggtcgcccgaaatccacaatagtctcggttccactaaaaaccgggactaaagatgatctttagtcccggttggtggctacagcgggcatatttgatctttagtctcggttggtgtaccaaccgggactaaaaatgatctttagtcccggttctaaatctgtcaggccttgtcaggccccccgatatctttagtcccggttgataacaccaactgggactaaagataggatctttagtcccggttggtcaactgggactaaagatcccagggatctttactcccggttgataatatcaaccgggaataaagcgtacgcaccagcccacgcacaagcgcatgcgtagccccccctctctctctctatctcccatccttatatctttttcttttccttccttatctccatcctctccccttcctcttctctcaccccctctcctcctcccctccccctcttcctcttgcagaggcagccgacgacggcgggatgggggacgggcgcgggctggcggtggccggccggcggtggcaggatggaggcggccgggcgcgggctggtggtggccaggcacgggttggggctggcggcggccggccggcggcgccgggatggcggccgggcgcgggccaacagaatggaggacggccggcggcggcccggcgtgggccggcgggatggaggccggtcgccggcagcctcgccctcccctcctccagaaccggccggaggggaagcggcgggatggaggacggccggcggcggcccggcgcgggccggcgggatggaggccggtcaccgnngcctcggccctcccctcccccagatccggccggaggggaagcggtgagatgggtggccggccggcggcgggatgggaggccggccggtgagtcgatttttttttgattttttttaatttgtggtttggatgttttgatctgtgaatgaatctatgaatcgatattgtgaatgaatctgtgatgttgtgaatgagtatgtgactcgatgttgtcaatgaacctttgaatcaatattgtgaatatatttgtgatgttgtgaatgaatatgtgaatggatattgtgaatgaatttgtggtgaatctgtgaatcgtgctgtggagttgtgatgtggatttggggtttgatttgatgatatgcataccactcgattcgggagaaaataaaaaagaaacaaggaccagctgatggactgccgctaccctctctttagtcccggttgatgacaccaaccgggactaaatatctttagtcccggttggtgtcatcaaccgggactaaagatcgatctttagtcccggttttttcacccgggactaaagatagcgatctttagtcccggattattagtcccggtttgaaaaccgggactataggggggttacgaaccgggactaaaaagcacttctccaccagtgtatattcaaaacagatgattgaaaaactcataaaatttgtaggaatgagtgtttgattaaacggtaggaaaaacataggaataaatttggattagagtaaattgggttggttatacactcttgtatacatctaacttacactaattgaatagacaagtggccatgagctaatagatttagttcgatcctgaatagttggaacaacttagcttaatggcctcaaaatgtgaagtttgggattatcctcgggtttccgtttttaagaatatgcttgtaactttcctatttactgctcggctattatcaatgagaaatgagataataactctattaataatcaccgttaggcattgagcttgagaaacctattctccatctatccctattttgtttgtcccaaaacacggagaaaaaagatatccataattatttttactttgctattttttttcgtggcttattagtagtagctcaagggctagtttgaggcttcgagggatgtgcagttgcgtatgaacgtgttgttttcatcgtcgtagcacctaatcagtaatcaaaggctttgggatatgactggttggtttggtttgttttgtggtctaaataagccttactaaattttgtcaatgttaaattttggtaagttttgacatgattaattttggtaagtctaatttaggcctcaaattaatccagccctacattgctttggtagttcactcgaaactggggcgttgtcccatgttactgatctactccctccatcctaaaaaagataaactatgggttttcgtgtccaattttgactgtccgtcttatatgaattttgtttataatttatatttttattattgttagatgataaaacatgattaatattttatacgtgacttgtctttttaatttttttaataatttttttaaataagacgaacggtcaaaacgttagatacagaaaacaagttttttttttaatttttgtggagggagtatgtgatcgctgtggctggccatggtcctccgggagccgacaatctgttcactgtgctcctttccgcccccttttccctattcacgatggatgcacggcctgacgcatattccgtctccggttgtcagtctggtggctattgcgtggcgctgcgagacgagacttgtgatgcgtgacacggacaggttcccagcacctagtagtagtatactagcgcctcaatctgccgtcaatcggccggctgctccggctgctgctgcatgcgctgagcgatggtacacgtccactgtatcccatatgtgtcccgtagctttaaccgattggacatggccctgtcttgctcgcttgtcgattttgcccgatgcggcgtggccatgacggtattctcacttgcatgtgggagaatagctttcttctttagataaccgatgggggaatagctcgcatcgggctttttagttgaagctaattagccgattacaacgcgtactgcccggccacaccaatctgattcgaagttttgttagcgttaatgagatcgctgtgcgcgactcgtgacatctcccatcacatgggccgatcgatcgccagctcgagggatcgaagccgagagctggattggccgacgacgttaatttggttttgggggggggggggggggggggggggaagacaggacnccacggnctccgntgntgagcagcagcggaaggattcgatcgaatcaaaccacagcgccatttgcttgtggcggaggagaccgcgagagccgggnaagcataattcgatgtgtgcacgcgctattggaggttggtggtgatgatccatcggaatgcagtgcacctgatgtttaattaggcgcattctctgtcaattggcccggtacatatttgttttttttaaaaaaaatgatccaacacacctataaaagacaaaaaaaatggtcggcacaattatcattcctttattatatatttacattcgctagctgtccgtaaaagatgtagtgcaattagtccaaagaattccatgagacaaagttaaccgtcaaaactcactgtcctagacaacactattgtttgcttttcaaattatcagtcatagctaaaatctaaatgtaattttagagttgagttgattttgatgtatcgtatttccagcacgacttttaaataggtaagaacacacatgtaaaaggttttatccataaattattttttatcgctaataaactttactgcatataattagttttatgtgcaactagtatggtggcctgcacagattatgcggctagcatcgttatatatatttttcatataatagcttaaatattttcatattttattattaaaatatattaaaaatagcaacataattttgaattttgtattgtacttatagttattaattgttttctagtttcgaattttacttatttctaaattatattcctatatggactcactcttcttccaatcttgcttatttttcaaaatttgaattttagttatttataaattgtatttttatatggactctaaattctacttttattttttaaatttttattctgattttcagttagttctaaattcctatatgaacattatactcttcttccaatattcttatttctaattccgaatttccattattataaattgtattccgatgtagactctaagtttttttccaatattaatttttttaattccaaaataaattatatgcttaattggactctagtctcttctcccaatattacttattttctaattttgaattttagttatttctaaaatgtatttctacttggactctaaactctatttgtttttcttaatttcgactttcaatttgttctaaattcctacacatactctagacttttctttcaatattcctattttttaattccgaatctccattgtttctaattgtatttctacatggactctaagctcatattttaatattctttatttttaactactaatttcagcttttctaaattatattctatatgggctatagaatcttcttcaaatatttcttattttttatttcaattttagatatttttaaattgtgggactctgacttctaatttagttttcttttttttaattccaaatttcaattatttctaaattgtatacttgtatggactctagtctcctcttcctatattttttttagtttcaagtttttattattttaaaattgtatttctttatggactctacttttctttttttcccgattaatgtgagaatttctaggtcatgcgagtaaacgtggaggctcctttttgaattactttaataagttaatagatagtgtaactatctcattttaagatttattgatgtagtgcgtttcagcttaccgtcttataataatttgggcggtcaagtattgggtttaacgcacaaagtgatatgggcgagaaaaaaaccaacaaaaggtagatagaatccgaagtatacaaaagatcagtcatcgatcaaaacattggtttttgtgaccaatcatttttcaggtcgattggtcgtatacctaattttaaccaaaatacctaattttagcccaaatttaaccgctggcttgatagcctaccacctcaagggccacccacagatatatgactactcctaaaccctagatgtgatggctcagtaccctccctagctcaagctatatcgccaccatgctacactgcaaccccacctatttccgtggcgtgtcgtctgctgctacgtctcgtcgcttgttatggtgtgctaccgaggttccttcttttattgcgccaccacctattgcacctcaccattgtcgctgttgtgcttttgtaccttgcctgtgataatatatcgtccggtgtaacaaatttaggtaggttagtcaaacgaaagaccaaactatcgatttaattaaactattggttagttgttttattttacaagttcggtttctcattttctgaagaccgaaaattttaaagaatgaagtcgccggaccaattttttggttaagaccaaatgccaacctctagataggaatattgtagcatgcacaaccttatgtgactttcatacagcaaacgtgatatggtcgcagggtgtgttcaatgattggacggccatgttgtcaagagaggggtttggacgggctgtgacaaaagatctgcaagcgtaattgcacaggtgcacatagggatattattagatatagattcacattcacaggtcagctgtagcctataggtttgtttatttggttagttataggccgttggttagctttttaaggtttagctaggctagttgcgtcatgtgtttggaggcttttgagaaccagtgtcatgcatgtgttgctgtgatgtcatcaaagtcatccggttcttcagttgtgattgacaaatgacaacatcgtagaatctgatgggctgttgtggagcaggcaattggcctgtcgcttggatccgagtgttcagtgatcatggccaaatcaaataggagtgtactgtgcggaccagtcgcaaggggccttgccgactgcgggttgaattctttgcataaaactcgaatggcgtatatatcaaccgaaatcgcagtataacaaggttttgaattgtttaatgtgggatttttgacgaggcgaaaggaataaagcaggaggagttttcaaacaaacattacatctaccgtccctcaactttacaccgaatttgtctaacatctcttatcctcagtaccagaaatcttcacccctaaactatacaaaacctcccaatctagatcctatagcagtatagacacctggtttcgctgacgtgacatcctagccagcaaaaataaataaataaagtatatgtggccccc

SEQ ID NO: 38757 - DNA, 27339 bp, Oryza sativa
  unsure (1)..(27339): unsure at all n locations
acaaggacacaggcccgcgacgcccgggggcaggacngccccaactccactctagacctaactcgatcctagagttaaatttaggagttggagctgtaccaaacatgccctctgacgtttagtgccactaacctagaaataatgagtgtcactgccgacttgccggtttgggcaggaaatcgtgagaaactgtggtaaatgggcaatggtagaaccggaagtgatgattgtttctgtgatagtgtgccaacaataaacattttttctctggtcataaatatttaacaagattttatcattttctattgaaattttgaccaccaatatataaattcttaaatatgtactttgtttaaaaaattgtataggtagattggtactggagagtagcatcataataattatgaccgtatgaagtatgtatatatagggcgtgggtcaatggcggtgggtgacgtgtaaacgtgctatgctttctctcacaaagcttacgagagcatacaatgcgcatttgcccccaaaattagtttgatatagtactatagccaagcctcacattgagtactcgttgtgcgcgcgagctaaatagttgcaagcaacgcgtatttttcgtaccttgcaagagtgtgaaagttggacgcgacagaatcatctcaccttcgatggagactggggagtaagtggtgaccagtacgtagtaatatacctgctcctcaacgcaatctatatgtggcgtgtactaagttgtggctagtcaaaaccacttgtacaatttcggactcgatcgataaatatcccaacgcggcagcctacggcagcacgcctcgagtgctaatgactttgcgcggtggcggcgcgtgcagcttgacgtcgcgctgctataaaaagggaaggaaaaaaaaaagaagtcatcgcgcgcactacttacatgcggcaaggtcagcgccggagctgccaatgcacgcgatccatcgagcaataagctagccctgcacggaattgaaaccacacaacgccagcttggtcggtcgcggctgacggcgccggcgcccacaccaccgttgcaacggccccggccacgcgcgcgcgcccggcgcacgcacagcacatacatgggcttagccacaagcgcacgtagctactcgtacgtcgcggccggtgctccgttgggagtgggtggggttgggcggctgtccaccgtcacgcggggcggccgacgtgggtggtggtggccgcgcgggccagcagcctgcagcttcgatgccctgccgtattttgtactagtagatttttgtgtggcagtgtggcacactggcacgtacgcgcgcggacttttttccgtgctggcagggtgtgtttagtttctgaaagaagttggaagttggaagaaagttggaagtttgaaaaaaaaagttgaaagtttatatgtgtaggaaaatttttatgtgatatgatgtgatggaaagttgagaataggagggaaactaaacacggcctatatagtagagattactagagattaggccatgtttagttcccaaaaacttttcgcaaaaacatcacatcaaatctttgaacacatgtatgtagcattaaatatagataaaaaaaattacacattttgtatgtaaatcgcgagacggatctgttgagcctaattagttcataattagtcataagtgctacagtaacccacatatactaatgacggcttaattagtctcaaaatattcgtctcgcagtttccagccgagttatgaaattagttttttcattcgtgtcaaaaaaaattcttccgatatccggtcaaacgtccgatgtgacacccaaaaatttttatttcagcaactaaacagcccctaatgcctgtgccgctcttgccgaaagcgatgcgagatcggcgccggccccggccccggccggctgctgcgagagttaggtatctgggcaggatgtacgtactcacgcacgcgtgccccaagatgcgcccaaaaagaaagctggggagcggtcgcgaaccaacggccactagctgcctcgatctcggtcgatcgatctggctagctcctcctttttgtcacatatctccccggggaatctgaacttggtcgatggaagtggaccggcaatcacacaatgccttgatgcatccatggcttgatctttcgagaatcaagtgacagcgttgcctgcggcgccaatcgatcgctatacgagtagccggagaagatcgatgcgtgctttcctcggaggctttaaactcaccggttttcggtaccgtcagatggcgatcgagcagccagagaagatcagatatgcgtgcattcccggggagctttaattcactggttctctgtaccgtgagatggcgacttaccatgagagctttgtgctcgtcgtggtctcagtctcgttcggcctttcacagatgggagaataacaataatcgttgctagtattgactattttacttcgttttcagtttcatcatagtactaattgaagttcataaggacctacaaggcctacgtaccctttcatcaacgttaccccgatatggcagctgaccctcgtatcagtatctgatacgcgcccggatacggatacgtgcgggatacggccggatacatatcccatacgtatccctcatttttctctttttcagataattaaaaaaataccgatactccttcgatacggcgggatacgtacatgatacggggagccctaaatcacacagaacaaaacgcatctcccgttctccccctccaaacgcgccgccgcttgcaaaacccaatccccatcgcagcgccacccggccgccccgaccacgccgtcgctgcgtcgcctcgccgccggcctgccctacgccttcgctgcgctgccttgccgccggcccgccgccagcgaccggcgccgcaccgcgccgtgcgcgcctatgccgtcgctacgccgcctcgccagcgccgcgccgcgccgcggcctatagccttctccgcgccccctcctctgcactctcctccaggagctccagactcctccacgaggcattgcgccgctgcctctgatcaatcctgcatcacctccaacgacaacgacgttgaggacttgaggtaaatcctgcatcatctactatgtgaacaatgttgcctaatgtctaccatctatttgaagaactatgttattttcatgatttcatctactgtatagtcttgcacttatttatgcatgcctcttcaataaatggtgacttggtgagatgctgtgagcctgtgaatctgtcgtactgagatatcatatatatgatgattggtgcattggtggtttgatgctgtttgcttcctattttttcagtctatattccacactcaattttttatatatatatatatatatattcgcgtatccccgtatccatatttttaggaagatggtgtatcccggtatcgccgtgtcgcgtattcgtatcagcgtatcggggtaacgtagcctttcataaccgcgattgttccaaagaaaacagcagagtttacatcagtagatatacagctcgtaaaatagcaagctaacctcaccgtgatgatgcagtgcatgtagcaagtgaccgcaaggtgatcaggagaggaagccaacaggcgtgcttaattagcctctgagagaaaaggagagagatatatcgctagccctgatcgagaaattcacgccgatggatcgtccagacaaatcacgtggtgaggtgcctaattaagcagctaacagtacgacaaaagaagctctgattatgttagcctgttaataatttatgcgacaaagcttatcacttcccttaactaattcggggagataagatattatacagttctaacagttcgatatgatttaattaatccattccccttctggcatgccgctagaacatgccaatcgcgaagccctacaagccgggttgtcatatgtcattaagaaaactaatctccctaggcccttcgtcacctactgaatatgttattaacacggtccaacaggattcaggaacatcagaattttcctctcttttttcttaaacatgaaactaacaaagcaattattggcagcgtgatcggattggcggaaaactcataaactcgagtataaaaacgagccactaagctagtcctctcgagagattggagtacaaggaaagcaatgggaggggtcaatctagcaaagcccacattgacaagtatttctttccagatcagtaccgtccacgcagccgtgacagcaacagaaagacgccatgtcgcgatcctgacatcgtccttgagattcgtgctcccgtgacgtgtcggcatcggagggcccctcgtcggggtcaatgggcggtggggccagaccaccgaccgggatctttttcctggcgcgcagaaccgtttgtttccgccctctcttttttcacaggagcaccggtctctggcttttctctcgacctttttataagcgcgggggttatcggtcgcacgcgtcgcggaatcagaaccaaaccccaccaccacacaaacgcatgcgcgcgcgctcccccgcgcgcgccgcaccggtcgcccactcgcccgcggacgccaagcgatcgtctcgtctcgcactgtttcaccggtcgcccaatcgccaccgcgcccgtacgtctatacagcgtggcaagaggtgcaagttggtgtcaggatcagtttaattacaaggttgtctgatctatatattgctgcagcacggcgggcgcggggtacgtttggctgcaccctgtctcgcggctgatacgtttgcacaggcgttcagatacagccgatacaccggcggcgctagctgcgtttcttctccgcatggacgctccgagcggcgagagcggcggcggcggcggcggcggtggtggcaggaggtggaaggggaagggggtgacgcccatacagccgcggcggcagctggggacggttttggaggactcgtcggcggcattgctgcggccgctcaagaagattgggcggagccccgaccgcctcctccgctccgcatcgtcgctctccacgtcctcgtcggctccgccttcgcctcgctcttcttcggcttccgatgctccagtccgcgtcatctcgtcgtcgccgtcgtcgccctcgccaccgtcggcgcgacacatcttccccttcgcgtacgaggcctccacgacgacggtgggtgggagcccaaggctccacccgctgtcgtggcagcaatccagcatgtcccagcccgcgtcgccacagcaacagcagcagcagccgttgcagcaccagcagatgatatcgttcggcgcgtcgcctccgtgctcgacgacgcagttcgtcgtcccggagaacgcgcagcagcagcagatgctgctgcggtactggagcgaggcgctgaacctgagcccgcgcggtggccccggtggcgtgccaccgtggctgtaccagcagctgctccgggtcccgccaccgccgcagaagctttaccgcggcgtgcggcagaggcactgggggaagtgggtcgcggagatccgcctgccacggaaccgcacgcggctgtggcttggcaccttcgacaccgccgaggacgccgccatggcgtacgaccgcgaggccttcaagctccgcggcgagaacgcgcggctcaactttccggaccggttccttgggaagggccgcgccggcgggaaaggccgcaccagcgtaagctcctcggccgctgccgccgcgtcgtgctcgtcgtcgtcgctatcgccaccggagacacctgacgacgcaaacacgcagcaacaagctcctcagcagcgagaacagcgggacacggcaggagtgtccatggagaagaaacaaccacagcctccagctccaacctctcgtcaagaagggtgctctggcggcgacgcagctgcgccgtacccggccgaaatgcttcacgcgccggcggcgtgcggcggcatgtgggttgctcccgacgagtcatggttcagcacgtggggccctggcagctccttctgggacgactacgacatggacagcgctcgcggcctcttcctccaccctcgcttcaccggtgacgaaactagcatggatcattccggcacgcaagcaaccgtgccggcagtggcagcaacagcggcagggatgagcatgccatgcgatgatgttccggtaacctcttcttcttcagatctccctccccaagggacacctcagactcctaccttcatgtggaaggaggactaagcatgcatgcacacagccacgcacctcgacgagacgactatctcttccatctcccatcgacttcgacgatctctttcattactcatcgacttcaaccacaaaggtatgattagggtagagatgcttgcagattgcagttttaaagacaattttgcagcatcacacagctctacgtacaacagccacacctatatcaattctcaagacttctaaaccacaagggaacccctgttctaggctgcgatttttaggtcagcttgttggggtgaccacagtacaattccctttatttcgtatcttcccaagattgtgtgtgtcagatattcgttgaactcgacttcaaaagatttgaagtattcatgttttcttttactcatgcgatggctttgtcgatctaactaggtattgattcttggggagattaattactacttcagttaatttactagctactagaatatttcatgcatgtatgtgttcaggtgatgattagttttacttatatttaattatcctgtaccctccgttttctggaacatctctggcattccactgtttttgtgtatactctggggaggtgattagtaacttcatactatttgcttctcgagatatttagtgcagatagttcagagcaaacgatgccaaactgttgcgaatcgtgtactaaaggcaagcacattataactctcgtaagttcgagcgagcagagcagccggggagttcttgtcaactacacaactcacaacgtatgtacgtgacagcgtgcgcaactgaatcacacggcaaaataatcaaggcatggcgcaacttgactatggcagcgtcaccacgataggtggccaaccacttatatcagatgcaaccctgcaagtggtagtccgacactccgactgataagaacgtgcgctgccatatgccgccatgtatatgtaaccgtgaacttaacttacgtgcctttagtgctgtacgtgcagggaaacacgcgagtctccgatcgaccaatcgacgacctcagagcatctccaacagtctccccatctcactctccaagctaaattttagctattctagcaaaaaaaaaaaaacgtgctccaacagcctctctaaccctaaaccctatccggctggccaaaacctcccctccactagccaaatttggctagccacaaatcacttgccaatcgtgggccccacacagattctccaccaccccccatctccttcgtctctccagcggtccagccacgactcgacgccgccgccgccgtgcacagccacgatctcaacgccaccgccggcgcagccacgacctcctcgatgcggcgcagaagggcgggccggcggcggagagaacaacggcgcgcgtcttgaacccacgccaaagcgccaccatcgtcgtcgaggtcgccagccgctgtcgccgtcgtctgcaccgtcgccagtcgtcgccatccaccgctgtcgtccccgaggttgccgttgccgtcgtttggatccggatatgcccgacctccgttgcctccggcgtgacgtgggttcagggcggcgcggcgtggattcgggaggagggggcaacctctgtcgcgcggcctccgccgcctccgcctacacctccccggcgctgcgagtgcggctcgggagggcggcgaggaggcaggcttcgccctgcacgccatcgccgtcgttgaagctggaggtggcggcggcggcgggtcccggatgcgcaggagcaggatggccctcgccttcggcggcaacagcggtggtgggctggacggcgccggcggcgtctcgcttcgttgtggtggtggcagcggcgccccccggcctgcgtcagccttgagaaggggaaaaaaggagagaggggctgacgtgtgggtcccatggctaaaatagagaggatgaatggagagactgttggagtgaaaggcaaatttgactctctaattttttagatggatgatcaaatgagtatttggagagctcaaaatagccaatctgttagagatgctctcactcacgccgccacgcgagcgctcgttaaattcgtcgtcacccagctgcaggtgtagccgtgtaggagtcccagcaccacgcccgccgcagtctgtgttgtgtgttcctcctgggtgggtggcgatcgagtttgatcggcggcatgccgcatgcctcccacggacatgtgcggttgtgcgcgctgccgtcggtgtccgcggatccaatctgctgatgccgtgccgtgacttgtgaggtagtaggagagtactgtggacatgcatcctggacctggactactggagttctagcggtctactagtggatatgcatgttgccgcagattaggcctagataatcatggcctctgggccctggggtccaaaaaaagctttacgtttagatttgtgaaggacttgataggcccatggtatggaagtggttgaatccttcggaccactttaatgggccgaacagtcaataggcctctccggcgagaatgctaattagcgcagacgtgctaattagatatctccggcccagttagtcgcgtgcggttccagccgacccaccagtgaaaaagaagtcctacttttccaagcaaaaaaaaaaaaaaaacgttgggagcacatgctgacgcgctattggaggaaaaatcgcattccataataaccgtattaattaatcttttctttttttattgcaaatttgaaaattacgtgaaattttaaacatttaatgcagatttgaaaacctttccactcaaaatttgaattttttgaagtcaaaatttgaaaactttcaacttttcatttaaaatttgaaaacttttgatctagatttgaaaacttcaagtcaaatttgaaaactttcaacacaagattgaaaactttcaacttgaaatttaaatttttcgaaatcaaattttgaaaactttccacttttcatctcaaatttgaaaaactttcaactcaaatttaaaactttcaatccatatttgaaaactttcaacccagatttgaaaactttcaagtcaaatttgaaaactttcaattctatatttgtaaagaggtatgcgaaagattgaaaaaaataggaagaaatgaaaaaacgcgtcgagaaaaattacaaaaaaagaaaaaaaaagggcgcgtgggggcccagctgacgcgcgcaccagctaaattgctggcgcgtacgcgcgcgctaggagccccccttctccagagtcctgaacctactccgttgcgtctgttgtctcgtccacgatttcgggggttcacgtgttgtcatcatcgtagaccactcgtgtaacaaatgtatccaaaatctgtctattactaacttataataaattagtagaaaaatgagcctccatgttcactctcacgatatagaaaatcccacattaatcgaaagaaaatatgaaaaaaaaatgaaaatgaaagtgtattaggattaggttgtgtaaacggacaagaaaattttaagtggaaacggacaaggaaaaaaaggaaacaaaagtcaaaggaatgatataaatattgtgcaacagaccaagattctttgaaatccacgtgatacaaaccaaccataattatagtactttgtatggccatcagttatccgttatcaaaatttaaacaatacttacatgccatgtcaacaaaatcatactccaagcacaacaaattaattcaaactaacaattagcaccatagaaaccttttcaccacagtccgcttcgtcaacattaactagcagaaatcctctcttcgcaatccaattaattcaatcacgccgacaatctttcctttcaattaattttgtcttaataattaattgaaattgtcatattaatcagacaaaagcaaaaagaaatggtgaatagctaatatggtccctgaaatttcgcttcgggctcagtttagtccttgaggtttcaaatcgtccaaattaatcatttgggttaatatagtccttggacccataaaaaataccacgtgaatacgcgaagtcattcttgcatgcagcggtatgaatgaaacgaacattctacccttatataccatatagaaaagaaataaaagacacaaacaaaataataacaggctagcccaagcccaacattgttgcggagggtggccgagaaaggaatttatacgatcagtgcttggctgcagcaatcataagtgacaactctaaaacgatcatacatgtgtgaaatacttgttttctttattttgctttcttttctatatggcatataagggtagaatggtcatttcattcataccgctgcatgcgaggatgacttgacatgctcacgtgacactttttgagggtccaagtactatattaacccaattgattaatttgaacgatttgtttggacgatttgcaccctcaaaaactaaactgagtccgaaacgaaactgcatgccccatattagttattcaccaaaaaagaaaaaagccaaatcgaaaaataatttaaagtatatgaaattcgaatttagaaaggaaaagaaagagtcaaactagaaatacaaagttcaaaattagaaaataaaataaaggtaaaaaaagaagagttcatgtacaaatacaattttgacaaaaaaaagaaggggagtctgtcagtgttacggataaggtataccctttatacttggatatacgttgtatactgatacggtatacccgcgcgtacacgggtagttcctgtatacgttaaggaaatctattacatgatagaaacagaatccacaaatggaaggagtcctactcggacaatactgggtcgttaccatatcgtgaggggtccgatatctccgagtcctacttggagatcaactgacccgcggtataaaagggaccccttgggcagtatcgaagacatcgaatcttaccgccaacatatccaccacagcctacagagtcggagcttataggagccaagtcgccgggtgatctagtcgaaccaactcgactacggtttcgtcggtatcatcgagttccactattccctttgtaatctatggtttccatcatataatcccataccaactggataagggctattacctaccaaggggcctgaaccagtataatccttatcttttgtttgcttgatgtcgtattacgtagatcctcgttccaacgtactccaataccctctatatccggtctacgggtatcccccgtcgacagagtccaaagtgaaatacacttaaaaatttctgaaattaaaaggagaccccaagtggaaatacaatttaagaaaacaagaaatacatatttaaaaaatagtaaaggaaaggaggaagagtccatgtagaaatacagtttttaaaaattttaaattcaaattaaaaacaaatgataaaatagaagattggatttgtaaatacaatttgaatatctgaaatttagaaaataaaaaaactccatatacaacacaatatgggttgataaaatttggaataaaaatataataaagttactcaatttgatttctgtacaacgtcatacctaaattagtcaatcacaaaattttagaataaaataaacagatatgcaaataagtgtccatgcaaaatttatacaataaaaggcctgtcgacgtttgatgtcgcgattttggtatttgcatagtatggggatcgttagtactaggatatatgcgagattgtagtaaaagagatggagacgaggatttttatacaggtttgggcccctgaattgtcaggtaataaccctacatcatgttggccgaagccggtattactcttattcaccataatcacaccagtacaatatttggggtagcttatctaactgttgtcgacatggcggtctgaaggtctgactcgtagtcgacaacagggtagtcttcctcctcgaatccgtgcccggcgagatcagagatagcgctttcgtctctcctgacagtatccggagacaccgtaggggactagtcgtgcttatccctgaagtcgatatccggcgtcttgtcttggcgtatgttgacttgtattggctttgtggctttgtggcgtctatgttgtccgtgtcccctctcctcccagggggccttgtatttatacccataggtgtcctcttatccaagtagaactagggaaaccaatatggatacaatccgagtagtccttgtcgtttccatatagaactctagtcatcattccttatacggaactcctcctatatccgaaggttgtttccgtataacacatggtatgtggtggatcatgttgagatttagtcaactactattaggtatgtggtatctataaccctgacaaggcccaaatttaaatacaacatataaacacccaaagttgtgattgaaataccaaaagataataaagattattggaagacgaatctagactctatataggaatataatttagaaataactaaaatttgatattaaaaataactaataactatcatgtatgtacaatacaatttgaatattccacattactagtttggtaaagtgagtacaaaatttaaaattattgtcattttaatatattttaataataaaataagaaatatatatatatgctattatataagagaaatataagaatgctagccaccatgctagtgttaaagaaaaggggatcagattattgcaaatttgaatacaatttgctagaaaaaaaatcttaatctcaaggatgcatgaaattcggcttctttaaactggttggctcggaggaccaaatgacccttgggatggtcgcaggtcagtgtagacatccacctcgccaatcgccatccacccccaaccttcagctggctcggcaatcggcatctcttatcctcacgtgcgcaccacctgctcgatgaaattccccacacggccaccaaccgtgccgatggcacccgccaccgccaccgccgtggcgtccccctccacctcctcccggctcctacaccgcagcctcctctcgccaacacccacggccgctcgctgcctccggccgccgctgtgccgcgggcgcctccgcaccgttcgccaggttgtcgccaacggcgacgtctcctcgccgtcctcggacgtggccgccgaggagtccgcggcggcccccaagatcggcaagcgcgtgcgcgtcacggcgccggtacgcgtccaccacgtctccaaggcgccggacctggacatctgtggcatggagggtgtggtcaagcagtacgtcggcatctggaagggcaaacgcatcacggccaatctccccttcaaggtggagttcgagctcagggtggatgggcaggacaaaccggtccggttcttcgcccaccttcgagaggacgaattcgagctcgtcgaagacgaatagctgaataggtctcttttacagaataatgtgctctcgtcgtctgcagtctgcagatgcagtatctgtatattagaagagaagattgaagagggtgcgaggagatcgcaagtaagttgttgtttgtttacttgtcgcgtgctcttcctcactcttttgtagttctgttaaacaccaacattttgagatttgagaaactgagaacggttcggattatgacaattatgaatgaaagtggttatactgatggttctgttgttggctgtattcagtagtattttttccagttatcttttcaagagaattcgctgcttataagaatatgttactcatcaggatggaaatcaatctctctgactagcgtaaccttttagcatttgattggaatatcggatcgtatttatctattggtctgttcacttgaacatttatcccacagtcccaatttcaattgttatgagcttatttagttgctgcagtaatagcattgagaacttggctcagggttgctagccaactaaactagacatgttaattcttagtagcacaattggtttctcaagacctcggttattgttggtggctcggtttactccacaaactagtaaattaccagtagtgttcaccaggattttaccgtaggcttgtttcgtccctctgcccatcaaatgtggccttgctgagttagccttccatgtttccaattgagttacatggtttgaaatgtattcactgttctggttgaattcccttgaatcttgatctgtcgagtgagagccatgctttaggtttggcctgtgcacatacatatttggacctgaccaaacatagatggcacatgaactggattgtggagggtatttaagctactgtagtttgcctcaactttagaccttgtgattaggtcctgtgtgaaggtaaagtgcacatagttatttatagcacatgttggtggtgattctctccagatatattacaccaggtcattaatgctggaaaacttacttatgtggatatactttctcctcgtcctctacggtgcttgatggagtgcttacttataagcaatagcttgatgaagggactattactttttaagtctataatatggatgatctgaatatattctttgtaggtgataaagggatcttgcatattatcttatccaaggagatgagtgttatattgcagtatatctttcaagtctggtttgatctagaaattagacatttgcttctctatgctttcaggtgctagaaaaatagcgtaagttctttcttttaatttttttctagttcattcacaaagttagtacacatcaccataggttgctaacctgctattgcaccagaattgctgctaacaaattttatgatatgacgctagtctggatgtgatcaagagtgagagtttgtcttggggccttatcgattgccctatggcttatattaattttaagccaaagccaaaattttaattttgaaacttgattttgaaattgactttgatgttttttcaacatagttatttttttcaagtttggcttttaagtcgataagaacatttatacaaaagttttactcacatatcattttttaattgctaataagccgttatgacttataataacccgtaagcaaccgatggggaccttgctgtgagacctttatttttgttgattggggggggggggggggtagattctttttattgtgcaagaaattatcacaactctttttctttaccggtaaatacatgggaaatcctatatgttttcttttcccatttataatgagaatatgcaagggaattatataaagaaaagtaaatcgtcaattttctctatttttttacaaaccttcaacaaggaccaataagtgtttttttaagactatctatcattcatctttaaacggatacttccaattgtgaaaactcattcttaaaagtataaacgaacttttgattttgcatgattgtgacgtgaatcataccttgatgagggtcaaattcaagctgagttcaaccattcctaatgttctttttagtttgcatgctggtggtgatatactgattctgtggaggcaatttactgtgggagatgatagtaacaaattctagagattcaagctgagttcaaccattcctaatgttctttttagtttgcatgctggtggtgatatactgattctgtggaggcaatttactgtgggagatgatagtaacaaattctagaggtctgacataatgttcattcgaaggaaaatattttcttcatttcctttatgttgaacaaaatatattgaaagaagagtaatcaggttttgtccctttatttccgaacagatgtttttgtggttcattggtatggatttctgaaagaacatgcatctgttctggcatgatctatcacatcctgcattatttgttgatcataaggtctcaacttgtggatttggtttccccttctgctggatcctgagtttctgttggaacgtgttcacattctgaaacattgttcatttatcatatttctgttgaaggttacacttcaacatagtaactgacagtatgctgcatttttcttccattctctggatgtatagttaatcaggtcaatatacacgtagaaattagagaaaaatctttatttatcgttgcataatggaaattaatgcttacattaccacatggaacttggtcattctctgaatcgacggaattgcatcagatattccaaaaggtcttatctgaacaaagctttcttcttttattttacactatcgcactatattaatatgctttggtcatgagactgtcttccaaatgaggcatgtgatatgtcttttattcgttttaggcgctcgtacaaattacaatcatgtgttccatgtctcccattaatacgtaggaatgtaggattatgttgacagttgtgatcatcaaaagttgggtgtgatgagggtagagaatgagacatgaggtagcagtgcattgtacttctagcgggtaagcgttttgtttactttgctagatcctgttttcgttcagcttttcagcttttgtgaatgcgccaactttgtacagtaaacgtcagcttgggttctgctgaaaactttggattctattattacgaagtgaaagaaagttggtgatttatctctcaggccatcaccaatgtggtgcttcggaccgtgcccctagcgacagctgttcgcttttccgtcggcgtcgtctccttgcgatggaacgcgtcgctctggtaggggacgcggctctctccgcgcctcaccagcttttcatgggagacgcagccaggcgccacgctgagcgcgtatggagctcgtgggtacggcatcgtccccccaaatttccccttgcaccctcgcctcactctcgctctcccctcggtctcgtcgtgtcgcgcccgacatcgccggtgccacgtccaccaccgccgggaccgccaccgtcgatgcattgctgatggccttagagagagagagagagagaagaaagaggcgatggcgacgacgacgacggatccacgacggcgatgaccagatatggccaccgagcgccgcagcagccgtcggccactagccggcgacgggcggagacggcttcgaggagcccgtgctcaccgcctcgcgcgccttgcccggcctcctccgccggcgccttgcccgtcctcgccggcgctgcggggggcccagatccgcccactacggcgccggatctggcgcccccgaccggccacagcgcgaggcggaggatgccggggaggacgccgatgggatagagggagagagaggggcgacggtggatgcccgcaacgggagaggtggccctcctcgtcgtcctcgccgacgctcccgtggcgccccgtgacgccgctccccgggtccgacgaggccaaggaccgcgccatcgccgagcaaggggatgtggggcacgcctcgcatctccggtgagcagcggcgcgctggatctagcgcggtgtggcgtgagatcggagggggggcgtgggtctggcgacagcgggagcacggagcggcggtggaaaaacgggagaaggggtagagacgggcgacaggcagaggagagtggcgagcggcggcagtgcgagggagagtgagagagagagacgagcggcggaggggaggaggcgagcacgcgtggaggcagaggggaggaggcgcgccggtaaatgaggggaagagagagagggggggagaagagaggggtagtatagtaaaatacctacatgggctctttgggttagggacactcgttgggctactagtggtatcctctattgtaaggggagtttcccagagagcgccctcagtaagtgagggcacctatagagtgtccctgattgtagatgccctcagcccattcgatgtgttggaaaataatgctatgcaatcgactttcgagtgcccttctacagttgtactcacctgacgtgaatggtccacttgcgagttaacccttgatgcatggttgatggccgttgccgttagagcaatcctaacccaggaactatgaagtcggagccattgtttcgacatatttgcaaatgaaaaataatttgtgaataaaatttttatatacgtgttattagcgatctaaaagcaaatgctgaaaaataaacttcgatgaaaataccataaaatcagcttcaattttaaagttgaaaatttaaattttggcgcataagcataagcataagtgaaaagatgagaccatatagcttcttcgtttgccccagttcacatgtgagagttgctagtaggcatggtaatgaaatgttcagatgcacgtactccctccgtctaaaaaaaataaatctaggataagatatgacacattctagtacaataaatctgggctaaggtcacatacaatactaggtttgttttttatgggaatgaggaagcactgcgtgagctgaagttttatccggctggttggaggaggtaagcgtacttgaaattcagtgggatactccaatccggtcaaattgataagagaatgtcaacgaatcaagggtgacggaatcgtcttctaccccaggaactgaaacatcagctgcgaattcccatcacgtgaaaaactgagatgctctccaaacaaagctcggcgagtcgctccaagccaccaatggtttgcttgtttgcaagcgacgaatgtactgtacaggattacaacggtcgacccattcaagttcaaaataatacaaagaactagctgggtagcccacgcaattatgcggctagcagaaaaaaatcatatattttttaagtataattttacttaaaatttattaaagagctatctcaatgttaagactttgaaagaccaaaccttatcatcctcgtgtttctaattacatagtttttaaaatcacaccagttgctacctcttatgtcatctccttctttatttgcttgctcgatctatcactatttctatttattattcttagagcctttaaaaattggattttatagtttttagagtttattgtcacgtttgggtttcgtttttataatttctagatgtcccgtcaaacgttgccattatactcctgtccactatctcttctctttattgttattgagattttaaaaatcgaacataattatagtttgggttcatttttactttctagaagttccgccataccgtcagcggttttgccattatgctcctctacggctcgcccgctgcctcccttctttattgtcattgagattttaaaatcgaacatgattattattggtttttttttttactttttagaagttccgaacctttaaaaattggacttttagttttattttttataatttttagaagtcccatcaaacgatgccactatgcccctctgcagccctcgtctgccgcctactcttaccccgcccgctgcttctccttttcattgtcattaagattttaaaaatcgaaaataattatcaatgtggttttttttctttttactttctagaagtcccagcaaccgctttacttgtttgtttcacgtcctacctgacgtccctccttttaatcgtcattaggattctatttagtgtttcattaacaatttttatatgccatatcaaccgccaccaactctacttatttataggcctgttacttaatttatttcgtcgtgtgttttagatggtcttttttttcaatagtctttatttttatcactaattttagttatttataaattttattcctaattgaaatctttttttttctaatttcagaatttattttttctaaaaaaattagttaataccatattgtgttcttttaatgtttttatttcttattttcaacttcagttgtttcaaaattgtatttatacttgaactctcttttagtttttctaattttggatattattatatttttatttgaaattttaattaatctcgtattgggtccttatatggattcttctttcaatattgcttatttttaattcggaattttaattaattttaaattgtattcctacttgaactcttctttattttcttttgccttaatttcggatttatttttctttttattccaaattttaattaatctcatattgagttcttatatggactgttcttttaatattcattatttttaattccgaatttcagctatttttaaattgtattcctacttggactcgtgtttccttttctaattttggcttttaatttatttttatttcgaattttgattaatctcgtattgggtttttatatggaaacttctttcaatattgctaatttttaattccgaattttagctatttttaaattgtatttctacttgggataaatctcgtattgagtttttatatggaaacttctttcaatattgcttattttttaatttcgaatttcagctatttttagattgtatttctattggactctccttttcttttttttcttttttccgattaatgtgggaatttctagccctcacagcgaacgtggtgtctccttttaaagttattttaataatataatagatataatagttagatagatagatagatgcgagatggtccatcggcatctatctatcacccggccttctctcagaacagtgaagtaccccagtagagtatatactatcatacggcatcgtatcttattacggcttgatacaggactcaattttgaatccactcaatagctgatacagtactcctactagctggttgaacggtaggactacacacacagtacagtgtgcttccttccagatgcatcaacgcgtgcctctgccaccttgggaccagacagctgagtaattatggtgtattttgcagtaaagaactcctttttgggaaattatcagcacaaatccctgggattagtatggacccaaattctccctgggggagtagatgacgagaaccgtagctactgtaaatttggaggtagcacttgtaacttcaagcttgttgagtgagttgtactgttactgttactgttactgttactgtacgccgtgccaaagcatactctgtcaccccaacggctttctcctgtggagcacgcgcgtcgtgcgccgctgcggccgcgcacgaaccccgacgacgcaacagaaaaatttgaaatccacccacccctcccccctcccccctccctcctccgtccaccgcagctggcttcaccttttcctcggttgctacagacgccacggttcaaaacacactctccaacgcacaaaaaaccctcccctaatcatccacgcctcaccggagccaaacaccgccaccacccatgggtctctgtttcagcaagaagcagcaagtgaggcggcggcgagaggagcagcagcagccgccgtgccatgaggccaggaaggccggcggcggcaagaaagctggtgctaaggaggtcgcgatagtcccggaggcggccaagaaggcgccgccgcccaggaaggctgttcccaaggcggaggagccggcggccgacaagaggacggtgttcgtcgtcaaggcggccgcggccgcggctgctgccgaggtcgccgcctcggcgagcggcgaggcggcggatgaggaggcgaagaggcccgccccggaggaggaggaggcgaagcccgtcgtcgtcagcagggtgccggtgcggacctcgagctgcaccaaggaagaggtggacgccatcctgatccagtgcggccggctcagccggagctcgtcgtcgtcggggaaggtggcgtcgggtgagggcggcggcgggcaccggaggtactctggatctaagaggagctacgatttcgaccgcgagaggaggggcggcggcggcggcggcgtggacgacgactgcgactgggagaggcagggcgccgccgtgtccaggccgtcgccgcgccggaggacgccggagcggaagcggtcggggagccacgagaggagcggcggaagtggaagcaggagagtgagccgttcgccagggaggcgcgcggacagcgtccccgcgacggcgagcggcgagcgggcctcgcggcagcagccggggaagatggtgtcggtcccggccagggagaaggggcgggcgccgtcgcccgtgccggccgcgtccgggaagaggtacccgtcgcccaggtccaactccccggcgagggcgggggccgcgggtaatgagaacgccgccgcgcagctggcgcacgggccgtctctgagccggagctcgtcgcggaaggccgagcactcgccgtaccgtcgcaaccccatggcggagctcgacgagaacacgctcggcaaccaccacagttgcaacaacaatggcaggccccaaaaggtaacagacgcatgaaagcttcacacttcagttcacccaatctgagccatcatttctcctcgccgaattactcaaaccatcgaaatgcattgcagaaacctacggagagtggcggcgccctgccgcagaaggtggcggagtgggctaaagatcaggtagccgcaagccggacggcggcgaaggagaagcaggagatcgtggaggtgcccgtggcatcatcagacaccaaaggggggaattccgggaggatgaaggcgacgcactcggtgagcattgtggccgagagcgtcgtcaaccagaagggccggtcgtcgaggagatcttcccacgacttcgacaacaatggcaactcgtacgcatccctgctcctcgaggacatccagaactaccaccagcagagcaccggctccgccgccgccccggcgccagcgttctcgctcccggcctgcgtgtccaaggcctgctccatcctcgaggcggtcgcggacctcaactcctcgtcgtcggagaacaagagcttcgagctggaccggtcggccaacgacaagtgctcggcaaacgggaggtacggcgacggcaaggtcgccggcggcggcacgctcgtcgtcgagtcggaggttgttgtgaaggacgacctgatggagccgagcctgcacaagtacgtctccgtgcgtgacatccgaggcgaggcggagccgcaggaatccgccgggagcaacagctttgccggcaacgcgtggacgccctcgtgggagcccagttccgtcgattccaccgaccggacatggacagcgtcgcagtccaacaacggcgacgaggtggagcagctcagcagcggcgcggtcagcccactggagctgtcgtggcagggcaagcagaagctcccgtcgcaggagccaagtggtggtggccgttcgcgggtgggtccaactggcaatgctcaacgcggacgcagcgctcatcgtggcggcggaggcgctgtcaatgcgcgatccgatgttcgtgctgctccggtgagctcatcgattgcttaacaatgtcaggtggagattgtagtcaggttctcatctttgtaggggcaagataggttgccgtttcagctttgagtttgcgttctttctggtgatgatacattgtttaggatgtaaccatggcggtgacatttgcaatgtatactttgttgttcatttcgctgagctttggtgatcgatttcattatgatttggtgatcggtggttgatctcctgataattttattgatctttggatgaatttcttgtcaggaatagaatgctgtaatttctgatgctgatttgcagagtactatgcatgactgctagggctgctgtaaccattttggtactgcgacagccatgaggaacgcatcagttatccagttactccagtcagttcgagttgggctgacagatcagtcctgaattcagttctcaatgaaaaccatctcagtgtttagacgtatgtatgcagcatcaaatgtagatgagaaaaaaccaattgcacaatccaactgtaaaattgcgagacgaatcttttgggcgtaattacaccatgatttgacaatatagtgttacagtaaacatttgctaatgacggattaattaggctcaaaaggttcatctcatagtttacaggcggaatctgtactttgttttgttatatacttcaaatatgtatccgtatacttaaaaaaaatttggcacacgaactaagcgcagccttagtttacatttcctcatagctacagacgaaaatcaaatgtaaattcaaggaaggaaataaaaaattggcggtcctaattgctatacgaatttgtcaatttggatttgactatctggtgacatgctaccatgaaatttgcaccaggttccagcccaaggggatgtggcttctctattccgatccatgtcccgtagtcaatcaacggtagatgtcatctgtggtgggtcacacacgtcatattcgtcttctcgattggttttctcatctcgttgttcatacatcatactacatccttattattgcctcctctctctcatgccgttaaacatggagggatcaatcaaatcaaaatagaataactgtgtaaaaaccatcgttcaaacatagttttatgtgatttgacgaccaaaacatgttgtttaaagcggagtagagattactgaaaccaatctggaatcgattttgctaggaatctgtcgggtgattttttttgttgctatttcccgtttttgttgccgttggatctgcgccgagatttgtgccaggaatggggtggacgtggtcatacgtggatagggcctcgcgttggattccctggcctgattactttgcactatgcaaatttcgatttccgcgcttgtccgtagccgttttttatttcccctcgctgatcccgctctctcctcgcatttctctctctcgctttccccttttcttctcttctcttctcgttttctccgcgaggcgagagagagatctcgtcggagtgagtgcttgctggagaggtttgtctcgtcggtgtaagtgctcgccggagaggactgtcttgtcggtgtgcgtgctcaccggagaggttggtcgctggcgagatttagtgtttagattttttttgttcgatttgattcagtccaggtccgattcaaattgtgttcgggttcaatctcggttttagttgttttttttgttcgatttgattcagtgtaggtccgatttgctcaccggaaaggttggtcgctggcaagatttagtgtctagatttttttttgttcgatttcattcagtctaggtccgattcaaattgtgttcgggttcaatctcggttttagttgtttttgttcgatttgattcagtgtaggtccgattcaaattgtgttagggttcaatctcggctttagttgtttttgaatcgatgtaatacgatggagagctcgccggagacgttggttgccgtagttttgtttagtttgtctcatcatttttgtgtggcatccaatgttttttggtcggtgaaatcgtgatgctgctgctgcttcgccaagttgcgcttccaggtttggagatttgttcttcctgggctgtgggaagcgttcacggaatggatctgagattttgttgtttttgttgctgcaaagcgttgcttttgagttggggaatggttgtttagcccgcggattcgggggttttaggggaggcttttgattttaggggtgctttttgcttagcaaatccagtttctgtttttgtgcttgttgatgtgtgatttagtggcaaattctaggcgtgaagcaatttttcagaatcatgacatggctttttgttatgtttgtattagtgaatttttttactgaattactgaatttggtagccagcaaatacatgatgtgttcattactttgtaaagcttcacagtgattatattttttatgtcaatgtaaatggatctggatgttgtacttgtgctaaagtgaagtttctacatgattgtgttttttatgtatgatttttgttgtaaagtgaagtttgtattgtttgttcattttaactcatgtccaagctgatgtttatttattgttctttcagatgcctcgtgtccaaacatcaaggttgggtaaaaatcccattgaagttgattctgatggaggtgaagattttcatgttgattatgaagttggtaatgatgtaagttatattttaaatttttattattgtattatgctgtttaagtttacctttaatttggtattacattatttttcttttttttaggttgatgaaggtcctgaacatggtgaaattgatggtttactctctgttgtgctcaggaaaatggtatgtgaatattttttttgttgagttgtgttaatttaattttatattgtttaatgggttgctcaatttcatatttgtagattgttcaagaagtgaaaaagaatttggttgacacttcttctgtcaattttcacaatcccattgtatgtatcttttttttattagcatattttattatgcatggcattttatttgttctattttattgggtttcttgttgcttataatcttgtgttaacttatcaatgaaacggagaattaattcggtcaaaggaaatgtagtactaatgaagtggatagttattttcagattggaattgttctgttttttttttttgcaaaataaaattttatatttgttctgtttggtccatgtgtacaatgcggtactctgaaccttgctaccatgctattataggctactgttagttatgttgaagatgtgagtatttttcaagttgtagttgtgactatacagattcgtatctattctctcaacacagttcagtacagccaacgttgttgagttttttgttttttcttctctcgttgtttggcactaataccttctttgttttctttcacatatcctgcacctaagtatccttggtagctttcatgcatgcaacgtcatattcatgtttcccatgtaactaattcaatctagtattatgcaaacatagccaccataacacgtgttatggatatgttttttttgtgtgtcattgtgtctaattttttctcaagtatatctgttttgatgtgtaatttgtgttagtttgcttggattagttttctcaagtgttttttttgttctacacgcagcagcttttaatatgatatgagcttaaactttttttcggggttgtgcaggtttgtaaggttgcaaaataatagtctagtagtgatggtttctgcacttatagcttagttcaggtttccaaaattttacagacaatttctactaaaattacagtacacttacatgctatatgcattgaatttacaattgtaattttaatt

SEQ ID NO: 38758 - DNA, 3257 bp, Oryza sativa
ttcatgtcaaaaggaatatcttaaccctcgatatgtcacttcctcttcatcacaggtattccttttttattggcttgtgtcttttcttttttaaaaaattcttgaatagattttgtgatgtcatgtttctgtatgctttattttttgactttctcttatttttttatttgttgtagcctggtatatctttacactgtcttgacaattcacctgttcaagtaattggtataaataataatgaaggaacacgcagaactcattgtattcagaatgtgaagaagaggcgttttgatgatgttattgtatgttcttattcttgttgactatatttatatattgtcctaagttacttttttttctataattatttgtttctgcttttttttttagaattctcctgatgtggaatattttggtcattctacatttcctgattgctgcaaggtgttgtgtacccagactgataatttgtataatgccaagaacatgttgaaaagtaacaacctggatttgagttctaccggtggaaaattacctccccatggccctagaagagtcttagttccttctcggaaattttcagatccttatgttctttctgttagacgccgatttctagtgtcagatcaagaaaagagacattacaatgcaatatgcaagttgtccgagagctctaaatggcataggtacagtttcctttacatatatttttatagtttttgcattatgcatgtttcttactttgcttttctttttatatcttttttttttgtagttatgatgctgtagacattgataatgttagagcaaaattctcttcttttgggcaatctctcatgaaaggtggtactgtattgagctatgttatcaatgtgttttgccgtgttttgttcaacaacaatcatccttcaaactccaagagacactatttcttctcttctattggtgtaagtagttatttttcaaatttgtgcttttttctgttaatgttgatatgttacatattttttggtatatttatttcacttttaattttttttttcaggaactattgttaactgatctatcttgtgctgatttgagcaaggtgaaaagatcgtctcttggagcagctagtgctaggaagttgcacctttctgacatggtatttttttttgttttcatgctcatgtaaattttccaaagttatgttgttaattctgaatgattttttgcagctatttttccccatcgaacaccttgaacattggttcctttttgttgttgatataaaggacagaatgttggtcctcttagattctttacatgaaaaaggtgatccctattttgaagacattgaatgcttactggtatgatattttaattttaaatgcgttttcattcagtttttttcttcttgtttttttgtagttgattgattttttttattttgtattcagatcaataatttacagacattctgggattcttattatggctcttcaattgattttactactttgaagaaagtttacccttgtgttccaaaacagagatcttggtatattttttgtgtttaatcttttctgttcaaataattggagcattgcaaaatacgttatttcaggaatgtgcagagtcacgcttgtattacattacttatttgttgatgtccaaattctcaatacttctttattttggccaatgttttctaattttctaaatatcattaattgtcctctcattggggcattgtagaatgttcttgcttcatttgttaactagtgaaattaccatgtaattctgtgagctagatatttttttattctgtgtatgctatgctcacacttttgctgtgtattttaatttgtgatattactgtggtgagtagtttgtgtttacattttgtgatattactgtgctgcatatatttttatatttttttgcgtattgcatatattcttaggatgttagtaataacacttgcccaatttttaacatactaataataataataataataataataataataataataataataataataataataataataataataataataataataataataataataataatacaagaaacaagaaaaaatgccattgtggtacaactaaattcaacaatatcatgaacagtactacctaggttttatttctttgttttttgtaatttaaagagttgtttcaatttttttttgtagctttgattctggaatttttgttatgaagtgtatggaattgtggtcaccaagggttgttctaccaaatgaattttcttcagatgatattgacaatattcggatgttgtatgcaaatcagttattcttccatccaacgaataaaatgctgcagactgaagttgaagaagttgtgctcaattggtttaatcctgtaagtgtgtttttatttttttttcctattcttgttttttgatacatttttagttatgaaaaaaatgtttttcatttttatttgtatgctcaatttgttggtgaaggctgaaatttttcagaaagatagttgctatgaaaattggtttaatcttgtaagtgtcttttattttttgccattcttgttttttggattctttcatagttttgaaaatattatttttgtttgttattgtaggatcaatttgctggtgaaggctgaatttgtccagaagattagtcgctatataaaactgtagtgtgtgctagcatagtggaatgtataggatcatagtgaatgcatttttgcagtgccattacatattcctgtagtgaatacagatgttcacttacatcaaatacttttagtatgaatacacatatatagtgtgtgtagtgcagtaatacagtgaaaaacattaaggtctaatactttcagtctcaaaatttgacatccttgttttctgtcttctaatttgatttgttcttttttgtgcttccttgatctttaggtagcttgcttcctttgtcattttcttcatgtttcttcttcctagcgggcattgcttgcttctctattgtccctgcaatacaaaaatttatatccattagcttgatttttttgcttgcccatgtttgtaatattttacatattattcatttcttttacttgttgttgtagacttctgtattttctttgtacttcttgcaatttgcatcagcgggcaattttctattgtgtgacttgttcttccacatcttgtacaatgtttttttggctgttcttttatcttctctaccatcccttttgttcttgctgattttt

SEQ ID NO: 38759 - DNA, 733 bp, Oryza sativa
tttcagtcgccatatccacttcattgtcctgcatgttttgtgatggttatacttatatcttgataattcttgctgatatagggtttttttgttgcaaagtttattttacctttgtagtgaaatggctattttttgattgatacagctcttctattcttgctgttgtattctgccaaacaataagttcttgttaatcaatagtgcaaaatagcttaagtctaaacaatttgaagtcaatattttagctaaaatcacctcagcaaaaggtgtgatgtatttgttgttgtaaatctgatcaaattcttcatagctccagtgtgtagttgatatgtgttgctcatatgtcatatcctgctgctcttctagttctggagaaaatctactggttgttaagatcattgaattctgcaatatcaaaaaacagtagttagtactgatttaaatgactaattagggaattgttacataagtattcataattttttattcttacatcaaatgctggtgtccgaagtagacttgtaaagctttcttgtcctccctgcatattcatagtttacatatcaattcatttattattttctcttttttttgtcaggtatataatgtaagttgatatgcttactgtttgttgctgtatggtgacagttggactatgaattatttggtgtatgaggttagtgtagctcaactgtccttcctgcacagttatatgtttattagtttataactg

SEQ ID NO: 38760 - DNA, 1994 bp, Oryza sativa
tgttgcaagttgcatgctcaccgttaattttctctcctttttcctccatctttcaattatgtacttatcaggaatcttgctcattttcagatacaacatcactttcaaaacatggctgcataggattccatctttggagaactttgcacatatgcacacgaagttttcttgtggtaagtctgtcatcacaacatatcttcttggtctgaattcttgttgtttcagatttggcgctgcatatacttcatatgcttttccttgttgtatagctgccacttctagatttagtgttcccttcaattcatcttgaaacttatcaaatatcccatggttgtataggtctgctgcttgttcttctatcatgtaatttgaccaaaaagactttggcttcttgtttctggattcataatctttcccatactcagtgtcgaagatgatgtcattgattgtttcatattccagtagaaaagtcatgacactatgtgttgggccaactccccttttaaaccttgcatttgtgccctcactaagtgctgtgctatgtataaatgggcaaaaatctgttttggaatacaccggtataaaattcttccttgttctccacattatttccagatatttgatatttttcaagttgtactgtgcaatcatttgcaaccataggctttcaaattcagctcttgtcaagctattgtgcacaatgtcattaaattctgcatagagatctttccttctcttgtctgaaaatgtatttcctgacctttctctacatttcttcaaaatgtggaacaaacaatttctatgtttgctgtttggaaatacttgacgtatagctgccctcattgccaagtcttgatctgttataattgtttctggatgttttcctcccatggctgttaggaacgtttcaaaaacccatttgaaagtttctgtagtttcatctcctaaaaatgcacatgcaaaaatgcatatgtttccatggcctgtaacaccaactattggagcaaatggcatattatatctgttagttttgtaagttgtgtcgaaactcacaaattcaccatattgctcatagagttgtgttgacctcccatcagtccagaacatgctcttaactttgttattctcatctagagtcagcttgtaatagtagccaggatcttttgcttctttttgccttagatattccatcacttgattcatgtcagtatttcttgtctctgagttaattgctgttccaacattgctgacgtcttttccggtatatggcagtgctgctatgcctcctctgagaaatgacaatattgaaatcatatttctcgtgggtatgttgcattgtttcaaagtccttatcaactttttctcttcatccgtcatatgtttgtgtgatctgaggaactttgcttctctattgggtgtgagtgtatggttatggttgagattcatgcttagtattctccaaacatcaccatcaagcctcactgttagcatgcatttgcaatcagttctgtcaatcacctgtgtattcctctgctgctgagttttcttttttttcttcttctgaccatcatcattcttaccatacctgtagcactggtatgtgtacttggtgatctgaccaaatctttttttgcttgtagatttgtagtggtgtgtgatgactacagaaaatcccacttgatatgcatagaagttgaagaaactacgcgcttcttcatgagttctgaatttcttgccaatgcaaggtatgtgtttcttgtcaattactacaggagtgttatcttggctatcttcttcattagccaagtagttgttaatgtcttcttcattgatagtgtcattgtcctctgctgaggtagcttttgtctcacttgttgtttctgcttgcccaacatgttgctctacttgttcaattgctgtgattgtattgatttgggaatcttgctgaagcatgtttgaagtcccttcctgaaaattttgttcaagtaatatgt

SEQ ID NO: 38761 - DNA, 8625 bp, Oryza sativa
  unsure (1)..(8625): unsure at all n locations
tattagatcagtgtatgttgcaattgttttgttggagcttgtcgacttggtagtttagaaacttagttagtacctaaatggggcattttgctgctgcttccttcaccctcttgcaaattgtagatattaggacttcttgcatatgccagcctccctgtaaaatttatataaatcattagagcatatgttagaatcaacaaacataattgtagttacctttatttattcttagagcaaaatttattcaaatatattttctgacctggagccatgttgatgtttcttttgcttccttcaatctgcattgcatcatttttgctctcctctgattgttgtctaattgtttctccttcttgtattgcttcacgacctgtgccatgggagaaatgaagtatatgaggtactgatttgttaaataggtatgtcttttgagaatcatttgtattttttagcatgtattgagctttagcagtatatgttcagtgtggcatttgcatgttttatgtcaaacatgaatatatttttcaaatacattgtggttgcaccaaaattacaatacacatacatgttacacttcaattataccaaaattatagtgtacttacatgacaaataaactgaatttacaaatctaattttagtcataaattgttgtaattttagttataaactgaaccacatttgtagtgcacttacttgtcatataaactgtttttacaattgtaattttagttataaatcactgtaagttttatactttttggatttattacatgttgtatcaactgaactttcaaatgtaattttagatataaagcactgtaattttttgccataatatttaggtcaaattatgattgttagcctagaatggttttgcatatatttttaaaatttctgtatttaggcacatatgtgattgtatttctgtgtgtttggtattgagtggcaagtgaaaggagtggtatatatgtgattattatatttggctatgtagttgaagtttttgaaattgtgagatgttttgtacttgaataagtagtgtagtgtttcaataccttttttctccatggatccaaccttgactggttcagtaaatttcattcctgcaaaattcatggaataaattagtatacatgtccactgaaaccatcttactagaatgttaagtattacatatttatttacatagcttattcacaaaaattacagtgaagttacacgcaatataaattgtttttacaactgtaatttctaattttaattttaatttcaaatcactgtaatttctacttccagtgtttgattttgcatatgtatggcagcatggatagtgctatttaagattgggtgctatgttaatgtgttttgagtgtttaacccttttctagttttgataacaatggtgtgaaagtagtagtgtttaacccttaatgtattttttaatattttgcatccttcaccctgcagctgaacattttcctgtgattttttttcaaagttgtactatgatattttttttaaatttctacatgatgttcagatcaacatagtatgtgatttttttaaaagaaaatacctaattgtagtttttccttgtttgtctccccagattccttgttctacctgatgctaattttgacaggatctgcatatgacttcatttctgcaaaattttattgaatgtattagaatacagcaatacatcatagagtaatacattataacttacacaacaaatgtataaaaattacagtacacttacatacacaatgacctgaatttacaaatgtaattttagttatgtaggacagtaatttttgtattccatgtgtatcatctagtcatgttgatctaatgaatctatcctgatctagagatatagatttgatgtgcataaatgattctcaatgatgatgtaactgttgcataatgtatatatacttgtagttgtattagttaaataagtactaaaatattgtggatcgggctctgcatgtactaagattgtttatatggcagatcgagtcatcacacatttccaagatattgagtaccctagattgtttactatgatgttcttggagtgatattcttttaatcctagatttgatttgaatggattattggaaggtactgctcctatataattcctgaatgttctatataagagtattaaatgtgatctatggtctatattctaagccaaatatatagagaactatgaatctattttgctagttccaaattggaaatcactaaaattttatccagccatttgtcttaaatgagtgaatacctagtattgaggagtgaaatatgcaggtgttctgtatgacagattactaatcaagcatcattttatcaattacacttcaataatgcaaaaaattatgttacccaaatttacagtgcaattgtactaaaattacagtgcacttacatgccatatgtactgtttttacaaatgtaattttagtgcaaatgcaatgtaaatttctacttttgagcatatatgaatgtgaaattggtttggtgggttgttttttagtttctgaacttgtttttcattatttatcccttgtgcatatatttgtttttcatatggattgtgccctataccaattggtttgtaactgaagtttactgtggaacatgtcctaattcatgcttgtgttctcttaattttagtttggttctgactccatggatctcaactatcctatccagcatcaagaccaaacccagcagccatcatgcaggttagttgtctctaacccatatcaccatactactcactattgtggttttattttcttttttgtgctgcccaactgatacatatatgttttggaatatatgatgtatttggtgctggaactcctgagttcatgtttgaatagatgtattcaatttttaggtagtaaacaacagaagttgttctgtatggtctacttgtttgattgattgataattttacagtgcatttgtactaaacttacagtgcacttacatgtcatatatactgtttttacaaatgtaattttagtgcaaatgcactgtaagttttactttcagtgtatgaactgtgccctgtattttgttcaaaacactccttatgcatatgggatgggggcacgtatggtgctatgatctaagatttgtagacaattttgaggatgagcacaggtttatggaacatacctaatttggatttcttccttatttcctgtttctcccctgtgatttcactttgatttgaagaattttgctttggttcaaccttttttctcttctttctctcctactcgttctccatggtgtgcgtggtgttgcttttttggatctggtgtgttaatttggatttgtgtttgtcctttttcttttagctttcttggcagccaagttgatgcttttggacagggttgactttacttctttgggcctctcagatatgttctttgtttgatttatttttctaatttgttgtttgggccagattgcagcccatgttttatctgtttttttagtgtgttggcccagtcatttttggccttttttggctgtctgttcggtttttttttaactctattggatgaaaatctaagggcaaggaaaaatctggatgatttttgagaaaaaatcacccgacagatgcataggtggttccatctggaatcatttttcttcccgagttgctttgccgttgtgtactttcagcggctttggttcgtgttcctcgctgaaacgatagacaaaaatcactcacaaagtaaagcgcccaacagaaatcactcaggattgcaagagattggaggggagaatgaaatctccattttcgttttcgatggagatgattcctccaatatttattctctgacatgtaccaagtaccatggcctgtaaagaagggagaagatgaaaggaaaaggctgcgggtgattaggaccaaaaccatagcccatgtcagccgcatccgacccaaagggcctaaatttccgataggccgagaccatagcccatgtttctctctagaaggaagacggcccattacatctaggcccaagcgaggcgtgacaaagaaggacccgaactgcggaactgctgctacacatcaacggatcaacccttgtccttcactcgcgaagtcccctcgaactcccaggcgcgcaaaaagtcccctggggaacttccagcggcgcacccaccgccagcagcagcagcttcgccgcccgccgacgccgtagcggagggcaagccatgaagttcaaggccttcttcaccgacgacggcatcgctctcctcgacaagcgtaaggccctcggggggcacgacttttcctccgccgatcccaatctctctctctctaccccgcaattcgtcgagcacctcacgcgcgtcgcgccgtcttgtctgcccccgcagggttcctgccggcgatggacaaggtgggccgcctgtgccacgtctacctcacgcccacgcacgccatgctcctccacaacctcctcggacccacggggacggggcccgacggcggagggccgcagtgcgtcgcgcagttcgccaaggacctcctcttccgggagtacagcgtgtcgtcgcggaacggcaaccgcgtggccttcgccgtcgacgtcgcgctgctccaccgcgccctccgcagcgcgctcgccgtccacgcccagtcgccggccgccggggacgcctcagccgcgatacaggtgaagctcgtcaacaagctgccggccgggtcccggtctgcctcgccgttcctcactttcgagaccaagggagcccgctctgctgtcgtgcaggacgtgcccatctcgcggcccctttcacgctccgacgtcgagcggctgcaggctgccctcgactccgcccaagagctccctcaggtgcgatgcattttactgaaatgctcgtgatatttcattagattatagatttcctcggagtcggatttggacgcccaaatgtggaactagttaatcaaagttgaataggttttcactgaacaatctctgctgggattattttggctttagatggaggcatcaaatgtacatcccttagtgtaggcttttctcattcgaaagcttgaactatggaattagtgatgagttggattcaacttgggctgccttatcaaattgaaacttgaaacctcacgtgacatactcatagttcactatagcaaaagcactagtccagtttatttcagtcataagaaactaactgcattatttgtttgtaccttgagaaaatttataaatagccaacaagactcaggatcaccgatcacaggcggtacacactaagttagtattacagaagcaaaatgtagaatagcaagtatactagtctggaactgccattcatgttttattttcgtcctgaaatcttagtcatgcttctttataataccatgtcaaggagactaaattagacaccccaactaagttttcctggggaattgtgtattcactcagggaggtttatgttgatttaatataaacgtcaagaatcacagacaactaaaagtatcttctatttcgatgattctaatctctaaatttattcttctttgcaaaaattgtagccctaaatcctaatggatgttgtcatgttgatacttggtttctgttctttctgtagactctagttcaggttccagatctgccacagttgcagagtttggtcgatcgtctaaaaaatgtcggcgatcttctgacagtagctgttactcaatatggtgacttacatctacacgttgccacttctcttgttactgttggttcagaattcaggaaacttcgtatccttggtgttcgtggtaagctgctctacattccaaagcaagtgtcaataatgtctttttagcagtgctgtcattatgttgaaattacctttttgttttaacgtgaatgaaattacttatcttatccatatttttatatgaattttctgcatttcagcaaccgcacctgttggtgatcaaaatttgagtgcttccactcgtaccaatatggcaattgagagaggggaggcgctctcagtggtattactcctaagagcttcacgttttttttttttaccatttttcatgcagctgttcacaagtttctgtctttctgtgtttttacagcaagtgaatatgaagcacctagctaaaagtctacaatgtcatttggctaagcccgactgtaccttctatggtgtgctttccagctatttctgtaatcttactgacaagttccaaatttgtgttggagagtcactttttgcttaaatactgtcctttttaatggcacaggtatttctcctggtggtgcttgcttgactgtgatattccagtatttcattccaggaactagactgacggacaagtccattagcttctactgcaggcttccagtccttgaccctggcagttaaacatattacagcgtggtaattactgacttgcttctgatatcatctaaggatatgcaatactattagcttagctactgtacctttctgttcaatatcttactatcttatgtgttatgacttgcttgtggactcaatatatgttggctcagcaataattcgctattttggaacatagcatttttattatcgatacctgcaaaactgaactgcttccactcattgttgttgtgatatcacttcgttccaagttgagccagtctcctatgcatgcgatctatttcctaactactatttacaatcccactgcttcaaacatccagatctcagtatcatagaaaaataaaaggaaaccagatttacggtaaatgataattacggaattatgttttttattaaccgagtacaaaattttcagtacttcccttttgagtgtatgaagatagtaatcatttttggagcaaatgaaacatttttttatcaatgattgcatggggcaaatgtatactcttgagccccatgtccttggtctggcataagagggaccaaaatcactggaatcattaatcttcctgtacacgcgtcctgtactagccacctcgacgctcttacatgtatggaacgtataatcctacgaacagtttttttatgcagtactaacagtaatttaacaaaaaaaagtgttggtttttacaaaatacaaataaaacttgaaatattccatgtttccatgccaaatgtttgtttgaaacaagtttatctatctaaacgttacaactttggtactgatctttcggcaagcgagcagaatcaatgtgatggtgtagtgcgtattttgaacggtgctttcgcctttagggccccaaccatttctttcattgttaatattgcggtactgccattctagaggaaggattttttttactgaatgtagaactgtaaattatctgtaaaagaagagacaggtaaattctgaaccaccagctatgtgtcaactctgcatctctgatgccatttttcacacattacatgtctgtatatacctgtattccgatcagcttgagcttcagtttcaaaacgtataaataccagtttctctgatcttagatacatattccaccaagaaccggcaagaaatgggcctatatctgctaacagtttatattctagctttcgttaggaccaagctctggatccacaacgtagcctctgagggagggtgtcttgccaagaggttccttcttttgaagccttttccttgcaatgtacccccgaatccatggcagtgcatcctcatttaccttgatcatgaggaagaacagaatgcggtagatgaagatcatgctgaaaattactgagagatcaatccactttgaccggtgcacgttgatctggaatatgtacttcagaatgaagtctccagggatcttcggttggtctgggtactggttgtcaaatacgagaccatccatgtcattctggcattgcccctgtcaggttgataaaagtttggtgtcaaattttcttcaagataaaaatttagtgtgtttcccctgtcaaagagtgggatttaatttacctgcagcgcccagtaatggaagctgatgtactgcatggggtatctccaaacaggcttcggaatgtcgtaaggaagtctaaagtatccagagacaagcataaatattccctaggaaaaaaaaagtaagacgagttatgtttactgagttatgaagttctgaaattttaattgaaagaaaaagcgtttcctttgtaaggcagcaatgtaatgcggccactaaaggataggatcagcagttagaagaacaaaacataggaataagatcttgaacgacctcaagctgtctttaaactgggatgggagtagtgtacagtaatgctgggtagcgtacggtaaagttgtgctgtccagcatttatttctttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 38762 - DNA, 5813 bp, Oryza sativa
ctttccaaacaacacctaatcggataccgtttgacctctcaaactgacacttgactaactactgcataatctgtaactgcagtaactcgagttgacaaaccaccactcaaatccggcgctctactcaaccaatcctcatacaaactaaccagactaaagtgcttaaagtgagaaacaaactcatcaagtttagtgccaatccaaccacgtttgagcctccaatgaatgacttgatgaagatcgggtaagaatgcaggctagggtttttcttcccatcataaagagataaggcaatatccaccattgatcaacatatgaattaatggctcatatttgttggactttttcggctgcaataagctgatagtaaaggcttcatatggagagaaatttggcccaaccgtcagcggaaatgctaatgggcgatcgatctcctggagatgggggcagcgatcgatcccctccccctccctcccttcacctgttttccctttttggcaccgcattactttcctattttagtaaatttatgcacctaaaatttatacacatcaagtttacacatctaaagtttagagacccaatatctaaagtttagagacccaaagtttataagtcaaaagtttatatatccgattcaagtttgaatttgaattcaaatattttttatatatagtatttctatacacctaaagtttatagacccaaagtttataagtcaaaagtttacatagccgtttcaaatttgaatttgaattatatctaattcaaatttgaatttgaattcaaatattttctatatatagtatttttatgcatctaaagtttatacacctaaagtttatagacccaaagtttataagttaaaagtttacattcccgtttcaaatttgaatttgaattatatctgatttaaatttgaatttgaattcaaatattttccatatatagtatttatatacatctaaagtttatatatctaaagtttatagactcaaagtttataagtcaaaagtttacatacccgattcaaatttgaatttaaattcaaactttttatatatatagtatttctatacataaatttttctaacttttgttttttttaaaaaaatttttgtggtgtagtgtagtaggaaaagaagaagggggagaaaaaagggggagaagtgagaggaagtattacctatagggggagggggggccggatctaatcgcttgggtgatcgatcgcccattaggacccttcgaaccgtcagctcttcggttaggtacacgagacaacgcagcagaaagaaattaagggatggatatagaaacgtccacgtggccgcaggagattgggcgtcttatccaagctctgggctaccaggatcacacaataatacgtacatctctgagtcttctcttttttcattatacaaagtacctacaaagtatgatccgtattaatttcataccaagtaactttaatatctggcgcttctgctcccttagcttctttgtgtggatagatatatgaccgttttagcgattttaatgggattaattttgacctcgatcggcatatatacatccattcatacacgaacagttaattcagtacgaaacacatggagtagacacaagagtagaactaggatatatagcttattaattaactgttctttcaaatacatggagtacgtatttgacagtagtatatatgacacagtaatgcatgcatatatgacaccaaaatgtgatatggatatgattaagcaggtgcagcaaaacgtacattaattaaacaacaacaattaaccctcgggcacgcctgtgttttgttatctcgctcaacatatacgtacgtaatactttgcttgcatagcatagggacgacgacattatattcttaattgataaactcaagaacgcatggagatggatcgagagatttataaatatggagcttgcttgattgattagatgaggtcgtcctccttgtgggtctcgatgacgacgtcggacttggggtaggcgtggcaggtgaggacccagccggcggcaacctggtcgtcgtcgaggaagctctggtcggactggtcgatctcgccggagaccaccttgccggcgcaggaggagcaggagcccgcgcggcaggagtaaggcaggtcgatcccttcctcctccgcctggtccaggatgtacacgtcgtccggcacctgcagctccacctcgccgtccggtgtgatcagcttcacgttgtacgtcgcctgcatccgcagcctgtctcccagcttgttgctcgccggcagcaccgacacgcgcgccggcgccggcgccgtcgccacccgcagggacatcggcaaccggacctggctgctcagtgccgtcgccgccatggctgctatagctaattaagctagctagctgctgctgctaggtaaggtagacgaggaggagaggagtgagctagcaagaatgtgagcgtgaggttgaaggaggctgaggcaataagaagggaggtggagggtgccacgtggcgagcggcgactggttggcttatctgcgggggagtggatggggcaacgaccaccacacgatgcacatcgccgatgctgtccggccgtcttgcgtgtggtcgcctcgcttttcttttttgttttcttcttcacaccttaacttcttttgagcttttttttttaaaaaaaataatttgtgagccaatcacatgtacctccaggattcagatctggtatctctttttcccatggccgtccattgattttgtttttcacgagaaaaataattgaacaagatgtatgtgtggtcacacacattttctttaatttcttttgctatgtatatatgttgtccacacatacgttgaatcacaattgttagattgggatttgatggtcacgagtcttgcacaagatagagtgcgatgtgcagcctctaataattttgaactgctgcatgtgccttcttccttcctgttcctggctaggaactttctccaaactaacctaacctctctgtttttcttctctcttttttgagggccaggccaaaacttttgctttgtacgatcacatgcacgcttatatgatattccatgtaaatgggccggcccaatccgcatagccgacccgattccaagatacggcccatagaacactggatgcgatgaccagcccatcttgtctcttattgggcttgtttgttgacaggaacatccatctcatctacttctaggacacgatggaacctgcagcaggcagcaggtacatacaggagtgattgagtataaaaatatgagtggatgtataacaagagagtagttcatgtgctgatcgaattcgatcgatccaactctatatgcatgcaggaatatatacgcatgatcgatgattgtacatgatattttcaactctttaagttctactctatatatatatattgctactggccggccggccacgtgttggttacgtggtccttttgatcctcacacgacactatcagtgaacaaacacgttgtacacacacatatatacgtgtatgtgtaagcggaacaataattgattgatcaattagtagatcgagataactggagtagtatcaactgctgcacatatatgcatgtcaagcatccatcacatgttcacatatatataccccgatatgaatattgatcatccgcatgcaatcgaatcgcccttcatgtggtaggactaaaagacaattttacctcattcaattttatattacattctatttaagtcaaacaacaaaccaatttaaatattttgaatcatttatactgatagtatatgtgtgtgtaactagtacattgtatcgtaacaaaagaaaaactctccacagctagctgactcacatgcatgccttggccctagcttgttgggacgtaatacatatccgtgcattattagcaaattaatagcaattgattaagaaaatgactagctacacagattccctagggaggaaaaaaacacacatatctaacaattaatagacagattgatatatggagtgagagaaaaaaaaagatttacaaccgaaaagaaagaaaacatcgggaaagcaccactggtattgacgtatagtaatgtgatgataaagtcgtggatgcatatctttagcaaatatgtccatgaatacttagcaaatatgcaagtgaagcttgtaccatgatttgagtgagatcagatcgagatgtgctattggtttctgtctttttagtacatgttaggggatgcattctcgggtgtacgagtgtggtgttgcatgtatggtggtgtatgtacgtttattgcacaattgaaaaaaaaaagaaaaatcaaacatggattatatttcattagtgaaattaaattgtagctgggtgtgtttagttcacgctaaaattataagtttaattgaaattgtaatgatgtgactgaaaagttgaaagtttatgtatgtagaaaagttttgatgtgataaaaaagttaaaattttgaagaaaaaattaggaactaaaccaggcctaggtacggtcgcgtgaagattgctcggatccgatcgacatccaaacgtaccgacacggtcaaaccagggatgcgcgaatgtttcctatctatagtttgaccagcatgcatgttctaatgttttctattcttccggtagccactactgttctattttcctatttcattaatcaatatactaataatgactaagcatatgcttcccacccggccctatccaaattccaatctcaaccaataattaagcaattaaccaatgagctatatatgagatttttttattgtactagccaaactgattaattttaattgttgcttttaatcatttcactttgcttgtaagcaattcatcgatcagttcgtgctttgcctgcggcctaccctttttgttgcccggcactactcccaggatatatacggagtatatgccaacacgtaccatgcacgtttcttcgttttgtattctctctcttcgcgtgtgtgatccagttgccttcttttatccgacaagattaatcttcatcacttttaaagaagaaaccacgtttaaaattgctgattttttttgttgaaaattctctctgtgtctctagtatttcaagtgctgatctcgtggtttttttactcccctttgtcacaaaacatgcatgtactctgaatgccgcatctatattgtttgaaaatataacattgactactactacctccgaggacaaagggagtaatttgtacctaattaaaagcaaaacattttaaaaccaacaatattataatactatcaaagtatttttcatgacatatttaccacatgcaactttctaatattggaaaaataaacatgtttagagtttttagagtttaacttgagacatcaattatgataaatttatattacacggggtatatataagactacccacctacaacatatgcgaaatatgtaacttttttttaataatggatatataaagttggtcattgtttcaactgaagctacaaccacctattacaaagttttagttcgaaggccaagcacggtacaataaaaccatgatagatgaaaagactggtacaacaacaccaaccaaagaaaataagcaacttatttaaagtttaagtttattccttaatctccatttaaaggtaatgaagatatgtatgatgattgatcctaaatttcgaccgcagcaatgcgaaatagctagcttgttttgacagggatttgtatatatgctatgcatcttctggattcctagttgccatcgtttgtcatga

SEQ ID NO: 38763 - DNA, 5617 bp, Oryza sativa
ctcaccattgtcgtttctctctgtcgggaccatgttgttgtcggccgcgtttccattattcttgttttcttcgtagccaaccgccaccatcaatggatgagtcataatgtggaacacgtccggccaccttacttaccgccgttggtcgctggagcactgtcgcccatcttctctcatcttttgtttcttgtgttggctagggaagacgacgaatagtattagtcgttttttcctatgtgtttaaggaaaaaagaatcctctcgtccgggaacgtgttttgacacgcctgcatccagtcgtgttcaccactaaagctcgtcgttgtcgtttctctttctatcgggaccacatacacgtcctaccactttcctcaccatcgtttggtcactggagcactggcgcccatcttccctcctcttttatttctcgccttgagttagggaagacaatgaacaatgtctgttgggcattattccttcttagtctagcccaaccatgctactgaaccactcacataatattaagaccatatgagaatgaatagaacatgaaaaattctaatttatatcaattaaacaagcgaaaggaacaccatagaagatccaatattgaagacaatatcgatgcacgttatttgttaataaggttcagccgaagcctacatccccagagcagtggtcctccccaatcaagcatattacaacgtatccgaattacaattaatgattctcggccagacgccgccgacagccgatacctctcacctatgctaagtcatcattgtcgtcatcatgtttggatctcatatgacgtttctttcgcgtttggtttccgatgtattatcggggtcggttttataacaaaatcatttctcattatttattaaaaaacatcacacttgcatcagttatatttttcagtggttagcttgacatatatacagtccatcaatcctattgtttggggtccacgtggcagtggtagtgggtgtctggtggaaccgtgactagcagaaccaccacatcactaccatactagtgtttgggaaagagggacttcagtccctctcataaaagtacaagtccctactagtatgtatggtgttgtttgggaatgagggacaccaccaaagtaatatagatattagtgcgatttctgataaatatttcatgttttcaaatatgctagctcaacgtaaattatgacattatattacagaatatggaatcatgcatgtagctataataccaacgagcttaattatctagacaggataaggttgacgaaaaggatattgttattatttattttgttctctatatatgaactggatattaagtccagcatgtgtggttcagttaagtcatcgatcatgttaggacttaggagttaggaacaacaatacacactccgtaaagtcttgtcgattggttgcttgaaataagcgttcttcagacatacgttaattataacgattaatggatcgatggcaactacagatagaagtcttttttatctttatctttataagttggtattttgagtagttttattgttttttaattaaaccttgtttttagttcatagttgtttctatagtaccattttgtagcaaagaccgaaatattttttatcatcttaaaaagaaataatcgatgacgaataaatgctgtgcgtaggaatgagatcatctgacacgaaccatactaaagtgtgatccatatgtcacttttttttcgcgaacgcgtaaaaagattgcacgtcaatatgatccatatgtcagtgactgaactacgtgtctttacctattataaaagtttaaggtgtttttgccagaattttggtacgtcatctgtctttgaaacggttttagttttatgtttcggttttaatctatatgtctactacaataaattcttcttaaaaaaaagtaaaagaagtccgactaaaaaaaggtaaataaaggaagaaaaaaagtccgacttaacgagtgattaaaaaaaaagttccgtcgtcacttaaagagcgattaaaaaaaaagcttccgtcgtcgtcagtaaaaaaaaaaaaatctcttgtccgactatgtagaaaaaggaaaaaaatcttccagtaaaaaaaagtccgtttggttttttttggcaccgatatttttttcccttttttctttgcacgcaaaagagttttttatgcgcacacgctaaagcttttggttttttcttttttttaatccgatctattcaccgcgcacctctcgggtgcttttagttttttcgtcaatgttttttgtcacctgtttttttctcccgtatgctttttgtttttctcttccggttttataatcccatctgtttaccgcacgcctcccgaggtgaaccctagcgccgcgccgctgccataccgatttgtgtattttctcctccaatttaattgcaaaaatggattccccactcctcttatcattttctccatgattttcccttcgattcggctttaattgccagttttaatctctgttctatagttgccgatgatgacggcgatcttcctcggttatttttatcccgagttttatgctctgattttggggaaaacggaaagagtagatcgagtggattaaaaaccctcgaccaattttggtttaccaagaaagattcggccggatttgatggggagatttgctctagcaaacgtatgggcacgggattatcttcgggaggttgaagatgtagtcatattcgggaagttgaagatggtagggtcgaagagaagcagaccaaatggagggaggtagcggactagcctagggctgaaaaggaaggaaggctttcggtcaaaacccagaaaatattttcattaactttttttaattataatctatagcgattccaatattaagatttttattaactttttcaattataatgtatagtgatcccaatattttaatttattacttagctctcaatatattactgaaaaatgtttacccgttgtaacgtacggacatcttttctagtatataattaggtgagaggatctacttccgcacgcatacaacgaagggagattaatttttcatattcggcaatacgtacatgctcttttaaaattaattatgtgcttattaattaattttttttgccgcggggtttctttcatatacatgatgtgagcctatacatcatgcttattaattactaataacattgtttaagtagttaattgttctttagaagaagttgaaggtgcgtggctcgtgacataatcacaagcttaacgcaaagcatcatatatatcttcaacgttctttaaacgtttcttgtggtgggggtggtgaggcaaatagaccccacataactactccgtagtacatacaacatacatatatgtatgtaggaataggatggtatgagcatatataggatttgattaacaaaagaccgagagctagcacatatagcagggatggtaactaaagatttgttgtactaatttttttttggcagtaagtttttttttttaaaaaagaaagtagtagcataaaaacgattcgaactaccctgcgtaggcatgcacatacatacgtgcatacgtcacgattttgtatatagacatacataacagatgcaatgtcaacgttaattaattagatttatttacaaagatttggaagcagtaaaatttattttgatactcctacatgggttttacgcttgatattggttaatcaatcaatcaattaattaattgatgaggtccgacgcggtcagagacggttggtagagtcgtcgtctccctccttgtccttggactgcgtcgcgtgtttccaaggcaattttttctcctctcctctcctcagataattaattaattaaagaaagaaattgaataaaaatagtacttgtgtgtgaaaaagaaaaagagaagagaagatagtttgtgcgtgggctccacgaggagcgtagaccggagacgatttgccgagttggagtggagggagactcatcatcatcagaggataatactctacttactagtagtaggagagaaagaacaccaacattcaactactagtacaaattcaacaacaatggaatacactagagtcgggaaacagctttactagtcgtaaatttttctttctttctttcttgctttctccaccacgccaagtccacagccacctccattttctcctcctccattcttctcttctccacctctcctatcttcttcttcttcttcttcccaattgcttgccagattcaattgtagtggtcggtattgtgcaacaaacgcgggcggcggcggagatctgagcgaatacagactgaccccttccctgccttgccactttggctgatgtatagatccaacatctctcgcaagctgtttccttttcttgcttcactgggaaatttgagatttttgatcccccgatgaaactgactgggggttgcaattggattttccggggatccaaagtcgatgatttggaatgaaaaattatcggtttttgatgtgaaatgttcgtcctgtgtcattttttgcgatggtgcgtggttcgtagccgtcaattgattccccaatgcgtgccagccgctgacttggaccatcccgacgcgccccttgtgttgttgtgtctcttcttttttaaaatttccttctttccgtgtttatttaaattattattattattatatagttgttgtattggatgtagtcgggatggccagcctggactctcggttgtttttccccccaattgctgcaagtttcctctttgtcttcttcttcttcttcctcctccggattcaagttcaatctcctcccctcttttcacattgccacttatcatctgtgtcaaatttgttttgcaaattctcttttgtagctctctacttgtgagcaccgatcgatcgtctctttctttccctcgatttgttggatgtggtaatggaggtttgactgactgactgcctgcttctgcttggtcgtggtcaggtcgtcgattcggagcggtggccgccggcggaggtgctcggagtcggaggggtagcgtatatgtgacgcctgctttgcccttgccttgcagattgcaggccatgtcatgtgcccagcaagacatggatccaccaacaaggtattcccccacctctgtttgtggatctccctttctttttacgcatagatatactactactaattgcttaaccttcaatctatccatgtttcatcactcattacattttgacagtcatagcaatatatcttagaagccatatatagaccacttctttgattttcggtcttgcacacatgtagcctgggtcaatcaatttcttccaccatcaacatctgtagctttgagtcaccattcaccatacagacagaatttttattacttaggagtatttctgtaggtttaattcccgacaacctagctagctagttcgcctccaggtaagatggattacccttgaggaaagggaactccgttgcaacacatgtcatgccctgcaagttgctattaatttgctattgtttcactttgccaaaaccctgtatttattgtcttcctatgacctatgtgtctatttgcattgtgacccgg

SEQ ID NO: 38764 - DNA, 2635 bp, Oryza sativa
ttactctaattttcgatatgaagctcaatcggttggaaagaattgctcgctgtacgggttctcccataatctcattctcagaagtcttggataaaccaaagctgaaacgttgtgactcgttccacatagaaaaatttattgaggagcataacagtgccagtgatggtggaaaaaggctatcgaaaacattaatgttcttggaaggcttccccaaaccgttgggttgtacggtatgtctagttcataattgtagtatctataacacattcatgcattttgatcttattcatttcgtccataaaatttgttcttcctgaaatctccccatccttttattaggagtgacaatgaaacctctaatcaaaacacccctgtcactgttgtatgccaatctattctagcttgctgtcttttacttcaaacaattattgattcctgatggtacttgtctgatcctgccccatatccaagtgaagtgaagtaaaagatttttatgttttgacttacaaaagggatagtagggaggtgtagatatctgaaatgctctcaaaacatgacaaaggagctgctccttgtcttttggcaaggcatgccaaattttagcaataaagcttggcaggagctatgcactctatggttctttacaatagcaaacctggttttgattatgatgtgctatacagtagcaagtttcatgcatcttttttttattatgatgccaaatgaatatgaccccttccatgcatacttattctctcgactgaataggcacatgtggagtcacttctttccactgagtagacacatgtggggtagtccatattttttataaattatctgcacaattataattctttctttatcatccagatattgctaaggggtgcaaatagtgaagaactgaaaaaagtcaagcaagtcatgcactacacagtatttgcagcgtaccacttgattcttgaaacatcattctttgaagatcagaggatatttttgaatgatcaaaatgcttcaagagagaattctgttactgccatggcagggccatcagcaaatggttacgatccatctgttctttgtgcctctgactttccttcacgagatgactctccagcacttagactgtaccatgccacttctaatggctacactgatgtgaagaaatccctcagttcatcaacaaaagtagatgctccaagttcaataacaaacagctcctcgagtgttggagaagatgcaagtatccgatacgactcaaagccaccacttcattctcaaaggttaccatcaccagtcccaggaacgctaaggaaatacgttggcatgttatctcatcagaatatttatttacctgtcacatccttgcaagaaacatctgctacccagatagaaggcgaggttgaatctggtaaagaaattgtcagtaatggttttcatgttgggtcaaaggtggaagagcctgcagtttctactgcaaatgtggattgctcacaagatcaccagagacaagaaagaattcaagatataatgccaacaaattctacgcacgacaaacgtgaagaatcacctgttatggtagaagatggggaacaacatagcaccattgatatcattagcaaagagaaaactactaacgaagatcaagcggatgatgcccttgatactcacagcatattaattttgatgtccagtcaatgcataacaaagcaggttatttgtgagcagagccatctttctcgtataaaatattatgggaatttcgatgtgtccttagggcgatatttcaagacattttgcagaatccggttttgcagaatcaggtacactgtttattaaacttttactttgtcctcgagtagtttttcttattttcacgaaatacccacattttgttttagcattgcaacttgattctgtttggatgcttactcagctcattgatgtaaattcatagcagaaactgagctgctcttcatgtggagagtttccagagtctcatctgtactcttacactcatcggaatgggaatttgaccgttcgagtcaagcatttggcgcctcaacatcatttgcctggtgaatctgaagggaaaatatggatgtggaccagatgcttgagatgtgagaatgaacatgggattccaaatcgactccaagagtgctcatatcatctgaagcacgaagtctctcttttggaaaattcctagaactcagtttttcaagccattctgcggcaagaaggctttcaatatgcggacatttggtgaacagggactgcttgcgcttttttgggtaagctagccagctaggcatattttcatttgcatcaaacaaaaataattttaagctgaaacaccagtatttggttaccaagcatagctatgccgtggaaagacatactactatacctttcgtctttcttgacattcattattgtctgttcactactgctttcaggttgggctcgaaagttgcaatgttccggtactcatcagttgaaatttatacaacctgcaaaccacaaaccactctccagtttgataatccctgcaggcaggattggtttaaagaagagaggagatatgtatgttttattaacttcagtataatcatgctatgttttcgatatgttttaa

SEQ ID NO: 38765 - DNA, 4616 bp, Oryza sativa
ttggtgatggaaaaccttctcttcgggcacaatatttcacggatttatgatcttaaaggtgctatcttttcacgacacgttgcacactccaatgaccgtaatactgtttacttggatcaaaactacgtcgaggacatgcgtgtttctccgatttatattggtggaagaacaaagcatcttttgcaacgtgcaatctggaacgacacatcattcctcactgtatgtataaagcaaatcctgaatccaattacaggtaattgtggctttcaattaaaaatgtgtctttaaccgatttattggcttgcagtcggtcaacgttatggactattctctgcttgtgggagtggacaaagaaaagcatgagcttgtatttggcatcattgattatctgaggcagtacacttgggacaagcagctggaaacatgggtgaaaagttccctagtagtgccaaagaatgtttcaccaactgtagtttcacccaaggagtacaagaaaaggttccggaagttcatggcgaagcacttcctcacagttccagatacatggagttcagagaattcttccggaccaagcaaatcgtttgggcatagcaataacatgttggtagaagtccatagtgatgacaatctgcttcagcatccaattgaggctgagacagttgtataaatgacttctctgacagttgttgaatcctatcctgttgctacttggctttttttttttcattttgtaaaatggtgtacataggagggcctcactcactaattgattttggcaaccccagagaagtttgcagattttaggcaagtcgatggggggcaagtgaggcctacagtacatgtatgtatacaaatgttcattgttaatttcacagttattacagtgaaattgcaaaattgatgattattctgaacctcagtttccaccagctagttagttggtaacttgtgacattattgatagaccaatattgctccgattcatttccgctggagacgatcttcttgctgtgagcactgagccatactcattcgcagaagcaaaataggagtgctgccatgaagcacaaaacctgggttgtcgcaaattaaaggggtatgttcacaaccacaagcatggcatcgacttctcgcccaaatccttgtaatgaagattatgacgagcagaggaatttttttcttttttaagacaagtataactatggcattgcgattgtttttttgatcttgtcttggtgcttggttgcagaactgctttagccaagggattgttgtcgcgctgttcatttgttggagtgcagtcaaggtcagctaatttaattccccattgcatacatgcagattctcaacccacaaagaatggaatatgggctagctatactccaattatcatcattcttcgtttctccacctcatgcatgactctgcaaagaaagatgcttgaatccaatcgatttggcatttcttcatctgattgagtcctacaagtcaaggtgatcattgccatgtcccaattcaagaggacccaccttctcatcatcttgcagccaaaatggtgagcaatatcatggagaatcatgtccaagagctctgcgtagctgcatcgagggtgtgtgctgttctcagttttctttccctgttcatcttctttgcttgagtgattattaaaataaccaattaatatgtttgtgctgccatatatattctcgcatagtggagtgatgaatgataaggaaggtgataagcctaccgccaagaacaaaagggagaagaagaagaagaagctagagcaaagagatggaggttaaaagatgtcatttttaaacccttcccgattaccagtacttgtttctttttgtcccctcctctctagtctgtccaagttgttacttttccagtttttttattattttttttaatggaacttttccagttttagaaaagggcaaagagttggtttccctttcggacatctgattcgtcgcacttttagattcttcctttcacaggtagtaaatattacaccatcatcagtcataaaacaccattaaaatatggagtacaaaagaagaattaggacttactagtggacatatatatatgttgattctgacaattaagcatgaactggtcgctagtagccgcaatggtaatttggagacacaaagatggcatgcatgggcatatatattgatcgatctatagctagatacagtgactagatgagtgatatagctaagctagagaagtgcctgaattacaagaaaacaaaaacacctacgaccttcctagctggagtactacattaagtaattctcatttgttaattactagtagcaaactcatccatgcatcttgtgctaatgcgactatctaccatgcattaattatattagtaatatgcatgcatgatgttaataatctgtttgtggcaataattaataatcatacagtggatgtctggattagactttggatcagcgatggctgcagaggtcggagagcatcttcctgccctcgacaatgtcatcgaacaagtcgtcgagctcggcgatgacggcctcggcgccggagctgagcatggcgaggcagcctttgacgaggtgggccctctcggccatgtcctcccggtgggcgtagccggtgccggtggcgacgaccctgtcgaggtcggccttgaggctgtcgatggcggccctggcctggcggaactcgtacatcaggatgccgtcggcggcgggggcggcgagggcgcgcatctcctgggcgacgcggtggcggaggcgagccatggaggaggcgtagccgggtgcggtgggcaggggaaggggagtgcaggtggagatgaggtggtcggggaggcaggaggagacggtggcagagaggaggatggcgaggaggaaggaggtggcgttgcggagggcgtagaggagggcgcggaagccgttgaaggcgttgaggttgaggtccctcggggagcggtggtcgaggaggaggagggaggccgggtcgaggatgttgtcgtggaggagggcgcggttgtcctggaggaggccggcggcgtggcggcgaggggcgttgatggcgcgggcggcgtggatgtagtcgtcgtcatggtcgtagaggtggtggatggcgtgggcggcggcggcggagtaggcgtggagggcggaggcgccggcgcggacgaggaggcaggcgtcccacaggcgggaggtctcgtccatgtactcgtccagccacctctcccccgccggcaggtgcagcctccccaccacctccagcagctgcgcgtgcaccgaccgcaccagcgccgcagcctgctgcacgaacgccgccgacatgaaccccacttcgccgaccgccagactccggtgcagcgcctccaccccctgcccgatcgacgagtagaacctcttcatcatccttagcttaattaattaattcctagctatctactccttccttgtagtgttcatggtcatggctgctgcctctctgcctgtatatactcctgcggtgcctacatataggagagatgtcatggcagtggcagcagctactcctagtcctcgatgctaatctagtgtgtacagcagcaacagccagactgcaagagcaatggaacgaatgatatgatggtgtgtctgggcgccagggggaaggatgattgtcactgcctactgcttcttcgatcatctctctcactcatctatacgaatgatatgcactattacttgctactgttcatcactatctatccatctatcgattcgattcgattatgtgtgtatcatcacgtacctgcctttgcattgccattttgatttcctacgtgctctcttcctctcaaaaataacttaggccctgtttagttccaagggtgaaaagtttctgcatttcacattggacataccaacacacatataaagtattaaatgtagcctaataacaaaacaaattacagattccacatgtaaaccgcaagacgaatttattaagcctaattaatccgttattagcaaatatttattgtaccaccacattatcaaatcatggagcaatgtttcgcaatttacacacaatctgtgtaattagttttttttttgtctatatttaatactctatgcatgtgtccaaacattcgatgtgatagagtcaaaagtttttgcgtgggaactaaacagacccataacctagatggaaatgtgaaccctcctagtaaaacaaatcaagacaatcttctattcaaattcattatactaagaggggtcacatcacctcttaggttgagtttttttttcaacaaagggagtgctcatatacatatgcatcggaaaacgcaatacacctagttacttaccccctctgtcacataaaaaatccaacctggtattggataagacattttttagtttaacgaagagaaaatgtgtatcattcaatattaaattagttttttcttttttggacggatggagtagagggtacagtacagtactagattagctttgtgtctccatggctggctagcaagtagcaacagaaacaggggacaggggtagtagaaatactagaatggtgcgtggttgttttgatatgaatgtccaattgca

SEQ ID NO: 38766 - DNA, 6201 bp, Oryza sativa
tggcaattcaacatgaaagcacactgatcagtaatttaactcattactgctaggagtatatggtgtgtgcagtaggacgtgtaggatctagctagcagtgatatgaccaaattaaattaattggtgataaaaagaccatcacaaataacataaatctactcgattactgtaggtcttgtgtagctactgctacttggttacagcaccactttgatgaatgcaggagtcaggaggaatatgcatgagatagatgaacacagagagagagagagaggtttgagtaggtaggtagctggaaatgcttgctggtctctttgggcatgcatgcattgatgcataaggctgcgccttgtatcattattcgtggactaattaataactagagtcatgcatcgatcgatcacacagcttgtttatatgtacaatcagtaacagtagatgcaatgatcggcagcctttttctcctagcatcgcggaacatttcatcagagcaagtttaatagtatagcccagtactagcttcaaatcatctataaccaatgtaatagctaatacatacaatagttgcttacgtataattaacacctagtccaacctgtcatacacacgttacgttttagagtccgtgctgtagctggctacagatctgtagcctgctgctcttctctctcttcctttatctctttaaaatatgttatagctggcttatagcctgctattgtacctgctctcatcaccatggtcgatcttcgtcgtatactactccatgtatgtgcatgcatataatatatatatatatatatatatatatatatatatatataacactttttattttaggttataagaatttctaacattatcagtaccgatgttagatcgatcgattgccagcgacggcgcatttcagggagaagctcatgcctagtatactccgtagctaattaattgaccatactgcatgcatcgatctgcttttatataatcctatatgtacgccaaatactaagcaaattaaagtggtgttcttttctcttgaagatgaagataaagattaatgcttttatgcaaaacgagatagtattaacgtatcattgattgagttttaattattacaaatttaaaaaatagattaatatggtatttttaaagtaacttttatatagaaagtttttgcacgaaacgtaccgtttagtaatttaaaaaacgtgctacgaaaattttaatcttcatcaactcttgttggagaaaagaacgccaaagcccggcagagtcttcaagctgctgagacttgtactaccagctgcttgcggagtgagtatgagtattatatgcaacacacttcagcaatctgttcccaaggccagcagtacatttttccttcatcccaatttgcttttgacatgataggatctttaattggctgcatacataattaaggaaaaaaaatcaaaaaggcaagcatatgcaagctagtcaaaagatgattgctactagcgtcttgttccaatgagcagcaggcacagccgtaacaacgcctttatgatgatcgaaatgagagagatggtatatatgagaatgatgcacatggaggaacaacatataagcactcgatcgaatctctgaggtaaggctgaaaagtgtcttatgttgatggcgcccatggattgattgtatttccccttctttttggaacacaacaagcagctgctaccaagcacatttatatcgatagagtagcatagtatccttctctacatatgtggatgggtagcgtcacgtcttatatagtacttcatccgtcgtataatataagagattttggagagacatgacactttcaaatactacgaatctggatagctcccctatccagattcgtagtcctaaaagtatgtagcaaaaagtacaagtttcctctactattttttgaccagctaattaaataattaatttcagcgtatcagcatatatccttgactccacctttcctccacagtgcacccgttgacacgcgagggtggaggtgagaggggaggagcatatgccatgttggaggccagaccggtgcgacgcttcctcatagcggctggtcgacggatccatggcagagtgaaaatggaagtctgggaggagactacaataggtgagcttgcgcatgtccgccttgatagggaagataaggtggtggcgtgagaccaacacggagctccaagaggagaagagcggtacagtcgccattctctggcaactttctgggcatccacatgatcatctccatcgacatgctcagagagatagagaggagagaaatggaggcgcatgggacttgtggggctagctaactttttataaaatatgtgttgactggattaccacgtagaaccaaaaccacccatattaggctaagagtatattagttagtttgattaaatagtttaggaggataatttatcaatttctatagttaagagggtaaatcttaccttttctttactatagttgatgaggtaaattagacttaacccttgtatgtatgctcccgtaggtaggtatgaaggaacacatatgtaggtacgtacggtgaggatcctgcagatgcacttctttccacggtcgtcggagtgagttgtaaagatgatgtgcatggaggtactacgactgcaaagttggctcactttcacaactcatcttttgcagcaggatcttatatttgcttctccatcatgcatgtttgctgctgcctagctatatatacgtacgtaccctacctctaattatattgcatgggctgctttctggagacagaaaatggatgagcaacttctttgggggcatatgctgtctgcaaactcatatattccagctcccaatctttggatgcattttgatttctgcctgctgcagggctgcttgatttcaggggcacctttctttcttcagacattccagcttggcttccaaaagatgtttgcctatgaatcgatataatgcttcttctctgctggtgcagaaactaacaaagcatatgcatatactcgatcagtgactggtaatatgtgtcgttgtgcgttctgagaagaggtgatcaattgcacggtagcaatttcatttttgtcccactataaacagacagacaacattttcttcaattgtaaaaaaagtagcttccaaggttacaaccttatagagttataatcttgtaatttttcttctgctctatcaatagaacttcgcaccgccttatgcgagtcgttaaaaaaaaagtagctaccatggctagcagtaagggtattatgtctttctcatgtaggtcactagtcagattgctaccatttgtagcaatcctaagtatgagtaaaatgattttaaaaatataggacaattaccagtggtagtggtccgaaacagggaccgaaatgaaaaatacctggtcaagacaggattaaaatattaaaaaagatgtcgagccattatcaatgttatggtccaaacagagaccgatcaatatgaaaagtaaccaggagctgaattgcaaatgttcccgtactgggctccttgggccggaacggccgtaagtggtctgggcacaggctttgatgcatctcttttgtccttgttgtcttacttccattccattgtatagattttaattgttcttaaaaacaatagcaaatgtacagactataatacttaagttttttttatgcagttcctttctgtattgaacatgttgcgcaattccttactcctttacagtaggacactttgttattgagaaacacaaacaaaagaacaaaacagaggcgccagaatgataaaaacaatagtatagtttggatggagcaataacataataataatatctatagtcaactgaacaatgctgtgtgatcaaatgtgtagcaatagtagcatagttacgagcaaacaaaaatcttttaatcctgtgagaaaaaggaagaaaagaatagaaagagagagagagagagagatacagctgaggagcaccccagcatgttcagatgacaagaaggaagttctattagctctatacgaacaactcaactgaaaactctgaataattttctatgacaaaagtgcctcaggattaatcctgaaagctgttagatgatgctcctttattcctattgatcatgcaccaacaattccctcctcttttgagtatcaacttgttttaatttggtggccaattaaatcttctcttgcttgtctcctacgaggggaagcatctccatccggctcctcggcgtgcgtgggctcgaattaacgctctgctgcgagatgagatgcctcacatagccatagaaggtgcagccgacgagcgtgattgcgcacccgacagcgttcatcgcggagatcgggttccggaagatcatccacgacaccaacacagccacagcaacctgtataaatcacagtatccaccaacccaatttgtgaatgcagagcacaaatgaacagcagtagagttgcagtcgagtctcactttcaggttgccggctacgttaaaggtgacagccgttgtggaatggatgacgtagaagatggagaagttgaggcaaaatgcgagtactccggaggtggtgatgatgatcagtgcagggacgatggaatcatacgtgtagagccaattgatgacgccactcccttccagcacaatcgctggtactgacagtatcatggttgcaaatggcgccatgtagtacacagtgttaatgctgcacagaagaagaacaaaatgacagatgcagaatcaataaacacaccaaaagaggaaaacatgcaaggctaagtatggtaaagtaaaattcagactgaatcaatttttactggcccaaggtaaaaagaatccatttttacctatcaaatttgtatccatggagtagagactctgcaaggatggtcttggtagatgttgccaggcaaccaaccatagcagcacaaaaaccaaacatgttgaaactaagctcagttattgatgttaacatgattcctcccactattggtaccagagaagcccatatgcgccactcgaaatacttcctccagaccaaccactgcagaataactgtgttacaatggaagaatccatcagaatatgcttacattaattgcagaaaagcggaataactgagaacgactgaattgacaataaagagctcaaaaaaaaaaagagcttagaaaggccaggaatcagagaacctgtcgttgcaggggtgaaagattttatggtctgcatgaaggagactggaatatatctcaggctgacatttcccagtacaatgtttatgcagaacacaaatgacattgggaatattcttctccaccgatcctctggggcaacttcaatcagtggtttcatcttgagaattttgattgcgatgtaagctccaatcgaagagcatataaagtggacacacgagacagtaagagggaacttgaactccaatttctgcatccaaggaaaaaaaaatgaaaaccatcaaattgatgacttgtgtgaatgattatgcagtaatattctgaaaaagaacacaattttggactcccaagtcaattcgaagaaaaaagaggaactgtacacttcatcatcaaggatcgatttgtgcagcgagaaaacatcacacgctacagggtttcttcagtaatacatcacccaggccactttaagtgacaaaggttacaaagaccacgaagttgcttcagaatagcagcagttttgtttttgcactgagtctaatatcctgtggtatgcaggctgttagtatctttaaaaccaagttttcttaatgcaatgatacgcaagctctttgtgtgttccgataaaaagaattgtaccacaaccttcaaaaatatagatggttgcaaggaggtgatttttttttcctttttgaacccaaaaacaggtggagagatcccttccaagggttcaatattcatgaaagctactccaccaaagttccttccagaatcagcactgttctagttaactttacattggacatccatcaagggcatcaagatgcaaactttaagcttttttttttctttttggatgcgacgttgtacttcaaatttaaggtagaaccatagagttgacttacacttgggtgtggctgcgtgggtgatccaccaaaagagaattgtcaaactttataatcttttgaggaaacattt

SEQ ID NO: 38767 - DNA, 7246 bp, Oryza sativa
  unsure (1)..(7246): unsure at all n locations
cggaagaagaataggggggggggggggggaagaaaaggagaggaagattatggaagaattggaacctggaagatccatttgttcatgatgatgacggtgacgttgaagccccaccattggaggatcgccagaacggctcggatggtggcaacgtctcccatcttggcttcctccatcgatcgagatcgagatcaagatcgatctcgactcgactcgatggatggatgatagatcaatccggccggtgtcaagaaacgcacgcccgaggagtgaaaaaaccggctttgtatcaatcaagccatcgataggaaaggaaaacgatccattagaggcatcttgtagaactagaaggcctgcctgcctgcatcgatcgaactaattcagttgtcttctcttttgtttgggggctttataaatatatactactacaagagacgagaagagaagaggaagatgaagtgaatcgaagagggaggtgtttaggttgcgagttcggttggtgtgagcagatgattccctccctctctttgcctttgggtgttgtctagtctagcatagtacgtgtctctctctctctctctcgcgtgtgatttgatttcccggcttctttctttccctttctttgaaaaacgtggcaccatccatcaagtctgcaactctcttacctttgccgtgagtctactcgtcgtacgactggttccatgtgctcacacctctcaaattttatgcaaataactagtttgagaatttttctgccatgacttacttcttaattaatataaatcgacgcaccagccaactgttttaggaatccatgcttccatttcagtaaaatatggagtcataaatcaaacggtcaaacgagtccaattgattttcagcaaaataaaagcatactactctattgttcagctttatctaaataaaaaaaatacactattgttctgagtgaaaaacgcaacacgtacggttccagaagccaaccacatgcctactcctgacagtagcggctagtacctcactcccaaaataagtgcagccataagtttcagcacccaactttgatcgtccgtcttatttaaattttttttataattagtaattttgttgttataagataataaaacatgaatactactttactcgtgaattatgtttttaatttttttcaaaaaattttcaaataagacgagtgatcaaagttggacgcgaaaaaccatggctgcacttattttgggacggagtaagcagtacataatgcaaatcctctacagttaggcaggcaggcctccgtatcctgccgtgcaaatcctctcatgttcatgcatttgttaatatagaggtcaacactcaccacaaatatcattaattcatatcaaggacacatatanattcatcatctggagatatagctacactacttattaatccaaccacagaatctctaatatgatataggagtactatttactataggaatgaatattcagggttagtcatacactcaaactatatactagtactacttacatgctccatgactgtcacaattgtctgacaaaatgaagatccacttcttccttgactctcatgcttgtcctcgactgaaataagacctccaaaaagcttcaggatcaaccaaaccattacatacacaacatacagactataaaccttcacaatcatcgatcacaggctataaacaatgacgaatcaagcaataaaaaggagattaaaaaaacaaaatcatatttcccccaaaaaaacgtttaagaataccatcacagggcaagtacaggacaacattcacaatggtcactgaaagggggtaaagaaggaaggtgaacaagtaaacaacacatcattccgcccagctaaaagactacatacaccatcttcaccaggtaagagttcttcctgtagatgtcaacggcagttaattaaataaactacacaactgattcagtatcaaagtcggtgtatagccctcctaaggggccaaagaatctcttttcctgagcttgtccaagcgagctcagaagctaatccacaaagctattgtgatgatcacttttcagtaccatcaccttcagaatccttcgactgattcacattacaagcatgcttactattcccatgtattttcagcacagaatcctcatacttatgcattccttccgctgccctgcggatcttgcaaaatgtacagtaccacttacctttggggatagtgttgcgtgctggtctcatgcaatatatgtgataaccttcatcacagccatcacacatgactatctggtcatcatccttgtcttggaagcaccctctgcagaggcaagaggggcagtaccagcaaccaagcttcttttgttgctcaattgcaagctggcttgttttcaggcatcggatatgatagaacttgtaaacgcagtaaggatgtccgcataccatgaatctcttgtcatcgtcttcgcatgtgccacagtgtttgcacaagtttgacagggcagttgttgacaggtctggttcattgtcttcccccatgcttgagacggagctcccctctctttcttcagctaattcaatttttatgggaagcttgggatcttcttcttctgtcttcaccagctcgagctggtcacacaaaacacagttaccaccatgcaagcagtcatgggcaacattattcgtggtatctgcagccaattcttttttcttgaagctgcaggttgaacaatgccagattgctgggacttgcttaatatcaggattgagtagcttgacacatgcaaagtggtacatggtgtcacattcatcacagattaggccttcttcaacatctaccttggtgccacaaccatcgcaagggcacagatcacgtccaggtggcacagttcgtttcggtattgtagaatgactagaatcacatggggccaactgcacggtggtagtcgactcctttgtgacaacgtggacagcacccggcaaacttatttcctaatgaagaatgcaattagtaaaaccattattaattaagtgtgcatgtggaacaatgattagcaaacatcctcaaacagacaacttacctctattctgtgctcagccacctcagcttcagaaaatccagaagcctataaaataatttatccattagtaatgcccagcataaaaggaaagatttcaatatactaaagcatcctgcaaattgcagcatggttgccaagtgtgcagtaatagatttatcttaactcaaattgtcaaaatataaccatctcgacgctagagacattaattgaaagataaagcaacagattacctgcttttggtatgaaactcgtgaaatggttgaaaggttgctcgctagacctgtcatctcttggccaacttgctcaaacttctcccacatctacaaaataaacaaatagagagttgtattaagaggaaggctcagcaggcaacagtatcgtataatttttcctagatgttactacacaacttctatgtttagagcatgaacaatataatgtaaacaaaaaaactcacagatgaaaaaagtatatcaatgataactgataaggaaatcaatatagaagagtaattgttcggtctttgagatgtgctagcactaaatattataaaagttttcttttttgtgttgtgcccatttaagaaaacaagtgataaaaccctagttgacttagacagaaacctcagcattgagtggttacacatgcagcatgcatgagatgttccagaattttgtgtgtgtcataccccagctcaaccacattatccatggtccacttcatcaaccatgaagcgcaagggagttggcatgttgcggacagcagatgaagcagacagatagaaatagagcatataaagttgcgaagacatgatagtgtagaaacagggctagtataccatttaagttgactagcgttccaaccctaacaaccagagttctagaaggtcagttgtgataaactccctaggagtctgttgcttggatggttcaaacaatttgggaagatcttaactagcaaacgcaaaagaagctcagataagcagttgagcatcagcatcattctatcaactggccgtacgtagaacattttgctcttatgatttacggagttgtgaacaataatagatggagaacacattaagctttagcatacagagggcgcttataagtacaggtaatatgcatcatctttattagataaaagataagaataaacactagctagtattatttccctccaacaacagtagctaaattactttcatgggagcaatagagaaacaattacctgctggatatcatcgtcaaatagtgcagggttgtgggcatagtctccatttctcatcttggcgtcgattttttccaagtcgatgacatcaccaggtttattgacatggaaggtcccaagtagcaaatggcacaacaaggcaaatttctgggagaccaaaatgtcgaagagggcattattacacattgccttgttagcttcggaagaagctgcggcagccgcatcttgtatagcagcatctgcagaaaccaccttgcctccagcagcaccattagggtgctgcacttttgcttcctctccttgggaatgagctgggttaccctggtaatgagaaagaagtcatgtgttaggaaaattatcattgcataaatatatatagggtagatgcaaacaaaggtggtgtgtgttactttgaattcagtgtgaacaacaacaccattggtgagcaagcaaggattgtgttggagagcatgacggatgcaggtctgaattcctccaccctggctaatagcaggggattggaggaagccgtggagagtgtccctccagctaatccaatgttgggccttggcgtctttcttagaattggcgccgttggccatgagtggcaaaggctgcaagaaaagaaagcacaacaagtagatgtaatgagagattgtaagaggaggcaagaagcgagagtacgaatcttgtagaaatcgaaaggaaatctggagaaagaagaagaagaagaggcagggagttggttggttggttacctgtgtttctttggagcggcggcgcttgtaggtgacgaggtggtcctccggcggcggcggctgcctcttgcgcggtggtggggggcggttctgggagcccatcagccacctgcggggggcggctacagcatggacagcaagccgagccgccgggaggagacgacggacggagcggagcggagctgcggaggggaagcaaaaccccggaaaaactagggtttgtgcgggcggggtgggcgcgggtggcggtggattcggatctctcgcctcgccgcggcagagaggagcagcagcggaggagcgggatttggaggcggcgagcggagccggagacaaacccaaaatctctctctctctcctcttattataacggaacgggaatggaaactgaaacggggttgggctggacacaagacaacccatcctcatcctgtgggcccttgtgtttgctcgctccaccaaacctccaatactccaatgtttccaccatacacatctacgagtaaaattatgggtctatttgaggagcttaagattcttacaagcagctagttgatagccaacttctgagaatctggaaaagctagcttttggcttctagttcattttctggattctataactacagcttatcagaatctggaccaaaagctgggctatttgggggagcttctgattctgggagaagttgtagcagctagaagctccccaaatagagcctacatagcccttgagattcttctttttcatgttacatgtaaatcttagagttaggctggtatatagcttaagtgagtaaaaggagataatagaggtggtgacagagataacttatagagtcaaagagattatagctagtcgtacatctagattgttcttaatcggtgatgtattgagtaaacaagtattaacatattattgccatgcaggatggcgaaaaaaagataacggaacataggttaatatacaagacaattcgagttggttatgtgttccattacgtgtgcgggtggattcatgcagtatgcgcgggaaaaacctatgacgtattgagaaatataactataattaaaatataaataatatagtgacggaaggttttcgctataatgcaataccacgtgtcgatttctatgctctatttttatatttcactaaactcatgttttaatgggttttgcagcccagcaagacaccccaaatgtttcagtgggaaaagcatcgaagaacactaccactttccatgacaattgtcaatgatgaacaatgtcaactttatagtttcttacccgggctggaccaaaatcaacgctccatacgcccccaaaggcccaaatacaactagtagcgtttcttttactcctccatttatattctaccataacagctgtagacgtagcaatagcacgcaggtaatcaatactgcaacgattcacccagcgacatcatgccaaaataattactgtgccagcttacaatttgcgctggtcacctagctgtatctgtatgcctccaaaattttacaatttgacattaatgtaactttcaactcatgtcagtttaacacctcatgatgttatcatcaggaggctggatctgcgactgtagctcatttgctaaattttgacattttagtttactgcaggcatgaagatgccagttcagtaacaagggaaatacagatggagttggctgcatttccttcagggtaccaatatataccatattaacactgctgccatgctgcttccattaacagcagcagcagcggtacatcaactcagatcaacgtacggtgatggccaaccttcaggttcagggtgaaaaatgtgggattcagatcttcagtacaagacgtatggcaaggaagcacagtagaacatgatcccgcaaagatctgtcgctgttgcctctgtatcaggtgataccatcataacggttcccaagccatcttttacctaacagaaggggtttcatcttgtcaaatgagttgatcaatggaagtataatcactaaatagataggatgctagactatacaagacaaagcatttggaagcaaaaataaagaaattttgatcaaatattcacaaaactgtttgttacaacttagaaggaagctgccatgtttttacaggggtacaggtcaaatatctgagaatctgtaaatcac

SEQ ID NO: 38768 - DNA, 8404 bp, Oryza sativa
ccagtgatcacttgttttatagtcatttagtactgctgactactgtttcagaacaaatgcaaattaccagttactcgtgtattttttccatgtacagagaaaaggcactgatgtattttgccgtgtactgagggcacagccttcagctgtacagcagtatagaatgatggggcatgtatttctatccatcaccatgaatactgacaccttaaaatttacattcaaagaagaactaaatcgtgcatggaacagaactaagatcactacatttaggcttgacactttaatcctgtcgataagaagtggctgcagtcaaagaaaactggctgaatcctccaatgacctatcaaccagcaagagctcagtctaaagtttagcattggcaacaagagctcactatctaaagtttagcataaagcgtctgattttgctcacaactgaattaccaaaatagataaacctatacaacatgataatacaccagggactggaattcataacaggtatcatgtgcaggtgcagtaacactagtgatacgcataccttggagaagctgggaagctcgtgctgccaggtgccacagcaaagacattggagtaagactttgtgaggtaggcgaagttgggtatcggcggcaatgaaggcacacgctcccctctccttatcatatcctccaggtccagcctttgcaaggtgagaacagctttgttctctctccaaacaaatgcaagccggccatccaggaggacaaagagcgatccgggctttgagccaggatacctgaacccatacccggtggcaatgccctcaccagcaaagcttctattgatctccacagcacgcgactcctcatcggtttgccacggaaaagtctcagtggatggctcaccgacccgcacgataaacatagaggacccattcggatgcacgacatagtgtgtaccctccaacaccttggttgcaatcagctgaagcttcccttcgctgtcctcctcataggagaggagtaggaagaagagagccttgccaggtttgcgctcatcctccggccgccctggcggccacccgaatgtgcctccccacaaaccggcatactcccggccaggcatgggcgcctgcgtcgtcagcttgtagagcacaaaccggttgtcatgcatgcttggccaattccggtagatagacagcctcatccgcgcgccacggaggctcaggccgacgctctctccggctcgcaggaactcgtccaatggcagatgcttggggtgggcgtactcagccctggaattggcggacgccgaccgtgtcaccatctgccgcaggctgttcctgacaaaaccggcgaccaccgagaaggtcctccgcagccgcatcttgtcgccggcggtgtcggccggcagcgccgccgtcttcctggccccgatcagcagcgcctcgatctcggccctgcgcaccatgcccccgccagactggctgtgcaggcgcagcatggcctcccggcgcgcggcgagcagcgggaggtcggcgtcggagcgcgcgaagagcggggcagtggcgacatcgggggggagggtgaggcgggaggcggcgacgagggcgttgaggaggcggcggcggtcggcgaaggcgaggcgggagaagtgggaggtggaggtggaggtgtgggcctcgaggaagagggtgttggcgagggggtggagggaggaggagaggaggccggggaagagggagtcgtgggcggcgccgtggaggaagaggaaggcggggtggccgcggtggtcggcgaggagctcgaagacgggggcccagaggaggcgcggggagagctcctgggggatggagcggacggcgacgagggagaggaagccagggagggcgaggacgaggttgccgagctcggggttctggtgggcccagaggccgaggagcggggcggcggagtggaggaagcggcagacggcgagggaggagtgggcgagggcggtgcgccaggcgaggaggtgggaggcggtggggaggaggcggcggcactgggcgagccacgccttgtcggcggtggagacggcgttgcggaggctgcgggaggcggcggagagggcgaggaggtcgcgcgggcggaggtgggcggagatgagcccgagcacgtcctccggcagcgacaggatcagctccgcgccgtcgacctcaccctcaccggcgagctcgtcggaagtcatgaggatggatgaggatttcctggatccggagggaggtttccttcctctactctctctccctccaaactcaaaacaaagtgaggatttttcacttctttcttctagaaatatcactgaaaatagatattttttatctaaaaatatgatattttctttaaagaggagaatagaggtttctgataatatatagtgccaggtaccaaggtctgatacctagataccagctggtatccgaggtaccagataccagccagaacatccatatgtaccaggtgtgaagagggagcgcatgccatcgtcgtcgtgcccggccaatgaacctcttgctgccatatgtcctctcattcctttccctcctcaacgtgcttcctccctttccttccgttgatatggctagcaagacaaggagaaaagacgtggaagctcagctataaaaaaaaggggatgagtcactctaagtatctcattctaacggtatcccgtcctctagtctctctctataaaatacgatcgtttttggagagagagaggggggattgactgaagaagcaagacttgctcgcttggcacatattaggggcttgttcaaattgtagccaaaataaaccttaccaattttggcattgcaaaattttggtatgttggcaatattgtaaaaatcttggcaggatttcttatatatttattaaagtttggcagcaaactaaatgtaaccacttttttttggcaactttgccaaaatttggtaagattgaaaatgttatctaagtgaacatgctctataagacaaccgatctggatctggtttttactacttcactaatcaattaactaaacaatcagggcctctttgaatcgcaacaatgcaaaattggaggaatagaaaaaatgcaggattctaataggaatgtatgtgtaaaatagaggattgcaaaatacaggaaaatggtcgtttgatttgaccgcgggaaaaacgtagaaatcggatgagagagatagtctcaaagggaaatttcaaaaaggttaaagctcttgctaaatttcctctaaaaactatataagattatccattccataggaatttcaaagaaaagcataggattcaatcctttgcttcaaaggacttcataagagattttctacagttttgaaattctctaaaatttctatgttttttcttcaaattaaaggggccttaggagtgacactttgggtcctaaaactaagtgaacaaatgcttctctcgagaaaaagaaaatataaaccttttgtataatacctgaaaaagaaaataatcactgaaaatagagggttttttaatccaaaaatatgattttttttttctaaagaggagaatagaggtttttatataaaatacgattgttttttttagagattgactgattgactgaagaagcaagacttttgctcgcatcgcacagatcagcagacgaccgatctagatctggttttactatactctactctactagtactcagggcctgtttggcgggactctagctcccatattcatcttacctatagctgtagtccatccaaacagtccagattcgttcgaaacaggagcggagcgcaccgaatcgctccgggaaaatgaactaccggactagagcggcatttttgtcgctcctcaactccaactccaatcacattacaagattgcccacacattttcgatgaaattaccagcaaatgccaccgccctaacccccatccctccctcccccgtaccgcttcaccccatctcccccgacctccatctcgagagagcgaggaggcgaagcagcagacgacgtggggaggaggggggagcagccggcggcaacgatggaccagcgggaaaaatgcggcagcgcacggacttctccttccagtgtatcccctcttctctccttcccatcccggcacacggcgggcggcggcgcatggcggctaaggggagcacgggggcggtggaggcaccggcggctaggggcagcgcatggcagcgaagaaggttgaggatgagcaaggcgtcgggtgcaagacggctaaccacggccgacactgaggtaatttgttccccaaaccctaaagtttctcccagattttaacttcaaatctagttcgttcatgtggggatggctgtctactttgtttgattggttgctattatgcaatgaaaaagggggaaaatttcagatctggccgtgagaatttagggatgtgaaatttcatatttcagaactagtgaccatgagcattttgtttgactgaacatgttcaatgtccacctccctgacatctagttgtctaaactctaaagttctatattcccaagcaagttgcaatggatgcagccattcttatgataatatatggatgcatacagttgtctgaacaagtgcagtttgtgaggtcaaaatctctatttgagatgtcattgagcaatttgcaggtgcagttgaactaaatcatatattaaccctatataacaagtgcagctaaatgtaatagcgaaagaataccataaactttgcattgatatagtgatagttcatctactggatgtaccaaccagagttcatgtattgataggatagctcaataggactacaagatgccatggactttgcgctgatagtgcatctactgaatgtaccatattgttgtagaatgaaatagcaggaaattgacttagttatgcttacaatttcttgatccttttaggaagaaaaatgctgagctcattttgccattctattgttttgcaggtggtgagggctgaatttatgcagcgtagaacaggaaaggaagttttatgcttcctaatagttgtgtaaacatttgatgattatgaagtaggaatctgaagaacctgaccagatccagcaatggatgcataactatgaactgtagaagtggtacttttaatgtctctttgctagatgagtgactatgtaaatatgtttggatgactatgatgctatatgtatgtcatggatataggaatggaaaagtatccggtgcaatactactattcggtgggagaatgcaatcatcaatgtggaccgtcggatgaaaagtgtacaacacagatcgaagcactccccacattgttggttgtttatgcaaaaatgtccctatgttatatgccaaaatgctttcagtccctctattatagcagaagccaagcctgaacattttagctttccccattgagggttagggtttccgtacacggtagattcggctcatcgcactgagcggcgggggcggtctcaggtccggcgtgcacctcgtcgccgtcgtctttccagccggtatgcggcggggtgaggggccgcaagcctgttgccggctaggtctgggacagatataggcaaggtaggtggatcgatccggtggggggagagcttggggatggagattcgtccatccgcgacgatctgccagaagccaatggtgggccggctaaatacagtacaaagttgaaaatgatccgccaaaacagtgcactttcacatcgatgtgtaaggactttattcaatttggttcacaagttggacaagtttggacgttacacaccaaaccataggttaaaggtgatcggatctgagccgcaatttgattccaagttgaaacaacacgtgcttaaactattaccgccattattacagctataagtaacaaaaaaaaggaagaagagagagattaggagccactgactttgactggctgtcgtcgtcggagtcaacggggatattcttcctttttaccggtcagggcggccgggcccactgcaaagtgacgtatcgacagctctgcttatgccagccactctactgttctgtgcacaaaaaaagtgagaccacgtcaaatatactagcatccattctcttcaaattactagtactagagaatctgctgatgatgctggatgctcctctttcttccgacaaattacattactcatcatattgtactttgactattactaaattgctaacacagctcacatatatccagactaaatgaaaaggtaagttaattaaaaatgatttgaaaaaaggacaactatcaacagtctagctgctccataccaaatggagaattacagatctccaaatgtgaagattaaaacaaggaggtttgagtataaattgcttaatgcatactccttccgtaaaaaaaaagacaacctaggatgattgtccagattcgctatactatactgtatcacattccattctatgttgtatttttttttaaaaaaggagggagtagtgtcgatgaagattctttcacatacgtcgtaggacatgtgcttttaatatctaggcccactagggtggacctcacgtgtttgtgacccacattatgttgaatttacgttagaggatctatttccatacaatgtaatgtgatagattttctttgagcttatataggtttaaaatcaacactctaattaaaacaaatgagagtaaaatataatacttagaaaagttctaccatgtataatatttttgggcaatctcagcttgccatcagggcgctgcttaattagcttcccctccattttttgaaataattaagttttcttttactaatctatttttggcataagttttctaaaagggtcaataattagtcaagttttcggaggggcggatggtttttggaaaatatttatttttgtacgtttttcttatcttgtgctgcacacagccaatgagagtaggggcagcggggatggacgaccacacctttagagagtagtactaatgtcatgccctgtgtaaaatacggattgttgatttcatagattttagtttttttctatcttttttttctggtgatcaattttatatgggtacaatgcgttttaatttggtggtcttttaggcagtgtggtttcttaagcaaggataatagtgggttatactataaacttacgtggaaaagagagacaaagaaaagtgagggtgttggctcctatacaagagctagttttacacatgctccaagatatttacaataaatttatagcgagagaaagagaaaggagagaaaaaatagggctaaccttataattaacctcttgtacaagttaactctaacttgagcttatagctaatagttagatctactattaaacttgtttttatgtggggaggaggataaatccgtttttacatggggatactataaaaatttgcaccggtaaataaatgattgtttccggctataatatactgtgtggttcgctcttcataagcattagtgctaggcaacgacatacatgattttatataaatcagtacactctagatatgtatatgaggaggactatactgaacgaatatatcaatatagggtctagatatatatttttttgaagggatatagggtctacatatatatgaaattaaaacctaaaactctcctctttcgtataaaggaaaacgaaaattaaaaagcaggacgccaaccgttaagcaagccggatcgatgggacttaaatccagcccatgtttgtcaacagtgtttgatcgacccacccaaggcctcgttaatttgataatcgcggaataatgggctggaatttaattaggcccaccaggaaaacccacttcaaaatagtatcgctaccagtgacttcattcattttcttctcttactgtagcagcaaaatcccttggtagcgtattcacgataatgaagtgtggtggtaaaaggatgatggaatggccaacgttttctataatataaccaaatatatggagttccctttcaactgcatgagtatgttgggtaagtagaactattttcaaaaaccattttcgacgccatcaacccatcaccattttatttttaagaaaaaatacgaattaccccccccctcgaactatcgcggtcgtccgaattaccccctgaacccgaaaaccggacattcttcacccccaactatacaaaccggacgaattaccctgcctcgacccaatccgcggtggttttggtctagtggcatacacgtggcagtccagtcagcattctatttatttataaaaatgtgggacccacctgtcatactcctcccactcttcctctctctcacgggcggcaggcgggggacagagcagcgccacccctccgctctccctcgccgccgcctcgcctgctccgc

SEQ ID NO: 38769 - DNA, 3626 bp, Oryza sativa
atgtggtcctaaggtcacaaaccacctgtgtaaattaatattatagggatttttgcaagtgtttcattaaaagaaaacgcctatgaaaacatgttcatttttacaagcgggaccgcatgcaaaattcatttagatgtataaaataaatcaattgagtcagtcaagggtggcctctttctccctcgttctctctttctccatcacctcaccctctcccttagagctatctctttgtccatcaactcactctctccctcacctcagatcctccctccctcacctcaaatccacggcaggtgcttggcagcagctgtgaatgggaggggctgtagtgctcggagcaagtgttccaataaatttgagtatttgaaatattggttccacctttcatatagtatatgtttatcctttacatgttacaacactcacacaaatatgttgacaaaaggtaatcgccatcaatattaagttattaactagaaaggaaatattaatataccttttttattgtgtagaaatgtgtacctatcattttgctatagggaatattcaccttaatttgatattatatgtggctatccatttagagattcgatagatttttaatactgagaagttcaaggggttatttgtaaaattaggagtaggtggagtggcatagatacattatacatacaagttacaacaaagccctcctcagaaggaaaagacaaaaatagttacaacgtacaagcccactacttacataagttgttgacggaggtgattactatacaatatcaagctatcaaattgtaagataatatataccaacagcttaaagttgagataagttgactaattatctcaagggagatgtgggacaaggaggagcttctccttgaggtgaatagttatcccgaaagtctctgtcatatcgatgcctccatttgctgcttgatctattggtagcttccaattgaagcgatacacaaggcttgctagcatgacctcgatggcggcgatcgcgaagttcatacctgggcatatcctccgaccagttccgaatggcaagaaattgaaattatttccattgtacccagccattgtgttgctaaggaacctctctggcatgaactcctcggcattttcccaatagctagggtccctggcaatagcccatgcattgacgatgacacgagtgcctgagggtatagtatagccctcaacattacagtcaaccatggagacatgaggcacaagaagtggcgctgcggggtgtagtcggagtgtctccttgatcaccgcctttaggtagggcatcctacctagctgctcctcagtaacgatttcctgcccttttggtaccacacccctcacctcagcctgtagcttggccatcagctggggcttctgtattagctcggccatggcatactctagctctatgtatgatgtatctgttccagcctcgaacatgacaaccaagtttgctttgatgttatccttagtgaggccatactcttgttgaatagagagtagaacatcgatgaagtcactctcctcatcattgttgtcgagcatggaggatcttcgcttgctagcgtggtcatcgatgagttggtcaagcaactgatcccatctcctcttgacgtgataggccttggcacagagcaacctcctgacaacaggtagcctggccaagctagggaagtaatcctcaaggttgaagccaccaaggagcgacgagttgatctcgatcagctccttgaatagctggttccgaccttcttcgcgaaaaaacttgccagacacagcatggcacaccatgttgttggagtagcagctgagcagctcagtcaagtctattgccatatgtgtcgccgcctcctcgacgatcttggccattaccagccgcacctcctgttgccgtgtctggccataggagtggaccttcttgatggtcaggagattcatggtgacgatcttctttatttgccgcaatagtcaccatatggtgagaatgccacatctgttgcgccatacaagaggatgtcggctatagtattgtagggccgtgacgcaaacacacggtcatgagtgcgtaggatggcctgtgctgtacgagccgacgaaaccactagggttggcaccgcgccgaggtggaggagcatcagatcaggaccatgcttagttgcaaggtcgcggagtgatttgtgcgggagagagctgatgaggtgcatgtggccaatcaccggaagccttcccggcggcgaggggaccctgctgagcatcccgccggaccttgttgcgtaggcatagcaacggaagatgatgagcaggaggataagagggcacatcatggcgagcaggagatcagagcacgacatcgtcggcatggtgctggcctcctgtggagcatgcagcgatgcttgctcatcatgccttaggccgtctagcatttgtgccattgctacgttctacgtattagtggcctagcttccaaggcagagcaagctcgctagagctagctaccttcaaatttgatgaatggaatgagttgaggaaggcattccttaattgcttcttttataatgagttgagcaagctcgccatgcatgcatcattactgtgtttatcttttataatgccatgcattatttactcctatgtttagagggagaaggcaggcatcgacacatcatcctccattaaattttagttctgtttaatttggaagatatgatgtatctatcgttcttattctcgtactggtgacactgacatggcatatatattgatattggcattgcgcgatcgaccaatcaattaccattcaacggatggtgctaaactaataattcttgcatgcagttgattaccacatgcactatatatacgtacgtccggtaaaatgattttatgctcaaggctctagcattagtgcttaataatgcagaatttaatattatacttctgcattcgtatgcttatataatagtgcaatgaaatgaaagaatttggcgagactccgcttctgacaagtgacacgcactcaagtacgtacgttgccaaatgtgatgcgccggttaattgttgcgattcgccaacaattaatatattaatctatcggctcatgaacaattaagcattaattatggaattgctatatgtcatttgaatgaaatttggggatgaaatcttaaagattttgaaccattggatccatgccaagattcgtgcatcggcatctctcctctaacttcagcgggctcccctttttcttcggcgctggcgacacccccaactccgacagtgagcatacgcgttagggtttggggttggggttagggtaggggggggtttcctcggcgcttagagggatggccgtggccggcggaggaccggcagtgggcggtggaatccagcgggtggcgaggcggcggcggcaccgccgaagctgtggggatgtaggagggtggtgggccggcgtcggcggcgggggcaaagcaagcatgagattaggaggcggcggccggtggtggcggatccagcgacggggagctgccggagacggggaagacggcggagcgggggaatctcgctgtcaccttcttgagaagaaagagagggggggtgggggaggg

SEQ ID NO: 38770 - DNA, 3203 bp, Oryza sativa
ccccgccgcgccgccggccgcctcgccggcgtcgttgactccttccggccagccggcgaggcgggcggcggcgtggtggggcggtggcggcagtggatcgggcggtagcgatggtggcggtggatcggacggaatgctcgagcagagggggggggacggaagaagaagatagggttaagtgtttgcacgaatcttaaagcatatccaatggtccaaaattcgaataataggaggtgtgattttctgtcacatgatatatatatacagcccccttaaatttatattgcttcctgaatcagatagatatacttacaactgcatcgccgtctacaactgtgggcgtcaaggatgccgccgccggcttccctgtcgtcgacttctcccgcgcctccgccctccccgccgcctgccaagagcctagagagaagagtgagagagagagtgataagaggaagggagagaagaggggaaagaaagaggaggctgacatgtggggcccatgtaggtcttacgctgactcagcagtcacgtaggataaaaccgggatcaaaaccgtcgagggacctattgtgactagttttgcataattaagggaccccgcatatctggttttgtggttggaggacgattttgtatcccgatgaaaagttgagggacctttggtgtactttttccatttgataatcgcggaatatgggcaggaatttaattaggtccactaggaaaactcacttcaaggtagtatcgctaccacctactagtgacttcattcattttcttcacgataatgaagtgtggtggtaataggatgatggaatggccaacgttttctagaatctaaccaaatatatggagttccttttcaacagcatgagtatgttgggtaagtagaactattttaaaaaatcattttcgacaccatcaacccatcaccactttattttataggcagtaaaaaaatcctacctatataaaaatgcagcatgtggtcctaaggttacagaccacttgtgaaaattaatatttcgatattttcacacgtgtttcattaagagaaaatggctatgaaaacatgtctatttttacaagcgttcctcctaataggaccgcctgcgaaaatcatataaaataaatcaatcgaatcagtcaagggtgaccggtttctccctcgttctctctttctccttcacctctccctctcccttagagctatctctttacccatcaactctcccttccctctccctcacctcagattctcctcccctcacctcaaatccacggcggtgcttggcagcagcggtgaaggggaggggctgtagcgctcagtgcaagtattccaataaatttgagtatttgaaatattggttccacctttcatatatatagtatatgtttatgctttacatgttacaacactcacacaagtatgtacgttgacaaaaggtaagcaccatacaatattaagttattagctagaaaggcaatattaatctacccttttttattgtttagaaatgtgtacctatcattttgctatagggaatatttcaccttaatttgacattatatgtggctatccatttagatctgattgatttttaatattgagaagttcaagaggttatttgcaaaattatgagtaggtggagtggtatagatacattatacatacaagttacaacaaagccctccttagaaggaaaagataaaaatagttacatcgtacaagcccactacttacacaagttgttgacagaggcggttacgatacaatatcaagatatcaaattgtaagataatatatatactagacttaagatcgagataagttgactaattatcttgagggagatgtgggacaaggaagagcttttccttgaggtgaatagttgccccgaaagtctctgtcatatcgatccttgaggtgaatagcttccaatcgaagcgatacacaaggcttgctagcatgatctcgatggtggtgatcgcgaagtttatacctgggcatatccttcgaccagtcctgaatggcaagaaattgaaattatttccattgtagtcagccattgtgttgctaaggaacctctctggcatgaactcctcggcattttcccaatagctagggtccctggcaatagcccatgcattgacgatgacacgagtgcctgagggtatagtatagccctcgacattacagtcaaccacggagacatggggcgcaagaagtggcgctgcagggtgtagtcggagtgtctccttgatcaccgcctttaggtagggcatcctacctagatgctcctcggtaacgatgtcctgcccttttgataccacacccctcacctcagcctgtagcttggctatcatctggggcttctacattagctctgccatggaatactctagctctatgaatgatgtatctgttccagcctcgaacatgatagccaagtttgctttgatgttatccttagtgaggccatactcttgttgaatagagagtagaacatcgatgaaatcactctccacatcattattgtcaagcaaggaggatctatgcttgctagagtggtcatcaatgagtttgtcaagcaactggtcccatctcttcttgacatcataggccttggcatagagcagtctcctgacaggtagccttgccaagctagggaagtaatcctcaatgttgaagccaccaaggagcgacgagttgatctagatcagctccttgaatagttggttccggccttcttcgcaaaaaaacatgccagacacagcatggcacaccatgttgttggagtagcagctgagcagctcagtcaagtctattgccatatgtgtcgccgcctcctcgacgatcttggccattaccagacgcacctcctgttgccgtgtctggctataggagcggatcttcttgatggtcaagagattcgttgtgacaatcttctttatttgccgccaatagtcaccatacggtgagaatgcgacatctgttgcaccctaaaaaaggatgtcggttatagcagattgctaccgtgacgcgaacacacgatcgtgcgtgcgcaagatgacctgcgccatacgagaggatgataccactagggtcggcaccgtgccaaggtggaggagcatcaggtcagtcgcaaggtcgcggagtgacatgtgtgggaaaaaaccgatgaggtgcatgtgcccgataa

SEQ ID NO: 38771 - DNA, 16642 bp, Oryza sativa
ttgtttggaagatacgacgacactaacatagcatattgatatttgacattgcgcgatccaccaatcaattaccattaaacggatggtgctaataaactaataattcttgcatgcagttgattaccccacatgctctgttaaagaaataatgaccgacgtcctcctctgttaaagtatggttttgtttggaagatacaatgtactatatatatatatattttgttatgggtgtactgaaacttattctgttttaaaaataaaaggaacatgaaacttgctttgcattgaaatactgacattgacatgccatctgctcttttatctcttggcccgttcgtagcaccgatggctggatttttcaatttttgttccttgcgaaaaatttattttagaaaaatagaaacctgaaaagcttatactaaataaacttttttcacggcgccaacttctatgatatataggaggttgatgtagtatgttgatgtcgtaactgttattttgtgtctagctgcttagcccgatctatggtgctcttgatggattattctgattttgtggtaattaatcgagggtacaaataaataaattaataagtattataaagtttaaaattttatttaaaaaagtctaattcgaagcttcatcaaggagtgtgctcatggcaatcgataatccataattaatctggttcgaactgggccaggacagttccacttaatgatatactccctccgtctcactgtaagtgcagccataagttttcgtacccaacgtttgaccgtccatcttatttaaagaatttatgaaaataaattaaaagttaagtcacgcataaagtattatttatattttatcatctaataaatagtaatcataaaaatatttcaaataagacggatggtcaaaattgaacgctgaaactcacaattgtacttattatgggacggagggagtactatgtacgataaagatggtgtaatgtaacaacctattaaatgaaaaaaaaacggattttgcataagtcctatatatatgtatatatgtagcttcctaatttatcatgaaagattagtgctaattaaattagcgtacgtattaaattggtactatgtgcattatatatattaaatttgttagggacaccatagtgtccgggctcatccaccatccaagtgctttaagatccgtgcaacgcactagaggatactatctatatagatgtgaaccgctgactcgtcgaatctgcatgcctccagtccaggaccacacgctccacatataggggaatttccattttttttctcttattatagataaatagataccagtgaacaagcacaccacttacacgatgaaaaatgagatcaccacaactacttagataagatatatagattgactatttaatcttgtgtgagccgaggaacaaggaggagcttctccttcggtgcacggtcagtccaaacgcctcggtcatatcgatgcctccctttgccgcctgatctgccggtatctcccaatcaaaacggtaaacaaggtttgctagcatgatctcgatggtggcaatagcaaaatttatgcccgggcatatcctccgcccactaccgaatggcaagaaatgaaaattgttcccattgtagtcaggtgctatgctattgagaaacctctctggtatgaactcttcagcattttcccaaaagctagggtctctggacagagcccatgcattgacgaagacacgtgtgccagagggtattgtgtagccctcgatatcacattcagcaatagagaggtagggtacgagaagtggccctgcgaggtgtagccgaagcatctcctttatcactgcctttagtagggcattcttcccagttgctcttcagtaactatctcctgccctcttggtaccacactcctaacctcggcctgtagcttggccattagttggggcttccgaatcaactcggccatggcgtattcaagctctatgtacgccgtgtccgtgccgccctcgaacatgatcaccaagattgccttgacgttgtctctagtgagaccgtattcatgctgaatggagagaaggacatcgatgaaatcactctcttcattgtctaggtctagcaccgaggaggaccgtttggtggcatgatcatcgatgagcttgtcgagcagttggtcccatctcttgttgacattatgggccttggcgcaaagcaacctcctaacagtagttaccctcgccaaattggggaagtaatcctcaagattgaaaccaccgagtagcaatgagttggcctgaattagttcccaaaacatttggttttgaccctcttcacggaagaacttaccagacacggcgtgacacactatgtcattggtaaaccaattgagcaactcactcagatcgacagtagtgcgtgccaccgctgcctcgttgatcctggccattaccaggcgcacctcctgttgtcttgccctgctgtaggagcgaaccttcttgttggtgaggaggtgtgtggtggcaatcttcttgacttgccgccaatactcgccatagggagagaatgctacatctgacgagccatagaagaggatgtcggtgacggcagagtaggtccgtgacgcgaacacgtggtcattcgtccgcaagatggcctgcgccgcacgagcggatgacaccacgagagtcgggacggtgccgaggcggagaagcattaggtcagggccgtgcttgatggcaagttcacggaaggagacatacgggagggagccaatgaggtgaaggtggccaatcacagggagccttcctggcggcgaggggagcttgtcaaacagctcgtcgtccctggttttcgcccggcaaagtttgatgagtaggaggagaagagggcacaggagcgccagcaggagagtgtagtaggatgccattgttggctgtggagctaccggcgatggatgctcatgctcatggttgtggtgctggtgcaagagtagtagtggaattggcactagcatcacagccatggctgcctaatctctctagtgtcttctccaagaggttggtgtgtgagacctgtcacttgatgagttgtgttcaatatattatcttggcacagatatgatcctcctgatatatatatgctcattaatttgtctagaatattgtcgagtcgacgtcgcagccggctgctagctaacgatctagtagagcattctagctagctagtagcttgcttgtcgtgccctgcagtgcaataggcttgctttgttgcgaaacttaacaatacgtgtcgtaccatactttttttttaaaaaaaaagcccgtgccgtaccatatacttgttctgaatcaatggaactcttaactcttttgaattgtcaaaaaaaaaacttgcttttacaccatagtccaggttaaataattttaaaacagatttctatacccttattatacatatattctttttgtcagctttcccgttaaattcattgtcactagtacacaaaaaaattttcctacacaaggagctcccattttcctatacggacctctttcatgttcgtctataaaaaattagccttctattttcacgcggatccttaagagacccgtacggaaaaatcgatttttacgtgcggacctctccagtggaccgcacgcgaaaatatctcttcctttttttccctctccttcacttcaaatttttcaccttctcttttcctttccccttttgttctccctcgatcactcctctctctctgcctttcctctcctcccctcccctcccctccccaccactcctctctctctcctctcttccactccccaccaagtgcacggggcgctggaggcgctctgctcactgctgccgccgaggcggcggccaggagcgggcgggaggcggctcagaatatgttcgggttccgcgtcaccgtctttgggattgttgggccgtgtattatgatgtagtataatagggacgtgtccaagggtccaagatataccctataacctatatattctgtagtcgtcattgagttaaggttgaattttgcttagattatttctgccatcgcagtatcgctgctagttcggtttgtgtaaccccaactttgagttcttagttaatcattcatctacaagagtgcaattgagttgttgtctctcttattcttggttgtgctctacgattcactcgtagcgattagccttctcggcgaggtaaatcgggtttcggcatggttgataaccaaaagagacatggtactgcgattgcaggatttggatcgtgttgatcagaaaccggatcatgagtcaagtttctgccaaatcgatagttatcttcacctgacagaagatcgagcatcccgtgggccgtggccatcaattccttgaatatctatatagatgaaaactactcacctgcatagaatgagaattgtcaaatgcatattatataatactgtctcttaagtgtcactagccatttcgtgactgcgatacgcgttagtttagtttgctgataaaatttaagtttgccacatggaaaaaatacatttgcccacgttggtcccttgttccacctcttgtcatgtcactttctctctgtctgtccttgtcacctcctccattttcctccgcaatcatcctgcgatttgattcgattcattttgcacggcggatcgaggaaaaccagtgcaaacaaaaaggagtatgtataaggtcattgtacactactgctacgtgactgaaattggctaccaacctcatcaaattcttcttgtattaagcatatattttttaagatattgtaaaagaagaattggaaatgggaaaggaactctgttttggcactacaagaaatatgacattctgtgacgaatttctcgtgacatcggagctattcgtcattagcacattccattttatgacgattagtatgagatgggtggcttagtgacgaaaaaaatatgttcgtcattaataccaactacaaatcgtcataaagtatttcaatgagagattgtgacgaatattaatttgtcatgaggggaaaaagcaaacgtcatagatttatatatgtatttctagaagcaatttaatcaagtgaattaataaggaaacaattttttcctttaaaaatcatggccggaaatattatttaatattatacatggtctaaattattctttgaaattttctgtgaattgtcgaagctcaataaataattttaataccataatattcatttaacctattaaaataaatagaaaactaattaaaatccttatctctgtaattgggcctttttcggcccaagtgttactctctccctccctcagctctcagcctctctctccctccttgggctggcttcccctttccctcctccctcttcgggccgccggcccagctctttcgctcctccctcgacgcaaagtctattaggcctccctcctctcaatttaaataattttttgggtagtaaataattttaaatgaaaaaattgtcaacaagaaagttatataacttatcaagatctacaacttttgttttggtcattttgctatatgactttgtttcaataatttgaatttgaatttaaaattatgaaaacttcaaacaatatttttaaatactaaatgatttcaactgaaaaagtcatccacaacaaagttgtataactcatctacaacttttgttttggtctttttgctatatgactttgaaatttgaatttgaatttcaaattataacaacttcaaacaacattttcaaatactaagtgatttcaactgaaaaagtcataaacaacaaagttgtatagctcatcaatatctataacttttactttggttatttcttcatccgataaagtaatagtaacgttgtttacaaaatttatttctctcttacagtctataaaaccatataagagatggattttaatactttgtatgtttctatttttttttccttggcaacattgagcatgaacagaaaactcaattacctgattttggattaaactaaatgagtgaattaatagtaaaaagaaagaaaaatttagaagtgtatatgtgattaacatcaagatggcatggatattgtgtctggtgagattgtactcttgttgatgatcgagcagaatatcaacaaaatctgactcttgctccagaatatcagcgttatgtacactactgttttgtgactgaaattggctaccaacctcatcaaattcttatgaatttgttgctgttacttattaatttctattcttttcacaccttagagccactttctttcggctgtcaccatcaggttgcaacgatatagaggtgaagagagattacagtatataaggtaccaaaaataatctttttttatataatgaccgaaaagaatcttccatgcgcatttaaacagagtatgtacctgtacttaattcaacataaatttcttaacaaacgtacatattgacatctgctatattatagcatatattcaacatctttatttaaaacatattgactttcttcttgttatttacttctatttgtccccctcaagagacgaatggactctctattttatttggtactattatatatatcttatagcagataactacgctattgcttggtatctatggctaccatacagaactcatggctattgaaatgttggccatatgttgtgttatgtgatcttgataacgtgtgatctcgggatgaggtagagtttctcttttcgcgccattgtaagtgcgaactgatctgtcatatcgacatcatctttgtccattccaaccgggagctcccagtcaaagcaatacataaggtttgatagcatgagctcaacagaggccatcccaaaattcatcccaggacaaatccttcgtccagctccaaatgggagaaactgaaagtcggttcccttgaaatcaacattatctatagtgtctccactatccataaacctctctggcatgaactcttctgaattctcccaacatttagcatctctgccaagagcccaaacattgatgatgacacgtgtgttggctgggattgtataaccattggcattgcactgagccatggagaggcgcgggaggaggagcggaactggtggatgcaaccgaagtgtctcctttacgacggcttttaggtagggcatattgttcaagtcatcttcacttaccatttgggtagttgtgttcttcctaacttcatcttgtagtttggtcatgagatgtggttttcttatgagctcggacatagcaaattcaagggctatatatgaagtgtccgtccccgctgcaaacatgtcctatacagaaattaaagattagctagattcgtcaactcaaaatatatatattatattaacgttgtttggaagaaacacatgtacaaaactcaattacctaattttcgattaatctagatgatagaattaatagtaaaaaagaaagaaaaattcagaagaacatatgtataagtgattaattaccatcaatatggcatggatattgtgcctggttagattgtactcctgttgacgatcgagcagaatatcaacgaaatctgactcttgctcctcctgatcatcatcacggtcatcatccatctgtacttgatcgtcacgacgcagcgacgatttcttttcatgctcgcttacgatgtcaccaagaacactgtcccacttctctttgagcttcttggtgtcggcgctcaccactcgcctcagcagatccaccttcgccaagctcgggaagtagtcttccaggttgaagccagcgtactgatcagcgttgccggcggcgagctccatgaacagcttgttccggccttctcgccggaacgacgacttcccgcacacggcgcggcacaggacgtcgttggtgaaggagccgagcagctccctcatgtcgacggcggcgcccgcggccgccgcctcgtggagcttggcgacggcgatgcccacctcctcctcgcggccacggcggagcgactggaccttcttggggctgagcaagtgggcggcgacgagcttcctcgccttgcgccagtagtcgccgtagggggagaaggagatgttggaggagccataggcgaggatgtcggcgatggcggagcgcggccgcgacgcgaacacgtggtcgtgagcccggaggacggcctcggcggcgcgcggggacgagacgacgaggttgcgcacctggccgagctggaggagcatgaagccgtcggcggcgtgcttctcggcgaggtcgcggagggagacgtgagggttggagccgacgaggtgcatgtggcctatcaccggcagcctcggaggcgacggtggcaggacatcatcgttgctcttgctcgccgccgatgatcttctggttgatgcagacaggtagtagtgaagaagcaccagcagcagcaagatgatgatcatgatgaggacgaagggcagtggctcctctgccattggagccatgaatttgtcatggaagaagagcatcaattgaacaaccatggctgctagtactagctagtgagctaattatacttgctaactaactagggttcttcttgtagtgaaatcgatcgaaagtttgtggaagctagatgcatgacgaatggttggatgccttcgatttctcctcttccttgggaggcggtagctagctagagtactgtgccacgcgtcgcgtctcttcggacgcttcgcttgtttgcgttagaagccactatagctgactggtgtgtgagctccatggccgttgctttgtgtaaccagccaaaaaacacgggaagatttctggcccattcatttattattgacgttatcgacgactcatctcgtcctgatcccaatctctatcgatattgctctgcgtgtgttccctttctgctgtaaaagttgtaatcccaccggtttcatagttcttgatatttcaaacacgtgaaaaagctgttcttagagtagacataaaggaattagggtgtgtttggttgtcggtcacactttgccacaactaacattagccaagttgtggcagctataaaagtgttgctagccacaaagtgtggcaaaattggcacgaaaattaagtctataacatgtgggagatgctattgaaaaaatatggcaagccatgattgtggcagtgaaccaaacacatgcctaacaaactgtgacagccacagaattagtgtagcaaagtgtaaccatgaaccaaacgcccacgttctcacttggcaaatgtgcactcactaagatgtctactctaaaaaattaaacaaatatgtaaaatgctatatgttaagtccatgtattactcgttatccctgagtgagtgctatattggacctaattaacttgtcttttttttttttggaaaactaattgagattctcctagctaagttcgtttatcatattttgatttcgacttaaagaaaagttatgtcctggtgacgacaggtgtctctttcggccgagctcttttgttggagttaccaatatatatatgaaggctcgggcccgatggcccggcccatgcatgacgcgaggttttggctcggcccagatacggcatgacccgactgatgtcgagcccatgccggtccgacccatatgtttggtcgtgtctggacctctatcttggcacggtgggctggcctgacccagtacagttcaataattagggaggcaaaataaatgagggacgaaaaatagacttactttagtcatataagacatggccaaaagagacgagggatgcgaaatggatttattctagccatataagacaaggtcgaaagagatgagggagcaaatagacttattgcaacaacgagcacgatagactttgttccttctagccgacccagcacggccgagtcttattgggtcgtgtttgggtcgttagtgcagcccatagacaggcctggcctgacccagcatgaaattaatatagtatttaataaaactaatttagtattgtaaacgtagctaattttttctataataaaaataaagtcaaaagacttgagaatacggattgttcccatatgaatataatgtggtataggaggagtatattatactgtaattcttcagaaagtaatgctgatcagacttcttgcgtaaaacgattcttttactccaacctcgtgggacagagaccaatcaaatgactctgttttaatctggagatctgttcaagtcaatatacattattttttgaccttcaaaagggataacatatccaagtaggcaggtcgtcatcgtcatgtatatttaggtggcatggtagcctaagggcctcatctttttttttcttaagcttatcagccaaaatttaaattttcaattttaaatttggaattgattttgaggttttttcatcaaagtttatttttcagcatttgcttttaaatcgctaaggacatgtacataaaagttttattcacaaattacttttcgtttacaaatatatttttttcttattccgcaatgggtccgtaattctccaaaattgttatatatagacgcaattgatccttttatcaagttttgtaacttatctcaatatatatatattaattaccacgttttaattaaaaaaattcctagcattgaggcctgaaatgaaactagctagcatgcacagggccttgccaacttacagattgtacttactcgaaaattaattagacatgtgtgcgcttaacaggggtggattcaccgttggggcttgttggggctcaagccccagctccattttccgcccccaagtattctcccggtaagctcaaagctagcagaggacaccaaggcaattagagaaggtatattttgggcccgcagctttagagaagaaggcaactcgcgtataggtctgtggtgtgattagtgctccatctgctaaatggtttattaattgctaaatggtataccaagcctaaccggtgaagacaattaggcagatattatgacccattggagggtctaatacaactggacaaacatgattttacagaatgaaacatggattttaagatcatatttttcaggaaatatgattttcagtgctgagtattagcaccacctctattttcatcctggattcgtcactggcgcttaatatgtataatcatgacttaatttgtctcttgatcatttcgtattgactcaaagaacgacagaagagttcgacatatttttaatagcgataatctctgttagaaaatataatatatgcaggtatatatacgataatattaggcggctaagaaaataaaaaatatataatcatatattaagatttgaagacattggccaccgaaacaaaagagaaaaagaccaagtacacaagtgttcatacgcatgagagagacatgcacttgattaatttccaagtttttagcatgaatgcactcacactcacgtgacacgtcacataagaacgccattgatcgatcgtactcccaccgttccaaatgatcggcaaatatttttattaggatagtatattcctaattgatatgattgtactctctatgtatgttcattatccgtgcattaaaataaatgaacatggtacatgtatccatacacacaactatttaatttatttacaactaacatgcaacatccggatatatatagttgtcgacgtttgatgtcgcaattctggtatttgcatagtatggggatcgtcggtgctaggatatacgcgagactgaggtaaaagagatggagacgagaatttttatacaggttcgtgcccctgagttgtcaggtaataaccctacatcctgttggccggagccggagttgcttttattcaccataatcacaccagtacaatatgtgggtagcctatctaactgttgtcgacatgtcggtctgaaggtctgactcgtagtcgacaacagggtagccttccttctcgaatccgtgtccggcgagatcagagatagcgctttcgtctctcctgacggtatccggagacaccatagggaaatagccatgcctatccctgaagtcgatatccggcggcgtgtcttggcgtatgttggcttgtattggcttctgttgttccgtatattgcggtggttgttgattgtgatgggtctcgatcatggtgaccgtgttgatcatgttgatcatgtcgatcgtctgtcgattgtcttgtcccctctcctcctagggggttttgtatttatacccataggtatctccttgtccaagtagaactagggaaactaatatggatacaatccgagtagtcctggtcgtttccatgtaaaactctggttgtctttctttatccggaactccctccatatccgcaggttgtttccgtataggacatggtatgtggtgggccctgccgagatttagtcaactactattaggtatgtggtatccataacctgacaatagtactccagtataaaatagttattaactcttttttctgtaaaaccatcatgttgtatgttgatcaattgggaacggagagcgagtatactattgataagtgatcaatactctcggagccatcgtttcacttatttgcggaataagcgaaatgacatatttataaatgaaaagaaacttttatatacgtgtttttagcgatctaaaagcaaaagcaaatattaaaaaataaacttcgataaaaaatctcaaaatcaacttcaattttaaagttaaaaatttaaattttacctgataagtataaacataagaaaagataaggcagtccaaagtaatacaaggaaaagacagacaacacaaacacgcaagtacgtactaatgaatgatatagatgaattaggcatccaaggctcgatcggctataaaatcacagcgcagattaacactctggctcacctcaatcgatgaagcaattagcaatggagctcaacaacaccgagccattaacagctagtagggcacaagcagcagccgtgttcttgctccttcccgtcgcgctcctgctgctgcttctccgctttgcgcgagcaacgacaatggcaggagatcgcaacagcgagcttcttctgagcaagctcccttcgccgccgctgaggctgccggtgatcggccacatgcacctcgtcggctccctcccacatgtctccctccgagacctcgccgccaaacatggccgcgacggcctcatgctcgtccacctcggctccgtccccaccctcgtcgtctcctcgccgcgcgccgccgaggccgtcctccgcacccacgacctcgccttcgcgtcgcggccgcgcgccatggtccccgacatcatcacctacggcgccaccgactcgtgctacggcccctacggcgaccatttccgcaaggtcaggaaggcggtcaccgtccacctgctcaactcccacaaggtgcaggcctaccgccccgcccgggaggaggaggtgcggctggtgatcgccaagctccgcggcgcggcggcgatggcgggcgcgccggtggacatgaccgagctcctccactccttcgccaacgacctcatctgccgcgccgtgtccggcaagttcttccgggaggaagggcggaacaagctcttccgggagctcatcgacaccaacgcctcgctcctgggagggttcaacctagaggattacttcccgagcttggcgaggacgaagctgctcagcaaggtcatctgcgtcagggcaatgagggtcaggagaagatgggaccagctgctcgacaagctcatcgatgaccatgccaccaggttggtgcgccgccacgatcatgatcagcaacaagacagtgacttcatcgacatcttgctctaccatcaggaagagtatggcttcaccagggacaacatcaaagctatacttgtggtgagtgctagctgctacatgccaacttaaatttagctactgttgatgtagaatcaagagtttacacttcccatgttgtacagattacgctacattacacaaaccgccatacactattaatttatgttatttatgcgatatgtaggacatgtttgaagcaggcacggacacatcgtacttagttctagaatctgccatggttgagctcatgcgcaagccacacctcctagccaagctaaaggacgaggtgaggagggtcataccgaaaggacaagaagtagtcaatgaagataacattgtcgacatggtctatttaaaggctgttatcaaggagacactacggctgcacccaccagctcctctctacatcccccacctgtctagagaagattgcagtatcagcggctacatgatccctacaggaatacgtgtattcgtcaatgcatgggcactcggtagggatgctaaattctgggacatgccagatgagttcctaccggagagattcatggattcaaacattgattttaagggacatgattttcattacctgccgtttgggtctggacgaagaatgtgtcctggaattcactcagcaacggttaccctcgagattatgctggctaaccttatgtactgtttcaactggaagctaccagcaggtgtgaaggaggaggatattgatatgacagaggtgtttggattgacagtgcatcggaaggagaagctcttcttagtcccgcaagctgcctaagtacatgcctatacaagaatcagtactacgttcgttggggcaagttatattattcatccagcaatcacgtgctaaatcaattagtgttacatgttgtcgttaattgttcgtgtaataataagagctattattggcacatgtcatttcacttgtttgtaaaacaaattgtccatgtggatcaccctccatttgtgctgttacttgtataatgtatactacatatacacccaaacaatataatcatcattaatgtttgtgatattcattggttgtttaatttggtccttctgtaaattcaaactcttcaatatatatatatatatatatatatatatatatattaattcagacagggtggatctaataaatattgggcctagatcttgagctggcccagcctgcattggcctagatcctaattaggaataagtctattttgcattcctcatatgttgcccttgtcaaatcgcatccctcaatcgtaaaaccgggcataatgcctccccgagcttcaaaaaatggtgcaaattgactcctttggtggttttgaaagcgatttatgttgaagtggcacgttgatttggtccaagtatcctaatgtgatagcccaatcatcaaaagaattaaaaatagaagtgggccccacattttagtgacaaaagtaaaaataaaaaacggtggggcccacttgtcagccctacttatccctttcttcttcgtcctcccttcttcccacacgagactacgcggcagcgggaggccagcagcgtgacaatatgctacttcactctgctgctcctttatcctcccgagccgcttctcatggcgaccccgatcggagaactggaggtcggggtcggagtgcggcgttgacagcgagaggttcgatgggtgcaagcgtgggaggccaccgtcggccccttcatcacgagaggagctgatagcccaatatagtaaagataatagtatgcatacatcactctaatttaattttagagcatttcgtaatactacgcaatgccgcaaccacgcgcgagctgtttttctaagctagaaaaaataaataaagaaaagaaaagccatcgatcgccgagacctaacccttatagtctacaaggtagaccctccgtattttaatgtatgacatcgttgactttttaatcaacgtttgaccattcgtcttatttaaaatttttatgcaaatataaacatatttatgtcatgcttaaagaacatttgatgataaatcaagtcacaataaaacaaatgataattacataaagttttgaataagacgaacggccaaacattcatcaaaaagcaaacgacgtcatacattaaaatatggagggagtaataattaaggattatgcggtctagtgtttgctctgattcggacatcactcgttttatttgttctaggccgccttaggagagcgcttccacgtatgcatgcatatgggtcttcttttatggccggcccaacgtcgctacccatgtgctcagcatgttcctagcctctcaattaattttttgcccagttaaaaaaattataattttataaaaaatagaaaaaaatacccgtgtgttgcaacaggtgaaggctattttaatcgtattattgttagatttttttttctatttaaaaagtctagggattttttattttgatagtatttatatctaattcggaactcttattaggacgattggtcatgtcatgtacgttgctttctaatggcttggcaagaattatgaaacaattagttgtccgactctcgtcccaagttaacatgcaagttttttaaaataattttttaatatattttcaaaagtgaataaacttaaaaactgactcaaatacgaacgatgtaacgatacagctgaacatctttaatttttataatatcttttgatttttataaaagtgtacatgcattcggaagaaatagggagaagcaataaagaaaaattaggggagaacaccaaactgaa

SEQ ID NO: 38772 - DNA, 12561 bp, Oryza sativa
aattcaaattcaaatttgaatcgggtatgtaaacttttgacttataaactttggatctataaactttaggtgtataaactttagatgtatagaaatactatatataaaaaaatatttgaattcaaattcaaatttgaatcggatatataaacttttaacttataaacttttggtctctaaactttagatgtgtaaacttgaggtgtataaactttaggtgcataaatttactaaaatagaaaagtaatgcggtgccaaaaaaggaaactaggtggagggaggaagggggagggaatcgatcgctgccccctatctccagcgatcgattgcccattaggatcgcccattccgatggagcctagtgtgcaatctaaggccttaagggtacacaaacgcactcaaaacgaggacctaatagatggagagggacttgcaattaattgattgccaagttggatgtctgcacactatgccgaatcaggtcatctgtgacgggtccaaatcctcacctttgatgggtttatccctggtcacagattagtggtcagtgatgacttaacctcacctatgacgggtgaagatccgttagtggtgagagacacctgtgaggctgtgacgggttgtaatgagcaacccgttagtggtgagagacatctatgacgagttataattaaaactcatcacagattatgtcacctcaaatgagttgaagcagtcgacccgtcacaggtgtgaaaaatcaaacaaaaaaaagggtgccccgctgcaacaatgaaaaatcggtaacagatccacgctgaataatccaaaacattttagactacatttctaatccaagaacttacaacgttgatgttacaaggaacataaaaacaaactagcgcaaaactacttgagaactgcaatgttcagattccaattttctagcaacatcaccaaagacaacgaaactctaaacacttgcagttcaccaccttcaagaaaaacaaaacaccaaagagcgcaacttttctagcatcagtcatccaacccttccttcaattaattcccagtggcaacacatcatgcggaaacaagaatgacacaccccaatcgaaaacttggtaccgataacttgcaaggtctaaaatcaaatcacaagactacaaacacatagatcaatacccatccaatgcatgacgggggaggcattgacacgtagtactcgatggtgaaggcgtcggctgctcgaagatggaggatgcggcgaggaccaatgctcaaaggaggaggcggacgctgtggcagttgcctctcggggatggaggcggctagctcttggaggtggctactcggtgaaggaggaggagcaggacccggatctggttacccccgacctcggagaggccggatctggtgccccctaaccacgaggaggctgcaacggcggccagatcttgcctttcctcgtcatgcctgcagccacaccggtgctcgaggacgagacatatgacgactgctcgccggatcgagccagaggggaaggagggatcacaggaggcccaagaagaacgacggccggcggtcggagacgcatctagctgggcttgcaacgggaaggagggctcataagagctagcgcccggcggctttggtgtgggaggtgctcggaagaagggagagagagggaggtggcggaagaagaagggagagagagggtcaaggcagaagaagaaaggagaagaggataaggatgggcgtgggcttgtgaaccgggaggcgaggggagggttatgagagtgaatttttttttatcatctttgacgggcacacaaattttacacacatcacaggtgaatacctcatctgtgatgggctagatcagaacagtacacccgtcacagttatttgatcgcctgtgacgggccagaatttgaacccaacaaaagcaactctctgtcggatgtaaattctggcccgtcacaggtgatcaaatacctattacggtctctggatagacccgtcaaaggtgaagccggccatccgtgacaagcactgcagcctgtcactggtgggccggcacagatgaacggttctggcgtagttgtaatcttgatcaatcgttctcaagaagtataatacaaccaataaattaaaactccatccatttcatggttatagtgtgcacaatctagatcaatcgttctcaagtagtacaatacaaccaataaattagaactccatctcgatcatggtgttatagtttgcctatatatatgaagaactcaagaagagaatatcagcacatgcatagcacagccagtaactgcatgcaagctagctagctcacacgatagagcttattgggagctttcagctagcatgtatctagtgagccatggagctcatcctgcagctagaagcaaaaactgcagcacaagcagtggtaaccgtcttcttcttcttcctcctccctctcgctcttctgttctactttgcacgagccgcaataagttccagggatagtaaaactcgtgagttaattctgagcaagctcccttcgccgccgttcaagctaccggtgatcgggcacatgcacctcatcggccccctcccgtacgtctccctccgagacctcgccgccaaacatggccgcgacggcctcatgctcgtccgcctcggctccgtccccaccctggtcgtctcctcgccgcgcgcagccgaggccgtcctccgcacccacgacctcgccttcgcgtcgcggccgcgctccatggtcaccgacatcatcatgtacggggcgctggactcctgcttcgccccctacagcgaccacttccgcagcgtcaagaaggtggtgaccgtccacctgctcaactccaagagggtgcaggcctaccgccatgtccgggaggaggaggtgcggctggtgatggcgaggctccgcggcgcggcggcggcggcggcggcggtggacttgagccagacgctgcagttcttcgcgaacgacctcatctgccgcgcggtgtcgggcaagttcttgtgcgagcaagggaggaacaaggtgttccgggatctgatggaggcgaacagcaatctgctgggagggttcaacctggaggcctacttcccggggttggcgaggatgcctctcatcagcaagctcatctgcgccagggccatcaggatcaggaggaggtgggaccaactcctcgacatgctcatcgacgaccatgtagcctcagctcgcgatcgcgctaaaaacgacgacgacgacttcatccatgtccttctttccctccaggacgagtatggcttcaccagagaccatatcaaggccatatcaatagtgagttccttctactccctccttccctaaatgtttgacaccgttgatttttttaaacatgtttgaccgttcgttttattcaaaaacttttgtgatatgtgtaaaactatatgtatacataaaagtatatttaacaataaatcaaatgatacaaaagaattaacaattacttaaattttttgaataagacgaacggtcaaacatttttaaaaaagtcaacggcgtcaaacattttgggatggaggtagtacaaaatatatactttctccttttctttattaatgtatgtatgacatcttgccttttgacatgacgtttgatattttttttttattaaaaaaaatttacataaacattatttattacaaatatagttacaataaatttagaaaactaaggatagttgaaactataaaccacacggaacattttaactgtttaactccaaattatttatgtgccatttatcgtaggacatgtttgaagctggtacagatacatcacacctagttctagaatatgctatggtcgagctcacacgcaaaccacacattctaacaaagctacaagatgaggtgagacgcatcacaccgaaaggacaacatatggtaaccgaagatgatatcgtcggcatggtctacttgaaggctgtcatcaaggagacacttcggctacatgcaccgggaggtttcactattccccacctcgccagagaagattgcaacgttgatggctacatgatcccagcaggaacacgtgtacttattaacttgtgggcacttagtagggatgctaattactgggacaagccagatgagttcttacccgagagattcatggatggaagtaataagaacaccgactttaaggggcaagacttccagttcttgccatttggatcaggacgaagaatgtgccctggaattcattctggaaaggtcacactcgagattatgttggcgaacctcgtatactgtttcaactggaagctaccgtcagggatgaagaaggaggatatcgatatgacagatgtgtttggattggccatacatcggaaggagaagctcttcttagtcccgcaaattgctaattattgaggatagatatatatgctgtgcaacattgtgtcgatatatatgcatcctgcatatatagccatgcatgcggtacaacattgggtcaaggtctacagtatccatctaaattaattatcagtgttagatgttatcgtgagtacagtcctgtaagtgtgttcaactacttgtagaataagctattcttagcacatgtcaacttacaatgtttgcataaaagtataacatttgtgtcgcactccatttgtacttttggatgtacatcaacaaaaccttcattggcccttgttggaatcctaactaccgtggtgaatttttttttaaaaaagaatgatatgattggctttcacttttaggtcatagctcaattcgtacatgtcgaaatgcaagttaaattcagaatccaaacaaggccaataatcgcctaacatttgcagcccaagctagatacactggacttcatgttagcgtagtacatgtacacagtgtagcccatccaatacggcccggcccatctactgaccatcattttgcttgcattttccttccaagaaacgaccaaattaaaagaagttaacacatactgtagtacatatgtatgtacttttgtacttataaggatgcatccaagttaacacatacatacatacatatgttaatccacacacacatttccttgcaattaatccggcacttgccaatttttcatcacaactgaatcaaaccatacatggttttacacgcaccatgtacgcgagagcagagaaggtgaacaagagatggaacgagctgttcgacgccggcgaagccacttctcgttcttttatgtttccggttgagcttcaatattcatcatgtggtagctgtttattttttttgagagaacagagcaaaatatattgacccagctttgcaagaaattgcctaagaacaaacagactcttacccaaagaaaaccctgtgctaggtgtgcatcaggtgacaaatcttgtcgcataacaaatgctagtagcttcttaattttagacaaaactttcagaattgcagtcaaagattaatcaacacaactgtagtatacttaatgaaatttacttaatccacaattaattgaaacaaggaaaattgagccgtaattaataatggatcaaatcgagtaaagtaattactactaaataggagtaatatatactttgatcgatgcaagtaactaagaagaagaagtagtgttgttggtgacggggtagccgatgccatggcgagtggtggggaagacgacgaagaggaggctgcacatgacgccgacgcccagcggcacgatgcccagcacctcctccgtccccttcgccggcgacggccagaagcaccccaccacgttcttgtccctcgccgccaccaccccgaacacgcccaccgacagcaacgcgtgtacgccgtcgatggccctcatccggtacctcgacgtgtccggctgcggcggcgcgccggcgccggcgggagggtagtcgagcagccagagcccccgtggcgtggcgaggccgtagtagacgcggccgtcggggcccctgacggagtcggtgaaggaggcgaggacgcaggagagcgcgagcagggcgaggagggcggcggtgaggagcgaggtggtggcgtcgcaggcgccgttgttggtgaaggtgggcgccagcagctggaacgccatcaccgtccccgtcgggagcaggttcgccaggctcgccgtcgacgccagcgcctgcgacaacagcgacggccgccttgctgccggcggacgaccaccaccgccgtcgccggcagcagcagcgctctctccttctccagcttgcttacctaccgttggcctctgcctgacgactgcgggagacgccatgatcgatcgatcactggattgttcttggacaggcagctagctagatagctcaattaatttgctccggtgaattggtgatcaatggagattgtgcaaggcgtgaaggaatggacatggacatgcatgcgctggaagaaatagaaaagcatatatgttattgttgtatcgaacaaaaaagaaaaaaaagagaaggaaaataatgtggcttgaagagatcaactgctaggtgctgatggaattgagaagcaacgacgacgacgacagcagcatgcaatgcaaaacgcgtaggcgtagcaggacgaatcacacattgttttgggaaggcgtaaagtcaagaactgatacccaatttgcaacgtacgtcatagctaatcctcctttgatcgatcgatcgtgaacaaaacgtgttgttaataataattaatgaagatgaggtgagtgtaaacatgcatgattatgttgaacaaagttaattactcgatcgtcgttgcttgcaagttgcagcaaccgaatcgatagatgacgaaaatataagtaagacgtggcagctggcagatatatagcataatacacatgtagcccggccctatgacagagactgttcattaattgtgtggcacatatgcatgtcttgcttttagaattgggaacaaagcaacatcaagtatatatatacattcgatccatgtattgttgccgtggtcttccacaggaattgaatgctacaacagacaagaaaatgctatataaaaatgtttctatgtaattcgtgctttgaaatgaagacaaaaaaactgaggaatgttaatatgaggttttatagtctttatttcctcctctaattacggtgttcttttcctacaattgtctagtcaaagttgccattcttatatttttcacatgttttttatatttctctgttttgcacttatactcttatcaaaacccttaggtattgtttggataatgggattggaaaatgatttcccacccatcaaaaggtatctttaaatactaaccattcattctccctcttccatttaatcctaaccctttattcatttcccaatcacaatcctactcttcatttcccattatccaaacacacccttaagtttttaaatcagcatcgattagactggagattagaaggggttgagctagagcggccggaattgagtaaggaggcggtgtaatgggcttaaaggaagcccaacctccttttgaaatgggccttcggtctgctgcgacttaaattaagttagaggggcaaggcctgcattaaccgaactgaactcaagatgggcccaatcagctcagttgcaaattaagaggatcagatcggataatcaatttagctacctgttcattgcctgtttctccagatcactgaagcaatcgatctgtattgaattagctaataaattaagtgcacgcacgttaatttgctgtattgtacagtagttcaataagtccatcgatgagagaattagcgtcaagatatgttcatcacctatcttgcttatcgggacatgtacaattaatccatgtatgtgcatgtatggtacgtactaccaacaagtactccatataattgtagtgcaaacagctaatagtagttagtcctaagttaggtagataggtaggtagattaggcagcatatataagttaatgatcaagtaccactactgtttttgttctgcatacatgaacacttattaagagtcaacattaattccacatggaaatcaggagatcagtcacttaactatgctactccacttccctacatatgctatatatgtttctactcaccatataggatgtcgttaattacattgtgctctcagttaatttgtcaatctgtgctgctctcactaatcacagttttttatgaagagctgctgctgtagtttatgggaatgaagaacaaaaacgtaccacagctgatggcaagttgtccaattgcaattaattagcacccggttttcctgtcaaaagtttacaaatattaatttggcaaaagtgagtcaagtactatctaaagtgaatagtcaagtatgaaattgcaatcgatgcgagtagagctatatctctgcaagaggactttaaatttgtccaatgttaggcgcaaaccgtagagaatcgatcgtccaccaccagtagaaaggatacatatgggagaaggatccaagttgaatccaaaagatgcatggaaacgttaactggttagcccttgactccctctctctcaaacgatcgaattaggccttgattgaccaatgtccatataatctggcacggttcggtcggaccccattgaccctaacttgaacctgttttttttctaaaaaaaaaaaaaaaaaacacacgcggtacagacacatatactcatctttataaatacaaacacacatatcctaatcctacgagcacctttaaaacaacgctgccgatatatcctgtaattgacgaggtcatcgtgatcaaatcgctccgacaggtaagcctggttctttttaacttattcaccaaattataaattgttccaattttgaaaaaagaattttcttataatatattcttatattgtattatattgtttagatcatttgtttgttgagttcatttctaatttatccatatagtaagtagaaaatggcaataacacactcaatagtttacatattaagctgggtcttttctttcgtaaagagggtaaaacctttgtcacatatatatcgtatatattgatagagcaggggacagtgggctttaatttggaaaaagtatgaattacccctcccccgaactatctcagtcgtccaaattacccccctgaaccacaaaactagacattcttcatccccaactatgcaaaccggacgaattacccccctcgaactaattcagagcggttttgtccaacgtggcacacacgtggcaatctagtcagcgttttttaaataaaaaattgtgggatccgcctgctatactcttctttccttcctctctctctattctctctctctcgctcttttctctcttgcgcggctcgtgctgcgcgcacagcaaggacggtcggcgaggacggcgcggggatgggcggtcggcgtgggcggtcggcgacggcggaggcagcgagcgtggcggaggaggcagcggcggcggaggcagcgagcgtggggaggcgagcggcggggcagggcggcgaggcaggcagtggaggaggcgagcgacggcggaagctcatgctgctggcaggatgcggtggaggaggcagcggcagcagcgagacggcggccgacgccatgcgcgacaaccagccccagcctgcggccgtgccttcctccgcttcgtcgcgggcgctgcctccgttgcaaagaggggataggccggcggcggtagagaggtggccggcgagcccaatcgagcttcgccgcctcgagggccttgtgttgacgaaaaaatcgaacacaccggcctgggagatctgcttaactccagtgcaggtccaaaggttgatgagatgcgggcgtgccagtcagtttgatcctgcaactgacaagatatgcaaatagtagatcaaaacagccgatcggctgacaagcggatggagtagttccagccgatagccgataatagccgatgccaataccagccgatagcgatagggtgtaagcaatcggctatatgtccaatgtagataatgatataaaggcaatcggctgatgatgatgtaataagataacaatataatccagtataaaccaatcggctgataataatatgatggaataagcattgatccgaaggttaaagcatacatcggcaggaggtccgatgccataaaatccaaaagattatattaaacaattaaatctttattgccatcggctaaatccaacttatatgtatatgcaatccttacaagccaatgcaacgtccagataactcaccggttgaaaccccgatgaaacccctattggcagtcaaaaagcaggctagagattatggttctaatctagcaacacgatttagctgataccggcagaaaccctaaagcgagaagcagccgatagaggtaaattgatatgctaagactatattaacagaggcatatgataaataggtagacaaatatatcatccaaaccggagcgatccaagaggtctaatgtactgatgcagccttaaacgacgccgatgtagatgagacaattgcctggaccgacggaacattggacttaccccttagccggagatcgaacactgatgcagccccgcgtcaggtgccaagtcccgccgaacgataaaataaagtagaaaaggtaaaaggtggcgatgtgccgaattgtattgatcgtgaagatagattacatagaccccgggtgtacatatttatacccatgggttgatacaagtccttgtcggacaagaaagaaactaacctaaagataaaaggaaaacataaagtccttacacactttcctaaagataaaaggaaactaacaaactattcctaattaatagataaactgccatgccgcatcctctttaaactcggtcacttagggataagcttcctttagtagattgatttccttaaccgaatatagtaggaatccgactattggcgacttgataactcccatcggctgattccgagatgctgcagccgatatgattctaagccgatgatgtctttgccgattaccaaatttcactgttaacaccttgcaacgggaggagggagagggggagaggggaggtggacaacgaaagatgggggagggaagaggcgcggcggtcggcgtcgccgccggtgggtccgccgtggagggggcgtagccgctgccgcctccaaatgatgacttggaccaccctgacgaggtatttcccgacgctctcgccttcctatcaacgggccaacaccggtcacccacgcctccacctcgccatccatcgcaacgacaatgtcatgcttggcctcctctccccctctcccgccgctctactccactctgctggcggccgcgcgctcgcccacttgctccggtcgctcgccgccgcccgctccactccgcctaccgcgtgcttgcccgttgcctcttgctgcgggcactttgctccacttcgccggccaccgccgccgctgcctcctccaccgcgctcgctgcctccactgtcgccgaccgcccgtccccacgccgttctcaccgtgcgcgcagcacgagccgtgagagagaaaagagcaagagagagaggaagaagagaagagtatggcacgcgggttccacaattttttttattaaaaaaacgctactggattgccacgtgtgcgccacgttggataaaaccgctctgaattggttcgaggagggtaattcatcctgtttgtataattgggagtgatgaatgtccggttttatggttcaggggggtaattcagacgaccgcgatagttcggggggtaattcgtactttttcctaaattttattgtccttgaatatttgttcgggtcaagtcaacaccagatcgaaatgagcatttcaaaattcgtacattttgcttttttccctcttacttgacacatatataatcccaccatttataatgtacattgcaaatccaatggcaaaccttgttttagaccgaatcacaaacagtagtaagtaattttaacattgagatggtcataaaaaagcgactttgagcactgttttataccaggaacaacagtcaaacaaaatttgaactgtattactttctttctattttacaacccagtgatatttcaactttataaaattatatttactcaacacaaatttagacacacgttttcatttcatatacaagacataaaaaaaatccaaaaagaaacaaagcattgacctaattataactttatcgtcattggtagtccactcctagtaataatggtaataaagggcgacgatgccgctcgctgccgtcattctctcctcctttccttctccttcccttgcatctcttctcttctcttctcttttcagtttccatttccattttccatttgaaccaagaccacgacgacgacatcactccactccacgcgatcgagcagcagcagcaagccgcgacgacgacgatgcccatggcgccggagcagaagcaacgacaagaagccgacgacgacgacttcaccttcccgactccgccgcagccgcacctcttcgccaccacccgccacctcccctgctcaccgtcacca

SEQ ID NO: 38773 - DNA, 3949 bp, Oryza sativa
attcctgcagccctcaccgtcactatcctcctccccgcccgtctggctactctcctcccccatccgccgcagcttctccgccgccgactgctccggctcgccgtggcgaaacgcgcgtgtcgtgctccgtcgtcgccacgccaccggcggcggcggcggcggcgcatgctctcccgccctcagcgactacgcggccggcttctgcgacggcgcggaggaggaggaggaggaagaggaggaggaggaggagaggatggacagtctctgggaggacctcaacgacgacgacgcagccgggaagaagggcggcgacatgttcctcgcctccctcgacgtgtcgcgccgccgctccgtgggtggcgcgggcctcgccgagaagcgcgagggcggcggaggcgcggcggtgttggggttgggggcgtcgaggagctcgcggcggcgggcgccggggctggtggcgatgatgcggtcgctgaagaggatgctggtggcgcacaaggggaagagcaaggtgcacaagtccgacgaccacaccaccgcctcctcttgcagtaattccggcaagaaatgatggtgaaactgaccatgcaatgcaacagtagaaacctgcggttttagtggtaaaaagaatttcattttaatttatacgtgtcagtttcctcacttcttgattgagatggccttgcagttgcagatggaatgatcatcaatcacagatcagtgttctttcatgttaatcactatgtaattatgtatccctttttgtaaagtttctgttcatcttttttggtgatagttagacagtgcttggcagtttgcatgaatattttttggaatgagatataatatacaaatgttattctgtggtctactgaatgaatattttttctgaataattctacttagctgcagcttaattctttactctttagaacatcggttgcagctgcccttttcattatttatttatccaaaaaaaagcatgattatactgcgtagcagcgagattaaaaattgtgttaggttttatggtacctagaggctatagctagagcacgtacgtagatggtcctgtgattgcggtagtaattgaatatatactcctaatgatatatagtgtgtagattatattattcttgttttgttgcaggaatcaagaagaattaggcacaagagtcttgtgtcatcgcctactcatcttccatgattaggagcaatcaggaccaaacccaatatagcaggcagcagctagcttaattaattaggtcggtgtgcacaatggacaaattaagtttgttaggcgctctaggtatttatagtggtaaaatacaacgagatgccaagtgcgtggttagccatatgctgtagttgaacaagcactaattcagcagtacaaggggaaaaaaagattactacagtaccattttaaccacaattctagcagaatgcatgcttcgcctgctgaaaacgcatctgtgaaatggaatttaatttgagtgatgtgaagaaacaagctagtagcgcacaaatcattgcagttttctgggcatttgtacggcagtttttggtgaagcaattacagttgattgtactggataagtagcatggaacgatacacagtagctgaagagcatggcgtgcaagctaggttatgactagtgtacagctagccgcatagtatcatgtatacttcctgtgttgctcaacttgttgttttaggaagaagggagtttattaacacattattaaagcatgcatcatgtatcgccatacatttattcacgtacgacgacgttatatagtttcgcgtatgcctatacttcaataatgaaattttttatataacttaaattgtgaaattgattttgtgtttttctcattatagtttattttatagttaagaacacatataaaagttttacatataaattaaatggtctttgcttacttacaagtattaagtcataccgataagtataagtagaagtgaaatgatggagcatcgtcgatagcatttccagagacagtttggacaacatgcagttgccccatttttcaggactttatgtctaataattgaactaggtacacacccctcatgtctggtatatgactgctataatatatatgtagccagaatattactttttgttgatatcatggccggtttctgtggaaacgagtgccaagtttatttatgctgggcggaaaaaaaaagccaaccttattacttgaactcataggcaatatacacgctcgcattgagcgtagttaaccactagcttatgtcagtgcgaaaattttatggttcatttaacttatactggtacttcatccgtttgtaatgtttcatatatattacagatgtttgaactttttttctaagtcaaaattttaagtttgattaaatttattgaaaaaaatagtaatatgtacaacagcaaatcagtttcattatattaaatattgaacatttttggtactatgttttcttttatgttaaaaatattgctatattttttaataaatttgatcaaacttaaaattgaataagaaaatcaaaatgtactatatataatacagaaacaaagttagtactatatatacatgtatgagtgcgttacaactgtagtccacgacgagtataacttttggctaaattaatactcgtacaagaaagactacaagagtggctcgtagcttaaaaaaaaggctcaatgaaacaactagtacttgttttatttgggtgtagcaagattatatggctagctagcaaggctaaacaaaaggaccttgattattcctacagtatttgtttccctcttctctttcttgggccttttggcctgggcctggcccatgaagccactccatcaaccactccggccggcagccataatcaaacacaagcatagggagggctagcatctacggtatgtctgagattgtggtgaccgcttccaagggggcgatgaaccccctactcgccaagttagccacactgatgggagatgagtacaagaagctcaaaggcgtgagaaaggagatagtttttctcaacagtgagctgagcaccatgaatgcgctacttgaggagctagccgatagggatgagattggaggaaccatatcagggagatggtctccgatattgaggactgcatcgatgacttcatgcaccgcgcagtatcagatcataaaggagccaagccaagttttcttcacaagactgctcaccgtctcaacacactgagggcaaccaaatccaagagattaaggctcgagtattggaggcgaataaacggcgcataaggtacatgccgacaattgtgtccctacttctgttgttcccattgatcctcgactgtccgcactctacacggagacatccagccttgtgggtattcatgacccaaaggcgaaccttatcaaatggttaatgggtgatgaacaagaaaggaatgtggtatctgttgtgggacttggaggtttaggtaaaaccacacttgtcaaggaagtgtaccgtgatattggagggaagttcgactgtaaggcatttgtatcagtttcccaaagacctgatatgacagctcttctcatcagcataattttacaaattgggcggcaaaagtcttctcactcctgcagtatgaaggacctcatcgacagcctaagagaatctctgcagcataagaggtacttggctcttatatagcttattaatatctaataggattaggatggatatgtagcagctgaaactttttgttccaaaatttgttgtgtggtctaattaatcttcagagaggtttatacaattttaatatttttttttctttttgcgtggatgtagtactcctttcgtgtgtattaaaaatcactctgaaccagggaagtcaatttgatactactacctacgtcccataataattacatttctacgattcaa

SEQ ID NO: 38774 - DNA, 922 bp, Oryza sativa
tgccctaatcaacccatcatcttcactttcagatgttttggccttctttggcttgcttgcagatgaagtttcagcatcaagatcaatagtagttggagcacgattcacctcttcgttttcagtttctacatcttcagtaccaagaactgaacttgagtcctttgcaaactttcctgtagccattgtgctcccaaagattgtaagcatctcaccatagtgcagaagaggtttgttaaaaaactcagcatcggtcttgtgatcctatcatgtaacatatttaacaaaataagtgcttgcaacaaaaatgaaaagtctgtagaaattttcatggaacaggagtgtttataccttgatatattcattgtagtgctcagcatcaagagtaataacaaaattaacttcatcccaaccagcagcactcactttcctaagcctgttcatctttgtgaacttcttttgccatgttttcaagtgattcttaatctgatcaccggtaaaattagtacaaaacatctcattgagagccctcgcacatgcgttgagatgggcctgtttgaagccagaagaagtcctcgtcccactagccacaagattggctagatgagacaacatgaaagaggacattgcatatgtccatgaagcatggttgcttcctccctttcctttgctatccatttcctacaagccataatatttagaaatgaaaattaagttcagcaagcatgatatggtacagaaataataaaccaatgaccataaaaatacctttcagcaaacaagttgtccatttaaatgaaattcacacataaagtgaagaaaaatgaccatcaacagcatatttaaccatacaaattaaattcaaccaactagctcatccattcaaatgaccatcagcaaacatgtccatacaaatcagccaaca

SEQ ID NO: 38775 - DNA, 3402 bp, Oryza sativa
aaggaatccttgtttggctccatatccagcatcaactaggtagtattttcctatcaaatgagggacaagttgatcaaatttctaccttttaacatttcccatggacaaattgatggaactaaatatatctattaccttgtggaatacgaaggccattttcacgttccaatgcatctcttaaaactacagcatcatgtgctgtcccctcccaaccaaccaagacataagtgaaccgaagatcaaaatctacggccgccattacattttgcgtggcatgagacttcctaccacgaaatgaagactccatattcttccggacagaggctctaatgtgtgtaccatcaatagctccaatacaatcctaatttgtgttcagtaccataaataattagggaccacatatatatttggaaataaaaatctgaaaaggagatagataaatgccacaccttaaagtaaggatcccatctggggttcccggctattttatttggggtgtccaatgaggggggcctgattagttcatctcgtagctcaccaatagcatgaagtactttgttgaaataacgactaactgtttctccggacctatcaaaattagtgcgaactaacctatttctaaggttgtgtcccactgtatttagaaacatagcaacctgctcctcaacacgcatgtggatggtatcctcaagcaaaccccgatctctaaacagcttacaaaatcgaaagaaagaatcttttctaagtctaagcatgtcgatacaagttgtatcattcctccaaatttttgtgtctaggtattcaaatctcattcgatccctttcatccattgggccatacttaacaccttgtctccgtgcacatctctttctttttctagattgaataataatggccatcattgacaataaaatatgtgcagcagcagcaaaaattaaaagcttggtcctcttatccatctacaatacaacaatcaaagtaaagcacaaaaactcttctcaatcacacatcatgtaatcacaaattacttgctcacgtcagaaattaatcactgtgaataaatagacaaaaataccacatcaataggcaaacatctattcaactataaattgatctactgtgaatcaactgcttcacctagtcctttcaacaacaagggaaaatcatctcaggaaacaaattcagcaagatctagggtttcaagtgctagggttttcttacctttctcactgaggatgcgaggacgaggatgagcagttgagtacagaggaggaaaggaggcgacaggtgggaggcgctggttcttcttcctcttgttgctgcagtagccaagggggatggaggatggaggacggacagaggatgcgagctgccgccgcttgctcctgcacgcgctgtcgccggcgcctcgggctcctgcacgcgcggtcgccgccgcctccggctcctgcacgcgcggtcgccgctgcttcttgcgttgccgccgccgccttctttttttttcgatggtgaaagtgcgatggggaaaggcgctgagggaggatagggtaccgctcaggagaggcgcgtgcaactcacgtgcgcgagagggagagaggtgggttcgatcggtccggtcgtttttgggtggtcagttcatcccgaatattggtggaatattcctttttggaaccaacccaacccacataatcctcaaaccaaacagctccgaaaagggatggccccgacccgacccaccaaaaccatccaaccaaacacatccttatattagggggcggagggagtaataaagtagggttttcactcatgtgagtttgctcaccttctgttcagcatctctactgggcactctgtactaaactgaggaatcacttagagcaaggatagtagtatagcttactttctactattagtccatcttaaagtcaacatatataataaattagctataagagcaagttcaatagtatagcccaatactaactccaattcatctatagccaatataatagccaatttatacaatagttgcttactatactattaatatacggtcccacctgtcatacactcattgtgtcttgaagtccgtgctgcaactggctacagatctgtagctcgctgctcctctctcttatcttttatatatctcattagaatatgattgtagctggctaatagtctgctattgtaccttctctaaggttggctacaattttcttctcctctctctatctctcacttagagcaagtttaatagtatagccaactactagctccaattcatctatagccaatctaatagctcattcatacaatagtaacatactacactattaatacctggccccacctgtcatacacacactgtgtcttggagtccgtgctacagctggctacaaatttatagcccgctgctcttctctctccttatttatctccttaaaatatgtttgtagctggcttatagcatgctattgtacctgctcttatacatttaatgtatttgtcttggagattgtgttaagctagctcttgcatgagagccaactcccttgattttttgttacctctctcctccacaaaagtttatagtaggcttatagctcactattatacttgctcttatgctcctagctttttttccccaacaactcaaagccactgtatgggcttgtcacccggcattcctaattgttttggaccttactcaactcatcgatgaatttagtctcgatctaccattgaccaaggttgatccaaaagaagttacacaccaatataataaccaaaacaaattgttttcaagcatatagatattgtcatgattcacattattagcacacacactctcaaagccaacatttattcgattttccaaaccaaattttcaaatatattgttaatttttcatcgcaaaatataaaccatcaaatggtcttacacgtactaagccccaaataagattggcggagatcagtatcactgctggagaatcgctttttagtcccggttgggaacccccctaagtcccggttttctaaccgagactacgaattcgggactaaaaataaatctttagtcccggttcgtaacaccaaccgggactaaagattctaaatctttagtcccggttgatgttaccaaccggtacaaaagttattttttttcttttttttcttttctagcgccaaatatcacatatttgtgttcccacatcactcatcacatatcgttcacacatctcaacatcccaaatcatccacagcaacaaaccaatatatatctcaaacatcccaaatcatccacacatttcaacatcccaaatcatctacaccaacaacccaatatcccaaacatcccaaatcatccacaacaacaaatcacagggctgcaggaatt

SEQ ID NO: 38776 - DNA, 2043 bp, Oryza sativa
agataaggcctaagggagagataaagagtggaggggaggaagagataagggtgaggactgagtactgactactctgcgcgcggagagaacaagggaagagagagatacgtgggaaactgatttgttgtcccggttggtataaacaaccgggactaaccgggattaaaaatattaggaaacctgccacgtcgtgccaataaataaaccgggacaaaagatgatctttagtcccggttggtaacactaaccgggactaaagatcattgcacttttaaactgctttttagtcccagtatttaagcatccgggactattgttgtttttggtcaaccgaccaaagatggtttctccaccagtgtatatacttaataatgtgtaagatgctgaagttgcagggcacatgacatggtactatggtaggtgagtatggtcgggagggacacatatacatcatggccggattggtttgagcaagttttttgtaacaatatagccaactgcatagagccagctcatgcatattggttgggatggacttgggggctgagatagtgggatgcatatgcaggaaacagccagctcatcagaacgaatcctagagacagcagattgatcgatcttactccaggattcccgcgaacggatcaaagcactggacgtatcgacgaatgtatcgcaagaactgcaagagcaagtaaaactaccttcattttttttaaaatatatcataccgttaactttatacatcattgtgtctggatgcttatagtacttgctctaaactagtcactccattctaaattgatcgtcttacatgtttatgcacccagaccaacgctaatttaaatcgcatcaatcaagacaccatacacatattatctcacaatacatgcatcgattaaaatatcataccaactacatcctccttgctacatcaattgtattccgatgaaatccgtttcatgcggttatatgatgatcaatttaacaaaattattatatgatgatcaatttgagaacgagagagagtcggcgtggatctcgaagctagtaagatcattactgtaatctctctattttaactagtggttgcgcaaatctcaagggaagaaaaatgtttgcccccaacaaatggctgcactaattggggctaattgtatatagtatatatatacaggaaaactcgatcggttgctcagttgcaggcttgttgtagctggagtagctagctacctctcacacgtacgtaaggtcacactagccactagctaggtactgactgatcaaaccaggagaggaaattaacccgatcgatcagccagcagagagaccaaagaaattaagatggtggtgagtgcatccatgggggtgatgaacccgctgatggcaaagctcaccacgctcatgggcgacgagtacaagaagctcaaggggctcaggaagcaggtctccttcctcaaggatgagctcaccaccatgagcgctttcctcgagaagctcgcgctcatggatgatgatgatgatggtgagctcgatcctctggccaaggactggaggaaccacgtcagggagatggcctatgacatggaagactgcattgatgattacttcacaagtcatcttgatcatcgttactcttcctcagatgcagggttaatccgcaagatagctcgccgtctcagggcattgcgggtgcgtcatcgcatagccagccagatcaatgagctcaaggctcgtgtggtcgaggcaaatgagcgtcgcgtgagatacaggcttgatgactgtaacaacaaacatggtgtttctgccaatcctgctatagatccacggataacatcgctctaccaaaatgccgggagtcttgtgggtattgatggcccaagccaagaactaatccagctgttgtcgttagatcgtgataccgatcaacgacaactcaaagtggtgtccgtcgtgggatttggaggtctcggtaaaacaactcttgcaaaatatgtgtacgacaagatcgggcatcaattcgattgcacggcattcgtctca

SEQ ID NO: 38777 - DNA, 802 bp, Oryza sativa
ctgcaccccttctttggaccaggagccttcaaacgctcccaatcatttcagaaaaattccagactgggatacaggggaagggtggatttggaattctttccatgaatgtcaattggcttacagaaaggacatacaaaatgaaattttggataaatttgaaattgtcaaccgttattctccgtctcatatgtctcccttgtttgagcaacatgaagaagtgagctctccacagttcactgttggtccaggtggtaatattttatctgtactggaggatgagatatctagtataatagcccgtgctcttgctgtatctggggaacaccgccatttagtggagaatgaaacagagggtgccaggttggagcatgctaaaacaatggaaaaatcatatagctttatgtctggaagttctcttgactcatcaccatggtcatctatcggatctttagattccgaagcaagttttttgtctcttggttcatcagtttcatcagatgacctatctggttatgatagcttgcctttgttctcttcaatacatccagaagtcgctgtaaatggaaaagtagctctcagaggcaaatattctgttactagcatatatgctaaacaattccaagatcttcgaaagaagtgctgcccatctgagcttgcatatattacttccctaagtcgctgcaagaagtgggatgctcagggtggaaaaagtaaagctttctttgcaaagacagtggatgacaggttcatcataaagcaaataaagaagacagagtttgagtccttcataaaatttgcccct

SEQ ID NO: 38778 - DNA, 688 bp, Oryza sativa
aatgcccaaggactcctttgagaagcagcagtctaggattgtggcaactggtcggcatgtgcttgtgagcagcatttttcttgaagactaaccccttgatcacctcactgcaatcaacattgcaaaatgaaggggggggggggggtataatttgaaacataaaaaaaaattcaatgttttcaaagaattttcttcagtaaggaacaaattatgtttcacctttgccgacgagtaccagatgctatgcacttgaccttgatgtaagatccagggtccatttcctttcccttgctagcatctggtttgatcagtagtgcagcttcccacgatagggaggtaaggatatcaagccaactctcaccgctctctcctttggaaaaggagataccagcagaggccaggaaccgacttacaagtatctttaactgcccattcatggcatctagcatcgcgctttctcgctcatccctagtattgtggctgacctcctgctcctcattagtggctgggaaacttgaccggccccacttgatcccatcactgtaatcatcgtcgtcgtcagcgtaagcaatctttccagaaacactgtcagcctcatattccttgtctgcagcttcaggtggtatccagatgctatcattttcagtgcatgttgagtcaatactgccacttttgccactggtactct

SEQ ID NO: 38779 - DNA, 1001 bp, Oryza sativa
gcaagcataaagaccattcttctctggatcatccaccaacttttcaatatttggaatgaacctctttgcttcctcaacacctctcctgaattgcaaagccaaacggtcaaattcagaagaccagtcggtggttatcgaatgcgcatcctgtgacccaaggagatcactaacaaagctaccactacatgcctgttcatgataactgctgctaccattatcagggtaatctgcttgactgtcaccgttaattgctgtctccttagatgaagatgggtatgccttcccaagaatatcatagaagggcttctctgtcgcctgaagtgcatcctgtcctttttttatgctgatcttttcatcaatatcctcctccatcaatattctgtttatataatcaagagttatgtttgagttggtctgacaatactcagggctgtccattatgctagacctgcattgctttaagcttctgaagcagaaatttgtgatctacaaaagagcaagtcaaccttttagaagggtttctttaccagccaatgtcttttttttttgcctctcaaaacttgctaaaatatcaaaataagtcatagataggataataggataagttcaagagttcttttatggtcctgagaggtgccacgctaattaacaacaggagttgccaatatgaatgaaaacattaaaattcggaggtactggtacctcccaggactgtaatcagcaaaacatagttttttgcctagataaactgacatgtaaaaccatctctggcacccaattttgaagattgtatgcactacttacctgctatgtaaatcatacttttgacatggataacctccaaactctggaagacaccttttgttgagaaaaaatgttggtgtatcaaaatgtaggagttggtaacttggtataccaactacactgtagaatatatcccaaatatactttttatgatgtatactactattactgctgttaccaattgttaacagcagcaa

SEQ ID NO: 38780 - DNA, 9896 bp, Oryza sativa
tctattcctagcttaggtccagaaaattcttgatatgtgatgaaccagacaggcagacggacagtatatatatactgctttgatgttgggtgagaaatgttagagagtaaaagaagtgggtgaaacagacacgatcagtttgcagatggtcacaacaacttgccatctccctccttgcacgattcacttggtacggacgcattgctcttgcttcagccttgttaccttgtactgcatctgtactatctcaatgtgaatcatgtgagattgatttcccaattcccatgcggatgacagatcacacacatcttcaagacccacacggccggccatgcatgttgagccgatcgaccacgttgattcttcttcaccgtgctgccattccatcgaacaggctgtgggtgggggtcggagttttattctccgaacccccctcgggccgtgttggattgggaaaatgagaagccgacggcggaggcggcggtggcgtgctacagcggcaggggaggaagcggcggaggccatggccggagatgaaggtgggcttggacttacgtgcggcccatatattaactaattgggccaaaaactaaacccttaagtttaggggtgtcagtgctgactgtgactggactgtgggacccggtcatcttatccgcatcgcatggaggagaggaatcgcctcccttatcctctcgccatgcatttcctgccttgagtgtgaggatcatattcatattgcagctagcgtactgcactgatcgatttgctctagctagctcgtcgttagccacccatggctgcttctcctgcttccactgccgccgccgtcgtgaatgcgccggcggccaccggcgggctgctgctgccgcgggggaggagtagttggagttggagttgctgcaacaataacaattcttcgatggggaggaggtggcgggcggcggcggtgggggaggtggcggcggaggggaacacgtacctgatcgcgggggcggtggcggtggcgctggtggggacggcgttcccgatactgttctcgcggaaggacacgtgcccggagtgcgacggcgccgggttcgtgcgcaagggcggcgccacgctgcgcgccaacgccgcccggaaggacctcccccagatcgtctgccccaactgcaacggcctcggcaagctcggccagatcgacaagtaatcatccatctctacctacctgcttcatcgacgatccatccatccatccatcatcatccagctgccagcttctgatcatctgatcactatatacatgtgtgtatctcaccatctgtgtgcgtcgtctatataactatatactataatcgttagtttggaacgctggaataattccatatatatggtctaattccagtgttccaagccggctatatatcaatcgctacttaaattcaatgtacttgtgttgctgagctactttgtctctgatatacatattcattgtctctcgctgctcttccgtttaatggaacaatattaacatgttcttactactcaccacttttgtttatatttcttcttttttggatggactggaacgcgtcgttggcacatgtacgcttatcgctttattaaattgagacggttagtataagcgaatgattttgatatatatagctccgagttaaatactgtcctttttggagtatagagagagctagctggctctcaggcttttcctaagttttgcattgtgaatataaaatggacctatatatcagagagtaagttcgatatggaattacggagtatattgcaattatcttttccctctctttgtttggtatgaaactaattagcacacttgaatagctgtgtcatcttcaacttataaactgtacaataacacaaggcaagcaccaactaagtaattaattattaatcttcctgcggatgatgcacgataatcggcaaattgaaggccaagcctgaatagagggcttggtcactttaatgacattttcaatcttaccaaagttgacaaaaaagtggcaacatttagtttcctgccaaattttggtaactatataagaaatcctaccaaaatttggtaaggtttttttttggcatcaaagtaaacaggcctagagatagcatcactacaataaagtttttttgatgaaatccagcgcgttgctgcgagagttttatgtgatattagtaaaaataacatgtaagatagtatattttgtataattttcatctctggttgactattgaaacaaaaatctataaacaatttagattaatctctggctcaatgagagaaggaaaagaaagaaggtaatatatatataaattaatcatccaaatgtaaaactaaagtgctatgacattgcaagagaagaaaaggacgaagataatttaacaatgcatcataagtgccttatgatgaattctctgcattttataaaatgtatctatgtcttgtggcagtttcatatagacatttttttatgtctataagagagtagaagcattttctagagattaaattgtaccacaaccatatccaaccaatgcaaaagaaaaggagaaaaaaaatgctttcccttgttattgacaatccttgagatcatgacttgggtaaatcaatttcatcttccatgcactaatcaacttaatataatgtcatacctgtatatttgtgccttgtgttatttatatgtagttcctaagtatgaattaacattgaaaggtgtgcctctatatagcttaaaatgtcttttacataacatgcaatttttacagtacatgaagaatttctctacaagataaaatagaatcaaacatactaaaaatgtctctaaagtgtctctctatagtaaaagttttctatgcaattttcaaagtgcctctaaaaagtctctaccctataaaactcctaattttagagccaattaaaaaagtgtctctaccaaaagtgcctctatatggggttttttttgttgtagtgatggtactcatgtcaagccgttgtccaccttactaattatatccctcacctccgcaaacatatatacttcctccattcaaaaatgtaagttgtattttgttttcttagaacaagacttggactaacaattgctagatatatcatttatgtgacacaaaagctagcacaatcataaggaagtacttttgaatatgaatctcataacatcaattttgcgtcataaaaaacatattataataaagtaactgctagtcaaaggcttgtccaaaaaaatatgccatatattttcaaatggagggagtaccatatatatgcaggtttaatctagctctagtgtcatcactgtccactatgtatgctcccgccatcgccttaactcgaagtctacttgttaattttgtggtccactatggcactatccataacaataaataaaccataataccagggtgtcctagacatggctctagctgacgtgcgtatatatagtaagctccaaaacattgctctgaccaaccgttctttttatcgctaactatgacttctagttgaaactaaaatccacttgtctgagaggaaaaaacaaaccacgatcgcatccaccagatatatgtgagagtttgatctatcactagcgcgtcatcgctatttctagtacatatgcttctgtcatcaccttaattgtagtctatctaatcttcctccttttccacttgccaaccctaaacgaaatcgaattcactcgttgatcttgtggtcgactatgcatagtaaaattgtatgtagtacatagtaagctacaacaccttggtatagagtaagtggttttttcccatcactagacaacatttggcttcaaaagccacaaccatatccaaccaatgtaaaaaaaagagataaaaagtatgtccccttgctattgacaatcctcatccatcagatatacgtgagtgtttgatctaccactagcgcatcatcgctatctcagctacaaaaccttggtatagagtaagtggttttctcccatcaccggacaacatttggcttcaaaagccacgaccatatccaaccaatgtaaaaaaaaggagataaaaagtattttcccttgctatttacaatccttgagctcataacctgttgggtaaatcaaatttatcttcaatgcactaaccaacacaatctcatgtcatacttgtacatttgtgccttatagtatttatatctagttcgttagtatattaacattatagagcttaaaattcctcaaaaaatgcctttacataacacgcatatttttaagtaccaaaagaatgcatctacaagagaaaattaaataaaatatactaaaaatgtctctaaagtgcctctaaaagtgtctctacactataaaactccttgttttagagataattcaaaaagtgtctctacaaaagtgcctctacatgtttttttttgttctagtgatggtactcatgtcaagccattgtccaccttactaattatatccctggcctctgcaaacatatatactccctccatttaaaaatgtaaggcacattttgttatgttagaacaagaattgactaataattttgcgtcacaaaaatcatactagtcaaagccttattctaacaaaacacaatacagcttatattatattttgaaatggagggattaccctatatatgtgggtcactatccactatgtatgcttccgccatcgtcttaacttaaagtctatgtgaactccctccctttttactcgccaccctaaacgaatgttgattttgtaacccactatccataacaataaaaccatgctaccaggcatgttgtcctaggcgcggctctaactaacgtgcatttgtatagtaagctccaaaccattgctctgaccaaccttttttttttcactaactatgaacccgggttgaaactaaaagtcacttgtccgagagcgaaaaaaatgcaccgtcgcatccaccatatatatatgagtttgatctatcactagtgcgtcgttgctatctctagtttagatgcttctgtcatcaccttacttatggtttatctaaacttccttcttttccacttccaccctaaacgaaattgagctttctcattgatcttgtggtccaccacgcatagtaaaattgtatgtatagtacatagtaagctacaaaaacttggtgtagagtaagtgcttttttcccttcactagacggcatttggcttcgaaagccacaagagtatagattaacattatgagaagtgcctctttagagcttaaaatgcctcaagaaaatgtctttacataacacgcagcttttaaagtaccaaaagaatgcatctacaagataaaattaagtaaaaatatactaaaagtgtctctaaagtgtccatagagtaaaagttttctaggcaacttttagagtgccactaaaagtgtctccactctataaaactcctgattttagaggcaactcgaaaagtgtctctataccaaaagtgcatgtatatagggtttttgttgcagtggtggtactcatgtcaagccattctccaccttactaattatatccctcacctctacaaacatatatacttcctccatttaaaaatgcaaggcgtattttgtttttttaaacaagagtttgactaacaattgctatatatatcatttatgtgacacaaaagtacgatcataagaaagtactttcgaatacgaatctcataacatcaattttgcgtcacaaaagccatattgtaaaagagtgattaatagtcaaaaccttattatagtagagtaatacaccttatattatattttgaaatggtgggagtaccctatatatgcgggtttaatctagctctagtatcgtcactatccactatgtatgttttcgccatcatgttaacttgaagtctatgtgaactccctccctttttgatcaccacccccaaacacatgttgattttgtggcccactatccataacaataaaaccatgctaccaggtaagttgtcctaggtgcggctctaattgacatgcgtatgcatagtaagctccaaagtatcgctctgaccaacctttttttttgtcactaactatgaccccgggttgaaaccaaaagtcacttgtctgggtttaaactaatgcgtcatcgctatctctagtttagatgcttctgtcatcaccttgattgtagtctatctaaacttcctcctttttcacttgccatctccaaacgaaatcgaactcggtcgttgatcttgtggtctccactatccatatggtaaagctggtacatagtaagttacaaaacactggtatagggtaagtgaattttccccttcattagatggcatttggcttcgaaagtcactctttcgttcgaaagcgcaaaaactaaggtaaagataaaccataccaaagcatatatagtatcaaacacgcgtcaaatatttaccgtgcgcacgtgtgttctacatgtacgcgaattattcggaccaatcaatcaataaattcctaaaaaccaagctattgatcctaaaaaatgtctatggtaatccttttcctagtgaatttacccatccatgtatacccatgcccctagctagatcaaaagcaatgcatagatctcaaaccaactaccataagtctgagatcgaagagagaacactgtaattaatactcaagcaagttaccaaaaagaaattaagaaagatgtaaggagaacaccatgagaagggaaattaaagatgtatgaggagcgatctaaagggcttattaatcatactccatgtatcggccggccgggaataaactgagtagaggtgatacattgatgagaaattaaaggaaatcgattaagaaaggcgactaatcaataaagagaaacctccaatataatccgacgcaggcaaaggatcgtcgtcgacgatgatcatggatggggtggcgagctagctagtactcgtcgcgccagcagatgagcatttggatgcagcggcgtatgatgtagaagcgcgcccggtgctccttcaccgtcttggtcagccgatgctttatgttctccgcggagtagctccggcacggcatcttcacttgctccggcgacgacgatggcggcggcggcgacttcttcaggcccttcgtcgtcttcatcacctgctccttccgcacggcgacgttgccgcctgcagcatcctccttcgtcttcaggttcttgcaggtcttcttcatcacatgcacttcccttgcgccgcctgctgcagcctccatagtcgtggtggtggtgatggtcgtggtcttcgatggagaaagagatttgaggatcgcgacgacggtgatgaggtaagctatagctatagctagagagagcggtcactcacacctggctgggtgtgccgcgcctggggtctaaaccacgcgcagccactgctgacgtgtggggcccacatcggccgtccgaggatgacgtccggccgagccgaccacacgcacgcacgagcccggtgcgggtcgtagcttgcttgctgcttcagttactctctcatctctcatctcttgctcgcggccacggccacagccactgccagcatatgatcatgtcatgctgtgcgtgcctagctttccagttgattccaagagagagaaagagaggagaaaaattatttttacaagcagtatatgtaatgtaaagtatatataacggatggatggaaattgcaatataatatatatggcaaataatattgttgctagctccatcttttccagctagcacacttttatttctttctgccacaatgaaccttgtgcaccacaggatattagctatggagaaaaaaacgaaacgatttatagttttacactacttgctgtctttattacgacgctctgattaatcattcttacctgatcaatgtcgtatgtacacaaactcaaacgtgcataaatatattcgcttctggccctggttttgatttttgaaatgttgatgtatcggatcatatcggagatcaaaacagaaaatggaataatggtcgatgcaaactaacttctatatattccactcaatcgccaatagccaagacttaattaattacttaaccaacactaccagaaactgaaatacccctgacggccgcaatttttactgacgtgtgtgcatacatgtcaggaaattgaaccctgacggacatatgtcaggcaaatttatttttccccgacaagctagttctgacggtgacatgtccggaactattttcctgacgggattttctttatttctgacgggatttagccgtcagaagtaatacaatttctggtaagatactcaaattcccacgtagatacgcatatatatgcttgcacagtaaacaaagatgagtatttatttaattttacatctctttcaaccgtatatatatatatactccatcttgtatagttcactgtcagaacatacgcatggttacactatagttacattacatttgaaagttaatttctttttagaaaaaaaacttatattacggtagctttttagataatttcaaattaacctagcaccggcagttcccgtgcaaaacagggggctagctagcttgcatgctagccatgcatatatagctttgatttttgttttcttgtgcttttcagggcttccagaagatgcagatgattgtggagtagaatactctatatcctagcttgctgcttttgttcgtttgttataagctttgtatggatgaaaaaaaagttgtttttaattaattacagaatgttaagaatctctcaagactctcagtagtggtatacccaatataatagtgcacctgacatgcatgtgaaagttaacggatggatgatatggatggatggatatgatgctcatgattccttactatttggagaattatctttcataatattcatatataatttacatgttgttaaattatacgatttttaaaaaaaagaattgatggtaaaagattaaaaaatatttgacttataacaaagctataatggcatctaatttaaaacagagagaatatcgggaatgcgtgggccttttttagggagataaatgcatagacttatagaaatagatgacttcattcatcaagatttaaattttagtgttcacgtatattacgcattggtgtgcactttcaatacgatttttggcgaggtcgagagatacccatgtcgtccatctatttaaccatgtgttatatatggacacacacatatgtatgtgggtatgggtgtgatgtgtgtgcacgtattcggtgttatgaaagaaagaatgcatataagttttacttgtcagtttcaagtttctaagtaattaactttgcgtcaacattatttgttgttgcgatttttttaaaaaaagaagcactatatgaatttgtatagaaatagagaacaaaatgaaaggaaagaagtagcgtgagcttatagtgtttcttcttgtagaacctgttgactcgggatttaagttacgactacttatttgttactaggggtgaaaagaaagctcgggttcgtgagcttagctcggccttggctcgagcttggttggcttggctcggctcgtaagccaaacaagccaagcccaagcctcctttttagctcgttgctgaaatgagccgagccgagctagctcgcgagccgcttgttttggctcgcgagcctaggccatcgtgtgtttatattgattattttactttatatagtgttattatttgtcaacttgaaatttatcactaagattttgaagaattgaatataaaaacttatttaaattttacatgttgatgatttgtttttactttttttcaataattacaaaatatatatgaataggtgtttcaacaggaaagcttgcaa

SEQ ID NO: 38781 - DNA, 1957 bp, Oryza sativa
accaaaataattttggcacgtgatatataaccttgggtattatgattctatagttttacaaaatcacacctttaaccattttgatttacttttatataaaaatttttaaaaaacggatgtaacatttatatgatgggataaaatccttataatttgagatatgattgtaaaactcaaaaatggtattgcgaaacttaagaaccataatacctgaggttatataacacatgccaaaatacttgtagttttgtgtaacttagactataatattatcggcggagttttatgaaatttagtgaaatgaaaggatggtaaaatggaacgcagggaggtccggcccacagggacatgcggcccagtaatagaagaagtcgattaggagcagcgggaaagcgataaggaaagcgacagccatagccactcgctgcgcctcctcctcatcgcctcgccgtcgccggagaagacaaccatgaccaccatcgccgcgcggatgccgtttgcgggcccacgcctcaggcctccctgcaacctcaccgcctcgaggccgggtcccaggagggccgggctggccgtcgtctccgccgccgccggtggcccgcttcccaccgtgctcgtcaccggcgcaggcggccgaacaggtgcaatgtactccttgcggaaacccctctcatgcccctcctcgccatcttgcccatttggttcctcgtgttcatcgaatcgaatcgaattttcttttttagataatggaatcgattttccttgcaagaagaaagaaatctagtttcgtgcacatctactcttgcaagaatttgactcggttttcccttttgcacgctgcaattggcctctctgtgatgatgatgatctttcaggccagattgtgtacaagaagctcaaggagagggcagaccaatttgtggggagagggctagtcaggactgaagagagcaaagccaagattgggggcgctgccgacgtgttcgtcggggacataagagatcccgcgagcattgctcctgccattgacggcatcgacgcgcttatcatcctcaccagtgcggttccgaaaatgaagcctgggtttgatcccagcaaggggggacgcccagagttctactttgaggatggctcttatcctgagcaggtgattaaatgtattttgtgtcactcacattttctgtatcaacttgtgccttcatttgaaattgatgttttctgctatttgctactctttgaaggtggattggattggccagaggaatcaaatagatgctggtaaaacatctttgtcttgcagatggattctttgaacttgtttcttttcagctatgctgttctttaaaccagtattatcaatgacttgttggtctagctagcatagctcctttttttttcagttaattcattccttgttcatgattcgtttatgttttttcgtcatcttcatgtagccaagagcattggtgtaaaacaggtggttttggttggatccatgggcggcacagatgtcaatcacccactaaataagttaggaaatgcaaatatactggtatataacatgtgcaaagtctttctttcttctaatttattcatctttatgtgtgcgtgttcatatgtatgcatgcatgagcacatcatatgcactgtttacaagctcagaatactttaatgttctttgaattcgcaggtttggaagaggaaggcggagcagtacctagcagactcaggtctaccatatacaattataaggttgtaaagcaagacatctcttgaaaatatagttgtgatttgtgaaatgcacgttgtcttgcagtctacataattttactagcacattagctttctagaacatggtttcacctttcttccctatagctataggtgcctgcagcctgatcataaactcaaaccttatgtatgtctgtcaggaataaagaacaaaccctcagtgcagttg

SEQ ID NO: 38782 - DNA, 2066 bp, Oryza sativa
tacctacaactgatttcagggctcttttttcgcaagttaatagtcgcttctaagaagtataatctgtcaacgaggcacaatatttgtgatggaataatatgaagtgtgtattgagtgaggttagtttcctagcatatatgcattttttttgttcatccttgtattagtaggcagttgattctgcatatatttttaattatctgtgatctttttgttacctggtactgttttgagaaaaaaaaagttcgctaattgcataccaatataacaaaggcagttacttattactcaatcattcaatatcttcaaatcatttaagagaaatacagatgattgctatagtaatgcattcacagtaagagtatgttaagagcaaatttagttacccacccctaccgagaactccttgttcgtattaattggaaaaatacagagagcaaacataagtcggaaaaccaagccatcttccaagatcatctccaatatccatcaacacaagaaataaattgcaatacttagaacccttatgctgatgattgcataactagcttttgagaatattggagactgattgagatctgctttggtctttctgattaccacatgatcacctaggtttccactttccatgttgacagtgcctgtattatcctccccttccatccctgcagcagccagccactatcttcatcaattacaaagtcttcatgataaaattccttgtaatgtactgatctattcagaatggcttgattaacaggacgttgcttgaacccagccctgaggatcctcatttgccactgtttgtagctttctggcctctcaatcctttctgcaccttcgcatgctacagcattaagtgcatcattcccaaagagatccttctctaccaatatccttgcttcatggttctaggaacattgttgtcgagcatatcaaaaagtgatgagtaatggaataaaacctctctgaatctagtcagaaagaatggggagctgtacaatccattcacaacaccaagaatgaaaacctgcgggttcatcctcttcatcatgtgtagtaccctatcccttgcactatcaatgttttctgtctcatcacctagctttctcattcgtgacatgcagttgattatgagtacctcatccttgtcaatactgagatcctcgatgcagatagtttcccatcttgaagcaatgccatgatactggaaaggtacgttgaacatatttgcatactctgccaaccgctttccagtctcctcaatcctttcatgagggcgaaaaccaggctggggtacatctacacctgtgatacgaagcttaggggggccaccttctcgctttgcaagtcgctgaattagacatggccactgaaagccgaagaggatgccaaaatcaacgatatgcaatgttgttttcccctccaatgcatcaatgatggttttgttggagaagtagtatgttaccatctcaaaagggcatgctacaaaatatagatgataggcctttagcatgtctctggtgctcgtttgtttcgccatcagtttttcgtacatttgactcccagtcccagccaagcgagcctcgaggccatctgcaaagcagtttgctagcctctgagaaccatctccatctggcaaagcgtgatgccttattttcctcagtagctcactagcaaagggatggttgttagatgctatcgcttgtgcacattggatgagaagaacactgagatctattgcctctttctgtttcttcttactactgtgtggcttcctttgcccttttccatatcctttgctttgaaatttctttgggttgtcgcttgcttcttttgccatcattcctctaaggttagcaacttcaccagggagctgcctattgcagagcagaatactatcaaacatttcatcccgtattgtttcactagtggagatggccatatgcttactgttccttgcttccatcaactctatgtgctcaacatgaggatcatgaggatgattccttattttgttctcatgcttgcccttctgttctgttgtctctgttgtttgtttgcag

SEQ ID NO: 38783 - DNA, 673 bp, Oryza sativa
  unsure (1)..(673): unsure at all n locations
aattcctgcagcccattttcagcaccctatcccttgcgctattcatagataccatctcatcaccaagattcttcatcctgaacatacagttgactatgagcacttcatccttgtcaatgttcaggtcctcaatttgtacggtttcccaccgtgaagcaatgccctgatattgaaaaggcaccnttgaacaagtttgcataatcagccaaccgcttccctgtctcctcaattatttcacaggggtggaaacctggctggggcatatctatacctgtgatcctaagcttgggtggacccccttcttcatttgcaagccgctgaatcaatgatggccactgaaagccagtgcaaatgccgaaatgaacaatgtgcacctttcttggttgctgccctttgatgcatcaagaatagtttggtttgcataggcgaatgacgccctttcgaaagggcaagctgaaaggtagaggctgtaagccttcaacaaactctcagcactggttcggcttgccatgagcttgcgatacacctggctcccgatcccagccaagcgcgcctccagaccatccaccaagtaaaatgccaacctctggttactatctccatctggtgaagaatgctgtcttatcttcttcactagttcactggccgaaatgcggtcgtcagctgctactgc

SEQ ID NO: 38784 - DNA, 2884 bp, Oryza sativa
tacaagctgagttgctgctgggaagaacaggaagacccatcatgtggctgttctgtttctgtggtggtgtattgattgtcaaagggaagctcaatcaccatttgttttttttttttttgccacctgaaaactgaatgacagatatatcctgtcccacagcaaatgaattcagtttgttgtctgtaaaagggaaagtgaagcaagttttgcatgagacagattctgaattcttcttcatgatcacggatactcaaaattatgttcagcctactcatttggtagaattcagaacatttgcatccccaaaccatagaaggttgtttataagagggaaccgcaaccagttagcgcattatttcctcaccctttttttctttggaaattcagcttataattgattcggtgtgaacttctatgaaaacaagcaaaactatggtctccagtaacaaattgaattgtgttgcataaattacacaacagtacacctgaagtactcgtttctaacattctgaatgttgaactgcaggaggctcctgatggaagagctcaagaacattgttgtctgctaattatggaaaacaggcaagtagttaaagtagacaaacacgcaccttacttatcagcagttccaattcagcaacaacatcatatataggttccttgagacacagaagtgaaggaagaggggcatgggccatgttcatttcagattatatagagatcatgttgtccccatgaaatgaaggtggttttccaatttcggtagctaatgtttggtagtgagaccagtgtcgatgtaaactaaaatctttgtatgtatctttctttcagggttcagattgctccaccgttttttggggggatattcttgatgcaatataaaaaaaggcgaatattagggatggcttgatgatctaaggctcccgtacatgttttttgcgagaaagtagctagcgagcccagctagaaacaatccttcttcttaagataatgagctaggaacatccttttatttgtccatctgtagttaactacaatgccttggcatcaagaatctccaatcaagaacacgttcacactataatgtgtctagcagcagctagcatcattatcctaaaaaaatttagctacatacataaacatttaaaagagtaaagtgtattgctggcacttaaatttgttcgtcttatctaggtccttgatattgttaaagtgtattattttgttctcaaattaccatgacatctttgagatcctatatggcactcacgtgtcaaattaccacgacacctttgagatcctatatggcactcacgtgtcatgtcacacgggtgttaactcattttctttatatttttctctttccttttcttctcttcttcgttcctactcgtgtgggaaaaaaatgagaaaaagaaaaagaaaatttaggaccggaatatccgtgtggcatgtcactttagtgtccatgtggcataccttgtaggatcccgaagaggtcttggctagttaggaccggaataacacacttaacaagctgggggatttaaaaatacattttaagagtttggagatctgggatgtcattgataaacaagtttagagatcgacaatgcacgttcgtcttgtttaaacaagacaattctatttttaagataatagaagcttaattgagctcatccaattacatcaaagtgatataactgtattgagaacactctcggactttgcataactaagttatgcataaccaaaatacacacaatgtggttttaaagtgaaagcaaatacaaaacacggggagaattaagggccatcaatcttaaaactaataaatcgctacccacgtttctgggtaaaaaaaaaattccatgctccaatctctaacatgccgcagtagtaaaatcaatctcggtttaccatatgctagcgacagagaaagcatggttagtgtagctgtctacccattttacacttagcttcactcaattggacagtctactggtgacatcgatgaacttacatccaacaacatactccatccgtccttaaaaaacaaatctagaattagatgtgacatatcgtagtactatgaacctatatatatctaggtttatagtactatgatgtatcctaaccggtactaggttgatcttttataggacggagggagtatatactatttcgcagagcacacactgggaaaaaaaaaactaaaacattaaattttggaccgaaagactaaagcatttacggcccaaataagcagacgtgtgtatccggcccacttaaaggttggttggtctcttcttcttcctcctccatcccctttgccctcctgctgcgccgccccaactccggcgccgcaacaaagccatggccaagaagctcggcaagtcgccggtggcgaaggaggaggacaaggaggggctcttcgcgtcatgctccttcaccgacctcggcctccaccccaccctctgcgctcacctccaaggtagtttttccccttcgacaagccatggctggttggttcttggatcgaatttagagcagaccattaccgagttgatgtcaaaattttactattctccgacgcctctgactgattttattttgttatctcgtccaacttccgtgacaagtttcacagcatgctagcatagggtttatgaacggaaatgaagatatatatattctttttattatagcttggtaatcaaacactttggtcgtctctttgatttagataagatgggcttccaagcgccaacaagaatccaagctcaggcaattccagtcgccatgtctggacaacacatgtatatgctcctttttcacaataccataactcctttgattcagagacttcttttttttatttaca

SEQ ID NO: 38785 - DNA, 15756 bp, Oryza sativa
  unsure (1)..(15756): unsure at all n locations
ctatgcctacaagtttatgggattgcacagcagttggtgcatcgtttccactggcttgtccctggttacataatgggtggtgagaacagagcaaaagaaaaggcaagattgcgaaaaggtatatcttgttcaaggacatattttgtatctcattaaatatacttttatatagcatcatatattgaggacatgtttattgcaggaatatcaattctaattgctactcctgggcgtcttctggaccacttacaacatacgtcatcatttgtctacccaaatatgcgttggatagtttttgatgaagctgacaggtctgatagccatacattcattactcggtttaccctatttcttagaaggtttttaagtgaacataactctttatgttattggtgctcatattcttgcagcattcttgaacttggttttgggaaagcactagaggatatactagagcacttgggttcaaggaatgatacttctaaccaaaataaaaacaaaatggaacctatgaaaaggcaaaaccttctgttatctgcaactctcaatgaaaaggtgaatcggttagccaagattagtttgaagaaccctgtgatgattggtcttgacgaacagaactccagtgcccatgggaagaaccacacttctctattatctgatgatgaagaggaaatactggaaaagcacaacgttacagtggaacaagcagttgacgatttcaagcttcctgcacagcttgttcaaagatatgttaaaggtagcagaaaattgcctccttatatcattttaagtcatgttttccctttgctcacttagtttttatatttcattcagtttcatgtggttcaaggctcgcgattcttcttaccattcttaaatctctgtttgaaagacaactgtctcataaggtaaattctctatatccagaccagaagctgcttcggtttcactatgttgtaacttttccacttcaagttttgcttgccaccaataaatactaaaagtcatgtgagttaaactattctgcgtttgtttgtgtcttctttttgcaggttgttgttttcctgtcaacatgtgactctgtagatttccaccatacagtactcagccagcttgagtggagccctggcctgcaactggatacggataagaagcaaaagtttattagctgcaaagtgttccgtttacatgggaatatggaccaggatgatcgcaagaaatcatttctgggattcagttctgagaaatctgcaattcttgtatctactgatgttgctgctaggggcttggactttccaaaagttaaatgtatcatacagtatgattcacctggggaggcttctgaatatgttcacaggtacctgaagcatctccctgtctaaaacatttatttgtaggtttctgatttattgtttccaacatagttataattgtattatttgattgtatacgaacagacaaaatgtattgttgcagactaaagcactttactctttacctggttcctttttatgtggtagtattgttcattgatttcctgttacatgagactgtttttgtcaaaactctgcaaagtttttagtcttttgagtgctattctgtcatgtaatttcttgtgaagatgttaaggcatttgatgtaagctaagctatagagacactttctcttgtgcttcccttttgctatttatgttcttttttttgtttatttcaagtatcagcaactttattcgtttattttagggttggaagaactgcaaggattggtgaaaagggggaggctctcctgtttctccaacctattgaaaccgactacttgagagatctagagctacatggtgcatcacttacagaataccccctccaaaaggttttagacagttttcctgtaaatggacagaggcttcacaaaaggaagcaaatatctttagatatgcatccatggataatgtctttacagagagcattggaaagttttgtcacatccgaggtaatgtatagaacacattttcgttctgtttcttggtatcatatttggctactcatgcacaatgagataaatagtgcacaaatatgattccgttgatcgtctattgtgaataccatgagcttttgaccttttgctgatcttagcaaatgcattgtcatgtgtcctcttatccaggacacgacgaagaagcttgcaagagatgccttctgttcttgggtgcgcgcctacactgcccaccgaggtgaactgaagaagatttttatggtcaagaagctccatttggggcatgtagctagaagctttgggttgaaggagcaaccctccttgttgggaaggtcacaccaggtgcaactcaagaagaggaagaaagaacagaagcgcgaaaggcctgcaaaaaggaggaaaatcccggccaagagatgaatctccatagcagaaatgcttgtaactcgaaaactaatggtggatcatgatccactccaattttgtggaactaacagccgcagcttgaaggtgaaaacattgaccccatgaagctttcatgttttggccagaagcctagagaagagctagtgtactgcctgtaatctgaaatgtatcaaaagacacagaatgttttgctcagtttgggattatctactgctctgctagttacccattttaatcagaaatataatccatgtgtttcttccttacgatattgtttgctcaaaatattatccatgtaaaaactggatttgttagaaaggcttattggctggatgcaattgaatgatacagtacaaatgttctaactcggtaagcacgtttttcagacaagcaatgttctacctcattgagttaaaaccatactatcaaaattacattgggactctgaaaggaaacaacattactgcctttaacggttttcataatacaaagtttgctctaaatggcccccttaatctacactgttctggtgattccttcctgaccaaacatggtgcacaaacttccatccatgggcaacatgtcatcagaggagcttctcaaaagtgaaccaaactgtatatgagtgtccatgaaagctgcagcaaaaagaagcaaattcagtttcgaaccaaaacaaacggaaacagggtagttacagaaattggttatgtttttctttttaccaggaaaagagtgaaagaggcaaacattccctcctgaagtagtgctccatggcctccaaagtcttcctcatcaatcttcaacaggtatgcatagtaccagtaaacgagcccagtagaaatagtcacaaacctgtgtacaatatatgtcatatgttaagaggaacatatcaaaagctcagatgctggtattaattaacgatctttacagagttcactgtgccatacagaagaaagaaaacagtaattactgaaagtataataatgaaacaataattacagtaattctgtgcaaggtattgcttactagtgtcatataaacagaaataattactgataattctgcataaattttcagggtactcagctaccgacaggttcgataatcatgcttgcaatgtactccaggccaaattaaattgtattgccaaaagctcatcttaagtgatacagcacatgaatctaaagaacctagtagcattcacagtttcacacactaattatactaaattcaagatggatgtttgcgcatgcttgcttatagcttcagggtcttctaattatcagcaattaaaggttcaacgcacagttaatcttcaccgaagataacctaaatgcatctagggcagcagatgtgcacgtatcatcgagctaagatcttgcagttacaggtgtcaaaacaaccaaaatccacaccaaagcaaaaggtggattttgtagacaatgacctcctgtagcgcagatcccaattcccaactaaaaagcagaaaagttattaacatatgataaatctgatcccctatctgcactacaattgaactcctcaatgtgaggaagagactcaacaagacacatctgactacaaatccacgaatccagcatagggcgagatgggattggaggcgtgagcaactcacagtgcgatccagatggcgccgacgagggggacggctccccagagcaggccgcaggcgaggccgagcacctgccggatccagtgcacggcgtccagcagttgatccttttgcaaaggagagcccagccaagcaagcatccatcaggcaaggagaatccggaggccgccattaatggcggcaagaaggaggaggaggaagtataccttgtcccaggaggcctccgggtcgaagtacctggcgagcttggagtgtccggcgccgccgttctgctgcgcctgcgcgcgcgactgcttcgacggcttcgtcttcctcatctcgctcggcggcggcggcggcggcggcggagatgggatcgcgagggagcagtcaacaagtctatggatggagctggtttggttggtggcgattttgcagatgcctccttggaaagtttggatattgcatttacgtccctactagtgatggtcggctaatgattggtccatcattaacatgtcatctcattacgtgcaaacatagaaaaataagagtaaattttataaagctgtaactttagtgacaaaactatcagtttgctgcaacaatagcgtcggaaattatcacaaagctgtaacttttacgttatattgtcacctatatgtactatagcagcatataaggtaaaagttacagttttgtnataatttcccacgctattgttgcagctaattgaagcatgtcactaatgttgtagcaaactgatacggagtagttttgttactaaagttatagttttctgaaatttactctagaaataaaaataaaaagctctttatcaaagcctaatttcgagcatgagaattattccagattacaaaattacagagtttcaatgaattttctactatggatcattggagagcaagccgagaggacacatctttcacaaaatcagtgggcgaaattacagcagttcacctcttaaaaaaaagagagagaaaatcccataataacactataacagttcagtacattggatagaagtacaccatgagatcactgctcgctaaacaagcgattcatttgataagggaagtactaacacacaacgccatcaagtacaagatctgacaagataatttgaatcatacatacaaccggcaatgagttccctgacagttgatgaattatttgaagatattactttagttactttcttggatctacaatgcttgatcagttaaagagccagtctgctcaggtgacaacaaattgcctcagctgacaactcacctgattccctgcaggaacaatgtgaaaattgtcaagattcattatccgcctttcactgtgattagtagtatcacttatcattcatgcatagaatgcaaaaaaataaataaataaataaataaataaataaaatcacatatccatgttgttgtctgccttgaaatatgatacatcatgcacataaatttggaatgctcgaaatgttatggataggataatggcccgaaaagaacttccaataagcatggtgcaaaattcagtgacagttgttcatctaaggaattcatatgtaagattgcagattgcaattcttcctgacagggtactaacccagtagtaaaaaccatccttgactagcctaaaaggtgtaaacctcaatgatcattcgtaccaagttttgaatcgcctgaatgcaaagttcacaagagcctaggaaggaaccagcaaagccctattaggctattactactaaaaactcaacttgtgcaaaagagcaaatgtgcatcaaagcaaaagggcatattgcctccatgaatatgcataatcaaaatggttctcccactcagctataacatctgtgggaagtgagtagaacattctaaactgacacttgagcctcactgctattttggctcctcaaaatataatcagaaactggaaacaaattttaggagaagagatggttaccacaaaatgtggggagcgccgcacaatagataccgcagaaccaggagatgctgctgatagggcagcagctcctcttttagaaggtagattccgccccttgttcttactctgagaaagactcttatcaagaacattttcagttctagagtcaagtggcattaacattggaggtgaaactggtatagaggaagcatctggacaaacaactgaactcatgagaagacctcctgcggaaatcagttgcacgagttagattacaaccaaaaaaaaggaagcctgtgtgcataaatatgggagcaaacaaaggatcggtactatgagaaaagggaggatgagaagtcatgaagggagagaaaactagtcatgtctacagtgcacattatggccagttgcacggcaatgcagctggagctgagtacacagcggcttggaggagagtcgtaattttccgtgagatggctgttaagtgttaacagggaagcttatgggtaatgcttaggagtagatcaattacatagcatatttatgtggttccagtacttgatggcaatcatggcatatctgtagtttggtaattagatcaatctgctaaggatatggcatatttaaaaaggctattgtgccacttgggttgaggacacctcagttaggactaaaggccctatcccctaatccctaccatgttcattgcaacgacaattcatactgacagttaatgttcagtaccattcacagtagcagcctcagcctggaacctttctctgacgattcttacaaacttgaacagatcgttagtgaggttcaaatccttcatcaactcttcagaatcttttatacttggatcacattgaagtactgttgttaggaaaaaaaaagataatgtcaagtacagctcaaaaaatcaagcattcaagacacttggccaagtttcatgaggaacttcaactcacagttatatcgatctttggcaagctttaaggtaaccgagtactccttatcagggctttgcaagtctattttgttgaagatgaactttacaccttgaggaagaacagggcaaatgccatgaaagatggaattggcataatttaggggcgattccttatattcctcagtaaagttcacttcatcccctatgtgccactgttgtcccaatgacatgtgggctttaaacccacgagtcagtgagctgataagtggcatataaaggataagatgaaatttaaaaggcataaggaatttatcccataatttacttgaacattgagctgattcatcactcaccttctcctccaacaacctggaaaccaaggaacttgctgtaccagattacagcttcttctattttcttcatccgtgtttcatcctcaataaactttgcttcaagagcttcaacagctgccacagtacatgaagtatatcactatcgtatgaacactatatgtgcacagttcaagaaagacattttctaagactagcaatataatgttttgaaaaaccttaaataagccacagcaacaaaaaaaaaaaacccaaaacatagccctaaaatgataggtaagttaccctcgaggtgattcgatatgactgcagcatggtgatctctcttgttccgctgatctgtaaccatgccctcaagcttctcatttatagccgcagtgcttgaaatcgtctctttggtaagttggtactttgactccttgccggccttaactgtaaatacagtttacaccaagatttcaggcataccatgaaccatttggcagcgaagtgcagtttaatttaccagacaatgcttctgcaagaccatcttccaaattccgcaactgaaggttgagtccactcagttcctctgcaccatccaaaatgttatgaaaataaatgcacaacagaaacacaaattttatcgtcgaacacccttacaggaaaaagaccatggacaccgactggcaatgatcaatgatcactattgaggtgctaaaaacgcaggggataacaaggcggacaaccccttcccatatggcttacaagggatatataaaggagaaatgtaggagccctaacagataaaagattagaagtctactaggaaactataagagaaaacgataatcctgtaatacaaagtcctattaggaaactcatcggaatgtattgctagctgaaattcagcaatatttaacacaaaaatttcagcactcatcggaggggaaaccgggtagagttacttcaattcactcaaattcaattcacattcagtaccaagtaccaaccacattttccaaataaaataaaatcgaagatacatcagacacgcgtccaaagttcatttcgcacaaaaaaaaatggggggtgtttattgaaacgagagagattgagggggtggggggagggattaggggagggcgttgccttggcgggagatggtttgacgggcgatggagcgggaggagagaagcgcggcgcggtagttggcggaggtggaagcttggcgctccctttcgacggccatcccgcgctggtacgccgccagctgcgccgccatctgccggcacagctccgcccctcctcctcctcctcgtgtgccggcggcggtgcctccggcttccatgctaccaactccctgggcactggcggcgtccggcgtcggcggcggagggatcggcggcagccgacggtggccggagtgcgggttgaagtgaggagttcgaacccaaaatttgtgagaagaaatttctcctttttggtctgagaaagaagaagaagacaaagcgggatccattccattgtgtgggcctttttgtgaagcgtattgggcctcatattgggcttaggcccagatcatcttgaagaagagctgtgcttttacccattttgaaggctaaatttgaccatattttctccactttactcatttgactctacatttcaaaaatgaagttattgtcttatcctattctctgaagcaagttaacggtgttgagactagagctcaaggtcaaaatgtcatttatgcccttgcttatttgacactactttctcacaggttctgttcatttggttcaattttgtgcccttactgtgtagtataaaatttgtaatgaaatgacatatctctggcagtttaactgaatttgacatatccgtgacaaagttgacttagatgtcacaaaatctgtgaaatctaagtgaaacaaaacctattatattgttaaacgaatagaaaaaagagcctccacgttcgctctcatggcctagaaattctcacattaatcggagaaaaagaaaaagcagagtccatatagaaatacaatttagaaatagttgaaattcagaattaaaaaataagaaatattagaataggagactagagtccatatagaaatacaatgttgaaatagttgaaattcggaattaaaaaataaggaatattagaagaggagaatagagtccatatagaaatacaattaggaaataactgaaattcgaaattaaaaataagaaatattagaagtagagtatagagtccatatagaaacacaattaggaaataatagaaatttagaattaaaaataaggaatattagaaatagagtataggtccatatagaaatacaattaagaaaaaaaaagaaattcggaattaaaaaataaggaatattagaagtatagtatagagtccatataggaatttaaaactaactaaaatttagaataaacataataaaattaaaagtagagtttagagtccgtataaaaatacaatttacaaataactaaaattcgaaattaagaaaaacatgggaagataagtttaaagtcaatataggaatacaatttagaagtaactgaaattcaaaattaaaaattaaataatattgaaagatgagtttagagtccacatagaaatacaattagaaataataaaaattaagaatattggaagaagaggatagagtctatatagaaatacaatttacaaaaaattcggaattaaaaaaaagaaatattaaaagacgagtatagagtccctataggaatatatataatttacaaataactaaaatttgatattaaaaataattaataactaacacatatataaaatacaatatgaatattacacattagtaattttgtaaagttattgcaaaatttaaaattatgttgtcattttaatatatttgaataatataatgacaaaacatatatgttattatatgagagaaaatataatgatgcaagccgcgcaaaattgcgcgggccaccatgctagttaaaaagaaaaacaaaacctttgagaaattagcagttccaaaaaaaaaatccaactgaagctggatgtatgacataggatcgcccaataccggaaagatggaaaggcacaaaattaacaaattctgctaaagaataccaacaaaacaaccacaagtcgtagagcgaagcgatgcgagggatgatttccagtcggccacaagatcgatcaaaacctgtgatgactgacgagacaaaaatgaaagaaacacagccaattcatcatcatcgaagaagaagaaaatggataagatcgtgtggtgcagagtgcgcgggagatacaagtgcggaagcaatcgcagccacagccattttttgtgtacacgtagacgtctcctcctctttcttctccatctccacgttttttgttttatttatactactccctgttttttagttttatttatattactccctgtattttagtattttaatgtataacgccgttgactttttaatcaacgtttgaccattcattttatttaaaaatgttatgtaaatataaaaatatttatgttatgcttaaagaatatttgatgatgaatcaaatcacaataaaataaatggtaataatataaattttttaaataagatgaatagtcaaacgatggataaaaaatcaacggcgacgtcgtgcattaaaatatgatatgaaggtagtatttaatttgcttttgtttcctccaagcaaccaccacctccactgcgccggcgtcactaccgaccgccgttgagtcgtcgtcgtaaatatcccacctctcctctccggggcagccacacgcccctacctccaagcttggagagactggagccatggctactgccgccccgccggcggcttccggtgcccgacgcctcggccggccgcgggcggggctgcgcgtcggggcagtggcggcggcggagggcccgtcgtgcctgtacgtggggcccatcgagacggccagccaggagatgctcgaggcgctctaccatcaggttccttcacttgcttgctgcttatcctcttatttcctgctcaatcattttcttatactgccaataaattcaccccctatacgtgttatcttgcttgatgttgtaacagtccccaaatgcttatcccttaatgcatagaaatgttggaatataaagtgaattgtccgtctttcctcatcagcaacacaataagaagtaatcaccatcttgttgttttttctctattgctgttttgataggccagggattcctactacagcggccagcctttgattgtcgatgacatgttcgacaaagttgaggtataattcttctaatcttttctctatctatatattcagcatatatgtactcactactcagctcagctaatatgattcaacatgtaaggctttaagatgtgtaacaaattgtatatccatgcccagttgaagctccgggtttatggatccccatccgtagtgaagtatccccgttgcagcctcaagaggcaatcgacgtacgcagacgctgaggttaccttttgggagggaaacaaattcagtatctctacatttgatctcacgactctggcaatactttcgacttacagtccgatgtttcgattggcttttgggtgtagggcaggaggacaaatcaatgttcatggcactctcaagcatctggatgctgctgctcttgtttggcacatcggcatttctcgttccctctctctgtattctaagcctcacttttggggatgcattcggagcaaggtatctcttgtatggtgcaaaatcgtttgatgtgataactagggtaaatgacatggttttaatcggattgggctatctgattggttatccgatttcatctgcatctggtaagggaacttctttgtaaatattccgcggtacaaggatttcgtgttccctgatatgccatgttggccacatggtacaatttttatgcgttgattaatcatcttcttatttttgttctttcagttggtgcactgcaaggcttgctgacaaacaatttggttgcactaaaaggttcttgcccaaattgcggtgagcaggtcagcttccttctacaagtagccaatttgaatgtttatccatatttcatgaagttcatcttttcggtcatctaaagtgtaacctgttcctgccaggtctttgcatttgtcaagacggataattccatcaaagctccccatagagcagaatgtcatgtctgcagctgcccactggagtaccgcactaaagttgaggtatgccaaaaacaacaatgaagaacaaatagctgaatgaaaatgtctatgacagtaaatggcttggtttcagagtgccatatggtataggagagggtgatcattttagattttggtgcatgctgtatgtgtagtttgtgactctaaagaaacaaaacggataatgtctactttcttgacattgttatccagaaatccttgtcgggaactagaagaacatgggtttatggcagagtttatcttgtgaagcaagggcatccaaggaagcggaaatggttgaaagactaaattgccagtgctagatgctgaagaaagtttagaggatgattttaagttatgtggctattctgaacttctgattgactgaaacatatttagagatgttgctcttactgctccaatgtgcttatttgtttctctgttcaaccaatgtatcttgtaaagtggtaaattccttggaaagattgccaaacatgaacaaatgttaaattgatgatgcagtattatgaataatggcgtgccttctcatatatttgttcattagaaatttatcttcatacatgaagtatgaatggcaaacagtggtctgttaagagcaagttcagtaggatcgaatttgttcactagatgttggacactaatagaaaatcatttatcctgttcgttcagcaaagttgcagataaaaaatgtcagacagaatcatattcttattgctttaaatcgcactaagcatactatatgtaaccaaatcatttcttttttctattcgaagagaacattcatccaaaactggtttcagaggggaagatctagaactcaaaaatatgatctggggcagcttgtagatttaaaaatcaggaaaaactggatctgggcacatctgttgcctcgaacaaaaatttcgcagcattagaactagatataaactgtacaatccacaatgcactgaactgaatgcatgcagatataggcgaccacatactttttacttcagacaagactctgactagaagctgcaaaaacaactaaaacaggcaagcaccaaggattcacaactctcctcttctttacaggtccctctaagagcctacactactcatctcaacagatctatatctgatcatatgatatatgattgttcacttaaaccagcctcgcatttgcgggcttccccttcgatgacggtttcgatccattgctgcctgcgttcttgctgctggacttcttctgcagctgaggatttgcccctgtctccttggaatcctggagctgttctaatacagcaacaacctgctccatgttaggcctgttcttggcctccacagagatgcattgaagtgccagtgttgcagccttctgggccttggcaagggagtactgcccgcccaaccgggcgtccaggatgcggaagatgcgccgcttgctcatcaggtatggcctagcccactccaccagattgtgctccccggttgggcggttcttgtccagtgctcgtcgtcctgatagcatctctagcagcacaactccaaagctatagacgtcgctcttggtggtcagatggccttcacaacatacagagaaatgtgtcagttaattcaataatagccaaatcactctatgtttggcacccagatgccagcaagggaaccatagattgacagtaaacacgatgtgtaatgaagctcaaatctttgtcgtgcatgttcattcattgtgatgaaatgattacattctaggattcagaacatggaagtaatatgctacctgttgcaaggtattctggtgcagcatatccataagtccccatcacccttgtggagacatggctcttgtcaccagtcggtccatcctttgccagcccaaaatcagagagctttgcatcatagttctgaaaatacagtctgtctatcagatcaccagttaagctatcttgtgaacacaaaggataatagttctgaggactccgtaccgcatccaaaaggacattagaggtcttgaaatcacggtagatgactttaaccttgtcactgtggagaaatgcgagcccttttgctgctccaagggcaattttcatccgaaggttccaggagagcggctgaaaatgcgtactccctgcattttacaacacattttagcatgttgtattccaaattgtaaatcagaagctagcaactaggaaagtacaaaaaaaaactacttactcctgaaaagatgattttccaagctaccacgtggcatgaactcataaacaagaagacgctgctcatcttcgacgcagtacccaacgagccttacaagatatgggtgtgacaactgtccaagataattcacttcagcctgcacaaattgaaaggaagataatgtcatacacagtgcaaacttgacaggaaagaatcagccagtgggtactaaccagccattccctgtgaccctggtggccttcctgattcaacttctttacagcaatgaccatccctgtgcctggcttagttggtgcgagcgtcttctcatcgatccaccctttgaagactgatccaaagcctccctcaccaagcacactgtctggccggaagtttctggtggcagtcctcagctcattgaaggcaaaggccttgacatttgctgcctccaggatctcatcctcgctccgtggtgttggcggcaccgaggctgcagacacactggagttgctagcatacttggatgtcccccctaaacaacagaagacagtacaaattttcaggccgtggtccattagattttagcctgatcaagttgttgtttctttgcttggtttgggtattaaaaggcaaaaacttcacagataagttaagaggttgcaccaaaagtattgaactttctgcataatacagtcaataacattgaaaaaaaagcacgcagattttggtagaaagtagcaccaaaattagaattttccacttagcctgatttgagcttctgcacttggaacgaacaaatactagcaacaaaggaaaagtcagataaagttatatgtgcgtttccattggaagcttcctttcctactcctagtctggagaaggagaagaattgagctttacgcatgaaacaaatccaagaagagctcaaactagaacttatacgcacgcactaccagtgctaggagacaaggcatgtgattggtgaccctaaacagcctgtaggaagccatta

SEQ ID NO: 38786 - DNA, 2506 bp, Oryza sativa
aggtagtagagcccaaaaagcaccacacctaactcacaaaaagacgcctccttttcgcgggaatcgaatcgacaaaggctcaagaacgagaggccagcacggcacagaagccacaagaagcgatcagaacagctgaaatcgaatcacgaaccaggacacctgctctcctctccggctcctcaaaactaaatcaactacctactactcctcccaatcctctctctgttcttcttcaaggagatacgagatagagagatagaaatagatacagataggagatgagagggaggggagcaagagatttgtactatggaagaagttgggatgaatggatcaaaggattggtgggagaggagattaaaggggatatgtatctgtgactctcgtgcttgcctgccttagctgagggactcaactctgttgaccttttgagcatgagagcgacgcacagcatgcaaccatcagctgctgcctttcgatttctttctccttcttctagaattctactcgaaagaaagaggaaggaggagaggaagatgaagaggaggaggaagccattaatggtggttggggaagaaggaaaaagcctttgcaggcttgtagccgccatcctcaacctcaacctcttgtggcgtccctacccacgctctatgacatgtggggcccactgcgaagatgccgatggatctgagcgtcggatgggcatccaacggatggattcgtgttcttttttttttctgttttgcttggctgcagggagactggagggacaggtcatgtatctaggcaacatatcctatgcacacaggccctcacgtgtacacacgtacacactaactaaaaaatgtcaccaaaaaatctagaaaaaatcatacacatactttcaattgtattacacctagagttaaaatattaacgtcaaatttattatattttagccgtaacaaaaaaacaaaaaatctgacagttttaaggttgtaattttatcagaattttatattttttgttattctctatgtagaatgaatttgaagatgcgactttgcacgtagatatatactattgaaagtacatgtatgaattttcctaaaattttttttgataatttttagttggtgtacacggtgtgtacacacgagggcctgtgtgcataggatacgctccacgagggcctgtgtgtataggatacgctcccatgtatctaacctgagttgagtcagcattgatatgatcatgtgtacacacatgaaaggtttgtttcaacatatttttgtattctaataaatgtgattcaattctatcggggtagcaacaagtaaatcggaacaaaacttggcatttcggcacatctaccatatcacgcggaaagggacgatggatgagctacctgtatatcgactagaaaactaacaagtgtccatagaagtcacgtgcaccattctatttttaaaacgtgattatttttcttattgaaaattagtttattataagcatatgtggtatatcaaaaatgtaaagaaatttttttatgacaacatttttgtattctaataaatgttattcaattctatgaggctagcaacaaataaatcggaataaaacttagcatttcggcacatctaccatatcacatggaaagggacgattgatgggctacttttattcgactaaatcaacaaactgtacatagacgtcacatatatagtcatataccattcaattcttaaatttgattttccttattgaaatttagttaattataagcaagcagtatatcaaaattgtaaaaaaaaaagtttatgaaaacattttcgtgttctaataaatgtggttctttgtaacgtggtaacaaacaaatcgaaataaatagcattttgtcatgtgtcctttgagaggtgtgattcatgcaccaacaaatacaggtgtttatacgttgtacgagttttaaaagtatatatatttcctatatgcatgtatatataaggcacatgtcactcatgtatatagtatggagtaggtgctaagtgcaagttcacacctatgggagggatgatgtaacgaatatatgggatagaatttattcttgcattataagtatctgtcgcacataattttaagtttcttcttgtaaagtactccctccattgattttaaggggcacattttgatttcaatagaccaaagtatgttgattttgattaaatattagtaaaattataagtatatttagtatataaaatttgcaattgattcatatttaaaagtggttttacgtatatatttaggttttacagcttactaatgatatagtatactacaacaaaatagttacaaattttaatctccacacaacttttaaattaaaatatgccttataaaaatcaacacaatagcagccactactactctttacaaacgttgtactatctttgtgtgggttgttttaaaaaaaactgctagaaaaacgtaataatgaaaaaacctctcaaaatcagttctaaaatca

SEQ ID NO: 38787 - DNA, 14243 bp, Oryza sativa
  unsure (1)..(14243): unsure at all n locations
gatttatcatctaatatcttttaagcatacataaatattttcataaaaattaaataaaacgaatggtcaaacattgataaaaagtcaacggtaccatatattaaaaatacggagggagtacttgctagtgtgcaacttggaaatgaacacgtcggccagctcgtgaattttaacctctgatctcatcattttcatgtgtactcctgatctttctttctcaactgtttgttgattttttttgctcgtgtgttgtcattattttctttgttttttttacatgtcgttttaaatatctgacactggctagcgtctgctaatacgtacgcatgtgtttttaataagacgtacgtactcttgcctggacataaagaaagactatcatgcgtgaatatgtaaccaaattgttgaaacatttctaaaaagaatatgtaaccatcagtacagctataaaaaaaatagacatcatgcgtgaatcgtgatcgaaacattagttcttggtaagaattcgtctactccggctgatataattaattggtaaatatatttttcccaactgtacgagatcatgaggtcaatctttccggtaaaagtggactcttttttactttaccatggcattagctagcaggtagtacaatatatatgtacgatcgcaacaataactataattgtatcaacattagtacggatgaaacctttggcgagctaaaaaccaatataattaagcagatgcgattcattgatcatgactcatcaggtcctaattagccaacgaattaaccaattacctgccacgagttgaccagaaaccatgcgtgcatgttgcacaaattaaatcaaaataaaaaaccatacggtccagcatatncttcgatagatcataatatggctccgttagaatctgattatatgatgaatatcaagtgcgcacgtaaaacgagataagtcattagcatataattaattaagttttaattattaaaaaaaataaaaatggatttacttggtttttatagcaaaatacactgtttattaatttgaaaagcgtgctaacaaaaactgaggaaaaatccagatgttgtggatgttgttggagtttagaacaggacctatgtcataatatgatcaaaactggttaaaatactggttaggtcatatcatatttatagttaaaaaagattttagtaccagacaacatagccatcgataattaatgaaacaccaatatttaagatatacatgtagctctagtcatttgaagattcttataaaaatacgataatatatttataaaaataagtgtacatgtgtgtgaacgaacgtgtcttcgtactgtattttgggagaaaaatatatagctagctagaagtatatttaccggctcgatatgagatggcctaattaattaagctgatggcgacacccaaaaatgagcactagctaactagagaggaggttggctatgtcggcacggtagggttaaaaggttatcttcttttgttttatttttcttttttattttttagatagatgcattttgtgttccggttgatccatgtatcacgcttcaaagtgatcaaacccgacagtgactgcctgtcctggtacggcagcttatttgacgagagcaccccatggatcggattttacaatcatcaaccaagtttggctagacaccctcacacattatattgatataaaaatgctagatactaactcgatccgttctaaaatatagatatttttagagttgaacatgtgtattacaaaaagatagaattaaatgaaggttagttgtgattggttgagaagtagaggtatgtgagagaattgaatgatgaaacactggtggagaaaccatctttggtcggtcggctaaattccacaatagtcccggttctaataaaaatcgggactaaaaagcatttttagtcccggtttaaaagttgaggggtaaaaatttctaaaaagcatttttagtcccggtttaaaagttgagggatactttttgatctttagtcccggttcaagatcatttttagtcctggttcaataagttgtcgggttcaagacattgtcgggttcaagacagaccccaattatttttattcccggttggtataaacaaccgggactaaaagtagatctttagtcccggttgtttataccaatcgggagcaaaaagtaccccgagccgcgcgccatcgatacttatccgcgcgcaattcctctcgatctcctcccctctcattaactccttctccatcccttcctctccccttcccctcccgttcctccccttcccttctctgtagcggcggccaggcgggagcggcggcggccgagctggcgcggcagaggccgagaggacgggggtcgggaggccggcggcaccctcccctcgatctgctgccggattttttttttcaacttatggttcattggatttgatttgtgatgtatgtgatattggatctgatctgtgatgtatttgagttgtgatgtatttcttttaggatttgtgatgtattttttgtttgagattctgtgatgggatgtatttgtgatctgtggtgtatttctttccaaactgtgatgcatttcttcccagatctgtgatgctattggggatatctagggagcggatcaattttagcaaaaaaaaaatcaaatcaaccgggactgctcccaccatctttagtcctggttactaaagatggatttttagtcccgattagtcatctttagtcccagattcgtagtcccggttgtataaccgggactatagggggatcccaaccgggagtaaagcccctttctccaccagtgaaagatcgtggttggttgagaagaaaatgttagtggagaggttatattttggaagaatcttgaacgctacatgttgttatattttagaacggatgtagcaggctagtagcttattttttattgcctaggaatgtactcccttcgtaccataaaaaaatcaatacgagatgtaacgtttcctactataataaatctggacatgggtatgtacggattcactgtactagcaggaaacatcacatcatattctaggttaattaaatttttatgggatggagagtattgtacacactctcctcttaaaaaataactgaattatgtcacccctatcaataattaaatgtaatttcttacagtttcacttattatagggtgttatgcgtgcatgtaagtaagtatctccgtttatttaatttagtcattgcatcattgttttttcactccagtaaatttgtgagggcgttttactaaagatttttacgtatttataagcgtaatagttgatgctaccgtgtcaatattgtatactcttagcaatagttgtatatatatgatgccgtcctaaaatttagaagtcggagtgacacatcactaaacaatatgctgacgtatatcagtatatcacaatcacatatagtcaatatgttattgccaattactacctccttccctaaatatttgacaccgttgacttttttaaacatgtttaaccgttcgttttattcaaaaacttttgtgatatgtgtaaaactatatgtatacataaaagtatatttaacaataaattaaatgatagaaaaagaattaacaattacttaaattttttgaataagataaacggtcaaacatttttaaaaaagtcaacggcgtcaaataatattttgggatggaggtagtatatatattaaggtcctttgtcgtagcctagctaagccatctaaattctaccgacgtaatcgtgctaggaagcgtcattaattactccctatgtattttaatttaatgtacgacgtcgtttaacaattcttctggttaaaaaaaattatataattatcatttattttattataatttaatttattataaaatattctttaagcattacataaatatttttatatttgtataaaaattttaaataagacgaatgatcaaacgctagtaaaaaagtcaacggcgtaatacattaaaatacggagcgagcatatgaattagtcttgtaatatatatagtgtgtgtaggagtgcacgcgtctacactgtattcttttttttaaaaaaaatgatagtagatgtggccatagtgaattgttggggtgaacaattggtgaggccggaatcaatctgtggatgaaaaggacagaaaagaaaaggaaagaaagtggctgggcacatgtaccatgcatatccatggatagatgatcaagacatcgatcaagtagaaatgaaggaaaggaaaagagctagctaggcgccaccaccacttgatgccgacgtatacgtgatatatatatatatatatatatatatatatatatatatatatatatatatatatatatatatatatatatatatatatatatatatatatatatatagtaaatttgtttggtgctccatggtgcccgggcaccattgttgaaattgagtatatacccaattcaaatgagcatgaaacttttttaattatttaggtattaatattaactactttactaactagttgaaagcaagtttgaactgaatttgaacttgtttttgttagattttgattctaggtatatagcatccatacatataattagttaggtatgtaatcatggattgtgaaataaagttaaatttaagttgttttgttgataggtataggtatgaatcaaattcttataactaggtatatactcacaatttgaaaattttgaaaaatttgagtgattttgtgcatttgaaaccatggtgccccatatgagtgtcctatatatatatatatatatatatatatatatatatatatatatatatacatacatacttcatacgtttcacgatgaaagtcactcaatcatttcctatatttatattgatgttaataaatttaaacactgtgaaacggagggagtatacgtgtcctttgctcatgtatgacaatggactaattattctaatcatcatctgctgatataaataaaaatatatgtaattaatataaatactagtatttaatttgggtctgattggttagaacaatttcatttttggtggctcacgttaattggctagcggcgtgttaagtaagacactcatcgatctatcgattcattaatatatgcacgagatggcttgaaaaattcacagcaattttagattttcagggtcgagagagagcgatcgattgatggagatgtatgcattgtaccggcctactatatttactgctctcttgcattgcaaaaagtatcagtttgtcggctagctctagccagctcatactgcccctgttctttttatttaatttcaatatattgagacaataaatacacatgtttttattattagtagtgttcttaatttctacctatatatttgtaagttgtagtatataacgattacaataattggatatagtttctttaaaagcaaaagcaggaatgaattctattattaaaaaagatatatttgtagtaattaaaaattatatgaaaaatattcatcatgaaaaatctgtgaatatcattttttgcatgttaacccttaaatttatatgctaataatttaatgtcatcatatttgaccgtatgtattttagggtaaaatgttaattagagcggaggtagtaacaacttgcaagggagcatgcatgcatgtatgaagcaatcagctctgaccaggagttgttgtagttgtcgttgtagttggacctttggtttgattttgcgacgaacttttgggctgtccgtttcacacgtactcatacacgctacattaatatttcttcagattcaggggtacatacagctaacctacctagctcatcaattaatacgtacttcatccgtattttaatgtatgatgccgttaacttttcgatcaacgtttgaccattcgttttattcagaaattttgtgcaaatataaaaatatttatgttcaacttaaagaacatttgatgacgaatcaagtcacaataaaataaatgatagttacataaattttttgaacaagacgaatggtcaaatattagacaaaaaattaacgacgtcatacattaaaatatggaggtagtacgatatttatatgaagcttatctctctctgtatgtatgccgcacggttagcttggagtacagtgatgtgcatgcatgcttgcttgcttttggaagaaaattaaaaagagggattattctcatgactgacctgacctatgcatgcgttcatgtatgtatcacaaaaaagattggaacaacacgtacgtcaatacatatatgtgccaatcctatccacctcatcatgctcgtgattcaaccactgcctggctgcatctgcgcaagcaaacacacgaaacatctcgtaaaatttgattatcacacacacacatatatatatatgtcattggtacgtatatggtatattgtttagaaacacaatataagcacttgtgctcgtaattaacacgcacacactagtaagtatcatctatcactgaaagaataatcacccataaatatgagcatctgcatcaagtttagtacttcaatccggatggatatatttcaccacaagaattcaagaaacatactcccacagttagagaaatcaaatctaatacgggatgtaacatatcatagtactaaaatatgtcacatctcgtattaggtttgtttttcataggacggagggagtaactagttgagctttaccctatatctagagaaagaaataaacagtgagagagaaaaaaaaagacacatgaatctctgtagatcatctagttggtcgccgctcgccatgtgattggcattcaggaaggcgcttgtgggttccattccggcccatctagtatagccagcttgttaatatcctccctgggccggcccaagtaacccacccactggcatggtctgctccggcccaactaacccacgactgcttggctatttccgtcattttcacgctgaaaacccccctcctcccctccaccacaatcgtcccgccaaactcgaacgcaaccgcctcccaatccccatctccgccgcacgatccgcctcgagattcgcggaatttcccttccctccctcttctctcgtacgccacccactgattgcgccacgtcatctatattactacacctctcactctcactctcagtccataactgaccaagaatctatcgctacccatcgatccaggaggaaggaggccagtgagaagcttccagaaggttcgatcgggagcgcggagtggtgatggcggcggcggcggagctgtctcgcggggcggtggcggcgatgtcgcggatggagcaggggctgcggccggtgctgcaggtcaccgacgtgcggcctgccgccggtcgatacctcgtggcgctcttcgacggaaccaagtcggggcagggggtgctcgtggcgtccatggcgcacctcgtcagggcatgcgccatccgcgccggcaccatcatccgcgtcctcgactatctctgcatcgacacaaggtgaccgtacaaatccttcttctgctctaattttcactcttatgtacttcctccgtttcacaatgtaagtccgaatgtggaaaatactagaaggatttacattgtgaaacggagggagtatttcatataccagatgcttgcctgctgtctggtcgatctttgcgatccaaattaatcggggagccgctctttgatcatttgatgcgatgtgtcgtgtactcgtgtgtgtgttgaaagggggagattttggtgaagtttttgttttttttctttctgtctgactgctaaggttaacttttgttctgaagttgttatgccgaaattagttttttgggagttctaaactaaacggcgctagggagggactgatgaataacagagccagctctttattactgaaccaggacagaaattatatctgaaaaaataactaaagtccagtctacttttgtatagaacttgcttcttttccaatttatttacatcatgtagcatcctaatacaaagttatgacataaaatggacgatctacttgttactatggataaattaaataatattactatgtattatataaatctaaacaaatatctcggaacaagtggtccaaatgatgcagtataagaaatcttttcacaagtcgtgtttttagaagcatcgagcaaataatccgatggacgctatttcattttgttatttgaacttaagcttccaaatactccaacatatgtcaactgttactgaaaattgtatcaacaactaacttttcgtatcatgtcttgctggtttcttaattcagggttattatcgttgagcaacttgaaatactgcaaattaactgcgcactgatcggaactagcaatactcatgggcgccttacttagcctaacacccattgctgcactgagcccatacaagtgtaaatggacaatcaaggccagggtgactgcaaaatctggtctccagcacttgagcaatgacagaggtgaagcaaagttcttcgactttgatctgcttgatgagcagggcggtgaaatgctcgcaaaatgcttcagttcggctgctgaaaagttctatggcctaattgaagttgataaggtctacttgatatccagaggattagtgaaacctgcacaggagcctttcaacagtgattatgaattagctctggatgcctcagcatcagtagaggtctgttccagtgatgttatataatggatcatctcgttcagttggcaataatgcagggctcgtctccagtccatgctgcttcaggtgcaaatcaaaggttgtccagggctatgtctgctcactaataataatgctcttagtgatacagtaggcagggtactgctaattaaagggcacttagcgagatgcatccagctactttgttaaatgttgaatgctagttatgtaagaactctgtcattaccattatatttctgttgatgtgttgaatatcccatcgttcgagttatgtctgataagtcatggaaaaatgaacgaagcaacgaaagataatgtgtgcaaaattttgtatctatgttattagcgactaaaaaccaacactgaaaaagagaccgataagaaataaaattctaaaatcaactctaaaactaaaatctgaaattcaaaaattagatgcatttgctaagataatctaacaaccagacgatgatggtgcaataggatagcagggaaatgtgcatgatcttctgtttggtccttcggttttgcctcaagtgtggactactaaataatgcaggaaatgctgctcttgttgctgtatcagacatttgattttgcggtatgtttagcaagtttctttgtcacgcaaacgaatataatctaaagaaaatttgaacaataccattggagaaatacgtgagttgtaaaataccattgtagtgagaatgacatgagagatctagatccacatgtcaatgacactacttattttgctgacatgttaattgaaacacgacgctgtcaacctaaaatgcttgcttcttgatacaaaatcacgttttggtaacgctgccatacaaaatcacgttgctgcgttcgttttggggagttcccaaatctccaccctcgtttttcgcacacacgcttttcaaaccgctaaaaggtccgttgtttataaaaagtttctatacgaaagttacttagaaaaatcattttgatccaattttttagctaaatatttaaataatcatgcactaatggatcgtttcgtttttcgtgcgcagcagatgtattgggacagtgatcacggaaaaactgcctagggtgacagagcggtgcaccctgttcccaaccaaaatagtgataatggaaaacggaacggtccattaacgcataattaattaagtattagctatttttttttaaaaaaatggatcaatatagattttctaagcaacttttataatttttttttaaaacacacctttaaaaaacgagaaagcggaaaatgagagagatggattggtaactagcgtgtgcgcctggtgtcatgttcatttcacttcctactagtaacgcttatttcttggacgagaaaggaaagctctgaattacccttgggcttatcaatcgtacaggcccatctcaattcccaaaaggccaattcagcccaattctattccacccaccaagggcactaccgtcatttcgcaacgaaaatttctctctccgtccgtttccctccactcctccagagagcgcgcgtcccaaaaacttcctccactccacccacccgcatagacctggtccatacaccgaacccacatccccaccctccaaaccgcctcgagattcgcgcaaccgccctagccttccccactatagtactctccgcctcctccctagggttcccaaaaaccctcccccgaattcgaaatcgaatcgcctcccacatctctctctctcgcggaagcttctggaaggttcggaggcggcggcggcggaggcggcggggacgacgatggagccgcagctgacgccgggggcggtgcaggcgatagcggagcacccggacgggacggggacgatccagccggtgctgcaggtggtggacgtgcggcccgtcaccaccaagaacgcgccgcccacgcccaagcccgccgagcgcttccggatgatgctctccgacggcgtcaacacgcagcagtccatgctcgccaccgccctcaaccccctcgtcaaggacgccacgctccgccccggcaccgtcgtccagctcaccgacttcatgtgcaacaccatccagggtaaaaggtcagcaaaccaccacaacacgcgccccccttcctctcttcccctctgatgagactcttgcagtctttttggtttggatgtttccgcgagaaagattggatcttgatgtgttagttcatctggttactgttttgagaaaaaagatttggtcttgcggcgatgcgcgggttgggagaggagggctctgtgtttaggtttctttggattgcgatgtttgcaatccagattggatagttcaagaaatgacgggttataattggtgcatgccttcaggtgtttgttctagatggcctgtgtcagtttccacttaactgtaatgccttctcagataaggagaatagttgcttcttttcccctttggggtgttcgttatgtaaagatgccaatgcaacgaaatatttgtctgttactacattgttgggattctgtgatttacatctagatctaattcgcacagtagtctttatgtcaacatgggggacagtgagaaggtcacattgctttttcaagcattaatttttttcttctactcagtataccttgttcgttctggtctgtctggcatgcgattacggagttctcaacttttcattaagttacagttgaacaggctgtccttattttgaatcatcatggtaaaattgggggctattgtgttgattcattgtattgaactctcaaatgaatgttttgtttaagtatgtacggtggcttgcatgtgatctcatcttatctgtaggttctaaggaaggtttgcttttccatctctacattgatttcagatgcgcttttatctttgtcatgtttcatccaacgagattttatcactttggggttctattgttagcagttgtccaatgtcgacaaatattcaacctgcaaatatgtttcaacttgcaactaatttgctggctaggttggttagtaaaagtgtactgtattttgagtaatttctcagagtattgtctttcatttaggtttccattaaaccattgaacaagtcacaacggcatgttgcaatgggctgaactgtagaactatcattcataactaagtgtgcaaaccttgctttttctgtaggggtgtgtttatcttttcactgtttcatcaccctcaattgagaaatcttacctatttatggtttatgtgctcatttctgtgtatcagtttggttgatgtgatttagaactggcctaatgccttctaaaaggaacatcctatttggaacttcagattattttttcttcatttttatgaatcactatgaccactatagttgacaattcttcaattctttttttcaggattattattgttgtgaaacttgatgttctgcaaaatgactgcattgtaattgggaaccctaaacactatgaaccaaagagtctaactaaggagcaagaccctaacttacaggccagtgtggctcaaaccaataatggaacctattctggtggcgcaagcatgctgggcccctccgttgcgccaagggcagagcaggctgctagcaacagttcatatggtggaccttataatagtgctcaaggaatgttgggttcttctattggcaggacagttgaacctggtcctgcaaatgtttctgctgttggctcttacggtgcaatatcagcacagaacacaacgaatgccaacatgatgcagcctacatctcagctgaacataatgaatgccaacacgatgcagcctacatctcagctgaacacaatgaatgccaacacgatgcagcctacatctcagctgtcctcgttgaaccctaatcaaaaccaaaggtttgcagctcctgcttcgggtggagtctttggccctcctggcaatgcttatgggcagccttcacgtccttcatatcagcagccacctccagtgtatatgaatagagggcctgcctctaggaatgactctgcaactcgtatcatcccaattaccgcgttgaatccataccagcctaagtggacaatcaaggcaagggtgacagcaaagtctgatatcaggcattggagcaatgccaggagttcaggaacagttttctcgtttgatcttcttgatgcacaaggtggagaaattcgtgcacaatgctggaaagaatcggctgataagttttttggccaaattgaggttggtagggtgtatttgatatctagaggatcactgaagcccgcccagaagaagtataacactttgaaccatgattatgaaataactctggatatcgggttatcaactgtcgaggtttgctctgatgatgataacagcatccccaggctgcagtacaatttccggcagatcagcgaactagagaatatggctaacgagaccattgttgatttacttggtgttgttacatcagttagcccttctgcaacaataatgaggaagatcggcactgaaacccggaaaaggtctattcaactgaaggacttgtctggccggagcattgaagtaacattatggggaaacttctgtgatgctgagggtcagcagttgcagttgcagtgtgattctggttcgaaccctataattgcttttaaaggtgcccgtgtgggtgattttaatggcaaatcagtgagcacaattggttcaacccagttaattataaatccagactttcctgaggtggaaaggctgaggcagtggtacatgacagaaggaaaaactgctccttgcatttctttatctcgagaaatgcttaatatgggccggactgatgcccgcaaaacaattgcacagatcaaggatgaaaatttgggacgattagagaagccagactggatcactgttaaggctgcaatctcccatgtgactactgagagtttttgttatccagcttgcccaaagctcttgcccgtcgggaggcagtgtaataaaaaggcaataaataatggtgatgggatgtggcattgtgaccgatgtgatgagagttttcaaaatcctgaatataggtacatgcttaggttccagatccaagaccacactggtagtacctatgctagtgcgttcgatgaggcaggtgagcagatttttggtcgcaaggcaggagaacttttctcgataagaaatgtcgaccaagatgatgcacaatttgcagagatcatagaaggggtccggtggcatctatatctattcaaactgaaggtcaaggaagaaacctacaatgatgagcaaagcttgaaatgcaccgctgtcaaggttgaaaaactggacccatcaaaagagagcaacgtcctacttggagcgattgacaaccttttactggacccaaaggggcaaagtgatcttgcccctaatgctggtttcaccgatccggtaggcggtcacggtgcgcctacatctagcaatgcctatgccatgaatactggtggcgtgaatcagtttgggcagcaagcgagtataagcgccggga

SEQ ID NO: 38788 - DNA, 9789 bp, Oryza sativa
tagcagcaacacgaaacttgcagacatgcagcatttgtggagcaaatgggcacagcgcccagatctgccatgtgggtgcagatatggatatgcaggaaacatcagccggtggaagctccatgggtaactacaactccatcgctggcaacggcagctcggagtgttacaaatgtaaacagcccgggcactatgctagagactgtccagggcagtccactggtggcttggagtgtttcaaatgtaaacagcctgggcacttttctagagactgtccagtgcagtctactggtggctcggagtgtttcaaatgtaaacagcctgggcacttcgctagagattgtccagggcagtctactggcgcccagcaccagacatatgggaataatgttgcagcatcaaggggttacaataggcaatcctttgttggtggctactgaagtattttgcaagggaagaagcagcagcagcagcagcatcttgattttgttcatcttggatggcatcggtgtatcgtgtatagttgttaaacctgccttatgtttatgcctttattacctccaatgtccactgggcagggaaccttgtgatctggactttgtatcgctaccttaaaaagtatattgtccttgtctgcaatcttgtaaatttcaatgcctgcttactgcttgatcggcaactatttatagttcgcctaaagtgctcgctctgtaataatatttgggctttgctagtgtgctttcccccccttttggctgggaatctagataatcagataatggcaattgatctgcttggttcatgcatttcccaagtactggattgtatcatatgggactgaaaattttcatgacctggagatattttcattataaattttagaggaaaaaaaaacatagccttgtgtaacagcaaggttttcttctgtagtactacctctttccaaatgtttattttgagctaaccaacgcaagtgcttttgcggtcagtggcattgcattgtcaaatgtggaagtcatgtttatcctctctgcagagtgttgcttgtctgatgattctataattttgttttagcgcctggaccttctatatctggcactggcatgatttacgggtatggctgcataatctggagagagatttgcattataaagatgagaggaagaaatgcgtacacttgtgttacagcatggtttgtgtttttacggccagttgcattgcattgtcaaatgttagtagtagtatgatgcttttatatgtttttctttggcaatctaatttcgcctatgccttggttccgggttctgagttctgacaagtgacaattctcgaactcattaagcacaagcctatttcacccttacaacaattcggaagaatatagatgggttttaaacatttgataatatttgctccccactcagatttggttactcgaaattgtacaagacctgacattcgtcatctggacactctagtagataaacgtgctggctgatgctagataaacagatgtaaagatgaccacttcaccatcaaccgtaaaaccggacgaagatcaccaaaaattgatactttggagcaacgataggcagcttcgattcagatagcacaatacttaaaagaccacatactagcatcgaattgatacatctcccctccaaatgaggctccaaaaactatccattgtttgatacagcaagcaataggatgtgagaaactgagattggcatttgtatttcactactctcatctgatgagacatgactaggctgtaactgaagctgaatctaaagaggaagattagtgtgggattgcagacaaaactgctactacttccttcctgcactgcaagaagaagaaatctgtatccagtctgtgttgaaccccattaaagcacacacagcagcttcgattcagacagcaaaagaaacattctgatagatagcatcaaattgatactagtatttcgtttgtgtcaaaaaaactctcgatatgtcgtaatcaaagctcgaaaatcccatttgtttgatacagcagcaacagcaagaaaggaacccctactccgatccagccactgaaacagtactaatgaatccggattcgcgcattcatcctatctgatgtgatgaaaagaagctagagtataagaatctaatctgggagaaggttgaggtcagtcgtcgaaggcggatgaggggtcggcgaggtgggcgaagcgggcggcggaggcggaggagaggaggaggaacttgcggacgcaggacctgacgcagtcctcctccttcttgccgagggttcgccggtagaaggtggtgacgcagtcggagaagcaccggtgcgacacccagttgtacagccgtatcctgcgtgcacaaaaatccatccatcgctactccactctctctgcgaggaggaagggaaggaaagtaagagattaaacgtacgcgtctcgggtctggagcttgtcggcgacggcctccatgcgcgccttgtcctcctcctcctccccgccgccggcggccatggcggcggcggcgtccatgctcttcttcagtagcagcacaagaagaagaagaagaaggagaaggagaaggagaagcgtagcccaagccctaaggccctttagtatagttgaagtggtgagatgggccgtggtgggccttcggtaattgagcccatgggctcaaccccgaaaatgccagtgggctaggtgaggtaaaccgtgcacgtgacgctttcagtttcttttcttttctttccttattatatcatcaaaaaaagaaaagaaaaagagaaaaaaaggtatggaagatactgtatagtatacgctagcagcataagctccgtccgtataattatttcttgtacgcatatgatgtacagtatgtattttacgagctgtatactaccattgcgttggatttatgctggagctatttgcctatgtagtggagtattctagaaggatgcttgtgcgccgtccattgcctgcagaaacggacggcgcgggtgggtgggccccacagggcggtgactgacgcgtgggccaccacattgggatttggctttgctttgctttcgtgccttgtcagccgctgcccccggccccttcttctccttcttcttcttcttcttcttcttctccctcaccatcaccaacaagagagaggaggagtggattcatcgatcgagaagtcgaggtagtacatacgttggattggattggaggaggagaatgcctcgcggtgggttctcggggtcgataagctcgcccaggatcgacgtcgccatcgacatggggaaccccttcctcaaccgcaccgtcgacggcttcctcaagatcggcgccgtaagtaaccatcttaatctatcccattccccctctctcctcttaatcacaaactcctaatcctcctaaatgcatttcttgttttgttttgcaggtcggggcgtgcaaggtcgccgccgaggacacattcgactgcctccacagaggtgagatatcgtcagtctttctaccctttcacctcctctcctttcttccccaactccgccctatcttgcacagttgcattatacttcactatacaaagtttctttctttttttttcacctttggggctagggctgcctgagcctcacaccaccaaaataaattaaattgcacgcatcccaaagtggagtactctggtggagtggagattgggaaattgaaagtggcttccaatctttgggtcaaaggattatataatcgaatgaaggcaacacatctatggccaacaagtcatggcttgtcgatttatcctcaccaccagagtacaatctgtatccattcattcacttcactgtcggctgaaaggcatattccttttttttttttcttttttgggttgatggagcttggctcacttgatattgacaaatcaaattcagtttgtcgataacaaacaatttaataattctattttatccaaggctcacttgatggagcaaggcttttcttatgtatcggcatggtacctgcctggcactatatagtatatactgcaaaaatatagcactagcatgatgaatacatgacaataaaatgggagtatttccatatatacaataaaatgtgaccgtgtcctgtttctatatacatgtacacagtgtaacataaattcattctgtttcctttccaggggatgtttcaaagcacaagcttgagcatatggtcagtatttccatggacttccttatctataaaattttcatggagtctgttcaacatggttttaagacctgaacccatgttttcaattgatgagtattttatacatgcagcacacacatctttgcacctatctgaaagtgaatccagtacaaatccaaaattagtgcaccacaatttcctgaatattttgaataaattgatatagggatgcccttgaattaccccacaaaatggataaaaggcgctatgcaaatcaggatttctatcttagtatcaatccaacatgttgacatgttttcatcttaagaaattcgatatgcaaaaccatcaccctgcacctccatagcgtagttgcactgtaactgtggaattcttcttaaaatgtagttgtttctttagtattaaggttccatctatggttcactaatatcctatgatgaatgcttttgcagctgaagaaaatgtgcaaggagggtgcctattggggtacatttttgttgacttgcaaatggatgaatgaattggcatatatgcatttattcattttttttcttatgtcacctttttgccgggtcgttttcttatgttacctgagaaaccatttttctctgacaatatgcaggtactgttgctggggtgtatgtgggcatggagtacggagtggagaggattcgtggtcgccatgactgggtactccctccatttctttttattttttaccattggttattttttaaactctaatgaattctgaaaactatgcaacattatcatagtatgttgtgtcataatataactatacaactttcactcaccataactaattgatgtaaaagttattaatggtcaaagtttgaatagtaccagccaacataacaagtattttgaaatgaaggtagtatagtaaatatctataatggatctctctcattttctgtatttgattgaatctttagttatgttgaagggaaaaataaatatgccttaccttgaaaaatattgtcaacccacttcaaatttgaccggtcctgtcacatataagtactactattattttttgacattgacaatgcctaggctaaatatcacttcgaccaccaatttatatattaatatataccaaaagctcataagttgtagtaataatctattcttttagatgaatccagccacatcattttcatgtgccaaatattcgtaaaggtactgctaaacgaagttgcaatagcttaactgcataaatgaaactcttactggaggagaaagccttattaagtttctttttgggggagaatagtactaaacttggaggagtaagccttaaactgattttccatggatagtttgttttagtcaatatttagatttatgaactccagtgtttattactctgtactgtataatttatgcttggtgctattatttgatcttgattcattattttccgtttcctcctgggatttttgcagaagaatgctatgattggaggtgctttaagtggtgctctgatctctgctgccagcaacaaccacaaagacaagatcatcaaggacgccatcaccggaggcgctgttgcaacagctgtcgagttcatcaactacctcacttagtcatgtaactgcgtttttgcagtggcttttgttggacagcaagaataagagcttcttcactgaagccatgttcagtttaataaaatgttaccttgttcatccctgcttcgttccctgcacttgtgatctcagtacttattctgagtaattattctcctgatattcgtggcttgcagtcgtcagtatgaccttgtgatgatttgttttaagttgagaaaagccatatttgcaagttgcagcaactgagattgaagcttgtatgcaataattacttgatgatattggcgactcatgacaggaaagttgtctaaatttccccccaagtggtgccctcactagaaagaagatggtaatgatcaggtgtcttggcttgttctggtgattggtggttgcataatctagataatcatatctctatttgtcccttatttgcaagattctttcaccatgaccttgatctgctagttgagcttggaagcttccagtttcagatgaaaatcacttgtttttttccaaggccattaatcccctttttttcagtttcagtttcagagtaataatcttatactagagagaaactgaaccgacaagagatattattcgtcctcgtcggtttactgcagtccagtactgttggaaataactttaccttttcacgtgatgctccagtgccaataattgatgtgctacagtagtcaaatgttttttttttccttgtagttccaatgatattctcatttttttccccttgtttcaggtaacaagaagaagtcgattgttcgtccgtgagctgtcgttttcgttatctttattcacgaatttgctgcaccgatcaaacctgatggtattttgattcgagaggtaaccggccaaatggcagcgatttgtgaacaggaagcaatatctccatcgattgatcggtcatgtccctcctcatataccgcacaagatactcccaattaagaaaagagatgctaatcaagtctctctgatgctaagaacacacagctaatcaatcaccattagattccagaccaacaacagtttgtcagctggttataactcgacacaaccatataatccctctgctaagaataacattttgttgcatcagaaatactgcaattagcaggatttgaacaaaccagcagacaacatgtttgtcagccgcgacgtttcgtcagtaaactgtactgttggacctgacctgactgcaggctattactctgaaattgttcttcactcaggccagcactatcattgccattgggaatcaactctgcacagttaatctgtttcttctccctccttaagagtagtagttttattgatccttttgcgaggagagaaaaaggtcactgctttcatgattaagctgattgtggagatgtctcttttttcaaccatggtggttagtgttatgcttcgttaaagagaaggctagtagtagttgtacgctgccgcccactgtcagctagagtccaacacggtcgaaaagatcatcgagccactgatgattatacttgctatttctttaaacttcagtatcttttctgatcaagagtaatttcagttagctttatcatgatcattattgtcgtaacgtttttagctctgcagctaaaagcatgctagtcggtttggttgaggctttttctttcttaatgaaaagccgtggggcggtaattccctagtgcgtcgagttcttgtttttatttcggccaacacttttatgccgtgcggaggattatcccctcgtttattcaaaaatcatctgtatagttatgaaaaaaaaatcgaaaacaaaatggacaacattcatacaacatacatatacaagtccacaaaattttactaaactcaactcacacatcaagaaataaaaagaaaaaaaaaatccaacgtatgaacaatgctggtgatattcacacttaaaatttgtctttctttcccctctcaatttgtaggtcaggtttgaatttatttttttagtagatgcttaccatactctagactattaaaaagatttagaattcttttaaaaccatttgtactgaatttaagagaaaaatgtatcacgagggaatatcctggagggattataattcatctccttattatttagcacttttttttatctacagagttgaaaggacatggcatcacaattactttcatctttcatgctcagcctcagacgtctaattggctagtatactagcttgttaggtgcaaagtcaagcaagagaatttcaactgtggcggtgtttaattctctttaaacttctaaaaattccgtcacatcaaatgtttaaatgtggacaaaaaaaaaataattgcacagtttgtatgtaaattgcgaaacgaatcttgtgagtctaattacgccatgatttgacaatgttgtgctacagtaaacatgtgctaatgatgtattaattagatttaatagattcatctcgcagtttatatgtggaatctatatattttgttattaatctatatttaatacttaatacttttgtccgtgtatgtaaaaaaattttgaccaaacaactgaacacggcctgtatatgtaaccaaagaaagatcaaaggagaggaggtagctactcctacaaagaaagaagaaacgatgagatttgattgcctactactccagctagctagtatacagtactcatacgtgtctatccatattcctgctcccaatgcaaaaatgcaatggcgagattgcaaggttgtgtgggtggtggaccctggatcgatcacctccattctttctccgcatctcgccacagtacgcttcgctgctctcccgcctatatataccacctcctcctcgatcatcagttcatcagcaaccaaagcaagaagcaattcttgagctcaatcagcaacaacatctatctccttcttgcttagttaagtccttcgccctcccaagaagaagaagatgtcttgctgcggcggcaactgcggctgcggcagcggctgccagtgcggcggcggctgcggcgggtaattaactaactaactaaccaactgctaattaattcactcaagaaaccattgtgacacgcacagatcgataactgatcaatattaacattaatatgcatggatgcagatgcaagatgttccctgatgtggaggccacagccaccaccaagaccttcgtcctcgctgctccatccaacaaggcgtaagtttcatcattaatgctaattaattgatctgtcattcctgtgtgtgttcatcattagtgttaattaattgattgatctgccattccgaaacaaaattgtgctggattacaggagctctggaggaatggagatggcggtggagagcggcgagaacggcggctgcggctgcaacacctgcaagtgtggcaccagctgcagcggctgctcctgctgctcctgcaactgaatctatcgtcgtcgtcgcccggctgcatgaggatttatcgtatggatgctgctactgtcgatcagagctttgatcgaggccttaatttgcttgcattagtacccagcttatatgtaggcaggccttgccttttgctctgacgcctaaataaaaccgtcgtcgtcgttgtcagtgtgtgcgtgtgtcgatcaatgttggatggatccctagctagcttggatggatcatctatcatcatggtgatctcatcatgtactcctgctccatctcctcatgcgtgccaggcttcttaatataatctacctctgctttcatcccatttctcttactgcttactgcccttgtttaatttccctttggttctaattaccacgaggaaattgttgttttttcactaatgaaaactctgcaaagttaaactgaccacaaactagttaacacagagactgcatcagctgaaagacctgaaaattcaggacggtaagtcggtaactcttataactaatgtccaaactgacaagaaaacggt

SEQ ID NO: 38789 - DNA, 449 bp, Oryza sativa
tatggggcaccatggtgcccgggcaccatggtatgaaatacacaaattcgcccaaatttttcaaaattttcaaattgtgagtatatacctacttataagtattcgattcatacctatacctagcaacaaaacaactcaaatttaactttattttataattcattattacatacctaactaattatatgtttggatgctatatacctagaatcaaaatctaacaaaagcaagtttgaattcagttcaaacttgctttgaactagttagtaaagtagttaacgttaatacctaaatatttgaaaaagtttcatactcatttgaattaggtatatagtaaatttcaatcatggtgcccgggcaccatggagcaccaaacaaatttactatatatatatatatatatatatatatatatatatatatatatatatatatatatatatatatat

SEQ ID NO: 38790 - DNA, 3429 bp, Oryza sativa
ctagttagagatgatggtggcatccctgcatgaagccatggacaagcttagaccctcatgtacatgggctggatgattgatctccttttgacacgtggcccggggagtttggcccatgttctggtaggggaggtaatgaggattattctttagaacaattcagattatattaactgttaggtgctttacttatgttattttgttatgttaagctggtaatcccaacagaaaatcatgggtacctatgtcgcttttctataaaagctgggtcattcggcctttggtctaggagaaaaaagaagagtgggttgttatacacatacaactccaccctagctagaaatgatttcatgaataattaacaattatgtacttgtgtgcaatattaaattaaagaaaactaatgaatgtgtcatagatgatggatcaagatcaataacgtacgtaccttggctattaagattcaccgatgcctaccaaagaaaaaaaatcaccaaatatatgccaaatcgggtatgacttgcaagaaacaaccagtaacaatgtgatatacatcctcccacttgatgtataaaatatataaaataaccacacgcagaaactaaatcctatttatgaaagcactaggatatacgattctccaatccaactcaacatcataggaaagtatattacaactagcaatttatatagatgatgcatgttacagactaagatccataggatattcgtcgtcttctcacccatgatgctttcaactcatagtacatatatttcattcattgtacacagctgcacatataaatataaaactaaatgcacattgtataaggaaaaaccacttgctatgtagtattttatgtgtgcaagtagcaaccaatatacaactccaacctgggggttgcattgacttggatccatctcccatccaattgatcaccccaggctgcttaattaatttgtttagtgtgttcactgttactactggtcaatatattgattaatctgtgtaagttaagccttctcttactttgcaggttgtctttgattggctatactctaatcttagtcttgaaccttccattaattgattataaagtcagatgtgtttactctagatgatgatgatgcatgcatgccttgcaaatgtcggcatggcgtaccagcaaggcaatcttaaataaagtgtgtatatacattacattcttgtaacctttctatcatatcctatcttactataaaattaatcccaactaatttttgaaacttaacacgtaagtatatcacattatcacccaccaacaattattatcaagagtattttaaatcacataaaagtgtgccacatcaaatactacgtacatacatcaatacttaattatcttttacttagtatatgcatgtttgatcgtgaagtgttggaatttacctttcattgtctacaaacgcatcaatcgctccagggcgatgcgggcggcgaaacctcaccgtcgcctcctcactctcctcctctcccccacctcgctgccgcctgagcagccgccggcaaagccgggcggctgcgaagacggcggtggcgggccggggctcccttctccctcactcccggtcagccgattgggacgccgacgacaccagagagcgagagcgcggccccggcgacgacggccaaatccggcgccgttgggtttggatccggccccttggccggatcttggctgggacgcgcgggtcggcgacggcgtggcgcgtgggccgcgcggaggcggcggagggcacggaggcggcggccgcggcagcggcgtgggaggcgcccgtgcgaaggtggtggggcagaggtccgcggctccggcgacgggcaggcgccagatccggtcgccccgcttggccggggtgaccggcgatgggctcggtcgatgccggcgccgctccacggacctggcaggggggtggctggtggcggcgatggtggcggatgtggcggcgacgaagttggcgacgaaggcggcggactgcggcgcgtgccgcgacgccagccctcgtcaagaacctcgccgccacgagggaggcgcgtctcccgtcaattgtatgccgtgcccgtgacgccttcctccatggcgccggcgacccgcactgcgcgctgcaccttcaggtctgcgccacccggccggtctggacggctggcagctggcgacgatggcggctggacgggggtggtggtggcggtggcgatggcgatggtggctggcggtggcggctggcgacggtggtggctgtggcgctggcggtggcggctgtcgacggtggtgcaaggccatcatccggggctgacggtgcgttgtcgtcggcagcggcatgtggaggcggggaaggaggagttcgggtgcgggcgcgctgtcgagaactgtgggcggtggccttggccgaatttctgaagggacaatgttgttgaccgacaaagatccttcttgtgtggattggtggtgtggttttggacagggaatcgcgggcgaaagccttgtcgagccgtttggccggctaacgacggcgacgccgtttggcgtcgttcccctccttggaggcgtcgttttagattacccctctcctttcctaaccatattttccgggtgaaaaccttgcttcgttccgaacgagcggtggcggcgatccacatctcatcctccttgggggcaccgctttggagaaacctcttcgtgcaaggattgtctaagggtctatgtattggcttcgaacttcagtcttaggctttgacgaggcattctagctccacattttgttttgcttttcttagtttgggtcctctcttttcctgtttagtgtgttcaacttgtcttgaactacactctcttctggagtggaactttgtaataattggctgtagctctttttgagcaaagaccgagatattatattccattatctagaaaacaaacgcatcaatacttctcttttacttggtatatgtttgatcttgaagtgttggaatttacctttcattgtctacaaacgccgtaaaatctatctattatatactaaaagtccattaaactccctacaaacgctcttaagctgccacgtgtctccctcaaaacactctcaacttgccacgtggcgtaacgagaggaattcagcacctcgtagggcccgcacattatttccataaatatatgtacgtgtacacaaggcaagatttgaaatctatctaaaagcaaaacatgtacttgtcgtgaacgaacatagattagttacatatttgtgtgtgagaggcaatattccaaatctctcaaagcaaaacattccaaatctcaaaaagcaaaatttagatcactaggaaagattattaattgcaacaaggattagttccatatacatgagacaatattcgtaaggcttgcatgcatatatata

SEQ ID NO: 38791 - DNA, 1848 bp, Oryza sativa
aagtaaaagttattaggctatgggatgcggttaatcctacaatggttgatgagttctatggtatacagatgattgtactagatgcagaggtatgattgttgtaaacatgtgatttaatatattgttctattatgtaaatactatttttttggtgcagggcaactcaatacatgtctctatctcaaagcaattggcgaaccacttcaggccaaaaattaagattaactcaatatatacttttaaaaatttcaaagttatggaacatgataaataccgtgtcctaaaaaacaatctgaaaatccttttttatcatgataccatagtaaaagaggtaaaatcaaaaagacaatgtttcttggactattacttcgagtttacagacaggaaaacattaaggagtaggttgaataaagatcaacagttatcaggtatgtgcataatcttacttcttttaaacattgttatttgtactaaagacctgtttgtatttagatgtgattggcttacttagcgggatgaagccgatcgagcaaagaatgctaggaaaaaacacaagcagggagagggtttgcaacatgcgtgaaattgaactccttttattagagtaagattgttgtctgcaaatttaaaccagcactaatactttctatgtggtatattttacatgactttattgcatttgtaggggagaaaaagttaaaattactctatggggagatattttagcaaatatggttgacgacgatttgcttgggaagcaaactgtgttcatcgccactggacttctggttaaagaatatgaaagtgaggatgttatttttttctaatttaacgtacttatagttttagtaaactaacgacattgatcatttagaattattatcatttggagtaacaagttcaacagaagtttttttggatatggaaattcctgcaagcatggaaatattgagcaggtgtgcagtagtagcatttaaattcatatatatttgttgatttgtctaaaattatctgatggattatattgcattttatttataggcataatgctgaaaaggttttgcccacaatgattgaagtggacgcaagcactcaaggaaccattgaagagcaaatgttctacaatagaaagacattgaaagaaataacagaattgcgatatagtaatatacaacagaaggtacatatccattcctatgttacgtttatttttcatttgtgtatttaatgttgggaaaaatctacttgatggctgatgtaatgagcattacctaaattaagtggtacgtttagtcgtgaagtcatctttagtcactctttcaagctgattagttaaccaacattaatttgttttttatttaggaatttatatgcacagtcaaagctaaaattgaggagattaatcaagaaattggtggtatatgtcttgcgataagtgcttttgtggaacaagaaaggaatcaaatgtatacatttgcaattcatgcggaaaggaagcagtgaacccaaaaccacggtaagcatgctcttcaaattttatttgacatattgtagcaggtatatttaccattaacggcacattgtaccaggtatgtaataaaccttgagataagtgaccacactactaggacgacatgtacaatatttaatgaggaagcagaaagaatatttggtcataagtctgtgtccaccatgctggaggaacagaatggacaaattgatatgattcctgatacaatacgtcagatatgtggaagaatattgatattcagattgaagttgactaaaaggaatttagaagagtgtaaggaagactacaaagtgaactacacttttacacctaatgaa

SEQ ID NO: 38792 - DNA, 4344 bp, Oryza sativa
aatgttgaagtgcaatgatgattatggcttcactgatttgcaaaaatcagaagatgaggtaatatataacaaataaaaaatatttttacaatatatattatatatataattatttattggatgttctgtagtttgggcagcacaattttcagataaaagaagagccaaaaaatgaaagtagtgatgattatgaaatgaacaatcatcgcaaaacaaagaaagagagatcaaacatgagatgtacaaaaagatcaaacaaggtatgtataattgctttcttatataacaattcgtaaagttatttatagtactacactaataatgatgttttataggaaccatacattaccgattttgatgggaaaacaaatgaaaaggcaattacaatcgatgatgattgtgaagaatcacttgatgattattttgatgaagaatacaatgaaaaggttacacaggagagtacaaagacgaatccttctaaaagaagagttacaagatgttttaaaacatctaacaaggtacttcatttattttactttccaattcactcaatttagttttcacataaattatttaccatttcaatatggcactatgatataggctaagaaaggaaaatgttctgaaatgaaaactcagagaaataaggtacaattcttacttttctttcatatacaaaacgatttgtcaaactattactgacatgttatatacaattgatgggtattaataggaaccatatactactgattgtgagaagatagcaaatgacaaaccaatttcgcttgatgatgattttgatgaagaatataataaaaatatggtcatggcggacaccagtacttctaaaagaaaagtcagacactacataggacaaactaacattgtacttcattgagttttactttctatttaatgttacctttcatgtttgtccattaatgtcaatatgctattgtgcaggtaaggggaaaaggttgtggaaagaagagtacaaatatgggaacttgcacaaaaagtgcaattgaaaatacaattcaagatgatgaagtatttgatatatttgttaaataaatcatgtattttaacataaaacttttttaattaactaactaagaacacaaaatttaggtgcatgacggaaaaattgcttcaggaactgctaaaagaccatcaaggaaatttataatttcagatagtgaggtactgcatgagacaatttatcaagttattaattaatatatttttttttgtaacaactaatttttttcccataggatgagcacagcagtaatacaaaggtgactggggacagcaccagctgtaatagtagtaaggaagatataaacaaaggtcgatgcaattataatattgagaacattaaagttcacatgaatgagcagtccagtcgatgcagatcaacaaggattagaagaccacccacccgatactcatattaggtacaacatattacttatgggaaaatgttggttgctttagatttggtttgattagtaaattataataatatggtctttcgtctgcaggtaatttatcgtcaagaaggcccaaaagaaccaattaaaaggagggttcagccaatactttttattgaagaatagtattatatatgttcctattaatttttatgttcattagatattgtcagatgtaacgtacaacttgcacttgccaaaggaatccttggattactttgtttatttctaagatagagagttaataacattcaatataaatgcatgcatgtaccttcagtacatgtatatgagtcgatccctgcttgcttcctctaccgttgatatcctaaaagcatataaaacaagatcagttgatttatatttcttaattaatacaaatccccaagcaagaaacttaatgattaaaaaaacttgattatgtaaaatggaaatcaatcaagaaagatgagctctcggggctaccttcgctctcagccatgcttgatgttgctgcacctgctatccgcactgccccaacacctgccatccccactgccccatttcctacaaataccacctcccataccagagccaactaaccgatggctaacactactcctgatctagacatcctgcggtggatctaccaaggcactgacttggatgccctatggtggatctagccaaccagtctttcagccgtcgctaccacaaggcattccctctcaaatcggctccgatggatgagtagtggaggagaaggtagtgatgagtgagctagatagattggagaagaatatatgttcagattctccgccgcctggccttcgccctcatgtggccattcgggacaggaagacaaacgcgaccgcagcgcagatatgtggccaggaagggcttgggaggagataacgatgtgcctgcaattttacactttggtcctgcagtggattttaatttataaatgagccctcagtctattatcagtacttcagtaatgaaacgtgtttagtatttaccaaaatataatgaatctccttaggatgattgtaaacctttggatgttctaaataaaaccgcatcaaaggaactttccaaatgtgtaatatttaaatggattttacaataatttaattaacttctgtaaaaatcaggcaaaaaatatctaattagaaatttgacaatatatatatgcaatctattttcaagtacaataaaaaaaatataccatctattcagcttatcatccgtaccaataatttcaattttaaaactgccaaaaaaagccacattgttttttatataaccgtactaaaagtattgcaaaatagagttgaccgtacacagtattaaggaattacatcttatacatagaatggaaacgataccattaaaaagaatggaagacaattgttcaagtatagtaataatatggatggagtactaatccacgacacataggttcatggaaactccacggactctatattcctatataaattaatcttacaacaatgctgcaataaataatctactcttcctttcttccggagacaccagtcaggtccctatcagttctctccatcatcttccatcatagtgcaacttatagatttatattgacaaacactcacatatgcagttgatactttatattttttgacatttgattcgcagttgatacttgcacaacaaaaatataggaaaacacgatgcagagtggaaatcaccctacggatgatggcagtccaacacaggacaggtaagaatcaccctaaataccttaatcgtttgtgattgactcctgcaaactgcgacaattatgaactgattttcatatccaattttaacagttcaaacttgactgctcgagccaattcaaaggaattatcgcggttagcaagatcgaaaaggaaaagaaaactagacctgagaaggagcggatctccatcgaccaaaaattactccagtgcggatgaaacaaatgctcttcaaaggtaaacactcaagttatcatcacaattactaaaaaggaaatgcgtcatatttaacaaggatatgccaacatttaccaggaaaagaaaacttgatgaaaaaaggactgggtttcaaatgagcaacaatgagtcaagcgcagacacaggaaatcccctgcaaaggtaaaattataggcgaagaatacaattacctatgaaggtcctgtatttaataacaatttatttcaaccgcaacaattatgaactgattttcagatccaagtttaacagttcaagcgtatgtatttaataacaattaatttccgaataggtacaatacatcagaatcagtcaaaaaaagtagttatctccctgttttgacatccaattttcacagctcaaacttcactgctgaagtaaactcaacggaactcgcacgcttatcaagactgaacaggaaaaggaaacttgaccttagaagaagcggatctacattgaataacagttcgacctgttcaaatccagcaaatcacactgaaaggtaaacatacagaaaatcaacaccattgttagaaaggaaatttttccttattcaacaataaacactgactgtgatatgaataaaatcaggtctagaaaagaaaaatatcagatcccatcaaccaacatggaaacgaataggtatgttaaccacattataaaaatgatatcatcattcagtttatttttaaatcacttttttcttttatgaaaaaaatatttgtcttccagtctcaagatgaatgatcgagtaagtaaggaaggaaacattacaaggaataaggttgctgtaccaccaaggaagaagaaaaaatcaagcgtgaaagaatggaattttggcaagcctacat

SEQ ID NO: 38793 - DNA, 623 bp, Oryza sativa
tgctatttccctatggagaagatggcttcacaaacaaaatattgtacagagataaccatggatccaaatgcaagagaaaacatttgaccatgctggagtactatgcttatcgcatacaacagcgcaaaaatcaatgtatgcacttgctaatgtgtgaaaaattgacgttgcagttcattgttgatgcactagcgtgcataatccaatataggctggactggataagaaaacatcaagggaatcttagaactgaactgtatgctggcttgcaggatgcaattgaaaggggtgacacaagagctgaacaggttggaaaaaggatactacttccttcatctttcacaggcagcccaagatacaaggcacaaaactaccaagatgctatggcaatatgtcgttgggcaggatacccagacctgtttgtcactttcacgtgcaacgctgcttggccagagatacaaaatatgctaatgaaataggagttcagaaaccatcagatagacctgacattgttgaccgagtattccatataaaattgagggaattgatgacagacataaaggacaagcaatactttggaaagactcttgcaagtaaaaatcctaaacccgcatattcattag

SEQ ID NO: 38794 - DNA, 711 bp, Oryza sativa
tcgaattcctgcaccccgtatgcttattaattactaaaactaagctagaatatatgtatgtagctttttgtcatttacattgatctcaaatatataggaaaataatatatatatatatatatatatatatatatatatatatatatatatatatatatatatatatatatatatatatataggggggatattatataaaaaagtggcgcatatatgagggcgactgagaccccctcagctcagctagagaggagtagtatatgagttgagctgagcaaatcaaaatggcccccatgaaacactctagatcactctgtgggatatcttcacactctagcacgctctatctctgtgaaaggagcacaaggtgaaggtgaaaaaaacacaagagccgcgcgtttgagtgggccctctcagccctctttgactacaccctctaatttgtggtcgcaattaacatggcaatcctattgccacgccgcactacgcgtgctatacaccgcagagacatacacatatacgcgatgtgcaaaatgtgcgcgtgattaaaattaatagggcgtatgcgaaatagactacacatttgtgaatagaccccatgcgatatatgtggggtcgcgtgtgtgaaatacttgcgtatatctcactcagagacgaaatcgcgcgctagctcgctcagctatagctcctaatatatgtctgagcctcagg

SEQ ID NO: 38795 - DNA, 11267 bp, Oryza sativa
atacaaacagagaaaaaatctcaactatcctacgcttcgcctaacagagcaacaaaaaaagggacatgctctgatagaaatagaaaagctgatgagacaagctggaaaaacacttgaggaataccctgatatagagctaccaaaatgtgctgaactacgggaacttggaaacagacttctgaatgaagaaatgagctatgacaaagacaagcagaaagaggaacatgatagcatatttggtaaacttaatgcagaacaaaaggtagcatttgattcaataatagagtcaaccaacaaggggttgggaaaactaatgtttgtcgatggctacggtggaacaggaaagacttacctgtggagagctatcacaaccaaactacgttcagaaggaaagatagtactcacggttgcatcatgtggtatagcagccttacttcttcatggggggagaacagctcactcaagattccacatcccactaattgttacagaagagtcaacatgtgacatcaaacaaggatcgcacctggcggaactacttaaaaaaacatcactcatactgtgggacgaggctccaatggcaaacagaatttgcttcgaggcgctagacagaagtctaagggacatactaaggtccaagggtgaagataacagcacaaagccattcggcggtatgactgtggttctaggaggagactttcgccagattcttcctgttgtgcgaaagggaagacgcacgcaaatagtaaatgcatcaataaaacggtcctacctatggcagcacttccacatcttcaaacttacaaggaacatgcgcctgagctgcatctcaagagatgaagacgagcaaaaaaggactgcagatttcgcacaatggattttgaacattggtgatggcaaaacaacatcagcggatggagaggaatggatagaaatacctgatgacctgatactgaagaaaggaggtgatccaaaggaagaaattgtgaagagcatatatccaaacttggtacagaattataagaaacgagatttcttagaacagcgagcaattctatgcccaagaaatgagacagcgaggaaaattaatgaatttataatgaacatgatagaaggagaggagataacatatctgagctgcgacactgtatgcaaagcaacaactaatgacagtgaaaccgatgtcctatatccaacagaatttctaaatagtctaaacttccctggaatgccaaaccatgtgctgaaactgaaactaggccttccagtgatgctactgcgaaacattaaccaaagttcagggttatgtaatggtacacgaatgaccattactcagctcgggaaaagattcattgaagcacaaatcataacaggaacacatgtaggagaaaaggtatatatccctagaataataatgacgccaacagagtcaggatggcccttcttgctaaaaagaagacaatatccactcagtgtgtgcttcgctatgaccatcaataaaagccaaggacagtctctaaacatggtaggactatatctgcctaagcaagtattcacgcatgggcagctctacgtagcgttctccagagttacaagacgagatgggctacggataatgctagatgacaatgaaagcccaggtgaacatatggtcaggaacatagtgtacaaagagattttctagaaggtattatatcattctcattcatctatattgatcatacaaactatgttgcaaactactcatgggtaccttatcattgtaaatattcattgcagctgctctattcctgcttctctccagtacaacattgattgtgctacaacatactctagcgaaaggctgcaattcaaaattaccatttacagtgagtatttttaccagctgaaataggatgatatttcaaacattatatcttcctttcacaaacaatatatttcatctttgtactatattcaataattactacctctgttttcaaatgaatgacgttgattagtgcaattttgaactaaccggcgtcaaacaaaaagaaatggagagatataaagttataggataattacattttccttctattataacatttttccccagaaagtaaacatccatgaaccatttatttttttagacaatggattaaacaggcttaaacatccaaaatacatgtacacagccaatgagccatttaatcacatcataattccgcaatctttcgtattatgcacataccgtctttccatagagctgtgaacaacaactccatcgctgccaattgtcccctggcgaacaccccagcagctgatgccaaatccactaatcaaggaaaatagagaggacataaccaatacagacgaaggaagatagagaggtcgacacaccgcagccgccaacccacccactgagctaggagataattcaaggaggatgttgaggtgaggacggaacatgggaggtggatatggacatggcgctgcaagcctgcaacagccactggagggagggagacgggaaactacaggagacccacgccgtccccgccacccgctgctctccgcccgcggaccacgccatccccgcctcctaccatatgaagttttgtgaaggtctggtatggtaattatatataaaattatcaaattgaaagcattttttactttgaagttacaagctttttttactacaattagttaactacgaaagctcaattatacagagccatacagacaccctttatgatgggccaaaaaatctcaaatatgcagtacaagagggataacttgaacgtaaagcagagacaaatcgatacagagcaaagacatgggaacagagcaacaggacattagtgcagtacacattgacgatgcagggatgcacgatgcaatacctgaggacagcgcctgttgtacagcccaatcgcgagtgaagcggttggcgatgcagtagctcggcggcgcaaccagctcggcctcgcactccacaaccttgcgggagcgcacgtcagatcgagacctccgtccccgccacccgcgtcgccgtccccccgtccacagcgcctgcagctctccgctaccgctctctgcccgcaacccacgccatccccgccacccgccgccgtccccgccatctacgccagcaacccacgccatccccgccgtctgacgccgtccccgccgcctacgccgccaacccacgccatccctgccgcctgcgccgccgtcccccctgcccaaagctctccgctcgcacctccggcccgcgccatccgccatccgccatccgccctcctcgtccgcccttcccctcagacctcatcctttccattttcccctcttctgtcactctctccttgctatccatacgtatactcgtatagcggaatagaaaagaagagcaaaaaaaaatagcttagacagagttacagagtattagttgcctactactaattagtattttagtcaaagcaaagtgatgcaaaatttgtttggttaagtgcagtttttttttcacaaatgcataattatttcatctacatagattaacaaaatttaacaatcatctgtttttcctgtacttgcgagacgaaacttttaaaactaattgcgccatgatctgacaatgccgtgctacagtaaacatttgctaatgaccgattatttacgcttaataaatttgtctcacagtttatatgcggattatgtaatttgttttgttaataatctatgtgttaataattcagataaccacttttctctatcctctattttacacatgcttctaaaaaatcctacgctatcacatgatttaaaatcttagacatattattttggaccattacattatatcttttcaaaataaaaaacatatataaaatataagaaaaaaaatatgaccattgtaactttaatcggtaaaacaattatttacatccgatagaccaatccttaaaaatacaaatccattccacctctctcccatacataatcactcgtctctccacgatatctgtacgtacatgcaagatatatatcttgcatataacagaattttaaaaaattaccatcgagacaatcgtcaagctactaatgcaaaggttgtttgattattatttgtccagatgataatttgatctaactgggttaatacattttaaattttttacactctatccaaacatccattctattccatactatattttaaacattcatttctatcatatttatataccattttcttttcttttctcaaaatcatttatataccattttctattattttctaaaaatcctgtgttacaaaggaaaccctaaattctttctaataacaacaaaaattatgatagtttaaataatatgcccgcgcaactgcgcgggctaccttcctagttattaactaaatagtaaattaaatacaccaccaacaaattaaaccagaacaattaagtgctgcttgtattgctcgtcagatggtgggtcacgaaactcaattgaaaagaagggtacagtagtgttccgctctactctcagtaagaagatggtaattaagtgtgatggatttgatcaagtgagattgtgcttgaaacttactgacaacaggcgatggcgatcgagtttgacctgaacacagttgatgatacaaatttggcatttcacatgtgagacttaatataacaatcgatatattaatttcacttcatcactagctacagggcgtcacgacacgtcgtaattaaaattaattagaccagctcgctaattaactatactcttcgatacaaagtcaactccatgcgcacaagctagagacgaatgcgaagaagaagaagaaaacttagaagatgcaactatatatcaaacatatatataacgagatatatatagtattagcaaagaaagagagataaattaagggatatatagatatattggtagatccttttgcaaggtcaactccataaacaaagcattgatgcaatggcaatgtcaacgcccctccctcgccgcccatttttgccttctcccgccgcgccgccgccacttcgatcccccctccgatcgatgcgcgcatcggatcgccgccgccgccgccgtctcgtctgagtcgtcctcatcaccaccatgggcaacagcttggcgagcctggcgacgccgtgcttcgcggacgccgccgccggtggtgggcgcgggcgcggtcaccacgccgccggcgacgacgccgttgcgttcgacgacgacgacgccgcggggggctgcaacagcatcggtcacattctgagcttcgatggacgcgatgcgccggcgttcgccatccatggcgtgttgctgccgtcgaacccgtcgacgatggcctccaccggcggcggcggcggcggcggcgcctccgtcctcaacgacggcgcgctgtccatcgggtcgtcgtcgttcgacagctccaactccttctcgttccggacgctccagccgcggcagtactccgggccactggagtactgcaccacgtcgccgtcgacgtcgggcgcgtcgtcgtcgcggcagctcggcccgcgcaccgacaagcagatcctcaacgacatctacgccaaccggcaacgccgccggtgtcaggggtccaaggggccgccgctcctcggccgcctccgcaaggcggtggcgtcgctgctgcgcgccgggccgtgcggcttccccgagcaggaggagcccgccgccatgatcaacggcgtcggcgtggtgaggaacggcgaggagagcatcagccggaacgtcgacgcggcggcggcggacgacggtgcggagagggtgcagtgggcgcgcggcaaggccggggaggacagggtgcacgtggtggtgtcggaggagcacgggtggatgttcgtcggcatctacgacggcttcaatggccccgacgccaccgactacctcgccgacaacctgtacgcggccgtgtgccgcgagctcaacggcgtgctctcggaggacgagccggatccaccggaggcggcggcggcggcggggcggtgcaacgggtgcggcggagcggcgcggcaccgcgaggtgctcgacgcgatggcgcgggcgctgcggcggacggaggaggggtacttcgcggaggcggaggcgcgcgcggcggagtgcccggagctggcgatgatggggtcgtgcgtcctcgtcgtgctgatgaagggcgccgacgtgtacgccatgaacgtcggcgacagccgcgccgtgctggcgcaccaggccgagccggacctgtcccacgtcgtgctgccgcggggcagccaccacgatggcgacggcgacctcgccggcgtgaaggaggcgatcaagcggcagttcgacgagtgcgagatgggggagctggcggcgctgcagctcaccatggatcacagcaccaatgtgtacaaggttattatactccctagtattcaccattgcattcagggtttaatctttcggtttggacgtttctattgaagggtgctgagataccaacattttgaaaaaaaattacacaaatttaaacaaaatattgccaaattcacaagaaaaaaaataaaaaatttggctgaaactatatcatattgtggggaggggtctgaaatgaccgaaattttgaaactctgattgcattgacattgtattggttggttctgatggaactaattgattggatcgccattgaaatgtgtaggaggtgagaaggatcaggagtgagcacttggatgatcctggctgcatcaccaatggcagggtgaagggttgtttgaaggtgacaagagcgtttggagctggctacctaaaagaggtgtgcatatttgtatctaactaaattttattcttaaaccacatattaatcctttagtgactaactatatcaagcctaactatagaagaaactaactgtaatgactagcttgcgtacatttcaagttaactttgatcaaagtcaaaacaacttataatctgaaacggagggagtatttggtgttgcagccccgttggaacaaggctctactagaggtgttccaggtggattatgtgggtagctcgccgtacatcagctgccgtccgtacatccgacaccaccggttaggggcgcaggacaagttcttgatcctctcgtcggatggtctgtatgactacttcacaaaagaggaggtggtggcacaagtggaggccttcaccgccggctaccccgacgaggaccctgccaagtacctcagccaccagattctcctccgggccgccaatcaagctggttagttttactctctatatataaactccctcaatcttaaaatatataacaccgttgacttttcgtataacgttggaccattcgcgttattcaaatttagtaattctctcagtatctccattacaagaaaaccgacaatagaaaaatgtgatacttccttaataaccgtaaaatcactccttctatatatgttgctatttagttggcaatgctgtttgttgttgttttaactttgaccaataataatcgtaatagtgcttgtaaatttactaaaatgaatggtcaaagtttgaatgtaaatgatgcttgatgacaaatttttaggaactgaagaagtaatagaacctttctttctcatagttattgtagaagaaaacatacctgaaatagcttgttaattttctggttacctctatcttgttagttgcactctaatcaagtcttcatttttttttctttcagagtcaagaacatgtaattgtttacttattattacttagggttaatattgattttaatttttttgatgcattatttgtgtagggatggggttccatgagttgctagagattcagcaaggagatcgacgacagtaccatgacgatgtctccatcattatcatctccttggagggaaaaatttggagatcatcacaatgaactaatcctgtccatgtactagtgattaatctctaccaccaatattgcattggtagcatacatgatgcaatctacaatgtacaaaggatcaatcaatcactgagggggagtagcacatgcaatttttttcccctcttgtaagtcaaaatcaatcacaaatcaatgagcaagttttggcggcagtttattttttaatcttgcttccatcgagttttatgaagggattatacatgatacttcattttaggatttctgttttgattctctgtgtactaggttaatataggttgcgtttagttccgtgtcctaatttttttaagtatatggacacacatttgaagtattaaatatagactaataacaaaacaaattacatattccgaccacaaactgcgagacgaatcttttgagcctaattaatccgtcattagcacatatgggttactgtagcacttacggctaatcatgatgtaaataggttcaaaagatttatctcgcgatttacatacagcctatgcaattagcttttctttttatttacatttgatgctccatacatatgtccaaacattcgatgtgatgaaaaagttgcaagtttgaagaaaaaagttaaaatctaaacacagccgtagtagttttttttatctcaccttctatataaaaaagggaaacaaacaaaagagctttatcaaaatgacaataatttgtatgtaagcagaagacagaaagacacttagattttatacttcggagatttgatcatataccttcttttatatcgaaaaggtaggcaaaatgtgagaaaaatgaaccaaaaagcagagctgttcccataagcagttttccctcattggcctaaaaaaataagtcaaagctaaaattttaaattttaaaaacttaattttgaagatgtttttaatgtagtttctttttagcactgacttatagatcaaacacgtgtataaaagttttacccacattgttttgattgctaataaaccgttacgacttgggtaactgacgaggcttaaaacctatgttacttaaataaaaaagtattatgttttcaacaacatataggagggagctatgtaaacgggtttgatttgaaattaattcatctaaaaatgtttgaattcctctaaaaaacgaaggagtttgaattgagtgcgagcagctcacttggaaattggaatgtcccaagctaaaacaaaaagagtgaatccactagtgtagtgctccactacactcttgcaatagcagagcagggtatataaaatctggcgaatcgagaggaggaggcgatcaattcgattaaattcactaaaattcaattcgaattcagatcgaatcgagggatcccccatccccatggcgtcgccgacgtcctccgcctccgcgccggcgagccaccacctgcgcctctggtggcgccgccgcggccgcggcggcgccgtcggggccaccttcaccgtcgcgctcctcgccgccgcgctgctcctcgccctctccttgtacgcctcctccctgccccgcgcgcctaccacgccctcctcctcctctaacctcgtcggcctcaccctcgtccgccgcgccaaggagaagggcgcgggtcagtagtcctctcacctcgatttgatcccctttcgtgttttgcaacatagttggtcaggtggagtgtgtttatgcttttgagtgtgattttgcagtgtgcttggatgggagcgcgccggggtaccatctgcagagaggctccggcactggatctcaaaactggctccttcacttggaggtgagcagccttttggatctagttctattgatttagatacagaaccatgaataattagtttagtttagaggacaatgcatgtttcgtgggtttcaaaacccttgaaatttaagcgctggaataactgcactttcgagtaagagttgctcatgttgttcatgtcatggtatgatctataaacactccgattatgatagcctgacacaaactttaggcatgatttagctgtagctgactcggtgttgatgaaacaatgggcctagaatggttttgcagaaaactaatgtttggagcatatcagcgtatagcaatgcgctggtaatggcacagttagattattcatgaaatgatagtgttgtggtatctagagggcttcttatttttaccatttttaactaatggatacttgctaattgatgctcccgagcttcagtttcttgtctgcccagtttttcttgtttgcgttattgtctttgccattcttgtcagcttttcaatttcctgaattatcgtgttccatgagctttagggcggaggctggtgccggaatctgaggtcatgtgcttcacgtcaaaaatcggtgttgggttcatcgcaatacatggaatgccagattgagtttgctgggatcttgagtaatgacaaatttcaaaacccaggtagctacattttatttttatactagctgtctgctccttttattaataatgtgatccagtattcaaactgctgtattgcatcattagtacaatctacagtgtgtacagtagtcccaggtagctacattttatttttatactagctgtctgctccttttattaataatgtgatccagtgttcaaactgctgtattgcatcattagtacaatctacagtgtgtacagtagtcgtgccttctggtaaaataatcatgtccaaataactcgagttctgttgttgcaacagtttttttacaacagtgttttcagcagcatgaacaagtcctcattgagactttgaaaatttcttggatagttatttacttactgtattttgcagcttaacctatcgtatcatattttactgattgtttctgacataaataatatatttcaccatcatctgtatataactagcagttcatgcatttgtatcatgtgttcaaacagaactatccatctagtatttacttggtgtgagatcaggccaattgttgactacagaacaaattccttgctcctttcaggagtaatatttttgaactcctaaatactggtagtctcattcagcttgccttccatgtgcagatttttacaattggaataaagttaagataaggtattgtgatggggcatcattttctggaaacgtcaagaacgaattgcaggtctgatttgcccttttttttttcaatagatgttcttagtaactcagtatttgttctgacatccaggtattgttaatcattgcagaatggcacaaaattctttttccggggccagcgtatctgggaggcagtaatgagcgaacttctactaaagggactcaggcatgccaaacaggtaattcctagcaa

SEQ ID NO: 38796 - DNA, 6264 bp, Oryza sativa
tgctggtgggctagccactttcattcactgcgataatttccgtacactgctaccaaaggattctagggttaagtgtcttgcggatggtggatttttcctcgatgtgtatgtttccaaatcacctttgcacgtgctttgtgattttcaatatttttttcatgcatgcatgaagtacttgctagatattctgtgtcaatctgagtatttgcagctgtaggcacaaatagtaactagaagacttcaaacatccaaactatttgagtgtatgaacattgaaaatcttgtactgacgtatatataaaatgaaatcgtccaacgagatgatattgtgttattcttactccggtgtcttgttataaaatcattcctggactgggccaactcgaggtggtacatatgcattcattctgacctttcagattagatttttttggagtttgcacttcctctacggcatcacctaagtcactagttcatttcaaggcattaattgtcagcaagcaaacatgttgcacactccttcagcactagctgatcaggaataagaaagtatattcaatatgccattttttcagagagaaaaaaatatactgtaatagaaaattgtactgcattatcttcagcttctatctatctcattatgtttttttttctccattacagagaggacatttctgggcaaaggaccatgcgagcattctacaacgatgttgtccgtcttcaggtctttcccttccttcctcctataaagttatctgtttccaatactcaaatctctttctcgaatgtccttttttcaggatctgcgtggaaggtttccccattgtggtccaaacatggatctgggccaggttagtcatggtatgcatttatatcagtaatcttgctatccctgatcttatgctttactaaatcctggccattaactttgttccagtgcttcttcccaagtgaagttgtaaaggacatcatcaccccagtatttgttcttaatccagcgtatgatgcttggcaggtatccttatttccaccactagagttctccagtgttgtgtaaaactatcagtgtcaaatattcttaaaaattcccatttcaggtgcaacatgtgttgagtccagtagcatctgaccctcaacattcatggctagaatgcagactggatattagcaagtgtgattcgaaccaacttgaaattctccaaggttgagtcaccttgtgtcttattatataattaacttatccgcctttcaggattttgtagtcatgtttttctatatgaaacatactttgcaggttttaggaaaaagttacatgatactataagtgaacttaagcacaaaaaggactggggcttttttatcgactcatgctttatacactgtcagtcgttgaactccttgacttggcattctccatcttctcttagagtcaacaacaaggtaatgctttcatcctctaaaaagaaaacagaaagaaaaaaaatgtctacagttcaaggaacattatatattatgtcaaattgacaaattgtaggttagcctgtgttgagggctagcctttgcaaatttatggtgaccgtcagctgacttaacatctagtatttacagtgatgatgttcttgagattatttatgtgttttaaactattcgatgtacaagaaagaaaggtgtcctgttagtcacaagataagagtgactctataaatagtttgccgaggattcagcctataaaaaaacaggaagaagctcctcagcagtcagctgtgctactgctgtacatgagtacatcgtctaagccccataaatatattatttaatgtaacatcacaggacatccctttgtaggtcatctgttgtagattgcatgtctccactacggcattacctcatgttagtttaatttcctgcacatgatacttactgagctaaccatgaaggtgtcagtattcctccaatcttcttggtttacttcttcaatattttgctcgtggtctaacgttgaatctgctgaatagaccattgcagaggcggttggagattggttctttgacagaagagaggtgaaggaaattgattgtgaatatccctgcaacccgacttgccacaacttggtttttgccaagcctttcaaggcatgatgaagttctaaacacgtttctctttttgccatgatattgtaaaacaggaaattttatatcaatcatcggtcatcatgtaatcttcagactcgtcgggtgtttgacacccaaaatcatacatctgagatagttagactggccgaattttttttccacgcaatttatgtaggattataagtagtttattcaaaagtagaattgtatgtgctgtacttcacaacttgttttctataaaataaacaaaaagtgtatttcttgtactgttgtagtattgcctatacatacatgtctggtcaatctaccctatcataatttggaccctgtacctgccatcaatcagcttagatattttaattttccatacgattaacgtaatgatttctagctcttgaaagcaaacatgtcgttttcttctgaccttttgaccttgttctaataatatgcgtggcatattgattaattgaggagatgatgcaatttaactgacaattccatctcacgaaaaggccagccatgggctgtcatttgagatagatgggcatctaacctgtcattatccgttaagcagtgggattactgatcgtttccattacagggacgcgcacgaggcagcctgagaaaagagaaggaagctaatgaaaacgaaagcggccaagaccaagaaaacgagtcgacggtgatgccgcgttaggtcgctcatcaacagttgtctctctttccctccatttctggtccagccataaacaccattaataccgtttttttatcctctttccaaaggaaaatttgctcaatacttgactgaagttaacatgacattgttcatcactcgttttcagaaaagaaaacaaaaaaaaaagagaggggacattattcatcactgtagtggtagtgtgcctataggcacgtcactgctctccaggaacaaaacgacacaaccattgtctcctaattcagcgtctattgggacccaatgggagcacaagtaaaaacagccattggggctgagtgatgagccatcagagagtaattaatcgcactttgaaattattagttagtttctgtcacatgatgaggtgtggcaccaagatattttttgcttgagtgatcatatggactatagaatggccaaagcttcacaaatatctgtccgtgttatcgtcagttcgtcacaagaagcaaaagaactactaggtcgatcaccaagcctgacgtggaattgcagccatgacttggaaggtttccaaattccaagttgtgtgctgtgtcctggtcaaaacaaactacagtagcacttggcttgtgtctcatatagtcatctcctagtccttaaactctgcataacaacaaagcttttgccacaaaaattcttgttatctccatgaatttctttcaatctaaacccaatccacacggcagacttcagtgttaatcagagttggtcctcagtctcacctaaacctatgatgctaagtccatctttccaagtgaaatgtagtggtatgatttgtcgatagaaaaattatgctactcctggatctcacaatatcactgcaggtaggagcacaagagaaggtacagatcgcaaggacaaccatacagctacaggcaacaacagtcttcattttatcagcctgaagaaaagaaacaatctgatgctgatgccatcacgaacgaacgaaggaagccaattactagcagtaacaatccggctgtaacagccggacgacgatggacagtggcactgacagagacagtgacacgccaccacagttcaaagaaccggtacacactggagtacggtacatacaatgtcatcacataggcagagaccgcagctgctgaattcatggcgatccaatggaccaccctgctgatggctgcagcatcaccaggacatgaactcgcaccattataacacgagacaagggccaaaaatgggggcatgattcatcacacagaggaggaggggtcaggccggcgcagagctcacatgccatggcaggctaactttagaggtgacgaacatgaaccccgtttcacatctctgctgcatgcatcccttaaccacaccaacactcactgtgtgattgatgatgaattgctctcactcactcactcactctctctctggtctttcagagctcctatgcatatgctaagcttaacccggcaagccgaaaaatagggtgggcacacagacaatggggagtggagggttctacttatttagtccctatctatttaactttccatggatcaaagttgctccaaattagccattggattttcatctgggtttctgataccaacggatgttttgaggatgatgcggcgattgtccgtgcgttgttctgctttcatagatcgtgctcaggcttgtccaggttgctgctgtcactgtccgccatgcggctcgagccacggccaagctttgagaaggagcccatggccgaaggtagccctttgaagctgctgctgccctcactgaggttgtgagatcgacgcgaccgcttccgggtgagctgcagggatgacggcttgtcaggatcacaagcagaccttgtttgggccaccaccagccgtgagatgctgccccggcagaatgggcaggccggtgagggcggtgtcagggtcgtcggattgggtttgttgtgacagcacagtgccagcgtgcacggtgcacacatttgatgtccacagtcttgcacctcaatggtgcaagcctggtcgaagcagatgcagcaaagctccgtgtcgctcacctgtgcccaaatgatcaacacagccattcagtcatcatgcaaatgcacagaaagctaaattacacaatgtgtttatgggatcccaatctgacagataacactgaaattgttcagcactcaaatacctctgagcatgcatcgtcatcggcactgtcatcaccgggcgaaggggatggcagggagtactttgtgccattcaggattttcttctccctctccctgttggcttccatcagagctgcttccaggagagccttagcttctggttcaagctcactgatgaacttaagtggggatggccacaccatgggctctgctgatgtagggttcagcaaagctgcacatgctccatggttccgtttcagcgcaacagaatagggaattctcctggggaaacaaaaaccattaaaattaaaatcagtggcagagcatgggcaattcagcaaaaggacaggtcaagtttgagaagaacagcaagctcatgtgaattcagcaaatggtcagcgagttcacctgttactacttgctagactgaggtctactgtctaagaactgcagggattctactaagcacctaaattcaacacctgaacttcactaacaactatgcttgatagcacatcaatgttttcttctatatgcgccaagacaaaaactgaagggggaaagatctagttctcacccagccgaatccctttggagccgatcagctccccaggcaagcagcttcctgatgcaatccaagttcccgctacgagcagccaaatgaagcgacgtgcttccagggaagctgcatcaaacaacaccaccacacgaatcagcactggtagcaaggaaccaacagagctgaacagctgatcaccaaacattaatttgggatgccaccaagatcagcagcattacccatatgatcctgtcaaagccgacacaatggcgccgttctccagcaacacctgcacgcaccccggccgcccctgcctggccgcgagatgcagcggagtggcgccgtggtcgtccctgacgttgacgaaccgggcgaaacccctgccaagcttcgacagcagcaagtgagctcacagagacatccagagctattctatagctgtaccaaagccacacgacaggatgaggatgatctcaccatgagtcggccaccggcgtggtctgcgcggcggcgaggatggcctgcaggcagtcgacgtggccgtagtacgccgcgtggtggaggcaggtcctcgcgtgcaccgagtcgaacatcaagatctggtgcgaaatcgtaactgttactgattttttcaaacagaattactacagtattatcagtatactgattttgcagttcttttctctcacatttgcgt

SEQ ID NO: 38797 - DNA, 16788 bp, Oryza sativa
  unsure (1)..(16788): unsure at all n locations
gcgagcgagggaagggtcggcggcgatgaggccggccagggagtcgaggtcgccgagctgcgccgcccggaagaagtcgtgctcgtcgccggtgcgggcgcagctgacaccgtgacccatgacagcacctccctcctcctccgccgccggcgaaggcgcagtgggtggcgctgccgtggaaggaaggccgagagtgagaatggggaaaggaaggagctcaacgcctctttattgacccttcttccttcttcactctctctctctctctctctctctctctctagctagtctctccctttctctctcctctctttttttttaaaaaaagaagaaatattcaaaacaggtagaaatatcttcgaattatttatttgagcctttcactgaatgctgaaatttttttcattcctcgtaactgctaccccccccccctaatttatgactctcttcaactcatttttacaattcagtttgcagttttttttttactttttccaattggatgaaaattgtacggataggaaaagtatccatatttcaaagaaaaaaaagggtctaaagtttcttcgattccctgtgattagtctcctctaagaaaataacgtgggtatcactttacttttgagaagtctcctctgtgttctttcggccagtgatcgatcgatgctcttgttacctaaaccgcaggtgagattagattaggtgctaatgctactactttgtactacacgcctaccgttgctctctggttatcgtggacccttctttcccttcttcaaaggcaagtctatgtaaaatgtctctagctagcctctcttattttgtgttgccactgcactgcaccacacaaccagactgacaaaaaaaataaccaggttgattggcttattgggctcatttgccaagcatttacagtggctaaaattgtactagttcttttttgggtaaaatcatgtttgttgttcatatgtgaaagtagattaatttattgttatttttaacattaccaagtttttcattgtcgaaatttaaagaggcaacatagcaaatacgccattaccaacgcaacccctgctaaattctaataattctaaaattttcctcttaaaaccctatcaaaatttgaataggcctcgaaccaagcactagaaacaattattttctttcttttttttgcaattttttttgtaagttgtaaattgaacgagtcaagcagttttatttgataaagaaattgtcacccgctatattttatttccctctatttatccactacatcatcataacctaagcaaaagagatttaagagacatacccaaataaaaaagaaatgtcgtagtaatctttgccgaataggagaaaaaagattagtcatcatttcttttatatttttccccaataaaatgaacacgcgtgtactcttaaatcaaaactagcgagatcttttaaatctgcttgcgtccttcatggattaggtaatcaagaaaatacactcaaaactgaaaaacaaaagtgaggagtcgtgatctttggggatgagtcggcatgtatgattgatgaagccatgaaggcaatcatcatggtttatcttctcttttttccggtgtggtggaaatggttttattggacgtatatattattagtgggcacaaatcaaattattgcgaacttgcaaggagacgtgtgtgtacaagaaaaggagagcagatggtaaacgtaggacccatcactccatgcatgcgtggtaccatactaccattagacatgcaaagctcccttttaattagcatgatcatacatagttaacttaatttgtgtataatatttttctttttttcctccaaatgggggttgttgcaagtttgaaggagaatgattccctccattttcaaggcgacatattgcaactttgcaagcaatgtggctcaaagaagggagcactttgtaaaagtaaataaaagtcttttttttttgggtaatgtagtgtgtcggtgcttctttctttccggctattattatgttggaactgaattattgaaatgagttaattagtggatagcacaaaactattgtgaaattaaatgctgatttctaggtaaattaattaatcgatcatggaatcatctatcccgtacatatttcctctgttctaaaaaaaaataatttgagtggggattcaacaccatttagaacgatgaatctggataatctttttgagtggggattctagcttgattttttgttgacaagagggagtacatgcattggggacacgaaatgaagtttttcgagattgagctgtaaaggctcacaactcgtacaagaagaagagttttgacaagaagccttgattgatcgtttatgtgatccttactctcgttctgttgtgttttgtttttcttgccccatgtccgatatatgcatgcagaatcgtcccatcacagattcgaaatggggcattctactggagatccacagttttgacaatggtatactgtagtaattgcatcgttttggtagtagagttttttttttaaatggaacatttgcagttattgttagctggggtaaaggactgcaatttgcaatttaaaaggaacaggattagatcacgctaaccaaaccatatggtgatgacagtgtggtaagcagggttgaacatgagaaggtatttttagctcctcaaacaaacaaatgagctccgttttcttctctaaatcatttgcttaaatctctactcaagaatccagatctctaaacaatactttagttaatttcaaagaggccctactgatttgtcggtttgcatccaaagatgatgggcagggaagatctcccgtgggtaggagcagaagcagagcatggaacaacgagctaagcacatgtcatgtacacacccatttctcatttcttattgattaattggttcgcacggttcagaaggttaagtaggagtaattaattaatgggtacacacatcactgtggcatgtacctggacagatgaaccactggccccacatcattttcctgcctagctacttgcttaatgcacatgctgtgttacataatccatcctacttggatgagccaggttagtttactgacaccatctacttaagttatttttgagctgatggatgcatggtctaaatgattcactagtactatgatcacatgtagccatagatgataagcatatttcttatttacccaaactacccaaccaatcttattattaaatcttgagcagttgcgccgttaaagttagctgctttaactcaaatggattaaccttagcttaacttgctgacgagagcctagctagctccatgaccgtgcaacagtgaatgataaaagagagatataatcaaattgtcgtcaaattaactgcagatcagagatgcatcgatcacagccacttgtgagtagtgtacgtaatgtcaattagcagaacactactgttccaattgggccactattagggtggacctaagcttgcctagtgtggtctcttgctgatatatagaatcagttccaaccactggttattgttactgtggccccccatctctcttgcactgattccactgatcatcgatcccaattatatatgtatgtggcacgttttatctcatcacatttctattttggtagtactgattagtcaaatagagattagaaaattaagcacataatacatgttttacattaatattgtcttagtttttatatggacttctgaaattaatattgattttgtgaactatttggctttttaatgaaagctgggcgtatgcatttcctctaaaaaaataatattgatttctcagttttctatgcaaattagggttggcgaaagatggctaaaaaataaagtagaaataatatagtatgatctcaacaaaaacaaaacctaccaattttcggagtctctctgaaaacatggacaatgatttggtgggggagatttaccatttaagttttcctcaataaagtttgcttttgatcttttatgaaaaaactaaagtcagaggaaaatatcttcgcccgggtagtacgcgtggcatgcataatgctgatggatgtttcattagcaaagacagtcacaaccaaacaaacttttggtttaattaaaagtaaacccgggattagaatatataataacatccttatatattgcccaatgctttctgttaattagtagtaatggtttcgcaatcaggttgatgacatgagatgctcgagagactgacacgtccattaccggacggaccattggttgttactgatgttaatgttgttctgttcacaaggattggcgaatcgaatccaatgaagcgtgattatggtggttgctagatctacttgtaattatcaattatgactcactaatcactgtagtttggatgctaaagttgaaagaattggtgctaatggcttcggctcaccaaacattggtaggtttcgatgctgacatctctgaaacaggaatatggttttacataggtgaaatctctgaatttttactcaattttgcatactctgataatctgaatctgagctagcattccatttgaaaatcacagaaataacaggaatattgatcgttcgtagcatttctatcaaatcccgcatagtttatggatcttaaaaaataaacaacaaagctagctaacacattgaaaatttcaagttccattcaggagatcgggctatcaagctccaatcccttgtgcaaatcattggttaccaattgagcccagcccatgaaagacggataggaaattcggcccatttgaacatatgagcaaacagcagcattgtcacctctgaatgagtgatcagaacgaaatcaaaattctcaagaatagcatatggcatcatacgcgctcctctttttttaaaaattttttttttcagagaaatgtattttttacccaacctctatatccaaccggatatatgcagccatttaaattagaaacttagccccacaaacaacccaaattcgctcatatgaagatttgagctcaagactttgagggtgctaattagctcactgcaaccactaggatcatttgtgctcctccatgacccgttctagtaattaaacactgttccgtatcaagaatccacgatcccttcagacaaagaaaagacattctccaatggcattttcctgaacccttgactgaatctctgaattgttcagtttaaaagaaattaatgcaatgccaaagttgcaaaaagaaccaaccaaccattgctgcagaatacaaatcgcaaatgcgttcgtgttcaataatcataactgaatttttatcatttgagaatatgtgtagacagcaaaattgcaatgtagaagtaaaaatatagcatatggaggcatcccatgatccgttgtaaacattgagctgcatcacgaatgaatttatgatcaggccatcagggaaaagaaacatttctccaatggcgtatttcctgaacccctgactgaatctctgaatttttcagttagagaatgcaaatcgcgaacgcgatcgaactcgataatcaaaactgaatcttttatcagtaatgttttcatgtacactgtataatcgatcgcaaacgtagtatacgtatacaagcgctcatcgcttctctttacgaatcaatcaaacccaatcaatctcgcaagagcggattactacttcttattcacaacttgatcgaacttgaactctcatcaatggcgcgcggatcatgccatcttgctcagtagtagccaccgtacgccgacgccatgggcatcccgtactgcaccggcatggcgccggcggcgagcctgtccatggcgacctgaccctgcatgccgccctgcctgtactgcgcccacatctgctgctcctgcaccagcagctgctgcttcctctccatctccgccatctgcacgtacgccggcggcggcacgcccatcgacgctgcgaacgggtcgccgccggtggttcgcgccgtgccgtcgggcgccggcagcgccagcacgggcgcgcggcgcggcgccgccacgctgctcgcgctccccgtcgccgcctcgtgcgcgcccacctgctgccggacggcgccctggtcgtacatcccgtgcagcagcagcgggtccagcccgccgcccatggacgccttctgccgcgacagcttgctcgccgtctccaccagggcgagctcccactccgccttgccggcctccgccgccggcgtctgccacgccgacgtcacctcggccgcgtcgtccgacgggaaggccacccacccgccgttctccgtgccggagaagagcgccagcgcgagcttgttctcctgctcgtcttccaccacgggttccctgaggtcgacgaggtcgccagtctgcggcggcggcggcggcggcgccatttgttctggtgcaactttctccggcgccgatcgcgatggctcagcggcgtgatgctccggcgccgggagcgccttgatgccgttcatgtcgagctcgtcgctctgggcagtttgctgctgctgctgctgccatggaggcggcgagctgtgacccgccctgccgcgctctcgcacgaactgctcgagcgtctcgaggagcttgtcgtcgatgcgcttgacgtcggcgaagtcggccgggcgggcgaggcggacgtcgtcgcaccagccgtagaaggcgaggaggtcgtcggtttgcttggcggtgctgacgtgtgcctcgaagaccttgacgcagtcggggtagtccatgtcgaagaagcggtcaaggaggacggcgagcacgacggcgacgtcggagcagagctgcgtgctctccttgaccaccgggtagagcgtggcgagcacgacgcggctttgcctcgcgccgccggatgggcggcacgcgaggacgcggtcgagcagctggcggagctgcagcgcccggcccaggagcgcctcggtgtccatctcttgcaccgtcgccgccgtcgacccccgcggcggcgatcccgtctcgtcggcgaagcgcacggtgcgcggcgcggggaggagggatatgaggaagcgggcgcggtggtcgaggtagagcgcgtaggcgcggacgaaggcggagtggtcccacgacgcggagtgcgcttcgtcgcggaactcggcgaggagcgcgagcatcggctcgccgcggcggcccgcggggcggacgagctcgtggcggaagtgcgggtcgccgtcggcgacgaggcggtgggcgagcgcgaggcacttggcggcgacgacgtagtcgcgcgtcctggagaggcggcgcgagagggaggcggcgcaggcggcggtgtaggggcgggagtgcgcggtgagggtgaccacctcgcggacatggcggtcctccgcgggggcgtcctcgtgcgacgtcgcgcggacgatggcgacgtcaagctccggcgcgatggcggcggagaccttggcgatgccgatggaggtctggtccttgacggcgcccagcgccttgcggatcgacatggcgccggcgatggagcagcgagcagagcaatgggcagtggcaatggcgagctcgcgacgaggtgttcatccggttcttgacgacgtaggaggacgcggtttttgaagaggagggaattggtcagcagaagatcggacggctgagatgggaggaagggtggagatggacggacgagatggattcggagagtgggtggcacgtaggagtggagggggcacaagtcaaaggcgtggccggcgggcgctgacactgggccccatcgttggttcgctgggaatttagttggaaaaatatgaatactatttgatttcttcttgaggaattaaaactcgtgttgtcttcactcgtttggaccggaaaagtacacgttttcttttttctaatttcgatttcttgtcattttgtttgatggatttcttctttgtgaggtgccttcgaaaggaaggtagagaaagtaccaggaaaaaaaaaacttggagaatcaaacgagttgatgggtgggaatttttagtttttatcaagatagcatatatggatcaatcagatgatacgattccatattcgaaatgtgcgtattacatactatggatttgtggccaggcatgcattcacaaaatgcaaaacatttccactaaaaaaacaaataaaaacattcacatggaaactgatcgagaagtttcaattacgaatgaaattgatcggacgtttcattctgatgaagggccgtgcggcccagtaatgggatgggcctccagtgggcccacagcactctcgcatgtatagttggataaaagagcatttattaattaatttggccatatcatacatcacacgataattaatcgtataatcgattgtctagctagttactttagttagcgtttaatccttcagctagggaaggtaagaaattttagagcctgcctgggaaggtaagaaatgtttgcactactaaaacttaaattcttaccttcagctagggaaggtaagaagttttttgaacagtacaaggtctatggtcggtggtcctcttcaaggagttttttttggcaaagctatagctatatccacttcaaaaaatcttattagccaaacagtctagattgaaaaggctcgtaactgtacttcacataaacaaactagtagccaaacgtgatgtttctctaaattcttattagctactccctctatttcatattataagtcatttgtattttttactagtcagcattccatgatcaagacctacatgcacaacagcgcaattataaaactttgttaagtttgactaaattcgtagaaacaattttatagttatattgttgtgtatatatgtaggtcttgatcctaatttttgtgggcctcattctgctaaattgcagcccaggaatgacaaggcctcgagtgggcccttaaactacaccctgatcatatgtcacttatcgtgagcattagtttaatttaattaattaatggggtagtgacataccgctctgtactaaaaaaatcaaccgagtaccatgcgaatttagacatatttctgttaaattcattgtactagaatatatcatattaattaattagttataggttttttttatactgagggaataattaatactactccatactcctgcctaaatatattagctagcgccatgagaaagatatatgtatcaatcgggtaaattgaaacaggagagagttttcagggaaaacttaacgctaatttggactaacaaacaatacattcatgcatccatctaccctataatttaccaacacagtattacattcctcattcctcgttgatcggtcaggatgccctctcacagatccaacgcctcacgtcgctcccaccttctcccatccgcgattctccctctaaaccgcgatctctctccctataatctctccacctaaccacgccccaccgcacctctccctcgcgcatcgcctaccctaatcgccgcctgccgctcactccctcgcgctcgcgctgcctcgcaggtccgccgccgcgccgctgccgacctaggtcccccccacggcgaccaggcagagacggacgcgggcatccatcgcctcatcgggcccctccactccctccccacctcgcgccgccggttgacgcggcgcagccggagccccccgcagagcacggcgctgcatcaccttcgcccgcgttcgtttctcccgtacctgcggaggcgggtcgccgacacccagcacctccgtcgacgcgacgctgcggcctgtctgcgactcctcctccttttggcccagctacaaaatagcaaacgtatgctcagcatttcaccttcatatgcttctatttttgggaatccttttgctaaatagtccttccacccttgagggtttttgttcggtcttatccgctgtgtacttgaagggcaaatgtattattgtatactgcataacacaatcaatgctctcgaagtttatcaatgcttgaggatcaacaagttatggtctaaattttaaaccatagagtttattactttcaatattccactatgttttccaaattggcatggtgcgattgagaaatcaaaatgatgtatatgttttcatgctgctattgagatatcaaaatgatgtatatgatttccataatttcaatataagatcgcagcattgtgaattggtttcaactaatgtttgtttatattttgtctgttagatatggatcaaaatgcttctgctaatgaaggtcgctttgccgccaaagatataacaaatagaaaaatcaatatgttttaagtgcataagacaagaaaaatgaatggaaatgacctaagggaaaattcgaattcgtgacatgcctttatataatttttctattcgtgacatctgaatctattttaaagttttattaaagacaaatataattacaccgtagcgtttagcacgggcatattactagtatataatagggtaagaattaaagagatacgcttttactctatccgttctaaaatataagtacttttagaatagtgcaaagtcaaattttttaaattttaactattaatagcaaaatattaaaaaagattaatcatataaatttgatattattatatttatcattaaacgaactatcttaatatacaactctttaatttaaaatattttacttttgtagatattattggttaaagtagcatctcgaagaccgtatcgagatcaaaaatgcttatattttaggacaaagggagtatatatatacttgatcttcccaaagtgatttacactaactttaaagcataatagttaatttgatgatggatgagtaggactagcttcttgaactgtttttagatctccaaattaaacacatatttattaattatatttattactatccattactgatttcaaccaatgtattgcgcgcgctgcaagcctgatgtaatggtgcttaaggcgaaagaatatgcccatatatattatcgatcagataccattatgtgaggttttttttcctccgattaattaattaacacaagtatctacacatgaaggtacgttacaagcaaaattaattactcacgttctaaacataatttgacttgttaagatttcagtaaaagccgggctcccgaaggtttttctcttaaaaaatataatttgatattttaggatatattagcacctcttgtatcccgaagaaaattaaacagctatctaattttgatgatgagcgttcattaatattctatgaacgacttgtatggcagatggcctcagtactgagccaattttaagtggtgttttaatactacaattagtacttaccaagtagtaatataattcagggcatgtttgaggaagcttctagttacaacagctttttccagaattagaaactccccaaacagtacagctttttatacagattctaaaaaactatcgttgtagttgtataatctagaaaataaactagaaaacagaagctagctagaaaacctattttttttcatattctcatatggtagcaaccaactagatgcttcttgtaatgttaagctcaaacatgctcttaaaacattgagataatcttttcctagtgaaaaaggactaggaaggaccatatctctaatgtacccgataaacactgggtcgatagccaaagcgtagaggggataacatttgaaattggtatttgcatatacctctcatgcatgctcttctcctaaatatatatatcaaactaatttagacatagatagggcatgtacaaaggtagagtcggatatgagctctacgttatctagagactagcatcctacaacagttagagacaatatggtctctaatcattaatgtatcaaaatactttttattacttttctttcctttctttcaccactatgcaacaaaatttgctctaataaatgctaagagtcgactcttagccgttgtcatgcataacaactatactccttcctctttctttcatgtcaccaaatttacttgcatggcaatagagagagaccactaataaacaccattgtacatacccttattagttagcttactagctaactaacaacagtttatttataaaactaataccctacattttagcttgtaatacactacactttctttaagagattatattacaaggaagatacttgaggaaaaatgatttttccccaaaagtgaaccctgattccttgaatgaactaaagacgcggggacacaaccccagagatgttgatcaagacagagaacactgtattccagactgattgattatattcccagtgattttacatccaccgtacctgcatcctctctctagagatgtcatttttagtttccctagatatatatacttaacgaaccagcagcagctgcagctggcacattccaacacaatctatgcatgcatgcatgaatcgagataccataaagaatatatgtgtgtgtgtgtgtgacatctagtatcttggatgcatgggttaaatcatcattattcctcaagaatccaaaaaggaactactaattatatgtacatcgatcgtctctctctctatcgatagatgcattagaatattatagctaactgttaactccaaatcatctataactaatataatagcccattcatacattatgtatctataaaaatatactacaccaataatacccggttccacctttcatacacacacataacgtcttagagtccgtgttgcagctggctacaaatctgtagcccgttttcttccctatcttctattttcttctcgatatgtgattatagctggcttatagcctgctattgtacttgttcttagactagctaactactacttaattagcttgtagtagtagagatgagatgagaggatcagtagcatgcaatagtatggtgttggatgagtagttgcatgtgcatggtgactttattctcccaaaggggagaacagaaatgaagagagaactggggagaggagaggagaggggggcctaggccttcgagaaagcaaagccaaagcaaacccaaaacaaagctatcaaagcaaaggcagtgcaggcagcagcagcagcgagaatctgattccctgcccctcccctcctgcgagtaacatgccatgcatgcgtccctcccagtccctagctatatttttcccttcaattcactatcgatcatgcatgctgctaattccagatctatctatcttggaccagctagctaccaaccaatctaggattacatcgtctctcatcagtacgagtactgttactatctctcctgttattaatcactactcagtactgatcagtctcgctcttacctaacttaacaatgcatgctaaccttagcttagcttagctagctccagtactagctactttatatctccatatatatagtattagttaacctaagctaagctagctagcaacatgatgcatgataatgatatcctcagaatatagtactgattcatgcatgatagagagtagtagtagtatgatctatcttctctctctctttcactatctcttttgcgtggcacacaggcacacacagagacacacacacattctttcgtacgctccattcacttttctgtgccagtcttgttggcagcagcttgtgcttttgggcacagcattccatcatctgctatctctctctctctctataggcagctcttccttagctgcttgtgttgtgtgtgtgctagagccatagacatcgtcgtcgttgagacgatgagagagtacacacgtagtccctgaaaaaacacccggccggctagctggccacacaaacacacaagactatagcagtagcagtgtagtaccactgaaccagagcatgcacttccttcttcagctcatcttcttcctctttctcagtgcacttctcaaacttccatgcacacaccatcaccaacacaacgacgaagactgaataatattatatatactctctcatctcatctcatgcaatgtcctccatgaaactcgccctagatacattacatatacttctcttccttccatttacatagtactctattggacactactgcatgcttgcctagctatctgctatctatacatactgtgtacggagtagttactagaatgcatgcatgcagtgaatttcaggtgcatttgtggtgattgattgagctcagaagcttaattatctgtgtggtatgcttattaattactaaaactaagctagaatatatgtatgtagctttttgtcatttacattgatctcaaatatataggaaaataatatatatatatatatatatatatatatatatatatatatatatatatatatatatatatatatatatatatatataggttggatattatattaaaaagtagcatatatatgaaggcaactgagaccaacttagcttagctagataggagtagtatatgatttgagctgatcaaatcaaaatggccctcatgaaacactaaagatcaatctgtgggatatcttcacactttagtacgttctatcactgtaaaaggagcaaaaggtaaaggtaaaaaaaacaaaagagccttgcttttgaatgggccttctcagccctctttgactacaccctttaatttgtagtcgcaattaacattgcaatcctattgccaagccgtactacgtgtactatacaccgtagagatttacatatatacgttatgttcaaaatgtgcgtgtaattaaaattaatagggcatatgcgaaatagactacaaatttgttaatagaccttatgcgatataggtggtattgcatgtttgaaatagttgcatatatcttacttagagacgaattcatgcagtagctagcttagctatagcttctaatatatttctgatcctcaggtcattacaaagacataaatttatactgattgttgcaccaatagcaaaattaagaattgagagagaaggcatcgatcatcacacgtaatatataggagaattaattgacatataataggagtttccattaacaaaatgaacaacagtagtggtacacataacgtacgtggccccaaatgcacgagagagaaaaaaaaaccctaacatttaaaagaaaagaagaagaagaagaaacacatcaagtgagattagatcatgcatgcaaagctaaactagctagaaaatactagtactacttttgcatgatcaaaattaaacacacactcctccagtcttcattgggacacatcacctaattgcaagtgcaaaaaatgcaaatgcctcgatctcgatctcgatcgatcgagatcaaccatccttaaacttaatttggttctatatctcacaccaccatcaccatcaccatcgatatgatcgatcacacgccctattatgaatatatatctagctagctaatcgtagagagtctgcattatatttgcagatctctgccattagctagctagattgtgattagttataggctagctctcgatcattacaagagatggttacctgtggttgcactggagtaggaggtgtatcctccagcgaggtgatgatcgccatacatgccccttgggtagccttctctcttcgatgatggcatcgcatggtggagctctccaccgtcttcgccgccgccgctgccatggccgtcgccgtctaggcctagctggaacatccccggcattgccattgccggcggtggcgccgccatcgccgcctggtgatccatggcgtggaagaacgggaagctctgcatctgctgtagtctccattgctcgaggccggtggcggcgccgacggagtagcagccggccgcgtcgacgggcggtggcttgccggcggccgccgccatgccagagaaggtggagccgaggctcatggcgtcgaagtcggcgaggcggagcagcggcggcaggatggagaggttgccgcccagcatcgccgggagggcgggcgcgttgggcgtggcgcaggtggaggacgtcgtcgtcgtcgtcgtcgaccccgctggcgtcgagccggcggtggtggtggcggctgaggcggagcccgccgcggacgccggcttgggcttggcgcgcttggcgtggcggcggtagccgccgccgacggggacgttgcggagcgcgccgccgcgggtccagtagcggcggcaggcgcggcagaagtggcggggctgggagagggagtagttgttgaagtagcagaacttggtgttggtggagtcgcagcgcgggcacttgagccccggctccggcagcgggatcctcgccagccgcgccctctccgacatcgacatcggcttcgccggccccaccgcgccgcctccgccgccgccatcggcaagcgtgcccggaatcattgactgctgctgcagaagctcatggctattgccgtcgccgccgccgccgccgcctccacaaccggcggcgacctgatgatgctggtggtggccgtgagcatgttgctgaattaatgaatcaaaccaaatcaattaaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 38798 - DNA, 1935 bp, Oryza sativa
  unsure (1)..(1935): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcagctatctgagggcccgatcaagtccaatattgatcggctcgaagctcgcaagattgagctcttggcacaacttcaagaatgcaatgccgagctggatctggaacacaaaaagctatctgatctcccacaagctgtcgaagaacaaaaggcaaggctggaatcggctatcaagaatgtcgctgatctgaccaagtcattaaaagttatcctagaaccgatgctcaagatgcccaagccattgaagaagtagaacaaattaggcacagagctatatcggctatccagcgttacctgtctcagtgacattctgtaataggacttagtaaatttttgtaatcggctaagatactctaatacttatttaactagtcttaataaactttgtgccgattaatataattctcaaaaattttgcaacttttacatatatgtgcccttcgtctgcgatataacaatatcggccattgtacatcgacaaaacacaaccgattacaatataaaaacaactaagggcgatataacaatatcggccattgtacttcggcaaaacacaaccgattacaatttaaaacaactaagggcgatataacaatatcggccatctcaaggcgatgtgaatacatcggctatcatgcatcggcaacactagccgatcatgcattaatccaaacacttgggtaatatttcttcaagtatttgccatttagcgctcgtccataaacttcgtcatcaagtccttgcaacatgtaagctcctttagacacaactttatagatttgaaacagtcattcccaattcagcgaccacttgccaaatttgctctcctgagttccattcggcaaaatcaacttccatacaagttctccctcagaaaaagacttaggcactactttcttgttataatgtcgagcaacccgttccttatacttggtaacctttgcaagggctcttaatcttgattgaaccaagtcttccctttcatcggccatgagattatagtactcatcggctgtcaaatcgtcttgcaactccgatcttcttgagccgattctaacttcccatggtaaaacagcctcatgtccataaacaagtttataaggagggacttggatggaaccatgacaagccatccgataggaccacaatgctttggctaatcgaatgtgccactgcctaggataattagaaatctttctcttaatcaatttggtcaaactcttgttagacgcctcggcttgcccgttagcttgtgcataataaggtgaagaattcaacaatttgatacccatgctatcggcaacctgaacaaactcatcggacacaaagatcgagccttgatcggttgtaatggtttgaggaataccaaatcgatcattagattatatgctcttgaacaaattgtatagcatccccagaatcaattttcttcaaaggaatcgcttctacccacttggtaaaataatcggttgccaccaatataaacttatgccctttgctcgatggtggattaatcatgccgatcatatcaatcccccaacctctaaatggccatggcttgatgataggattcatagccgatgccggtgcttattgaattgctccaaacttctgacaatcttgacatcccttgtaatatttgaaacaatcctcggggtgcaggaa

SEQ ID NO: 38799 - DNA, 1462 bp, Oryza sativa
ggtgtcctagtgcaatcgacttgtttgaatgggttgtgatgactttcggcttaaaaagtgctggagctacatatcaacgggccatgaattatatataccatgatctgatcggctggttggttgaggtctacattgctgatgtggttgttatgtctaaagagatagaggaccacatagccgatttgaggaaggtttttgagaggactaggaaatatggcctgaagatgaatccaacaaagtgtgctttcggtgtatcggctagccagtttttgagatttcttgttcatgagaaggggattgagataactcaaagaagtgtcaatgcgatcaagaaaattcaccctccagagaacaagacagaattgcaggagatgatcggcaagataaattttgttagaaggtttatttctaatttgtctggaagattagagccttttgcacaattgttaagattgaaagccgatcaaaagtttacttggggggcagagcagcagaaagctttcgatagtattaaggaatatcttagctctcctctagttttgattcctccacagaagggaataccttttaggttatatttatcagccggtgagaagtcgatcggctcggttttaattcaggagcttgaaggaaaagagagggttgtgttctatttaagtcgtcggctcttggatgcggaaacaagatattctcctatgtagaagttgtgtttgtgtttgtatttttcctgtacaaggttaaggcattatctactgtccaatgaatgcactgtgatatgcaaagctgatgtagttaagtacatgttatcggctccaattttgaaaggaagagttggaaagtggatattttccttgaccgaatttgatcttcgatacgagtcaccgaagggaatcaaggggcaagctatagctgattttattgttgatcatcgtgattattcaatcggctcggttgaggttgtgccctggattttgttgtttgatggatcagtaggcactcatggttgtggtatcggcttggttataatttctcctcggggggcgagttttcatatcaccatgggcgatataacaattaggctgagtatgaagcagttctcaaagggttgcaattactcaaggaagttgaagccaatgctattgagattatgggggattctttactggtgatcagtcaattggcaggagagtatgagtgcaaacatgataaattaatagtttacaatgagaaatgccgagagttgatgaaggaatttcggttggtatctttgaagcatgtatctcgagaacataatattgaagctaatgatttggcccaaggggcgtcgggatataagccgatgatcaaagatgtcaaagtagaggttgccgcattaacagccgatgattggagatatgatgtacatcattatttgcagaatccatctcaatcggtttctcggaaactgcactataaagctttg

SEQ ID NO: 38800 - DNA, 1155 bp, Oryza sativa
ccttaacaggttcgagtatatcggctttgcatctcctcagaggttgttggtgcggtctaacccctagtttgataggtagccgatgttcaacaatcgatcggctgagtcctgggatctcataatactcccaagcaaagcaatctctgaattcttttaaaaactctatcaacttggttctaaattctggagataagttcttactgataaatgtcggcctcggtcgatcacttggacctatgtaaatttcttccaaatcatcggccgacacgaaaccatgtccttacttgtcatcgagatcatctactgtgtccttggtgtagacgtttgaaccctccacgacgcgctcaaaataataacttgggctctccatcttcaatcggctatatatcacaatcggacacctttagaaaatctccttcccaaacctttccagacaagcaatcaaggccatccatcacccaaagagctaaatcagcactggcaacgttaactaacctgtcggctggtatattttcaatcttgtcgtcttgccattaaatcaagcattgctgcatggttgatggaatataataattagcatgaatccaatcccttccaagcaacaagctatatgaacccttcccatcgatgacaaaaattgttgtagggatactcttgttaccaactgtcagctccacatttaaaactcctttggtttctgatggattgccaccaaagtctttgagcaccatatttgtcttgatgagatcctcagcattcctgcctagcttcctaaatgtggcataaggcatcaaattcactacggccccaccatcgaccatcatcttagacatcggcttcccattgacataaccgtttacatacaatggcttaagatgctgattctctgctccttctggcttctcaaagactgcttgttctggtgataaaaccaacctagccgatgctacctcaacttcatcaacatcggcttgcttggccccaaattctgcaggtagtgtgaaaaccatgttaaccgatacaatcacaacacttttccctttagccaatctttttgcttcatcggctgtggcttcatcggctgtaggaacttgattcttaacgcgccactcctgcgtcggcttcgttttcttcagccgatggttgatttcttgc

SEQ ID NO: 38801 - DNA, 8409 bp, Oryza sativa
tacatttcctactacttatcatatttcctctgatacttggtgataatcttagccgagttcactagaaaaccctgagttttccctccatcggctattcgaccagctgtatgtaccatattgtcaggaaaaggattgccatcaaccttcatcggcttcttggaatcatcaaacttgattttgcctccctcaatagccgcctggatctgctgtctgaagactttacaataattggtagaatgagacccagaattatgccacttgcaatacctcctcttgcctagctcttcatccgatggaattgtatgaccagcaggaagttgaatctgtttttcccgaagtaacaaaccaaagattttatcagccttggtgatgtcgaagtcatacctctcttcttttccagaactttttacccattggcatggtataaccttcttgctcctaacccactcagctgctgctacctcggaatcatcatcatcatcatcatgatcagatccatatatgtagagacagacatgattgacctttttaaagttcttcctggcttctgcaaacctctgttcatgcaaggttaccttctatgcaagatgtgacaaactatcaaagtcctgggacgagaatttctccctgatcggagctatcataccctgaaaagccaaatccgctaaatgggcatccgtcaagctcaagctgtagcacttattcctcatctctctaaacctctgaatgtagtcctgcacaggctcatcatgcctttgcctaatcgctgttaaatcagacaatttcatctcgtgaaccccactataaaagtaactatggaattgcttctccaattcggcccagctgttgatttatccatatggcaaagaagaaaaccaagtaaaagccgatccagacaaagacaaaggaaacaacctaaccctcaaggcgtcaacagccgatgcttcaccacactgagctaagaatcagctaatgtgctcataggtcgaaacactgtcttgctctgagaattttgagaaatccggaactttgaaccggttaggcaatggaaccctctcaaaccactcagggtatggatgccgatacaagtttccagtgtcctttggcttgagcccaaattgctctctcatcacctctgcaatcatatcggcccatggtccctgttgaggcaccacctacgcttgctgtggcacaggctcgaactggttgtactgaggagcaaactgaggctgagccgatcctccttgttgattctgaacttgtggcaatggaggctaatacttgtaattaaaattgcccccttgataattcttaaagtttggttgtatgttgtgcaccagatgctcgggaataacttgaggtatcaccgattgatctagttgcacattatgaaccaaatgctctgggacaacttgatttgcagcatgctgcctcgagtgattatcaggcgttctgaacccagccgatgcatttagcaaaccttgctgctgaatcggttgagcaacttgctgccttggtggcgtctgctgaatcggatgagttggtaagaacatagctgcaacttgctcttgagttagttgattcacattttgtccactatgttgtggctgctctctcaccaacaaccgaggattgattaattgccctggtgccgatgatggtgcagcaggtgcaggagccgatactggtgctgtcggttgaactaatggcgcattgggagcaattgactgagcagtctgttgattattagtgatcaagggccgataatttgggaaaacacctcctgataaataaaccggtcctatagcctgatactcagctattgtgccatcaaccatcgacttcaccatgtttgacaaagtattgactaacaccctagattgattaatcaaagcatgttgcacggcaaagtcaatcagatcttggaatttgttaaactgtagttgtgccgtgttaccatctgggctgagatcctcaccttgcactccctgagaagcatcacctttatcacctaagccatctgcagcacctttatcacctgattgagatgtaccatctgagacctgttgtacttctccatccttggaaaaacttgtcccagtgtcacatcctgattttcgttttaggatttataaattatctaataaattattattagaatttatattaaatgttcattaacttacaagtgaagttaaatgtgggaaataaaatttcctaaatttaaagcatggatggatttaatttttattaaattctccatgattaattgcactctctgaaattttctcggatttttcagagctcaattcctaaatgatacaaagaacagtttagtaattatttgatcaataatgatctaattataattgttaagagtttttccttgtttaaaaaaatccttaaattataaattgttgtttaaaaggaattattagaaatgatcttaaaagcctaaaagagaagatctaattttaatttgttaaatctgcttaattctataattcctagatttttctgggatttatttgagctaaggaagtatttttaataaatggaattacatttcatgaataatttaaattgaaaaaggtttttaaaagtctcttttggctttgggccgaaagtcggcccaaaaccttctctctctctctccccagcccaagtcggcccagtccgccgcagccgcgcgcgcgccctcgctcgctgacaggtggggcccgcctgtcaggtcgttgtcttcctccggccgccgccgcccgaaaccctagcgccgagccgccgccgtctccttctaaattcggccgatcctttccgtttccggtgaaatcaattgaggggaaatgatctttgggatcttctctaccttttctcttttggaatcatcctctaaatcgctttggaagttcgtggattcgaggtcgaatcggatcggtctctttcctctgaaccccgaggtttccttcgcgtcgccggtcgccgtgggccttcgccgccgcctccttgcccctataaaaggatccccggtgtctcctctacccgccgccaccctcgccttcgtctctcgccgtcggaagcgccctagcaccgtgtaaccttgtgccgttgtcgtcgccgtcgctccagccgtgcttcgccgtcgctccagccgtcgtcggtcgccgtcaccaccatcgggttcgcgaggtcgtcgccgtccccgtccaccgcttcgctgccgccgaagaccgccggagcaccgccgtcgtcgtcgacccgaagactgccgccgcttcttcctcgtcgccgccgccgtccgttgctcttccaccgtggttttggtcaccggtgagttcgccgcgtcgccctctacccgttggtgccctccgtacgcgtcctcgcgccgtcgttcgccggcgagcatgcgttgccgagccgccgccggtgctgacgtcatcgctgacatcgtcgctgacgtcatcgtcgctgtccccgtagacccgtcgtgaaccgatcgatctcggccgtccgttttggatggatcgatctcggccgttctttcccgtgaaccgctgccgtgcgcctggtccaccgcaaaccctagccgctgacgcaataattcccttttccttttcaaaaataattcattattgcgtcataattcaattaaaatcaatataagtgttttaatccgatttaatcttcaaaaattcataactaattcatcttagctcggatttagttggttcaagtctctaaatttttctaaaattgagatctacatgttaaaaatatccacatgtactgttcatgcttgtctatgtgctgttttggtgattttgctcttttctgtttagattccgacgtttccggagagtccgttttcgcaggagaagactttgaagagttccaaggccagcaaggcaagtcacacagatcccaaacaaccctttgagcatgttgatcccatttaaagctattgtttctattcaactattgcatttattttcgaatgtcattgggtggaattaacctattgtttgttatagcccttttgttcttgattactttattccttgataccatgggttattataattcgactagttggatttatatattggttcaactagatgtattagatataattgcttagccatgcttagaaacattagcacacaattgggataactaatgtttcactactacttaatgatggacttgataatggtagctcacgatggtcaatcgtgattggatagttaattaatgtgccaactaaaacttgataatggtgggttgtgagcacctggttttgatggtcgtactcatgacaattaaggaccggttcacgagtttcggttgtgaaacattaaccgtgccaaccacaagccagcgtgggcaacggctttaccttttgtatagcatggttcattgcggggcaagtggaggagataagcccacgggggtcgctggggagtccatgccttgtttataagggggtgattatgatccaggaaaggtgcgctgtagtggattgtgttgtgcgaggggtattgtcacagctcctttccgaggtaccgtggtggtattgaggcacatggtgacatgatgtggggctgtgtcttgtgggtacagtggtacacctctgatcagagtaaaactattcgaatagccgtgcccgcggttatgggcgggtctaacaatgtttttcgtgattagtctcacacttctcatcataatagaagatgctatatctggtaataatttgattagctcctggtttggaatggtatattcctggtttggagatagatctgtacagccgggtatggttgttcagaatggttgggcctatgcaacagggtatgttgtatagcgttgattaatattgtttaattattacttaactgttttattaaattctcaaatgtttgctaaatgctgctttcgcaaatgaaaccctactatgccatcctttggtatccttgtgcacttgcatatttgctgcgtggcttgctgagtatgtcatatactcaccttgcaatcattcatcagaggaagagttctacaatgatgctgatggtgtggaggattaggtgtagccctggtcaagctgcctgtggagtggagccgtctgcgccgtttatcttattttccgctgcttagatctttattgattgagaggaactatctacctctgtaatgacattttattcgcttattaattagagtaataattgtactctattatcaatttgttattgtgtgcctcggctgattcctggacgagggttcccacacatgtaagcgtttggaattttggatagaaattccgggcgtgacacccaggaacatcaacagctaatttcatcttgtacctctgaacaattgttcctccacgggtctccatgaatgagttcaagaactggttctgtgtttgctgcatcatcacctcgagatccttcttttgttcaggtgtcaatttgtctatagtgatgagcacgatgttgctctcatgaacttcagacacaccaagcttagggatcctagatttgggaggaccctctttgccagccgaagacggcgttgctggtggtttctcaaccatgagagaacgctattgcggttctgacttctagtcggtcccaacgggcgtgccaaaagcgtgttgatgtaaaaacacgaggcctgggagatctgcttaactccattgcaggtccaaaacttgcctttgggtgtgtgagcgtgccagttgatttgatcctgcaagcaacaagaaactaagacaaagaaaccacggttaaatccataaacgatagccgatcggctagtcgccgatgacatatcatttatctttgagccgatgtcatatatgcatcgatcggcagtcattaataagtaagaaagaactaaatctactcaatcggctgtagatattaacaatatataatccttatatcgatatatacttaaatcaagtgattggaatagatcggtcgcatgccaagacagtataaatcacttagatcaaaatatatactaataataagactatatatgttcatagcatagccgatcagatagatgtagcatgtatcagctaatactccaataccactctatattaagagagtaaagcaagtagaatataccaaacgaaagcctaatatacttaaatgcgacaagatctcaacataaagggcaaatttaacatgtcaatcgagcatataagataaatgtagttagatcaggtaagatcggctgaaaccctgatgctaccctaatcagcaaccaaaagcaggctagagattgagattctaatcacgacttataaggtcaaactcaactggtagatatcctatataatctaagtcaacatcggtatttcacctaatcggctaccttctattgacagatgttagccgattgtaagttagatggcgatattgccggagattatataagataaatgataattcgacgaattacataaacaagattagagtataatgaagatgaaagcactaatcccgataacaaaagccgccataacaagttttacctcttgttgaagatcgaaaccgatgcaactcaacctgaaagcaagaactcgtcgaaacaaaacgaaagtaaaagggtggcgatgcgctgagattgtattaaacgtgtgttttttattacatggggctctgggtctatttatacccaatattacaaaatatgtccatatcaaactcgactcttatctctacaaactctaaaataccataagtctttgcggaagactttttcccaaacatatctctaaggaaattacataaaatatcctaattaatagatacaattgccttctcaggactctatccatgcatggcaatcatcatgaagtaaatcaacctaacccgacaacgtatgccgtgtcatattgtcggattcggctcaatcggctaaccctgtccaactcggactctgtcgatcctggtcacagccgattcggactccagccgatccttactctgtttccgggaagatctccatctcgaagtccatctcgatttcttcttcatctccgatccttggattaccaaatttggtcgttaacacctgggcatcgttgtttccttctccaggaaattctgcatgaatttcaccaggctgtccgttttgggtggctccacttcgaccacttgaatattctgcggttttggcccgtactttatcttgaccacggagcattgttccgtcctcggttgaaactcaaacttttcttccttcccgttgatgtggaaactgatactccccgttcctacgtcaatgtaggctcctgcggtgctaaggaacgggcgccccgggatgagcggcgtctcttttcccatgtccatgtccagcactacgaaatcaaccaggatgaagaaatcccatatcttgactagcacatcctctgctatccctgccgggtaacgaactgacgagtcagccatttgaagttgatcttgtcgaagacgtcttttggcatgacgctgacactggctccaaggtcgcacaaggcttggtcgaactgttgtgccccgatcgagcaggtgatcgtaggacaccccggatccttcttctttttcgggagcttgtggagtattacgttgctgcattgatccgtcagcttgaccacctccgttgttgggagcggtctcttgttgttgagtatgtccttgagataacgggcgtatgttggcacttgcatagcgtccaacaacggcacgttgatgtggatcttctggattacttcaacaaaacgagcgaattgctcgtccactaacggtttcctactccgttggggaaacggcagcaaccgtgtgttgcagtactcctatggcactgtcttttctagctgaacttccttgtcagccgagtcactagatggtgcttccttggttatcccattggttcctgcagggttaggatacagcggatcacgagtggacttacctcccctcgtcgtgattgccataacattttcaatggaggagtcgggttgccccggaatcctcctagtttcatttgcagggactaaggatgccaactgagctagctgtgattctatcattttattaaagctcagctgattttgaaaagcagaagcaaagccatctaacttgacattaatgttctttaggatattgtcattggcagcaagctttttgcttagcgcatcagtagttttagcttgcgcaaaaacgagatccttcaaggagggctggttagaaaagttaccgttgttgttacctccttgataatatgggcgtggttggttccaccccttacctccttgtggacggtacccattgttgcccatgtacatcgcctcctcacgggtttttcggcagtcattcccagaatgacccgtgccgccgcagacctcacacgtgacgt

SEQ ID NO: 38802 - DNA, 2467 bp, Oryza sativa
ccgcaagcgcacggatataccattgtagcatttcacccgagagtatttcatgggtatcgtatttattttatcccatgggaagatcatgtagagtgaacttgactaataatttatatattacttgtgataatcatagtctaagcaggggttaagataacccaagggtagagtgacacacaagcattaactactcattctcattatatattatctaagttaagtggacagaaaagagaaagaaaatctattcctatacttctaatatacatagtatacatacattctagttaaccgatatactagctaataccctctatccgatgccctccaggtacttcgagaagccacccctgactgccgagttccttacgacagcccgtcatgaccatacaaccggggctaaatacggaggaataccctccccagggaattaacttaggattatatactggcgcggaggaatacccgtactgagctgtcaccatcagcggcccacctttcctctgcaatatataaccccgaataatgatatcccgtaatctagacaccacgtctaaactaccagatactactctaatatcatcgtcatgacatagagtaatttcatatgcaaatattatacccacaccaaagcatctgccagataagctagccgtatattcagtataacatgaacataatgtaaagtaggtactcatatacttggaaagtattttaataccataaatgtatttagaagagtattctaataaaagtacaaagcttacaaaagagaagagaaaagctactagagccatacccgaactcttccgaaagcttccggactcctgatttctactctattcctattccaccagctagatactactaaactaaacttgagagaaatgagagagctattgcttgaggtgtgtgtgtgaagtgagaaggtgaagtccttttataggcaggtatgaccattgtaaccactgcgaaatgtctgaagtaccccgcaaccgccatcaggagaagatctggagcgtcctgccaaaccccacatccaacggtggagaaggaggttcggctgaaccaggggccaacccaacctggcccaaaatcagcaggtggcctcctccgttgcttcactttgtagacttgtgaattttggcccaattcatgcataagtctaattctcgatattgtccgattgatttatcgtctgtgttgatgtcgattctcctccactttagtgtcattctcagcaaaaggttagtatacctaatactagtggaatatgattattctaatagatatatgcattgcaagcatcactagttctcctctattttagtaatattgacggtcgaaactaatcgataacgaccgtcaacaaagagcaaggagaagggggcacggtgctacaagtgtcatgagttttgacatataaggaggaattgctcgttattgaagaagaggaaaactacgattgcaagtttagcagctcatggtgatgattcagagagcaccagtcatgagattctcacagtgtctaacgagaagtctggagaagcgtcaatgttggactcagctagttcctatcatgtggcattgaagcgggagtggttatcttcatacaaatctagtgattttggtgttgtttacttgggcgatgacatgagttatcgtgttgttggaatgggcgatgtcaagttcaagatgtatgatggaaacgaggtgctactttcggatgtgagacacgtgccgggactaaggaagagtatgatttcgcttgagagcctacatgagacaggttggttgtatcaggtggattttgataggaggaccatgaatatcatgaaggaaggcaagattgttatgactggtgagagggcaagctcatgtttgtacaagttacaagggagtgctgttgcaggtggagtcatggaagatgggtatgctggtgttgttgtgcacaatcctgaaggcggcgagcctggtggaggctcgttgggcggctcggcgtgagcggcggaagaaccaactcaattcctggtacacggagattcgagcaagtaacagattcaggttggtgtggcatattcgccaaggtggagtttgttagagtttgtgtcgaatatatgtacatagtaggttacagtttaggacttgagttgtaatagcgagagggagcggctaccggcggcgaccggccgtgagtcattgtaactctaatacgatgtatatgctagatcggggaggagcgcccataatcagtgtctcggagatgtagacctcggctgaactccgttatcaaatatcgtgcctcggtgttgtcatcgtgtttggttctccaatggcgtttcttccccgtttggttaccgatgtgatttctaggcctgttttctaaaattatcttcccgacggtgtttatcccgttattgatgtgcactagggttctcaatcttccgaaaggttctgataaacaacg

SEQ ID NO: 38803 - DNA, 7925 bp, Oryza sativa
gtgcatcaatatagccactggaatcataaaccgtgtcttcaggatgagcatcgtcgtcaccactcaccacttcctcattggaaggtgtctccaacgcggcaacccgatcagttagtgtggatatccgcttgtccaacctctccatgtggttcaggaagccgattttagtgaaggcatctggacagactttgcaacggcttccgtgatgtccttttgagtattttcttggagagttcgtagttgctcttgactgacacagtcagcaaaatcctggggactcttctcaccttcgttacctgccattgaaacaccaaaacggcaacaaacggtgaagattgtcgcgaccgggaaaattgccttttcccgaacgctagtgtattaatccccgtcccaggaaaagccggggtacaccacacaaacatgatataaaagacacatctttattatatcgatagtatttacattattacagaggcgcttcaggcctggcaatcaaaaataaacagcagcggactagcaggcctacggctccatcttcacaggcgctcaactggggtataagccaggactccacctaagacttcttctccaaagcttctcttactgaagggggggaaagattgagcaagaatgagtacaaccacagtactcagcaagtcacaccggcagatgcatgattaatgcaagggggtacaaggagataataataggggttaagttttgcggtaaacaacatttaaaagtcacttagttgcccaaagccattttataaagacgatcctagagttacacagtgttattaatcaaggccgtgaaccctcacgaacctgccttaacccaaggcctacgatgattcagaccgaactggcaacccgaccctgggtcccagctcgtcccaagccaacccaggccaaccattccacattttagttgttgagcaaattttaagaattaaaacactaacttgggtacattgctcggcttgcccataaccgagggcgcggctattcgaataggttttactctgatcagaggtgtacatctttacccacaagacacatcttcctcacgtgtaaccacgtgccacataccaccacggcatatggacggaagacatgacatagtttccaacccatcctagccatagacaagagtaccgacccaaccccacctacggccggaacctccgggacaggtaggcaggattgagcccctagcagcaggacaccagccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcagtgtgaatccaattccacaataaaccaacaattccaaagtgtccaggtgatatgaatatcccaaagtctagagttgtaaaaccacctaatgttacctaattaatcagcgaagcatctacctaaaattatactagtggtactatgagtagagtgtccactagttggggttttgtttaatctagggtgaacaaggtaataataacaataacaataataataaggccataacaaaggtagataggcatggttaaataaaacagtgataacgcgggaatttaaataaagcgataatgcaataatttaaagcaacataattttataaactgggattcaatatgttcaaggatgatgtgacttgccttgctcagagagaacggccttccgaaccttcggcgacgaccacgaaccacgcttcgggaacctccggaacgacagaagctacgcgaagcacacaagcaaagctacaagcctataaagaagcaataacaatacataaaaagaaaacacagggttctttaggttataacaaacattaagagacttgaacgggtcgattcggagctcgtatgaccaagatatgatcatccgaagtttaatgctgttatatggagatttgcggattattataattaagctttgcaactataaaacaggtgtaagcgctagcctggaaaagacaggaaggctgcgccgttgacatgcggaccccacatgtcaacaaaaaggaccgcggtagtccgagtacacagagacggtccacgggtcgatggaagcggatcccgtgtgtcaaccgaggcgagtggccgacaaacggactccactagacaccacacgggttacacacgtggaaaccacgtggctaccgagcgggcacactaacacggtcaccacacgcacacatggacgactaccgacaccggtgcacgggtaccggggccgacaaccgcacaacgagcacgggcgacactgaaaggacgaggacggggcagcgagaggacggatccttaccaccacgcgacgaggcgtgggaacgacaacgacgaacgggcgcggcggagacagacgggcacaacggagacgaacggcgaggggacggcttcggcggcgatccttggacgaaggcgagacgcggccggcacgaggcttgacgacgcggagccgaggacgaagacgaggacggggctgcagcggctcgcttgacgaacgcggacgacggacgagaacggctcgacggagggacgaacgccacgacgaccgggaacgacgagaggatgacgacggcgacgaccggggccggcgaggaggcgacgagggcagccggcagcggctgcacggagacgaggacggcgtggaacacgccgctgcgatgttggtgaaggtggtggtgcagcggggcgacgagccgacgaggaggaatgggtggttggcgcggcggcggcgttccggcgaacttcgggcgacgccgcagccgggccggagaagaggatggcgctacagcaccgacagaggtggcagcgacgtcggccggcgctcaggcgaggcggcagggatggctggagacggtggagtggtggcgacaccactagtcgtcggcgaggacgcttctctggtgatttccccgcgaaacggaggcgaagccggggaagaggaggcagctgcgacgccgggagaggtgacggcgcagccggacggcgctcgggcgaggagggagaggcggctggaggcagccggcgcgaaggaaagagaagggcgacggcgggaacgtagctccgggggtctccgcgggaaacggagggcaagccggggaaggggaagccactgcgacgccgggagaggcgacggcacggccggacggtgcacgggcgaggtggcacaggcggctggaggcggccggcggcgtgggagagagatgagggcggcggggagaggtggtgaggccacgggagaacgcgggagggggctaaaactggagaacagatcgagggggttccattttataggagaggagagggagccggccacggggaaggtcggaacggcggcggaaaaggcggccggcggccatggaagttggccggagttggcgcgggcgttcccggcgattgggggcacgattcaagggggaaattggggggaattgaagaggattcaatggggattaattccccccaatcaatttggaaagaagggcattgattcgcgtggatttaggggaggaacggcgctaggtttccggggagagagagagaggaggccggctgggggaggaagacgaccgcacgtgctgcgcgcgtgcggggagcagctcggcgtgggccaggtggctgggtggcgcagcttgggccgggcgggaaggagggaggggaggggcggcccagaaggaggaggagaggagggagtgggccgggagagagaggggaggggagggagctgggccgggaggggaggaggcccaagaggaggagggagagaaggagagggagagaaagagagggaggagagggagactttgggctgggcttggcccaaaggaggaagaggatttatttttaggtttttctttttaataaactctaataattgtttttgttgcttaataattatttccggtgctctgaaaattcaagtaaaatttgagggctccttttagaccaaggagaatttaacaaaaattcttcgggccacattcgaatttttcttgtacgtattttagtgtttgccaatttcttttcgaattttaattaattctattattccttttagcgaatgatttttaattcgggatgaatttatcaggacgtgacaaatccaccccccttacaagaatctcgtccccgagattcgaggaggctagcatgaagataggttgggtggtcttctcttcttgtttgacttcttctgctccgtcttcacaaactttcagcaaaacttcaccactcggaactgcttggcttgacctcctgttgcggatggaatgttctcttcacctgacttgaaccagggtgcaccttttagctgactcagactaggttgcggtagtttaatgatgcttccgttccagaacttctcatgattcatatcttcggagtcaacctcatacaagttaccacttcatgtcatgcgtcaacactagcttgtcattactaggataccatgtttgtcatcataagaatatcatgcttgtcatttacttctaacttgccaccaactgcctcatattagctttcctggtctccgggtgatagctacttctgctatttgatgcaagggtcgataactttgcctttgaattatgcttcccaagagaaccaacttatcccacttgacatactttgacgtcttcccaaatggctttactgctggatttgttattgtctaatcattatcctgccaaatctgaggcttcgttgttagatgtgattttaatctgacctctgtagattatcttcgaacatatcacttgattcataactgggaatagctctcacgaacaagcaactcggattcactttctttatgttcagtttactttccactattctcttcatgttgtcatcatttagcattcaacgtattcctttgcaccttcagccttgatgtgttctttctcgatggatcgattgctaggaaagtgcgttgaacgatactagtgcaagtgcttttattctagtagcatctgatacaaagcccaaggttgaaccgagctttagattccactgttcaggttttacttcttgacttcttggtcatgtcacaaaagttttcatccttgtccccatagaagtacttctacctgtggtcatctctcttactcgtgaattcaccttctttaatgacagggcaactgttgtagggttgattgctatcgggagtcttcctcgagtgacacaaatcatggttctcgttatcctttatcaatcacctttcgacctacttcttttcccagtaaccaaacatcttttccgatctcttccattaatcacctttcgacctttctcaaccaggtactcttcgctccgggtgttgaggatgcttctggggcaatgaggtccttgggcgtgctgtctttcagagaaaccttgaagtagttcgtcaaaagctagactgacgattgttgcctttgatccgaagaagacacatctgaaactcttagtccaaacaaatgtctctttggttgatcacttgattttcttcgccatcaatcgctaggttatttgattcataacagattatgggtttacggaaatgagaccctaggtctccctaatcaacaacaaaatgtacacaactcacagcacttgcaatcttaacatggatccttcataaacttatcaaactcattcattatctcatgtttctctgttattacatgattgacggggaacaactataaaacaaaagtatttgaacactgatataagagtattatggttgcttctgactagcgctaggcttaacaggtaccgcatttgctccagtgaccacttggcgattggcatgtctgcttccttaacaggtactacagttgtaacagacaataactttcttacgctcgggttcttcatcttgtacttgatttcttggctgctgtgctggaacatccaaaggtacaatgccgatactggcctctgtcttgtcaactgatggctagggctgaaattgagcattgacaccttgtggtaatgcactcgctggagttggagctgttgcaacgcgggctataggattgcttcgggatgcatggatgacaattcgctgaggagcaagcttctgattgcagggagttgcgtggactgacgtgctggcagctatgtttctcggttttgggcacttgtcggcgaaatgacccattccttgacaattgaagcaacagatatcttcccggactcggcattttcttttctcattttgattcctctgtcctggcactggagttaggctgaaactgaaatcttggcgaggatttgtgttgccttgatgcttctctccattggaactggcgggttggttggccatcttcttcgtcagcagaaaactgaattgacaatcttttggtacatgatcagttccttcacaaaagaaacaagtgatcctgctcgttggacacctgtcgggtggatggtcttcctcacaatgaatgcatgtagtggcacacgagctggcaacatgaccgatttctccacaacgagagcatgccttacgtccatttcatcttcatcatctgaggagacttgatctgaatcttcactatcagacactctacctccattagctaaaagatgctctgtcaactgtggtgcacctcggaaggtatttcttctctgacgttttgtcattcctggtggaggccattctgtgctggtaatgatcatcttacggacttcatcttcggttcgcattgatgtttttcttttctgctgaggacactcccttgcatagtgcccttgctcatcacacataaaacaaatgatacttgcttcttttgagtcaacatgtggcacgtcaccctgggtccttcgggatgctggcggcatgctgacttgtggtgtgagtgcttggactgcctccaactgcacttgaggttgtatttgactcaggttcagaattggcgtctgatgctgctgtagtatctctataagcaatcggttctggttaatcaggtgttggactagtgtcacacaactggtgtctggtgcttcattcactcgggagcttgaggtaccaatgtcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaccccactgatgcaaaccacgcgctacacacacaagcaaggaaacacacgactaacgactctaccctagagggtggcttaggttctgtgacgggttctcaagatcttcactcctgcttcacagctggcttcactgcttcctccacttcgctagcggatcctgcagtcttccggagcttcggcaaacaactgacgatgtcttcttcttcactgacctgaccatctagtactagttgaaatccgaagaaggaagaagggagtaaaccttttgcaaatagcattaggggaaggagaaaaaaggaactttcgcaaatagttttatttacaaaatatgtccttaggttttatccacttggcttatcctacagtcgagatggctctgataccagcttgtcgcgaccgggaaaattgccttttcccgaacgctagtgtattaatccccgtcccaggaaaagccggggtacaccacacaaacatgat

SEQ ID NO: 38804 - DNA, 30465 bp, Oryza sativa
tgtttgccaatttcttttcgaattttaattaattctattattccttttagcgaatgatttttaattcgggatgaatttatcaggacgtgacaaagattatccctaataatctagtacgcatatgtagtggtgcctctcaacgattctcagcaatatggagtacctaaccaagctcttataaggttcttaccagcaaagcaaaggataccgggaagacgtaatcagcgattgcagggatcaagaacctgtgctatctagaagttatatgtggagctaggaaggccaaatatatgtatatgagtggtacacaatccaatgacagatagtaatgctgaataaaaatcccaagtcacttgcccttagttgctggtctactcgtgtcctagacagtagtggtaacaattatggctcaaggaaaaatgataggacttgcaggcaagcttcggcgagtttcagcaaaaacagaaaaaccgaactggcagataagctcaacggagcgcatcgtaagctcaatgcactagtggaaatcaacttttcttttttttcttttatttttttgatatttttttctttttccagaacacgaaaataggcacacctccaagttacagctcaatcggagttgatatgtggcctatggaattttctgaaaccactataaacaaggtgcgtgaacttgtgagctcgaatagacaattttgcaaaccaaatttcggaattttggattcgccaaacccaccaaaggggggagaaacggatgtaaaatttttttctcttatccgaaaagttaaaatttgcctgattccgagtccgtacgcaaaagttatggctgtttaaagtttcggcttctggctagtttttccagaggggatataacctagtctattttgcggtggaattgggatatggtggcagcggagttgtagcgtgttctagtgatgcgtggtgatctggatgggtgtttatgatggcggaaacggctctcaaaggatgaaccctaacacacggtgaaaggtagcggctagggttacaaaggaaaaacacacgactagactaaaacacgcactagaccagcaacaggaacttaaactaggactcaaactcaacactacggactctgacaaagaatcatgcaaaggctaaacacggtctaggttaaggtaactaacgactaaaattttttttggcttttctgtagactctaggataaatgcgaaaacaaaaactaatctagggcaaagaaactgagcgaacctgacggtgaacctagagctctgataccacttgatgtgcactagggttcccaatcttccgaaaggttctgataaacaacgatttgggcggagtcgcgacacaaatcgatccggctttttgaacgcgcacgctcttgagccccgcaatcgcagcaccacgtctcctctggttatcacccgtgtctaatcacagatgacctcaccgagaaggctaatccctgtttgccaatcgaagaacacaaataagaacgagatagaaaacaaccaaaattgcatatgaatgattaagctcacgagttggggtcttacaaaccgatctagcggcgaaattgttctctacagattaatctaagtaaaaccaaaaaaacctaaagatggcggcggtactgatatatagagtttagggtcgtgcaaccccctctcgacgcaaccctaatgggttccaacacgatacacgggccaaaagcccaaatacggtgacgcagcaccggaacagattctggacgttaaattattcggtcaattcccattgacttggaaagaatatgtatgtggggccaaaaccattggaaagattatcttcttagctttccatccatataaagaacgccccaatccgagcacgtaggcgacctgggcgcccgttttagtgcagactggtactggactccgaattgcacccgatgtcgacttggtttgggcctccaccttgacttggatgtcctcgatgatcctccatggctctaagtccttctccaagtgtctacttgtcccctccattgttcctaatcataatatgatcgttaggtagcaatctattcttgaattcatacaaagaagaacataggaacgagctcacctctaaatttaattgtcgcacacgagctcttgttatcggtccttgaatgaccgttggaggattgttgtgtgtatccgaggtagtgatgtccgcatcagttatggcctcgggtcatgacaatacaccatcagaaagggatgtttaacaggaattgaattcgatctttactaaccgaaaagaataggaagataggacatcttttgttcttcaccagcggaggaacagcctgaggccatggaataccgcgattaatcaagcaatctatcctacaaccaaatttgcaaacatcaaaacatatagagactacagaagaacctgtgtttagaaattacctgacgacttaagtatccccatccctgttaggaataagtctagctgctcattgtagttagttgtttgctttcctattttcatattaagtctagcgcatgatctggtcttccgggttgtgcagattgtgggcttgacgcacgctgcgttcgtgcggagtctgttggagccgtgcgcggtatgctccagttcgtgggatggcgcgaagtggcaaggggtgtgacgcgtgcatttaggaggccactatggccacatttttgttctttcttgtaatctgctatttaagcttgagtcttaatccagaaaagctgctagttaacgcagcgccaaaatactctgtgtttgctctgcttccgctttgccggactagctacagttttcgttttgccgctaacaattggtatcagagcctgcggcgatcgccggggttcctgatgtcgctaccaacgccgcgcgtctcccactcaccgccgtgtcatcgctggcgtttgccgtctccgcgccgtggccgtcatggcggccgcggccaagtcgtggtgcatcgcgtcgtccgtgaggtgaccacgagcagcgtcgtctacccgacactcacccgcacaaattaccaagactgggtgctggtaatgcgggtgaacatgcaggcccaaggtctgtggggagcggtggagccggagggtgatgatcttgttgactaccggcaggaccggcaggcgctcaccgcgatacttcgcgccgtgcccgccgagatgctcgccacgctcgctgtcaaggagacggtgcaggaggcatgggaagcgatcaagactcgccgtatcggtgtgcagcacgtgcgtgaggcgaatgcacaacagctgcgccgagaattcggtgatatcatcttcaaggacggtgaaaccgtcgacgacttctcgatgcggatcggcgtcctcgccaacaaccttcgcaccttaggtgataatatcactgatgctgaggtcgttcagaaattgttgcaggttgtcccagaacatctccagcaaatagccatctcgattgagaccttgctcgacgtcaatgagctgtctctcgaggaagttactgggagtctgcgctccgtcgagcaacgcaagcagcgcaaggctgtggctgcatcgagtcgggtcgatgcatacggctgtctcctcttcaccgaggaagaatggctggcgaaattccgtaaggcagcctctctccaagacgccgctcactcctcctccggcggcaacagcgaccgccagggtcaagggcgtgggaataaggacgatggagcctcgaaggagacccagcccaagccagccaacctgggaggccgtaacccgggaaattgcaagaattgtggcaagaggggacattgggctaaagactgtcgcagcaagcccaaggctcagcaggcttacgtggcccaggaggaggacgacgagcctgctctgctcctggccaaggtggagctggatccaccgcgtcctcgtgtcgtcgcaccggcaaaccccgtctcgccaccgagcgcgccaagaacgccgtcgccgacaagcgagctcgctgtagttaaggcaaaagtcttcacgcagctcgacgatggtggcgagcactatccggcgacgtggatcctggataccggcgcaaccaactatatgaccgggtcccgctccgctttcgccgagctcgacacggcggtctccggcacagtcaagtttggcgacggctcggtggttcacattgagggccacggcaccgtcctgttctcctgcaggtctagggaacaccgcggcatcaccgggatctactacatcccgtggctcacggtgaacattgtcagccttggacagctggatcattctggcagcaacgtactgattcaccacggcgtcctacgcgtgtgggatccctgagggcacctgctcgtccgcgtcggacgctccgacaactgcctctacaccatcaagctggacatcgaccgtccggtctgcctcgcggcaaggagcgccgagccggcgtggcggtggcatgctaggtacggccacctcaactttcctgctctccgcaagctcgtgcaacaggaaatggttcgtgggctgccgctgctgcaacaagtaactcaagtctgcgacggctgtctgctcgggaagcagcggcgagcggcgttcccggcgcagtccaagtactgcaccaacgaacacctcgtgctcgtccacggcgatctctgtaggccgatcgaacctgcaacgccggctggtaatcgctattttttgttgcttgttgatgacatgagccgctatatgtggctaaccttgatcaggagcaaggatgaggccgcgaacgccatcaagcactttcaggcccgtgcagtggtggagaccgggcgcaaactccatgcgctgcgcacggatcgtggcggcgaatttacctcaatcgaattcggggaatactacgccaatcttggagttggccggaagttgacggtgccctactctccgcagcagaacggagtagtggagcgtcgaaaccaaaccatcgtcgccactgcccgcagcatgatgaaggcgaagggtgttcctgggcggttctggggtgaggccatgtccacaacggtctttctcttgaatcgttctccaaagaaaagcttggacaaccagacgccctatgaggcatggtatggccaacggcctgctgtgcatttcctgcgcactttcgggtgcatggggcatgtcaagatcaccaagcctgggctaaagaaactcaacgaccggagtgtgccaatggtgctcctcggctatgaggaaggctcgaaggcctaccggctctatgatccggtgagcgagcgcgtccatgtgtccagggacgtggtgtttgatgaagacgccgcctgggactggggatcagcgacgcccgacggtgcttcctagctcgagccattcaccgtcgaacaggtggtgaccaccaccattgggacggcacccgcttcgttgccgactctgccctcgccaccatcgccggccccgccagaccccacaacgctagcacctctgtcgcctccgtcgccaccgccggaggcggttgagtttgtcacgccgcctacctaggattccatcctggacgccgacacagatgacgacgtcgtgcctcgctaccgcctggtggataacctgctgggggatgcctcgctgcccagacagactccgcaggtgctggaacagctcgagctctatgctgtgagcgccgacgaacctgcctcgctggctgaggcagaggcagatccaaattggcgtggcgccatgcaagacgagcttgacgcaatcgtcgacaatgacacttggtcgctgactgacctaccccatggccaccgtgcaatcgggctaaaatgggtctacaagctgaaacgcgacgaacagggggcgatcgtgcgctacaaggcgcgcctcgccgctaaggggtacgtccagcgacaagggggtggacttcgacgaggtcttcacacctgtcgcccggctggaatcggtgtgcctccttctcgccgtcgccgcgcaccaagattggcaagtccaccacatggacgtcaagtcagcattcctcaatggcaagctgctcgaggaagtttatgtctcacagccgccgggtttcgtcgacgacaaccacaagaacaaggtgtatcgtctgcacaaagctctttacggcttgcgccaggcgcctcgcgcgtggaatgccaaacttgatagctccttgctgtcatttggctttcaccgcagcagctccgagcatggtgtgtacacacgcaccaggggaggaagacgactgaccgtgggcgtctacgtcaacgacctcatcatcaccggcgatcacgacgacgagattcgtagcttcaagggagagatgatgaaactcttcaagatgagtgatttggggcactcagatactacctcggcatcaaggttaccctggacagtgatgggatcacgctggggcaagctgcatatgccggcaagattcttgagagggcaggactcaaggactacaatccctgtcagactcccatggaggtacgtttgaaattgggaaagaattcagattttcctctcgtggatgctacactctatcgcagcttggttggaagtctgtggtatctcgtcaacacacggcccgatctggcattctctgtggggtatgtcagtcgcttcatggagtcacccagggcggatcatctcgctgctgttcggcgcatactgcactatgtggcaggcactcgctgctgggggattcgttttggcccaggtgcacagggcacttcaagaaagctgttgtctattctgacagtgatttggctggtgatctagatgagcaaaagagtacatcaggccagattttcttcgtcaatggcgggccggtcacttggcaatcttccaagcagaaggtggtggcattgtcctcttgtgaggcagagtacatcgccgtagctgccgcgacatgtcaaagcgtatggctcgcgtggctgttagcggaggtgatgggcgacgaggtcgccgcaccgctgctgaaggtggacaatcagtccacaatctcattgatcaaaaacccagtgcatcacgaccggagtaagcatatcgatgtcaaataccattatatccgggagtgtgcagaaaagaagctgattgaggtgatgtccgtgggaactgcggagcagcttggggatatattcaccaaatctctgggcagaaccaggtttcaggagcttcgctcgaagatcggtatgtgttctcttgaatcgggcagtcagacttaagggggtgatttgttaggaataagtctagctgctcattgtagttagttgtttgctttcctattttcatattcagtctagcgcatgatctggtctttcgggttgtgcggattgtgggcttgacgcacgctgcgttcgtgcagagtctgttggagtcgtgcgctgtatgctccagtgtcgcgaccgggaaaatttccttttcccgaacgctagtgtattaatccccgtcccaggaaaagccggggtacaccatacaaacatgatataaaagacacatctttattatatcgataatatttacattattacaaaggcacttaaggcctgacaatcaaaaataaacagcagcggactagcgggcctacggctccatcttcacaggcgctcaactggggtataagccaggactccacctaagacttcttctccaaagcttctcttactgaaggggggagaaagatagagcaagaatgagtacaaccacagtactcagcaagccacaccggcagatgcatgattaatgcagggggggtacaaggggttaataataggggttatgttttgcagtaaacagcatttaaaagtcacttagttgcccaaagccattttagaaagacgatcctagagctacacagtattattaatcaaggccgtgaaccctcacgaacctgccttaacccaaggcctacgatgattcagaccgaactggcaacccgaccctgggtcccagctcgtcccaagccaacccaggccaaccattccacattttagttgttaagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccatagacaagagtaccgacccaatcccacctacggccggaacctccgggacaggtaggcaggattgagcccctagcagcaggacaccagccctgtgccatgacatctcgactaccgggccgcagctcgtgtagccttcatttgccctggagaatgtccatcgacccccgacttcatccatctccatccgtgtacttttgtttataactagactgagccacaaactaagccttacccactagacatgtggaagtacggtagtgctttgcaacagaggcccgaagaccggtccttatatggccgaggtgctactatcaaaaccatgcaccccgagcccagcctaaaaccattttaggggattttaaatagagggggcggtgtgaatccaattccacaatactccaacaattccacagtgtccaggtgatatgaatattcccaaagtctagagttgtaaaaccgcctaatgttacctaattaaaagcgaagcatctacctaaaatcatactagtggtaccatgagtagagtgtccactagttggggttttgtttattctagggtgaacaaggaaatagtaacaataacaataataatatggtcataacaaaggtaaataggcatggctaaataaaacagtgataacgcgggaatttaaataaagcgataatgcaataatttaaatcaacataattttacaaactgggattcaatatgttcaaagatgatgtgacttgccttgctcgctttcccaaacgccggcttcaacttccacgaagagcggatcttccgaagctgcagcgtctacacgaccaacggaaaagaaaaggcttttactctactaaactccatatcacaagcagaaacaaagcacaaaaatgggttcttgactttttaaggaaaaattagagacttgaatggtccaatttcgagttcaaatggccaagttatggccatttgaagtttatatgctctttaaatggatatttacgaatttcttgatttaaattttaatttaaaatcggatttattgcgtcagccgaggggaggggcgcgcggaccgggtccacgggagtggggcccacgcggcagcctcacggtccacggtggaccgggcgcacgcggcttgcgctggccggcgccgtgggtcccacgcgtcagccgcaccgagggcgcgggcggctgacggccgggccccacatggcagccgcggggcgcgcccaaaggcggcctcgccggcacggccgacgggaggcggcgcgcccgcgcccctatggtcgccggcggcggccataggcacggcggagcggcggccgagagaggggagggaagggggaaacgaaatggcggtcctcggctcacaccgggtcgacggcgacgacgggaacggcgaccgaagcggagagaggcggcggcgcggctcgggtcgacgaggacggcggtgctccggcggtcggcgggcgaaacggaggagtggacgaggtcgacggggacgcggcgaagccgaaggaggcgatgccgaagcgggaggaggtccggggcgacgacggcggcgaaccgaagctcggcggcgacggcggagagagaggacgacggcgcgagctcgattccgacggggagagagagcgacgagtggcggaaacggaggagggaggcacggggagcgtttaaatagagccggggcgagggagggtggccggggaagggaggaaaccgcggcgcgggaggtcggccgccatcaatggcgccggcgagattaggggagcggtttccaaccgaatccgagggagagagggagggaaaaatggggggaaagagagagggaatcacggggagtgatttccccctctttattgcgcgcggggacggcgggaggcggcgggattcgcggcggcggcggcgctagggcacgggcgaggcggcgggagcggcgggaggatagggatgacaggtgggccccacccgtcagcgagggtggcgggcgggcccgcccgtcagcggcgcgcgcgcggggagaggctgagtgggccgcggggaggaggagagagagggagggagatgggccgagccggcccaagagggggaagggggggggaaaaggacttttagggtttttctttttataaaatcattttaactttgtttatttcttaataattattatttgtgctctgaaaattccactaaaatttgagggctccttttagaccaaggagaatttaacaaaaattctccgggccacatttgaatttttcttgtacgtattttaatgtttgccaaattcttttcgaattgtaattaattctattattccttttagagaatgatttttaattcgggatgaatttatcaggacgtgacatccagttcgtgggatggcacgaagcggcaaggggtgtgacgtgtgcatttaggaggccactatggccatgttttcgttctttcttgtaatctgctatttaagcttgagtcttaatccagaaaagctgccaattaacgcagcgccaaaatactccgtgtttgctccgcttccgctttgccggattagctacagttttcgttttgccgctaacaatccccaagtggctttgctcttcgccagccttgccacagaaaccctgattgcttctatccttccatgatacatcttcctaccatccattatgcttatgacaaggactgtgcaaggaaaggaggtggagaggagagcggagagcactcgtgtctgttgcaaccagtgtccacatccaccgggatggacgcgccgcgatggtgcaccagctgcgggtacaagtcaccgtacctgacgaggtagctcatctttatcacgttgatgcccagcacataatcagcctagcaaaaacaaaactctgattagtgatcacatctaatatttacacataagacaaggcattagagttgagcgcatgacagaagcctgaagcctctaccccgtgtcacgcccgaaaattcactagtaatttccgaacttatttgtgcataaaatcctcgtccaggaatcagccgaggtacacaaactgacaatttaatatacagattcatccaattaactaaaacgataaatacttacttaagaggcacttagtcctcaccatgaagaaaactgcagcggaaaataaaatctagcgaagctccggctccactcccacaggcagctcaactggggtataagccaaacgtcttctccttctggatcctttttcttcaactgaggttgattgattattgcaagaatgagcatatgacatactcaacaagccacacagcaaatatgcaattgcacaaggataccaaaggatggcataatatagtctcatttgcgaaagcagcatttagcaaagagttaagagtagtaaaacaatagagtaattaatcagaaattttaatcaacactgaacagcacacccatgctgcacaggcccaaccatcctgaacaaccatacccggctgtacagatctaactccaaaccaggagctaagcaaattattaccaggtataacatccataaatattgtgagaggtgtgagactaatcacgaaaaacattgctcaacccgcccataaccgcgggcacggctatttgaatagttttactctggccagaggtgtaccactgtacccacaagacacagccccacaacatgtcaccatgtgcctcaataccaccacggtacctcggaaaggagctgtgacaataccccttgcacaacacaatccaccacagcgcacctttcctggatcataatcacccccttataaacaaggcatggactccccagcgacccccgtgggcttatctccgccacttctcagtctggtgctccgcaatgaatcatgctatacaaaaggtaaagccgttgcccacgctggcttatggttggcacggttaatgtttcacaatagtagctcgcgaaccggtccttaattgtcatgagcacgactctcaaaaccatgtgctcacaacccaccattatcaagttttagttggcaagtaattaatttaccaatcacgattgaccatcgtgaactatcattaagccatcattaaataatagtgagtcataagttatcccagtaatgtgctaatgtttctaaacatggctaagcaatcatatctaatatctagctgaaccaatatatatagctcaactagtcaagttataataacccaaggtatcaagggataaagtaatcaatgcaaacaggccataacaaaggaatagattcacaccacctagtgacattcgaaaataaatgcacagttgaaataaatagagaatttaaacataggatcaacatgctcaaaggattgtgtttaggatctgtgtgacttgccttgcaataatcggtcttcaattaatcttcttgaatacttccggcgcactcgcgaacctttgcaacgacggaaacgacaagctaacatgcaaaacgaagaaaaagactaataaaaaccaaataaacaatacataaaaagtaaacaaacatgtagatcataattttagatgaattatgagacttgaacggcctcattctgacttcaaatgaatttattatgaattttactagattaaatctaattaaagcccatttaaaaagaattaaataaatttaattcaatttatggataattttaatatgtagatctttattttatacaacttttgcaacttgaaccacataaaactgagttacaatgaattagttatgaatttttaaagattaaatcggattaaaacacttatatggattttaattgaattatgacgcaataatgaattatttttgaaaatgaaaagggaattattgcgtcagtggctagggtttgcggtggaccgggtgcacggcggcggctcacgggaacgaacggccgagatcgaacctatcccaaacgaacggccgagatcaaccgatccacgaccgggccacgacggacggtcccgatgacgtcagcggtgacgtcaccactggcggcggctcgggcttgcaaactcgccggcgaacgacggcgcggcgacgcgaacggagggcacctgcacgtagagggcgacgcggcgaactcaccggtgaccaaagaagcggcggaggagcaacggacggcgacggcgtcgaggaaaaggcggcggcactcttcggcttgacgacggcgacggtgctccagcggtcttcagcgacggcgaaggggcggacgaggacggcgacgcgatggcgaccacgatggcaaccttcccgagcgacggcgacgactggagcgacggcgaagcacggctggagcgacggcgacgactgcggtacaaggtctcacggtgctagggcgcttccgacgacaagagacgaaggcgagggtggcggcgggtagcggcgacaccgggggtccttttaaaggggctagcgagcggcgacggaggcccacggcaaccggcgacgagaaggaaaggttagggttcggaggaaagagaccgatccgattcgacctcgaatccacgaacttccaaagcgaaaaagacgatgattccaaaagaccgaggacggttttccgtgaagaaggggaggatgatgtgaccatggctaccacagatgcaaccattgctcacatcatggatgaacaagaagatatcaagatcaaatcctccaagtgctggaatccgattcggccacctactacactgctgacttcaaacggctgccgaatctgctacgacctccgttttcggcccgtgagtacttgatggaaagctcttggagtcctctttccaatggatccagcctcattgcgaaattccatcttattgagccgcaattgaagcaacaaggtgctgcgtcacctataatgggcctatgggcttgtaacttcgtctgggaccccggcccaggtggggcccatgtggggtgcgccccagccaggtggagcacgaccctaggcacccctaggtcgtcctcccacccctatttatatagttaggtaccccttcagggtttcttgggttttgatagattaaagtttagccattgctacttgcttgcagcgcgcgtgtcggctagaccgtccgtctgcttgttctttggaaccccaacttatcattcgtatttaactcctatttgcaattcagattgcttttatcttgttcttgcttgtttcttcgatttgcttgcaggaataaggttgatttgcaccggcaagatcaacaacccacggagatgtgtatcgatcgctaaggcgcaacacaacgtctcgtacggttgtagtcggatcgtcaacgtttctcccaaatcgtagttatcacaactcaccgaaagatcgggccaacaacagccttgagtgtcgaaaggaactcagggttcatcaaaactgaccatcattttctgtcacaacccgaccatatgcaaataccattaatataattatcattaaggtacaccactttcttttatactccctctgtcccctaatataagggattttaatattttgcttgcactgtttcatcactcgtcttattaaaaaaatcgtgcaaatataaaaaacgataagttgtgcttaaagtactttggataataaagtaagtcacaaataaaataaataataatttcaaatttttttcaataagacgaatagtcaaagagtgcaagcaaaatgtcaaaatcccttatattaggggacggaggaattacataattaaccaatcaactctagacgggggcagatccagaacaagatttaagggcggaatcatctccttcttccttcttcagtccccctactcttcattttctctgatgaagacataactagctcggatataaccatgactaccttatatattaatcaaccaaaggtgcatatgttctatattagatttacttgttatatatttgaaaaaacgttgctacacaatgagttttatgtgatttcatttgcagaggtacttgcttgggcgaaagaaaagaggccgagcgtaaggaatgcacgcatgattaaataagttgattagggaccaaaccaagaccttctctaagtctacttctaccttaccacgtcacttttggtccatagaagataaatggtcaagtttcacacgttttggattcggattcgggcctcctgatagcatcaacttcaaacagacctagccgctgatctagaaggaatttcggggcccataaatacttgttggaaaggttatggagtctaatttcagatggtttttgtcccacatcaaaattcctaccgagctgccgggaatctgcaaaacaagccacgtatcttatccagtccgaatctggtttgggttttgagccttgtaattgtatcgtgggcttagcccaaaagggtgtgcgcccaagggcaacctaggatgtccctaatcatatttattcagtagccgtcatcgtttagagtcgggttttgcttagattaatctgtcaagaacagtttcgccgctagatcggtttgtagatccccaaatttgagtgcttaatcattcatatgcaattgtatcgcaatctatcttgttcttgcttgtgttcttcgattcatatgcagggattagccttctcgacgaggtcaaccaggtttcggcatggttgataaccaaaggagacgtggtgctgcgattgcggggctcagtagcgtgttcgttcagaacggatcgagttgtgtcgcgactccgtccaaatcgactgtttatcaaaacctatcggaagatcgggacctaacattccttattattctccctatacattcttcccattcatctccccttctatcaatgaggatctagcggagtaggggggactcgagtccccccagcacccacactggatcgttacaatacaatactgggcgcatatgatacttacaagtaaggagattacattgaccatgctaattaaagaaataaataccttcggttaatcccaggacaatcattgtattcccatcccatgaatcaggtgacggtgctcgggatcggtggcttcgtgatgatgatggggattgggtgaaggagtgagggcgatgtagatcttcatggcgtcgaccctcgggattggaggcaatggggaccgggaagacatagagttgggcggcgcgacgggcggagggtaccacaaggaggcatgatggttggctcgagcagcgcgacggcgacgtggcggtggtgaatcggcaacggcgttcgggatcggcagggccacgaggatgccttcccgagcagtgcttgacggagtccttcacgacggaggaacaacggcgactcttgagacggctgggtggcggcccttgtggctgtagtgattagggtttgcccgggggagtgggcggcgcttgtggtggcaggggatggaggaagaggtggcagcggcgattagggtttgcttggggagtgcgtacgacggcgccctaaaggttgggcgaaggagggggcaagcaggcgatggaagggatagcggcaccgcgggctggagccttgggggtggggccaaggaggggtccaattaaaatatttgctacttttactgtaagataccgaaattttaggattaaggaatttccatcaaaactagttaaaaggaaagttcttcaattttgtgaaccataaaatttcatttttaacctaggtgtagtcaacctaacttgaactaaaataaaatttgggaaaaaattaaaacctttacatttctaacctaggacaaaaatgcaaacccgattgaaagaatgcatactcactagggacattgtataacttgagtcatttttgtgcattttattttttgttggcattgcataataggtctcatgaacatgaataaaagctaacttctctaagcaaaacctaaatgaaaataaatacacttggttgtatgtgcattttagtatcttaggtttgtttttggatatttttggtgcatctcatgataggtttcatattcatgtcatgcctaaagaaaattcctaaaaagcaattaagcaacaataaaattcaccgaaattctcataaatactacacaacatcctaagttcatagtaattttagcttgaatttatcacatcaaatgttggctcaaataattccttcaactcagctagaaatctggaaaacagcatatcacttagactactttgcgccttcaccaaaatttaatcataactcatctagctaaaccacttggtcagaatgttaaacctgttgtactctaccatcagttgcaatggcttaattgaattcgaagagaaaccacatggaatatgtactacaagatgtataaacagtattcctgactgcagtcaatagtgtaactagtcaactttactaaattaccatggtaaatcaaaaagtaataaaactttagaacttggaacattgaactatcaaatccttgtacaccttgtagcaaccttatctctccaaaattctaaaattaaatggattagagaaagagagtaatatagtatagtgtaatagtgccaacactatcttacttatgggaccaagtccttgtggagcccactcatcaaacaaccacagccacacatcatctacacctctcttatttaatttttttttcatttttctaaaggtgagagagatggagataaaatacaaatcacacctaagctactactctacctctctcattcacctagaatgtatctacatggacccacttgacattcactcatcagccatacacccttggcgaatcacctctttgatcctaaattctacttaaaaaaaaaaagaaagagagagagagagagttatgtccaaattacacccaaaacttcaccatacctcttcaatcttctggaaacatctacatgaggccactaggcagcctctcttgctaaacatggatggagtacaagttaggacatagcctcattagtttctaactcataaaaatcgtgtccatgccatatcatgccacctatctctcccttgccagcacaacaatcactatttggtcaaccatttcaccagcaaactcaactcttcttcctcatcatgtttcactaagaattagaccaagaactttattgtagagccaagaacatcctcctcaatcctttcaaccgaagatgtttaatccattgcttgatttctctggtgagcttcgctgcatttcaaccatggcaacgtaatctacacaccatacctaatattttcatattcaatattcttcattttccatggatcgaacacctgcgtcgagctcgtcgtcgctcccggtgtccagtgcgcagccgcgggttcgcgtcgccgttcccgtcgacccaggccatctcagactaagccactgcgccatgattgtcaccaagaccctaggagcaagaccaccgaaggaaacgagctgaggcaccgtcgttaaagagatcgagcctttcttcttcaactccggccgccggcgtcaatcttcaattcccgctgctctggtgagcctcgtgtcgattcctcacatatacaccatccttgagacctctctaaccacctgtacaccttctcttagctctccatctaccggaccgtgctgtcaccgtgaagccgacatcatcctccgccttcaagccgttccgcgagctgctgctgccgtccaagcctcgccaacaccgtgcttctgaccggtgagcaccctaaacctcccaaagatcgaatgcatgcattcctttagcccaaaatcaagttccaccgcaacatgcaaagccatctgaaaaccttctccactattctgcaacatacgggcgctatggttgaccatttacagcatattcaccttctctaggattgcattgacgtgggacacactttttatttttattccgacaccatccgagcctccgtttgccgccggcgagcttgagatcgagctcggccatagcttgtcctgcttcagctcgaaccagggacctccttacaagaatttaatttaatgtagggtcctttctgcaaaagcacaggacacacagcactgttgcaggacctactcatatttattgaaaacaggaaggactcttaatgaaaacagctattcaacatgtgctgaattgttcaaatctactttaaacttcaaaattgcatactcctaactaattcatctaaactctttttaggtgaaaccaatttctatagattcacaaaatttagcactataatgttataaaataagaagtgacacataaagtacaaaaatctatctctaaaattcatctaagaaaaatcagacataaaatatgcacaggattataaaatgcatagaaaactcattacaactcattttagagcaaacttagcttcaacagatccaccaacatgttctctaaaatcaaagtaaaataaaacatatacacaatttacatcaaatgcctctaaaactattacttccaagttaagctgaaatttagaaattgatataaaattcatcttaggtcctttttgagtaaacacaagttctgtagaatcaccaaaacatataattccaagttataaaataaaattatatacttactatatgataaaagcctataaaaaattatgtaagtaataaccaacatagagcagcctttaaattctaaaatttgtagaaattcatttttatttcaaatggaatgaaccaagtttctatagaaccagcaaacagtgagcttcatcatagtaaaataaaatatgacaccttctgtacagattatagctctaatctttaaatagataacctaggagttaatcacctagtaatgattaagcaaaatatatgtgtaaaggtatttaaaatgcactctagctatgaataaaccaaaataaaacttgttagaccagagaggtcatagttccagccttaattcccaaagacttagcaaacttaactcatataacaatttctaggttggtatgttaagtaactaacatagaccatccctatttataaaatgtgtagtaaaataatataaactctaaaattatgaactaagattagattagttaactaaaatactcattttatacatcactggctagatgaggcaagttctggacctaaacctctaaagccatgaacctatataacactatacacctataacatgttataacttgtaaaatacataaagaattcatattaactctaaaaattatgaaaccaaatatgttagtcctagaaaacacatatcttcaccccagcaaatataaacttaataagaatcaccttacaatagcatttcataatagtacctaagtaaatcctatattataccacgcaaatttctaaaattcataactcccaaataaaaagagataaaatagaaattctttcacctaaattcatcttagaccaatacctatccactgtgcacaaatcatgcattttaaagcattttggatttttcgcatatttcggtgtttaattgcataacatgtactttgtatagatgattgcttagacggtgaagaagtgatttaggtgctgacattttccagttgcaaggcaagtcccacctccctctctttaatcactttgaacctatgttttggaggttattgaaaatgtttgcaaatcttgcatgtcaattgtacagtaataaattaaaattttgttaaacttgttagacaaactcctattatttgcattatcaccttaaccccacatatatccatatccatcattcctaaacttaggaacaatatgactatactgtcgacgtttgatgtcgcgattccggtatttgatgtcgtgattccggtatttgcatagtatagggatcgttggtactaggatatatgcgaaattgtaataaaagaaatggggatgaggatttttatacagattcaggcccctgaattgttaggtaataaccctactcttgtcggtcgaagccagtcgttgctcttattcaccatgatcacaccagtacaatatttggggtagcctatctaactgttgccgacttgacagccataaaaccatcccgtagtcgataacagagtagtcttcctcctcgaatccgtgcccggcgagatcaaagacagcgctatgtctctcctgacagcatctgtagacaccgtaggggactagccatgcttatctctaaagtcgatatccggcggcatgtcttggcgtatgttggcttgtatgttgatctattgctccgtgtcctctctcctcctagggggccttgtatttatacccataggtgtctccttgtccaagtagaactagggaaactaatatggatacaatccgagtagtccttgtcgtttccatgtagaactctattcatccttccttacgcggaactcttcctatatccgaaggttgtttccatataagacatggtatgtggtgggtcctaccgagatttagtcaactactattaggtatgtggtatccataaccctgacatataccactttatatatacgagttttgatgtcactaggttacaataatgcttagccatgcttagaatggtgttccttgtcattatgggctcattacaaacatgaaaattgtttctgaaataatctagacagaacttgaatacttatgattttgataaataaaatggagcaaaatatggattttaggtttgggcctcaagtggtgcacatatggtgatttgttgtgtaccgataggggtagagtgcgtccaaaccgacctaaggacttcactcaatgtcagttcatttcgtatacagtgcaaccacatccacatgtgctagtacgggatagcccaagcttagaaaattatttatgatttagccttacattctggtaggccggtgtatatgagttcgtataattcagaagagcttcctatttaccccgacgtgatacaacagtattgtgcctcgtggtgggttgccgttgtgtccgccaccacggcgttaagtttaaggcgtgggcccgccacttaacggttctaggtcatataacgtgtatggcttaagatggagtaacacgtatcgtgctggtgtaaggctaaatcatgaattttggaacagctttgttgcgggtaataaatcgggtacttatgtatcgcgtatcgtgctggtgtaaggctaaatcatgaattttggaacagctttgttgcgggtaataaatcgggtacttatgtatcacgtgccatgctcttgcatgattattatttcgcatcttgtggggaaagtgtacaaactctgcagacttatgtttattcttctaaatgctgaaatttaacttcaaaatgtgatgagatttgagaatgatctccttgctgccatggatagcaatgagctgcatacttatacatgattaatgtgcccatatgctaagtactagcttgctgaaatttatttgaaagcaaaatctgatttgaatgtgttttatgcaaataaaacttgctttatgataaaaagagacatattatgccttccttgattatatgtcttgcaaatagggtgttaggcttgtgttggtgcttgccagtacattatttttaataatgtactgactcttgctattaaattaatcttttgcttgcatgttttagatttagttttttagtgatgctggtagtacattatttctaataatgtactgactcttgctgttgaattaaccttttgcttgcatattttagatttagtctttgagtgatgcgggtaatcgactgcttcttctaggacttgaacttaatggggtaaatccctagtcggtgtgcttgaggattgggtagtcaagcttccgctattctatatatttatttggctggtcggcctatgtaactatgaagtagttgtaatttagaatcactttcgtcttaagtgtatttttctatgtatttccatgcttgagatgaaagtgtgaatctagtgtacatcctgggaactagattcacatgagtatgagttaagaatatttgagatgttgtagatctttagccatttttgtcaagtctcctgaatgtgtaacacaactggtcgccgccttcgagtggtttgacgggcacatctcaggctaaagttgactggcaggctataggcccagcaatatctccaatattcctctctcgaggcgtcagatatttcattatgcttgttgttgacttgaattatttatttcatctctcaattataatggaaggtccggagagcctacgacatttacgtttggtaattatccgaatgcccctcttaggttcggagttaattttttgctcttctaaagaggtaggcatggactccccagcgacccccacgaacttctcgctgcttctcagtctggcaccccgcaatgaatcatgctatacaaaaggtaaagccattgtccacgctggcttgtggttggtacggttaatgtttcacaacagtagctcacgaactggtcctttaattgccatgagcacgaccatcaaaatcacatgctcacaacccaccattaatcaggttttatttatcaattaattatcataacacgattaaccatcgtgagctaccattaaccataagtaataatgtaatatgattcatcccataaataagctaatgtttctaagcatggctaagcaattatatatatagcatttaggtgaaccaaaccaatatataaggttcaagctaatcaatttattactcataggaaaataaagtcattgttggccataattaaatgggaaaggctcaccacccgataacattcgaaaataatgcataagttaaaataaaacattagctttaaacgggttcaacatgctcaaagagttgtttgggatctgtgtgacttgccttgagcttcctcaaacgcttctgaaccttcctcaacgtaaacgctctcctccggaacgttagaaactaaagcaaataaacacaatcaataaaacagtacaaaaacaagcataaacagtacatgtggatatttttaacatgtagatctcgattttagatgaatttagaaacttgaaccacttaaatccgagttacgatattttagttatgaatttccgaagttttaatcatatttcatctaatacagaaaaactaataaaaggatttatgacgtcatcgatgacatcatcgccggccatggctctgaaccatgagatcgccggccatggctctgaaccatgatgtcgccggagctagaggacatggccgggtcttccgaggacacccatgcgaagaggacgacgacgcgaactcaccggtgcgaaaaacaacgacggacgacgacgaacgaaggccggcgacgaactccaacggcggcttggctcgggtcaacctcggcgacggcgctccgacggtcttcggcggctgaaaaggggcggccgaggtgctcctccaccgcgcgaacccgacggcgacgacggtaagcggcgacggcgaccacaaccccagcgcgacgcggttggaacgacgacaacgaaggcggcggctagggctacgcggtggcggcgctacgggcaacggtagagctcggaacttgaggcaaacggaagaggacgacttagggatgctttatataggcacgggtgagagagatcgaactcaaaacgagaggattttaaccggaaaatccgagggttagtttggagaggtaaactcaaaaacgagtttgactcggataaaatacaaggaattaggttccgattcttaaggaaaacgagagaggaagataaaggaaatatttcccctcaactaattttcggaatacacgagagataaggccggatttggatgggaaaaacctagcccactcggtctcagttcggctgtccagaggttgaagatgaacagtgcaaaggacgaaaattagacttttcggctgggcttctacttcttggcccgattgaaagagggacacaaagcagacttcgacagagggagggagagggctgcaggctgagaggagattgggccaagaaagagagaggacttttcctgtttcggcccgaaaaggaaaagaggaattttaattacttttccaattaaattaatcactgaaatgatctttgaattgttaaaaatacttccaatgctcaaataatttcaagaaaaatcctgaaaatacttggacactcaaagtacttaacaagattataattagaccatttaatgattaatttaatatgtggataattactgaaatgttgtttgtattattaaaattagaaattgagctccggaaaatctgagaaaattccagagagtataattaaccatggagaatttaataaaaataaatccagccatgctttatatttagaaaattttatttcccacatttagcttcacttgtaaattaatgaacatttaatataaattctaataataatttattaaataatttataaatcctaaaacgaaaattaggatgtgacagtggactcttaattattagccacttttgcttatgtagcatgccaaagtggcaacccagggtgagaaattgcgtagggaccacacgtcagtctctccctccccttcatttcgacagtcccgtcgacgccggcgacgccccctgctacaccgcacgcaaccgtcgacgccggcactgctacgctgctccatcgcgcgcatctcttgcaccacgtcgatgtcggcgctcgtgctcctcgtcgccacccacagtgccgtcgcggtgtacaacctagtgcaacgagctcggtgcgcagcggcagtgttcatgccagcggcgttgcggaggggcagcggcgttgcggaggggcagcggcgcggcagtgctcctccagctcatctttctcgtcgtcctcgactcccactctcctactcacatgcggcggcgttgaggaggggcggcggcgtggcggtgctcctccggctcttcttcctcgccaacctccactcccgccggcggtggcggcgccgagctagctgtggcatgctgtacaccccggcggcgctgtgggtggcgatgaggagcacgagagccgatgtcgatggggtgcaggagatgcgtcgacagggctggagagatgaagaggagggagagactgacgagtggtccccatgccatttttcccctcgggttgccactttggcatatgacacttaggcaaaagtggcaaatagttaggcaaaaatggcaaatagttaagagaccacctctataaaagggcaaaaaaattaactccaaacctaagaagggtatttggataattgccgaatctaaaagtggcaaatagttaaattccccggcaaaggagagtgcgttgggaaggaggagcgatatgagccgttgggttcgatgattttgggtcgttggattggtgaattaagatgatccaatatatatacaattcaaatcaggcttttcaaacaccattttagggtgttggacacggaataagacgaatattcaaaagttggacacggaaacccacaactacacttaaaatgagacggagggagtatatagttttttttccatctgatttagcaagtcaaactcatagctaactccagcaacctctcaatctaccctctttattctgagtatacgacactaagatccgtatgtcaatctctaccatcctcctaactacgctacctttgatcctctatcctccttcctcccgtagcaacaacagtgacaagaaggggagaagtcggcaatggtggcatgcggtaagagggatggatagccgatggcagcggctggtggcaagaggacaagaagatggcggcaacaacaacactagttgtgatggcggtggattcacgtgatgggggaggtggatctgcatcagccaacggtggaaggagcaatgacctcagccacggcagaggtacgctcgcacgacggggaggcggaggcacgatggccgttgatgtcggagctacagagggcgccactaagctatcttgcaggtggcaccctccctccctcgccatgtctcaccctcgcttgccctttttgtcgccggtgttctcgatcctccctcactgcaccgccatctcaccctctcgccctcaccccatcccctccaaccgcgggcagaggccaacgtagtggaggcctagcgcaatggagccccgtcggtgaccgcctatcacctcgtctagagagggaggggggggggatagagttgtgggacccacgattgggaagtgatgttgggtggctaaatttggctaggagtgaagagatttgggcagccagatgccttggccatcctattagagagactattagagcactttttttttaatagagtagccaaattttagtttggagaggatgtcgcagttgctctttaggatgcatgaaataagggatgggtaaaggcatgggagcgcctctgtttctttcggcagacgaggacgaagtgtactatgaatataccttgatggcagcatggttacatcatggtaaccagggaaaattgccaatatctaaatatgtacgtatgtattggaaatctagacattcaatgtagacaaatctcgctatcaagactaaaaatttctcccggattcaaccatgagtaaaaattttactcacatgaaaaattttacttcggtgacgtggattaatcacaagcctccatttttttatacaacagtagttttcagatttttcactgcatatctagtttacagtacatattttctctcgtaaccacgataaattcacatcctaaattttgtccaaatttttaaactccgcacggtaaacgatggtattaacggtgtgctgaagataaaaagaaaaaaatacaaagaacagcaataattctaaaaaatccaaaaaaaaattgaaagtctcaggactacatactacttttttttgcagaacatttcttatgtcttactactccatccaaaaaagagagaaaccctagctacgaacctgagagaaaccctagctacgaacctggatatatgtgtgtccaggttcgtagctaggattggtttttttaagaacagatagggtatacaattaaacaaagtagcaatcaaattccaacctctctctcgttttgtaacatcttttcaatttctatggagctacagaatataaagtaaactctaccattttcacaaactttgttcatacttgtagatatatttttatttttttccaaaattgaattcaaacaaaattcattgaaccctaccgacggtttcacctaccatgtccccacaataaactcaattaccacgcagtaaccgccggtaggcgacacccttatcacaaccagaaacgggtgcatatacaaatggtacaagggtatagggcatttccgaataaggataatgtacatgatctcttagcttattctcaatatacctatcatttaaggtacaaataagcccgattacgattcccattacactgataaccgatcaagcgtgatcaaaaagtgctgaaatgtctacaaggaagactgcaaactatcataatgtaactaaacgatgttcatcaacgtacatgggacttgcataattcacttattagtacctactgaccaacacaaaatcatcgtcgtcaagaacccgtgcctcgttctcacccacaaagttttcccgtccaatagattcaacgattcggacaaactctaccctcttttcaagaggaagaggtacatatggtaatctgaaaacaggccttaccactccaagctgagccagggcagtgttgagagcaattggatttggctggcaaaacaaccatttcatcaggggaaagagcttctcatttagcgtcttattctccccttcatacatgagatcgtgcatgagaccaggaataaggttgctagccacagaaataactccagtggcaccatatttccacctagaatcatggcattcatcatcattaccactccatatggttatacctttgtcagtgtagcacttaaccctctcatgtccaacacattctttcacacctgccaagtttgtgaaacttgaaacagcctcaataactgcaggaggaatatcctggccagtcctagatggaacattgtaaataatggttggacccattgggaggacagcctcaaaatgagatatcaacccttcgatagaggtcttcccatagtaaggattgatatggagagccgcatgcatacctacagcaaatccctgctctgttgcatgaatagcctctcttgttgagttactacctgtgttgcctaccactttaactttagcaccaaagcagttaacagtatgtccaataagcatgatgtgttcatcccagctcataaggtggccctctcctgttgttcctccaactattacaccttcagcaccaccatctatctgcatatttatcagtgaatcatatgcttcaagatcaaatcttccatcaggcagatatggggttttgaccgctgtaattactctgagactagtgatatcagctgttgatgtcctgcggatcagaaaaaggaagatcatatctcagcagcagataggtatcaagcactgaaatacccatgtgcaaaaaagggatcacatgattattaagttacaaatttaccaagcacaaaattgggttaccatttaccaaaagattatacaggattatttcatttcacaaaattggaaatagcaagaacatcttatttctctttaacgcgtgaatgattattcctgataagacctgaacttgatacacatgaagcatgtcctcagtaagtcagtatccaacttataccgttacacatcacccgagtgaacagcacacaagcaaacgtatggctctaagtagcaatttcggattttggtacaaggtatgaagagatttggtgctggcatggtacacattgaattcagcaggggaataaatgatttcggaacatgataaagtaaaattggttacaaaaattcaattagaacgggatgtggacatgtgaagttctgactgaaaagtggcaattgaaagtagtttacgggacatcttaatgttcagctaagcttatggaaacataaataaaacaaggaaccaattctttccttccaaactgagaagattaccgatttttcacttcagtacttcgcattggaagataatcatcaagggtgatggcctgcaatgcaaactttcctctgctaatcctgtatgaaagtacttcttgtgttagtgtgttgcatatgaaagtagaaaatgaatatgggggagttgatgagctaaatatccttcatcactccttaaaatgacagaaaagaagttgcacaaatcgtcagaagtacaaaatcctaaataattgagatggtagcatatatatttggttgg

SEQ ID NO: 38805 - DNA, 3952 bp, Oryza sativa
aatgcacaatcatataaaaatcccctattttcagtattgcacaataactcttgaatctatactactcagcggtccaggtttagaattagccctatgtagttgatatttaactcatggataatctctgggaaacttagtcgcaatccgcgcatcaacgaaaataactgcacattccgtaagaaccatacagactctcaagctccaacatctgtattgcgcagctgaagcaatctatatcaaatcaaccaaaaatggtattccataagtccccaatcaacactaccaagcacatcccatccgctggcatccccagcagtttgccgtgatggctttcaaatagaagccgggtctccggaccttccctcaaaaaaaaaaaaaaaagcacatcccatccatccaggtctcacccggtcgatcattccgcgcagcagtgaggaatggataaaaatcaaaagggaaggggcagcagtagccaagagagatgaaaacgacctgagcagcggcgccggtgcagccacggcggcgggccaaggtcgcgccagccgcggagcgggtcccagggcggcggcgtccttccacgcgaggcggtgggcgccccccgtgctggcgatcagcagcgacgccatcctcgcctccgtggagaaagaacggactagggttttggcgtctcgctgtggggagaggggagagtgcagaggggatgggggatgggggatgcgccgcggcggcaataagcggtgcgcaagatttgtttagcagtttaggtcggacttgtgatcgtactggactactggtggtggtaaggtggaactggaatttgcaaaccgcggtcgtcggtcggttccggtgggtctcggactctcggtagggaaattccacgggaagcgagcggtgcagaagcgagtttctattttttttctttaacctttttaatttttaaatttagaaataaatccctgcaaaacttaatggacgcgactccggctcgggcacccgatggaaggaggctaaaattggacactgacgttagcatgacgttagcacccgatttacatgcaaaactattttaaaaactgatttttctctttaattacttatccaaattatgatctgattgcaccataaattcgttgcaattaaatcttcaaaacaagaccacacatggatatattccgacgaaaaaaattagcttattattgaattatttttaaatgttgcacgatgttccaccgggtatatcggaattgtttcactaagtagatcaagaatgttttactcgttttaatcaggtgttgtttcaccttatataaaaacaatgtttcagtaaatagcaaaaaaatgtttcagttcactgcaacatttgatccatacatagtgaaatattataagtacactaggtgaaacatttttcggtggaacaacaaatgaaacgaattcccttaatacagggcgtttccaaaatatgtgggttttttttgttacaatggaatatttcagttcactgcagcattagatctatatatagtgaaatattgtgagtacactaggtgaaacatttttcgtggaacaaaaataaaaccaatttccccttaaaaaggggtttccaaaatatgtgggttttttattgccaaaaatatttttattcactgccacattagatctataaataatgaaacattgtaaatacactagatgaaatattttttgtggaacaaggggagacaactgggtgggtccaatggaggtacgcacgtgggggggcggggagcgaccgatttgttaagaaactttaggcttcgcccatgaaggcctggcccaaatacacttattgggcccatcaccgaactttctatatattggattgcactatataaagagaggaggaggctactcattgtacaattgattggaggattgaatagaaaagagaatctcatccctaaactttgtgtctccacttttatacgattacgggaccctcttggactacttcgtgtagctggagggttgtgtaatacgttatcagcacgaagctctaccggagaccaaggttgaaaaagggtaagaactcaacaatcctctttgcatctcgtagattaaattgcaaaaatgaaatccttgcatcttgctcgttccgtttttgtgactcccgacgaaaaccgccatcgccgacatggtgtacaataaagtgggccccactttattgtacaccatgttttggctcaaaatgattgctcatttctgagttcttggcccatccatccataagtctcattctcacagtgtctatttgattgatcgattgttgtgctgtcgattctcctccattttgatagcttctcctgcatgattagttttccaagcacatagtggaatagaatgttttatttgtgaaataatgcattgcaaacacagctagtctttatatattgggtagtattcatggttgaaactggtcgataacgaccgtcaacaaaaccccctaagcttgaacctttactcgtcccgagtaaaggacgaaaggaataaagacttgattgttgataggagttgttgcaacgctgtatatcttaaagatacagatgcaaggtatgtatactctctctaaaatcaaataagtttgacacggtggcttacccttacccctgattcccatgagacactgcctctccttgtcttgagcggttgtgagacagaacatcaattagagcactaatcacccaatctttattcaactatcattccggaagttttcaaatgattttgcaaaagaaagccaagttcctcaaatgattctctcgatcactcaaagtgtatgaatatggattcctcaccaaatttgcctttttgattcctactctaaggttgatatatggagctcggtagggatcaaacatggcatacttgtattcacatttattactaagttaaaaactttgactaaaatagatgataaatcatactcaagatcaagatcgtgcaaagtgtgtgtgaataatatggtggaaaactatgatggaaaataaaatgtggataaagaaaatgcttctcctttctcctttgtgcttatgcttttcctccaaaatatgaatttattatttttctcatagccatacatttccctctttttttttctttttttttgcaaaggatttttctttggaaaggaaacatggatggagagcttattcgtggataatgataacatggatatggtggatgatacggatgctatcttctagtgtagaagcttagcatatgtgggtgtatgatcttgatcacagagcatgaaaagtatctacacaagtcacaaggatttgacaaagtttaatggaattacaagaaaccagaatgtatatggtttaatcaatatgaatatttttggctttggtaggaatttatatcaaatgaggaactttcaaatttatcattttggaaaataaaacatacggaactcaagtcaaacttagaacatgatcatagcaactcttattttactatctcatatctcgcaacaacctagactcagatcagcaaagtgcagctcacttacctcaggttcccggataatttttggcttctctgattcaaattttgagacaatacttaaccatgaatccatatatgagagatatcaaacagagcaactattcatcatttcaatatgaagaactaagcatgtcttacctagcatattaaatctaacctatctttttggtatttttggttttgcaaatttttatgttgtttttaggtttataaatgcaatgcaaaaatttaaacatgcagtttgaaaaggaaatatgcaatgtgatacaagttaacttagtggggggagagacatctccccccaagcttgcttcttgctatagctcatggcggggatcaaatccctggtagcggtgaaacgcttgccagtcagcttgctgctgttgcactattgtgttgaagt

SEQ ID NO: 38806 - DNA, 26848 bp, Oryza sativa
  unsure (1)..(26848): unsure at all n locations
attcctgcacccctttgggatttggatccaaccgaggcatccgtggtcgggtcccaactgtccctgtacatctgctggtggtgaagaggaagacgcctcctgaggtgcttctctcgccatccgtcatgttaccctgcgtgagacatcacgaggcaactccgcttggagtggaatggttagttctcggcaattatacaaatgaaactccgggttaggtaacagaatctcatttgtatagccgggaaacaaaaatataagataatcatttggaccatgtttgagtatgtggcattgaaccaaataggtctcatcaacataagagcgggtaataggaatacttgcatataaagcagagtcccaactcttcatgctaaacgagtcaccaaagaaatacactaaacaggaccagacaacttcacattttctaaccattgcttgatcatgggttgaacgggtgaaactttgtttttttttaaccatggcatacaagaggactagttcgcactatccggataacagctctatgaaacaacgtgaaaccaagcaacttatgcaacagccttaaggtaggattatggatgtcattagttctaggctttctataggatgagagacccgaaatactttgccaaaacatgcgcttgttaaaatcaagaaatgtgtccctgaaattaactttgcatgttttgtcaaagcctagatgcaagctaaggtctttccaagaaaggtgatattccttgcggaataaccggaaagtaacaccatcgcctacctctagcaaggcacataaaaactgcatggtaagcaaacgggaacccggctcatctacacatgcaaatttatcccatcctaaagcacgccaaatagtatgaaactcagcatccatccctatccttttcagaaggtcgagtcgtatgatcaggtctgagtacacgctcggtctttcagcatatgataggcttgcatttcccggtcgcccacgaggtcgagattgaagttgtcgtactgccttggtggaacgtaagcctcctccatggatgcatccgcggaagaaggtgcactcggcttatcgtgtcggcttgtccgtgagcttgaccgtctcttgaatatgcccgaaagtcgtttcttcatagctacaacaaagagcaagaatacaagattactcggacgggggttaagcaagtacccgccgattaaccttgcaccgaactaaagcaaacttgtatatgcaaagtgtctaaactaaatgcagcgaattgtgtgaatttgaggtaagcctgcaaaactttgaatgaattttggagcaagatttttgagagggagtgaaaatgagttaaaatggtgtgacttccctctcctagccgagctgcatatatagtgcatggataactgctagtaatggcatgtggaccccactagccgctaccctgcagaaatttgcagccagccggtgccaggccggttggttcggccgaacccccggtggacccaattgtccccatattttgctgttggattccaacgactagtgtggtggtggccgtgcaaacttttgccaaaaaatttattttattttgctcacaaaaattcatttgaagaatttgcctcaaattcgaacctcaatgcatgctttgagaattcaaacattctttgatgcaatgggaaataaatatgagatagctaccaatttacctgttggcaagggcgacgtcgttttaggtctgacgagcacgaccgtacctccgatgcatttagctcgatgaggcaccctgttccggaagtacaggaacaggtgtcttctccttaatccgccacaccttctttgccttaggtgcaggcagcggcctcttcataactgggaacgcaggttgaccgacatgtattcccggcttctaggatgccggcttaaggtactgacggttcctcgttttcttcccgctccaagaagttcatcatgaaagttttgaggctatccgtccttcagtgttttactttgacctccttgtgggttcggtccattcctgatctaccccatgaagcaatgctccatccttggtctccttgtggatgatacccgttgttgttgttcgtgagctttgacattctcacaggtttttggacaattcgtcccaaagtggccgtcattgccacagacctcacatgccatgtgagagcccagggccttaatggtaccctgcttggcgtccttctcattgttgtccagtctcttcataaggagatccaactgggcggcaagcatttccgtctcattgacggtgtgcataccgcattgacgggtttatgttgtttctcgctccaacccatatttgagagcctcttctcaatcagatcagtggtatctctgaccatctttgagaagggtgctcctccagcagcagcgtccagttgatcccaggacgagagtgttaatcnnnnnnnnnnnnnnnnnnnnnnnnnnncaggatgagccactcgtccatcccatgatgaggacgggcggtgacgcattcctgcagcctttcccaagcttcaagaatggtttcatccctcgttcgctgcaaaccaaatattcttccatgaagagcgttggtcttgcccatcgggaagaatcatgagaggaatgccgttgagtgcttattccgggttttcaccgttgcacggttgatgtagaaccactattttgctctcccgaggagggagaacgacaacagttggagtctgagtcctttgacggtatacgtgctacaacttaacaggaattgctgcaaataagcatttgcatcctccttaggcttgccacagaacaggcaagcctgcgccatcgttaatttagctggtcttcaaattaaagtcaccatctcccctgctgacttgggttccaactggcatgttaccagcagagggagcagcgaacttgcaaagggtcttctcagccatatcgtgcaattctggtggcgcgaaattggctggtctagttgccgatagagtaaccttgaggatgaacgataggggtcagcttcacttcatcagtgactccagatatgaaattggtcggcagatcagaaccaatcctgtactaccctattttcacataaaagagaaaacaaacaaggtttgcctacaaaggacaatgacttatacagaggtaaatataaaattattagaaagtagtaaactcttaatcatttatcttccccgggcaacggcgccagaaatgcttgttggtatttcttagcgacactactggaaatataattcccagcagtagcactagaaataatcctggtatattatagttacagatgtgatccgcaagcgcacggatatactattatagcatttcaaccggtgttggcggttgttaaatgccgattctataccgccaacggctacataaagatcagataataaaacatccaacatagtgataggtgtttaatctcacgtattccacaagtgtatttgtatgcaggtgataaaccccgaagttgggaggaaatctagactaaagtgaggagaattctgtatccatacaaggatacgttgtgaacttcatcgaggtatcagtaaatcagcccaaaataccaagaattggatagaggaggaccaggggaggacatgggccaaaggccaggccaggagggcccagcccaggttcgcccgaaccctggtaaacgcggttggatccaggttttggcgtggacggtcctgatcatctcctgatggcggttgcggggcatttccgacaattcgcagagtacaaccgtcatacctacctctatataaagacctcacttcactcacgtcaacacacacttccaagcttgagctaaattataagaggctctattgtactatattttatactagaataggaagagagtagagtagaaggagtcggaagaattccggagttgtcggtaatcttctcctatttcttttattttgtttattactctgaattcaatataacattcttcttgagtaatttagatttatcttgtgagaattatctcttggttagttcgtaattagcatacgagattattgttcactataatcaaccaaaatatagtgattgctttggtgagttataaacactaaagtagatattaattgcttagacgtggtgtttaggtaattattatccagtaattgctgcgtatcccacagtacgtttgaggtgggtgtagaggtggtgacagccctcgagatcacttaagtcctccctgtccgggtacataatagagagacatctgggaacagcgggttgccagtgcctgaagtattgcgttaggattaaaattaagctttccctagacactatttctcactagtgaatcctctctatcctagtctatcattagcttcgtgtccttggatgaaccagaagaagatctgaccacacacgttcccttggattcgatacccttagaatactccgtaggggaagtactacatcggtatatccgtgcgcttgcgaattttatctgtaaccgtatcaaataccaacacccgggagtattccaaggtatcgtatttattttatcccaagggaagatatgataagagagtactatgctaacaattcatatattacttatatacgtcaaagtctacgtatgggttagttcagttcaaagggtaggttgacacacaaaagaaagaactaagaactactctcactaaaatatagtctaagctaactggagaaagaataagaaaagtatcattcatgtacttctagtatacatacatctttagtctatacttgctattatactgtcatgtaaccaatactccgtacccagtgtcctcctggtgttttgagaagccaccccttactgccgagttccttacgacagcctgtcatgaccatacaaccggggctaaatacggaggagtaccctccccaggaaattaacttaggactatatacacacgcggaggaatacccgtactgagctgtcaccatcagcggcccacctctcatctgcagcatataaccccaattaatggtatataataatctaagcaccgcgcttacattactaaatactactctacatcctttcaaccgacgtacaacaaccgaataatcggacactaaacccacaccaatacacctatctggaaagctagttacatgactatattgattcaagtataaagtaaagtcggcactcaagtaatatgaatggaataaattaccgaacttgtataaagaagaatattctattaattcagtaagtcttacaaaagaagaaaggaaagctattaaagccataaccgaaatctcctgaagactcgaggacttatgaagactattctatttcctactccactagcactagaactactaaacagtacttgagagagctcttgatcttcttcttgaggtgtgtgagggaatgaatgagaagaggggtatttataggccatgaggtgccttgggagagtggaaatgctccaagcatcctatgagcatctttgctctcatcatgacaagtggcatggtcaagcatcctatgggcatctttgctctcctcatgacaagtggcatggtcaagcatccaaagagcatctttcacccttctcttaacaagtgtccactttcatgacggtttctaccggtagaattgctcccaactgtcataggatacgtgtagataactgccggtggaaaatgggctggattgggccagctaatggttcggccaaaccaccaggggttcgaccgaaccctggctggctcccctggcccatagccttctttaggatgctgacatgtgggccccactttattttacaccatgttttggctcagaatgattgctcatttctgagttcttggcccatccatccataagtctcattctcgacagtgtctatttgattgatcgattgttgtgctgtcgattctcctccgttttgttagcttctcctacatgattagtttccaagcacatagtggaatagaatgttttatttgtgaaataatgcattgcaagcatagctagtcttcatatattgggtagtattgacggtcgaaactggtagataacgaccgtcaacaagcctgtcgcgccacaccgccgcgactggccgagccgccgcgccacccgcaggccgccgcgtcctgccgagcccgccgcgccgcgctgcctgcaggccgcagtgccgcacgaaggccaccgcgtgccgcgagcccatcgccagcagccatacgccatcaacggaaaaaaaaggaaagagaagaaagatggaaagagattggcgattttgcaaaagggcccctggcttttctgaaaattatgcgcatatctctcagcatggagattccttgggcacagacccttgaatttcataaatttccattttcatccctccaccgcatggaaacttagtaaagggccccctgtatttgcacatttcgcatgcatttcttatttaagcattttgtttatgtcttataaattttgaaattgaatttcatgaaacattaattaatgttaattgatattttgaatttttgttttcagtatttatatgaatatatgcaacctttgcacctttttttatgaatatttgtatgcattttaatatgaaatctagtatttctttatgaaaattgcatttactatgaataacattcatttctttgaataattagcaattcctttgcataagaaatattggaaaatcatgaaaaaagttgcattcatatttgcaaccatgttactagtagtaacttatgaatattttgttacttttgcaacagaacgtcagggatcacgtaccaggagtttgccgaactggcccagcatggccagaaccatggccagaactacctgacctaggcatctgacgtccagatcgtccttggagccaagaaactccgccagacgatcgggatgggcaccccgcaggaccgtgcgcctacccctgatgagaacgatcaggcgctgcacttcctgcgacaccacctctacgccacgctcaagaatgagtacatgggattgcggagcccaatcactctctggaccgcactcaagaagcggttcgagaagttgaagtacaccatcctaccccaagcagagcaggactgggctcgcctgaggttcgccgacttcaagagcgtcgccgagtacaactccgcactgcatcagatctgtaccaacctctccctctgtggcaaggttgtcacggacgaggagatgattgagaagacgctctccaccttccaccctagcgccatgcaaagcgctcgtaactacaggcaggcgtcatacaaggagtatgacgagatgatcgatatcatgcaggtgtctgagtctcatgaagaggttctccgcaagaactttgtctcccagccacctggcaagagtgttggccttgaagtcaatgctagcagttacaaggtccgcaagcccgtccagaggaagaggggcaagtgtggtgagaagaaggcaaccgagaagtcagagggaaaagctcctcctacccagggagcacagggaggcaagggcaagaaggaagccaagccacctcgcaatgacaagccatatggccagcaggaccagacatgctacaagtgtggcatttggggccactggagttgtatttgcgaggagcccccgcacgtcgtcgacgcataccaggccagcaggaaggccaaggcatccacagaagcacacatggttgatgctcacactacggccactccccaaccactactccacttgacgcccctgcagctgcagtaggcacagcaaatgaaaaggacgtcacacaggagcagatctttgcagagctcgatactctagttgattccatttaagtatttgatgcccctactttatttcatgaactaagttgctttaggaacaatttgaataatggttttgtaagctctatgagagcataacatttatttcgtgattcgccatgcatggctagactttatttccaatattatgttgcattttgctatatgataaagttttacttcttgccttgaagtagtgatgttttactttattcacatagacaatatgcatagcctaaggtgaagaggaacattctggaacaaaggcaccacaaagtgtaatcttgagagacatgagacaagttcagtctatgcaaagacgtgaactaccttcacaaccgcacgcaatgattgtaaaggatattgtttttctcgtagaaaagcgattacacctcaaatctcttgagaattgcaaactctcgcacaaaagttcccttgtaggaactagaagatgagagaagcatactcatcacctaagcatgtgagatcaatgtcctcactaagaaatgtaggctaaagtagactacttcatagtcaatttttcttagaatttagtatcttgcaaatgaatattgcacaaatagtgtcacatcatctgttgtatcgcaacgatgagacatttgtcacgcgcactgcctgagcgcctcgcaccaaacttgcgccagacattggcgtccatcctacagcatcatgatgcgcactaaggccgctactagcgccgcgctctaaatgccgtactatgcaccaaatagcatcctcgctgtactgggggactggacaaatcatgccgcgctagcacgcgccatgcaactcctaccatgcgccacagttgcaccggctgcatacccagtggtcactctggccgcacataccatcgaacatcggatgcgtgcaaaacgtcgaccaccacatgaatttcgagataccttgaaaggtataccggaatgaattcgcacataccacatgaattcacatgcatatttagccctttaaatggatcatccgatacatactgcgcttatgaaaaagttgcaatttgtgtctaatcgacactacgctcttcccaaaccaaccctgcaagatcatgcatgttggcatcagcatattaagaaaaacactaagtactggacgtccacaagaataggactaaaaatgtccactgcatcattattgaaattcccgccactggaacagacttgtagatccaaaggcagcgaattatcaatatttggactattcgaaatgtgttgtccacttaaaagaatactagtgttgacttgacacacgtacatactccacgaccatcagggctcccttagaaaaaattggaaatttttaacagaggtacgaacgtagcctaaattccttgacgataagaagcattatttcaggggagaaataacccttaaaatgataaatgtcaggaaaaatggtcaaatgaaaggatggatgcacatttaatcaagcattaaccgcactaactacaacactgaatgggcaacggcttgatctgtagtgtagcatgtcccagcaagaggtgccatggtatgtagttgataggtggtaatgtcactaaatccataatggctatgtcaataagtccgtattgggagccaagggaacttggctagaggttcggccacatctactagggacttggcgggtgaccattctgttgagcgtgttatacaaaggggtcttgtcacaattccttttcgaggtactgtggtggtattgaggcacatagtgacatgttgtggggttgtgtcttgtggataatttgtacacctcgggctagagtaaaactattcgaataatcatgcccacggttatgaacgggcctacatattttttccgtgattagtcccacactattcattaatgataataattgatggtgataatttgttagctcttgttatgaagtttagatatgtgaaactgggattggttgttcagagatggttgggcctgtgcagcattgatatgttgttaagtgctgattaattactatactattttactactctcaaatatttgctaaatgttgcttttgcaaatgaaccatatattatgacatactttattatccctgtccacttgcatatttgttatgtggcttgctaagttttccatgtactcatcttgtaataatcatcaacttcatttggagaaaaaaaggatccagaagaagaagacctttggcctagatcctagttaagctgcaagtggaagtggagttgaagtttcgctagattttcttttctgctgcagttttcttcattgtgaggactaagtgcctcttcagtaagtatttatcatattagtttatttagtattttatattcaaattgtcgatttgtgtacctcggttgatttctgaacgaggatttaatgcacaaattagtttgaaaattacttgtgaattttcgggtgtgacattcacgaatccaaactcgatgtcacgatgagggacataaaatgaactttttccttccaaaaaataggaaaaagtacacagaaggtccctcatcttgtcaccaaattacaaaatcgcttctcaaacgaaaaaccagatatatagcatcctcaacttacaaaaccggatcactttaggtccttaggcggttttgttctcggtgttgtccaacgtggtagctgagctagcgtagaacccacgtaagcctcacatgtcagcaacaacttcccctcgctcacctcctctcttcaagtgcatggccggcgtcctccccttcgaggagcacaaccgatgggggaggagtgtgggctaaggttggtggcgtggatgagtgagaaggccccgtcgtcgcactgctgaggcaccgcctcgccaccaatgtgaaggcgagctggatattgtaacgccgcgctttttgcgagacgttaaaaactaattcggcaaaaccctatctgtgaaaatttctttctttgagtgggagtctaagtcgtgccatggatatcaattcaaattccattgttccctctccttgacataaaaaaacaacctcatcaaattccctttccaaatcaagcttccgaaatcaaactccgacgtccaatctatcccttcgaatcctcgctaaacaacttgtctcgattccacaaaaatatccaaatttcccccttttgatctcttccaaatgcccaattcaatttcaaattccaaattccaatccaaatcctctccaaaccaaaccccttcggcaaaagtctaaaaatcctccctcttccctgtgggccaaatctcccccggcccattcctccctctgcccgtctccttcccccacctcgcgtgcctcacacttgcgccgctctgagcaagagaatgagcgctcgctctctctctctctctatctcttcctcctctctactctctcgcttcccggggaaatttaactatttgccactcttatgagtgccaactctccatatgccactattagatttggtataacatatctgccactagagagagattacgccctaattttttgccacttttgttgagttggagcaccacatcagcatgccagcatggaccagcctagtgaaatgacaattttacccctccattcgcaagtggttaatagccaacataatacaattaaattaactacacacatgaataaatgataaaacataataacttgagaacaactttgttctcaacacataacatactgcatcattaacacacatgcacaacaaaaatcaatttttatcctagaataacttcttcatcgttagaaatagtactaccaagttcataaccactatcaagttcagagttactgtgaaggccatacataacaagtttcatgccattacgcaaggccatacatcattacaaaagcacaataatagaaatagcaacatcaggccatacacttaagttcgttaggccatacacttaagatattcacaccacatagcaaaatatgccataccaaagtgcacatatcatcgcacatgacttgcaattagtttttccaaaatatcatgccatagtagaccacaaataaccaatttcactagcaggttgacaaatttcaatccaaaagtctaggtggtgttgcacttttcttcttgcttgcgagcttctttctgggtgtaagcttcttgggtggctccactatagctggagctacttgagagctttggtcaagctccaatgcgaacctcctggtgtttgtgatggtgtaaataataaaagaagtttagttcagtgcataataagtaatgaaagctagagaacaatgaaaagagcataatggtgcttacctccttgtgactggtccagggctgctgcttgtttgtgatggctgcacttgagagctttggtcaagctccaatgccaacctcctggtgtttgtgatggtgtaaataataaaagaagtttagttcagtgcataataagtaatgataagtaatgaaagccggagaaaaatgaaaagagcataatggtgcttacctcctagtgactggtccagggctgcttgtttgtgatggctgcacttgtgtttctgcagctccttctctagctgcaactgctcttgttcttggtgtagttacttgttcatcactaacaccctttgatttcttccttcccacctttgttgttgttttcttgttcctcttcctgccaaaagaaaaacagttagcatataacagcaagaaaatgaataataattgagatgaaaatgcagcacacctctttttgtgccagttagttcacatctagcacttcccttccagtgtccaaagacaccacattctgggcacttaatttgccttgtagccttccccttgcccttctcaagagcagatggcatcctattctttctttgcctacccacttttcttttcttggatgtcacacccggaaattcactagtaatttccgaacttatttgtgcataaaaccctcgtccaggaattagccgaggtacacaaactgataatttaatatacaaatccatcataataacatcattacatacttacaaaagaaaagaaaacagcagcggaattaacggtctagcgatggcttcagctccactcccacaggcagctaaactggagtataagccaaacgtcttatccttctggatcctttttcttcaactgaggttgattgattattgcaaggtgagcatatgacatactcaacaagccacacatcaaatatgcaagtgtacaaggataccaaaggatggcataatataggctcatttgcaaaagcagcatttagcaaatatttaagaatagtaaaacagtatagtaattaatcatcaattttaatcaacactgaacagcccacccatgctgctcaggcccaaccattctgaacaaccatacccggctgtacagatctaactccaaaccaggagctaagcaaattattaccagttatagcatcaataattattgtgagaggtgtgagactaatcacgaaaaacattgctcaacccgcctatgaccgcgggcacggctattcgaatagttttactctggccagagatgtaccactgtacccacaagacacagcctcaacatcatgtctaccatgcgtcgcgatactggaaagtacccgaatagaggctgtgacaataccctctgcacaacacaactcaccacagtgcaccatttctggatcataatcaccccctctaaaaatataactagaggcatggactccccagcgacccccacgaacttctcgccgcttctcagtctggtgccccgcaatgaatcatgctatacaaaaggtaaagccgttgcccacgctggcttgtggttggtacggttaatgtctcacaacagtggctcgcgaactggtccttaattgtcatgagcacgaccttcaaaaccatgtgctcacaacccaccattgtcaaattttaattatcaattaattatcataacacgattaaccatcgtgagctaccattaaacataaccataaataacaatgtagtataattcatcccattaatgagctcatgtttctaagcatggctaagcaattatatatatatagcttttagctaaaccaaaccaatatataaggttcaagctaatcaatttattacctaaggtatcaaggaatagggtattcaatgcaaattggccataacaaaggaataagttcacaccacccggtgacattcgaaaataaatgcacagttgaaataaatagagaatttaaataaaggataacatgctcaaaggattgtgtttgggatctgcgtgacttgccttacaataatcggtctttaattattcttcttgaacacttccgacgcactcacgaacctttgcaatgacgaaaacgacaagctaacacgcaaaacgatgaaaaaaactaataaaaaccaaataaacagtacataaaagtaaacgaacatgtagatcatgattttagatgaatttagagacttgaacggcttcattccgagttcatatcaattagttatgaattttacaagattaaattgattttagccttatacagaaaaggattaacgatgtcacgacgacatcactgccggcgatggagagagatggctagcgcggggagaggcggctagggcacgggaactcgagctaggggatggaaacgaaagaggagggcttggggttctatttatagggaaagctggaggagatcggctcggacccgagaggatttggcggcggattggttaaggttcgccggtttgggataaagtttatccggccgatttgaactcgaatcaaaggataaaatccaattccttaggagaaaaggaagaggaagataggaggaatatttcccctcaactaattggacatggggtcgctcaggtgcgacggatttggcggaaaatggcaccggatcgggaagaacaggggctctggacggctggctcgaggttgaagatgccactgtagcgatagggagatcaaacagacttccggctgggcttcttgatggccggattgaaggaaggatagaaactggacttcgggaaagagagggagatgggctgaggatgacagatagacttttctagtttcagcccgaaaaggaaaaggggaatttcaattacttttccaattaaattaatcactgaaatgatctttgaattggtaaaaatacttccaatgctcaaataatttcacgaaaaatcctgaaaatacttggacactcaaagtacttaacaatattataatcagaccatttaatgattaatttaatatgtggataattactaaaaggttgtttgtattattaaaattaagaattgagctccgaaaaatcaaagaaaattccagagagtataattaactatggcgaatgtcatgcccagaaattcacgaactagaatttctacgataaatgtgcattaaatccctgtccaggaccagccaaggtacacaaacgacaattattaacatacagatctacatcttacaaaaatataaaagattacaaatgcagcggaaagatcgaacgagctagacttggacgcttgacttttacagcggggcgactccacaccacaggcaatccttgacggcagcgacgaaaccaacttcgacaagacacctcccactaggaagatcttcagctctggtgtggggggaaagagagtaagactgagtactacccactgtactcagcaagtcataccggaagaggaggtatgatgcaggatataactaaaggaggctaagggttcatttgcataaagcaggcatttaaaagcagaagtggaaagcagtaaaacagttgtagtaattaatcaatattaaccaatcactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccgcataaccctcccctaaccatccacaccatgctaaggtttcacccccacccccaacgggcagtgggcggtcccttcttgcaccgcggtgaatccggcagctggacaatcggacaccctggccgacccaactccatcacgcccaccctccccaccggtgcctaggaaagggtcgagctatacttcagatcaagcagttacccactcccgcttgtggtaagcacgataagtctcccagggttttccgtgaaccggtccttaactgccatgggtgtttcagtgtattttaattaactaacaccattgcggtggtacaaatccaaagctatgctaatagtcaaaatctatgtaataatgtgatccccatttgtgtactagttaaactaagtatggctaagcatttcctaaaccaacatctaatcattttgatacccaagttatcaatggcatacggtaaacaatatatggctgagtaaggggacccctcccacatgacattgtaaaagaatgcaacatttaatagaaatacgggatatttgtaaattgggtacaatatgatcaattgtaatgcatgacttgccttgctctcgcactgatgagacctcagcaaacgtcttcgagaaaccgtggatcgacgaaaccgccgaaatctacgcgacaaacaaagcacacaagcaaaacatgctataagactactgaaacaggaaacaaaaccatttttaatggattctagggatttttatgaatttactgacacttgaatggacttaaacggagctcggatgaattagttatgaattttagaagataaactgtgtttttcctaataaagaaacagtccttaattaatttattgcgcaatattgcccagggctgacatcagcgaaagggggaggaggtggcaccggctagtggtggccccactgggcagtggctcaaggggaggggcagacgcccggtcggcttggctcggcttcaaaccggtcggccggtgaggcgatgcggcggcggcaatcggccaccgacggcggcgaccggcgagaagacgacggcggccggtgacgcggcggtgcgacggcgaagcgccgaacggcgacggcggcgcggctcggcgctaggagggagaggaaggggaaaaacagggaagggggtgcctcaccggggttcggccggcgcgggaggaagtgacgacgaacggcgacggcgagcgaccggagagcgacggcgaatggcgaccgagctccgggacaccctaagagaggaaaagagagaggttagagtgagagagggagtccacggcgagcgaaagcatagccgaaggcggcggtaatggtggaacctcacaagagcgcggggagaagtgggctccggtggcggaactcgacggaggggaggtggacgaggtggacctcggccgcgcgaacccgacggcggcggcactagcggctgctagaggcggccggagtagtggaagaggcggcggcggcgggtgggtgtacggtgcgggagcggtggagagctctggagaggccggcgagtgagggaaacgagagaggggttgtggcgaagctttatactggctcgggaggggcggacacgaccgggaaacccccccgatttggccagtgacatggtggagtggggagagagagttggggacgggattcaaatcgaatcccgcccatttttgggcgcgcgcgagagcgggaagtggtgggggaggggcggcgacatgggcgcaggtcgcggagtggggcggagtgggcgcgggagacacggacggcgacgtgggagcggcggttgccggccaggcgcagtcggctggaggaaggggatgaccccgataggtgggccccacctgtcggcgtccccgagaggaggaagggcggcgcggtttgggccacggcctcgggccggcccagcaaggagggcgcgcgggagggaggttgggccgacggcccaacaaagaaaaagaagggaatgaaatggagaaaaaggaaaaagattttcctgggattaaatattgtggttaatgaattttaattggttaaaattacttatagggctctgaaaattccactaaaaatcctattaatcaattgtgacatgtggaacccaagaaaaatcccacaatgccattttcaattattgaatgcatttattaattagggaattagctctaggttaattaaacaatttcttcgggcaatttgtttaaccattttttcaaaagcaagaaaaagagggaaacttcagggcatggcaaacctaccccccttaaacggaatctcgaccccgagattcggaagagctggcgaagaggtgcggatgggcggccttcaattcatcttctctttcccaagtggcctcttcctctgagtggtggctccactgaactttgcagaatctgattaccttgtttctggtccttatctcgttggtttcaaggatacggtcggcttctccacatacgtcagatcttcctgaatttcgatgtgatccggacttgcctgttcctcaggaactctcaaacatttcttcaactgagagacgtggaacacattatgaatgccaagcatgttggaggggagctcaagctggtaagcaacttcacccctgcgttccgaaatccgatatggtcccacaaagcgtggtgccaactttcctttggtttggaagcgatgtactcccttgagcggagtgacacggagatacacataatcccctgcttcgaaaacgagctcccttcggcggttgtctgcatagcttttctgtcgagattgcgcgattctcaatctttccctgacagctctgactttctcttctacctcatttaaaacttaaataccaaacaactagcgttcccctgtctaatcctagaagagcggagtacgacacctccgtccatacagtgcttcaaacggtgccatttgcagactagcctggtatctgttgttgtaagagaactcggcatatggcaagcttttgtcccatgctccaccaaagtcaagcacataggctctcaacatatcctccaatatttgattaacttgctcagtctggccatcagtttgcggatggaaggctatgctgaagttcagacgggttcccaattcttcttgcaatttctgccagaactttgaagtgaattggctccctcattcagacacgatcttcttaggtaccccatgtagacacataattcttgccaaataaagctccactaacttcttccctgagtaggtagtatgcaccggaatgaagtgagccactttggtgagccgatcaacgactacccaaatagaatcgtgccccgatgacgtcctgggcaaacccgtaatgaaatccattccgatttcttcccatttccattctggaatctgaaggggttgtagcaaacctgctggcctttggtgctctgcctttactcgctgacagacatcacagagtgcgacaaattcagctatttcccttctcatactgacccaccagaatttttctttaaggtcttggtacattttagtactgccgggatgaattgaatattgagtttgatgagcctctgtgagtatcaggtcttttaattccttgttttcaggtacacacaatctttctcccatccagattgttccttgttcgtcctcaacaaaacctcaggcttttccaactctcatgttcttttcgagctctgctatttcaggatcacttgtttgagctatgcgaacctgctccaccagtgtgggttgtgcctctagggcagccacgaatccgtgctcaactataccaaggtttagatgttccaaatcacgttgaacctcacagcatagttcctctacccatgcgacgttgcagtaactcttcctgctcaaggcatttacaaccacattagccttgccgggatggtagtgtattcctatatcataatctttgattagctccaaccatcttcgctgtcggagattcagatcaggttgagtgaatatgtactttagacttttgtggtccgtatatacctcacaatgattaccaatgagatagtgccgccagatctttaaagcatgaacaactgcggccaattccagatcatgggtcgggtagttgccttcatgaggatgcaactaacgtgaagcataagcaaccactttgccatcttgcatcaacacacaccccatcccttggcagaatgcatcccaatatacctggaaatctttcgcctgatctggcaaaattaaaactggtgtagataccaaccgtcgcttgagttcttcaaaacttctattgcattcagcagactagacaaacttttcttccttcttcaatagctgtgtcattggcttcgcaattttagagaagttctcaatgaaccggcggtaatagcccgctagccttagaaaactccgaatctgagtgactgtctttggtggggtccacttggtgactgactccacatttgctggatccacagctaccccttgagcattcacgatgtgaccgagaaactgaacttccttaagccagaagtcacacttgctgaacttggcatatagctggtgctcttttaacttttcaagtaccaaccgaagatgctactcatgttcttcctcggacttggagtaaatcagtatatcgtcgatgaaaaccacgacaaacttgtccagaaatttcataaacaccttgttcatcaaattcatgaagaaggcaggtgcactagtgggtccgaaagacataactgtgcattcgaacaacccataacgagtgatgaatgctatctttggaatatcctcttcacggatcctcaactggtgatagcctgatcgcaggtctatcttatagaacacagtagctcctttcaactgatcaaacagatcatcgatccttggcaaagggtacttgttcttaatagtaacctcattgagtgcgcggtagtcgacacacatcctcttggttttgtctttcttttccacaaaaattaccggagcaccccaaggcgacgtgctcgggcgaatgtatcccttcggtagctgttcatcaacttgcttcttgacttctgccaactcgttggctcccattctgtacggcctcttatggatcggtgcagttcccggtgccaagtcaattcggaactcgatatccctttttggtggcattgtggtcagatcctccggaaaaacctctggatactctctgactatgggaatatcctccaacttcttagtggttttctccactgctacctcttgttcttcacctgtggcctggttcagactgatccctggcttctacggtactggagactagaaggttaccacttctcccttcgcactggtcaacttaatggtgcggctagcgcaatcaatcactcctctgtgccttgtcagccaatccattccaagtatgacatctaggtccttggattcgagaagaatgaggttggctggaaaaatcaccacttgaatttcaactgtcgctgatgggcagtagtgagttgtggtcatgccacctccaggagtatgaactcgcattggtatcttaagcttcactaaagataacccatgtgcaccagcaaaacgcttggaaatgaaggaatgagttacaccagaatcaaacaatattactgccggtgtcgagttgacgggaaatgtgcccaatataacctctggtgctcactgcgcctcctctacagatgcatgattgacacgggcctgaatgaacttgagtccggcatgtcttggcttcgggcacgtaccaaccatgtgtccgggctcgttacaattgaagcagagttcgggcctttctccaaactccttgggctgttctggctgggctggcagagctggctgaactgattgagctggaatcattagtggacttggagtcggattgaggctgtgctgctcactgttgctgtgactgccactgttgttgataccgttgaaatttcccaggtggtaaggacgatgctgccggataatcatggtggaaggtccaccctaatgtcccatcatgaagcgaggcttctgactgatcccctgggaagtactgagctgagctgccttcctcttacggttcattttgttgcactgctcctcttgacggatagccttgtccaccagcttctcaaagtcctcataatccttggagatcagctggttggtcaattcatcatcaagaccaaacaaaaacttctcctgcctctcggcatcagtgcgcacgtcctcaggagcgtagcgcgcgaggcggttgaactcatgcagatactctataactgttctggttccttgttgcagagaacggaactctctcttcttttgtgctatgattccctcgggaacctgtgccttattaaaactctgacaaaactctgaccaagtaacttccgtcctagctggacgggtcaccatgtagttgtcccaccaaacagaagcgggaccttgcagctggtgtgtagcaaaagcaaccttctcctgatcgttgcattgcaaaagattcaacttcttctcaatcgcatggagccaatcgttggcctcgattgggttggtggtgcttgagaaagtgggtggcttgatacggagaaactctagcagtttggactgggatggtggaagaccaaaccgcaggttctgctgctgctgctgctgtgcttgttgctgcacctgttgcaacacctgatggtaccgttgctacatctgttgcatcatcattgtcatcatctgagtctgattgtccaacacctgagtgatcgttgggttctcatgcggtggagatgaattgtcgttagatgtatcgctggcacgtgctaaactgatatgctcttcactgccactgacgttggtgaagtcacgagaaccattccttgtcttcaccatctaaagggggataggtagaaatatgagaaatggaggaaaaacagggggcttagaaactaatctttcttataaattaaagtgcaattatctttatcttcattaaaacactgaaaaggaagcaaacaacttctaattgaggcagccataccactgacatatgatatcgaccgccgactaacccataagcaacaaacctaagcacggaaactagcaagcaaacaaaactaagaagacgataaagctaagggcggcgactctgaagctcggagcagtgcttgcgatcgagggataggactgatatctaaagtaggcaagggataggaatcaatgcatgctcaaatccaaattaaacaaagcaacaaaagactcaaaagaataaccaagcatgatgatttttatgcatagaacatttttcatgaacccagatatagacactaatgcaactgactaaacaataaattaatgcataaaatagatgcatagttaaaatgatgcgcataaaattgccccatcaaacatagacacgacttagtgcatatcacccaatagattcccgactgactatcgaataaactccaaataaaatttcactaaaaccctagactgtccctagtcgagaaatccaattaaagtagcgattaaaatatctcccaaaaatcacagaactaacaccaaaggaataagttcacaccacacggtgacattggaaaataaatgcacagttgaaataaatagagaatttaaatatatgatcaatatgctcaaaggattgtgtttgggatctgcgtgacttggcttgcaataatcggtcttcaattaatcttcttgaacacttccgacgcactcacgaaccttcgcaacgacagaaacgacaagctaacacgcaaaatgatgaaaaaaactaataaaaaccaaataaacagtacataaaagtaaacaaacatgtagatcatgattttagatgaatttagagatttaaacggcctcattccgagttcatatgaattagttatgaattttacaagattaaactgattttagccttatacagaaaaggattatcgatgtcatgacgacatcactgccggcgatggagagagatggctagcgcggggagaggcggctagggcacgggaactcgagctaggggatggaaacgaaagaggagggcttggaggttctatttataggcaaagctggaggaagatcggctcggacccgagaggatttggcggcggattagttaaggttcgccggtttgggataaagtttatccggccgatttgaactcgaatcaaagggataaaatccaattccttaggagaaaagcaagaggaagataggtggaatatttcccctcaactaattggacatggggtcgctcaggtgcgatggacatgcggaaaatggcgccggatcgggaagaacaggggctctggatggctggctggaggttgaagatgccactgtagcgacagggaggacaaacagacttccggctgggcttcttcttgatggccggattgaaggaaggatagaaactggacttcgggaaagagagggagatgggctgaggatgacagatagacttttccagtttcagcccgaaaaggaaaaggggaattttaattaattttccaattaaattaatcactaaaatgatctttgaattgttaaaaatacttccaatgctcaaataatttcaagaaaaatcctgaaaatacttggacactcaaagtacttaacaatattataatcagaccatttaatgattaatttaatatgtggataattactaaaaggttctttgtattattaaaattaagaattgagctccgaaaaatcaaaaaaaaaaatccagagagtataattaactatggcgaatttaataaaaattaaatccagccatactttatatttaggaaattttatttcccacatttaactttacttgtaaattaatgaacatttaatataaattctaataataatttattaaataatttataaatcctaaaacgaaaatcaagatatgacattggacacaggagcaagaagcttgaattctttctcaacttgaggccattgcttcttgtctgtaatgttagggatggttgatgcatatgctgcttgaaatctgagcacagagaaagccttatcaacatatttctccatatttggttgcctcacggttgtgattactgccaatgcatgttggcaaggtttctcagtaacttgccattccctgcaggtgcaagtgcacttgtcaaggtgcaccacatgccttgttagctcctcatcattatgtatctctgtaacctcagcttggtaaggatcacccttagtgacctttagatggcctaacccctttgaggctgcattcaactggtgaatcaccacaggaagaatcactccattgagggctgtagagatcctactcttctaaaaaagaatcaaggttttctccctaattgcatcagcaagagcatcgattggcaagtccttcaaacctttgatccaagcattccatgactctgccatgttattgttgatatattcacacttgctctgacatgaaaacttgtttctagcccacagtaggttgtgatgttcgtcaagccatggcttgacatctgagctatattcaaacacttcatccatccacatttgatgcttctgaagcatgtatgtcctagctgcaggccacatctttttcccatactagtagcatgtccgtggtaacgctacggtaatatttatattaagcaaccaaaagacaatatataaaatgagattaattttaagaaataaaaaaatgccagatcaagagaagtataacaccagcgttcaaatccaagttctctttgctactcttatatacataatgaaaattttcatctcgcagcagtcatggttccttggcgacgcggattgactaaataataagaaaatggatgcacaaagactaaatgaatcctttccaagatcaggtgttggcttatctgaaactgaaatcatgtaaccaagagatgtgaactggaattgtcttctgtatgccattattaaaaaaagaaaagaaaattgttgatgtccagctaaacacatatattgccaacagctgctgaacatccatgaaagctttttcctcagactttgtgtaatatcagtatcacaaagaaaaagatgcatggggttgtagtgttatatggaaaaatacagcatcaaatctattgtagctagatcagccaccctcctacatgaaaatacacttttatattcgcatggatgacttgtacatatttgaaaggttatctaacctgcggagatatttcaggacagtaaagtatagcatttgtagataaacattccatgtattgtgagattagtgtttcagttatctaatgaaatcagagagattcaaacaaaagacctgccaccggtagttgcaaacagatgtaaaaggattatccgtaaaagaaaaggtaggcaagtagtaattacagtcactttatgatattcaaatctacccagaaatctgtaatgacagaactatttcctaaaaatgatcagtaggctgcatctgtacactttgtaagtcaatctcaaattgtcctgagcaatttatacttgttagacaaatggttcatgaggaattgaggcaccaacagcagatgaatcgcaaactcagcatagcaacagcagcagaggaagccaaacagttgtccatcccatgcagtggaatgaaatgcccacatgaacaacgtttccatgttaatctatttttgtatgtcctagtatgatcgatcactgttgtcattctttcaactcctaaccaacaaaaaaaaaatatagaactgtagctaacataaaagatcaggtgatagagaaaataaaagacttccgctctctgcatatatgttacattgtagcatacaccaaaacacaaatcagaaaattcttactaaacagtaagattttcttgtatgcttcacttttctagagtaaaatattagaagtacatcaacaaacatcactaatcccatgcagatttctgtttcaagtaacatggatattt

SEQ ID NO: 38807 - DNA, 1415 bp, Oryza sativa
  unsure (1)..(1415): unsure at all n locations
gcagatccatattcaaggtgtgaagtcatccgtacacggtggccggacgtggtcgtcagtaattctaggtgtgaagtcattcgtacaagcgtgcaggatcaccgccgccaatgtcccctcagaggatatcctctccctacaacgccggacgcgcggaccgcagagtatcagccgccggggcgcgaggagccgaggaggatctccgttgcctagatcataggcggtcacgcagagtcgcggatgattgatggcgtggctcgaggtggcggcggcgtggatcgaggaggcggctgcggttgaggggagcgaccgagaggagggtgagagagagagagagagagagagagagagaggggagaggggtgcgtacggaggggagacgtgggacgatctcgagccattggattcgatgattctggatcgtcggatttgatgaatgaggagtgtaggagtgtagttggtgaattatagggtagatatgttcccatgaaacaatttattcatattctccatcaagtgcctaaagcactctctttgttcagcccatgggaaaactttttttacagcagtttctaggcctttgcaagcatcagtatgcacaactaaattctctactggccctattgcattacctaattgctccatgaaccaaacccaattatctttggtctctgaatcaaaaagaccaaaagccaatggaaacatccaattatgcccatctattgcattggctgcaggcatgtgtccattccacattccattgagagcagtagaatctatactaatgtatggcctacagccctctaagaatccatctatgcaagctttgaaagcacaaaagaatctgttaaagtgaaccttatctccaactctaactatgtcaatctcaactacactaccaggggatctcatttctatctcagccttgaacctatacaaccaatcaaatgaatcatcaaactttccaaataacttatctttagccctctgcaaaccataccacgttgtctgatagcctatggtggtcttgtatgtctcctgtagcttaccttgaagttcctttgcacccatgtctttcttcttcttcaaaaatggaatagccctttcagccaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngg

SEQ ID NO: 38808 - DNA, 620 bp, Oryza sativa
caagcctaaggaggatgcaaatgcttatttgcagcaattcctgttaagttgtagcacgtataccgtcaaaggactcagactccaactgttgtcgttctccctcctcgggagagcaaaatagtggttctacatcaccgtgcaacggtgaaaacccggaataagcactcaacggcattcctctcatgattcttcccgatgggcaagaccaacgctcttcatggaagaatatttggtttgcagcgaacgagggatgaaaccattcttgaagcttgggaaaggctgcaggaatgcgtcaccgcccgtcctcatcatgggatggacgagtggctcatcctgcagaatttcttcagcggattaacaacggattaacactctcgtcctgggatcaactggacgctgctgctggaggagcacccttctcaaagatggtcagagataccactgatctgattgagaagaggctctcaaatatgggttggagcgagaaacaacataaacccgtcaatgcggtatgcacaccgtcaatgagacggaaatgcttgccgcccagttggatctccttatgaagagactggacaacaatgagaaggacgccaagcggggtaccattaaggccctgg

SEQ ID NO: 38809 - DNA, 16825 bp, Oryza sativa
cctggagatactcgttggagctctcactataagacactgaagagtttggttcaattgttccctacaactgttaaagttctagagtatgtggaagagaatgacagggatgacaaaaatagtaggcaagcagctggcctccttgtttattttcagttatttcagtttgtgttttatttgcagcttatgttgaatatcttggcaatcacaaacaccttttccgtaactttacaaagaaaggatcaagacattgtcaatgctgttaattgtgtaaaatcaactagaaatcacttggatgagtttaggaggagtggttgggaatctattttagctgaggtgcataacttttgtgagaagtatgacatttcagaattggagatggaggatgcatacataaatccaaagaggccacgccaaaaaactgggattacaaacaagcatcattttgaagttgattgttttaacgaaattgttgattggttgcttcaagaattggacaatcgctttaatgagaaaacatctcagttactcatatgtgcagctgccttaagtcctaggcaatcatttcatgatttcaatttagagcatttgatgagtttagcaaaactttatccaaaggattttgatgatggggaactaatggatcttagacatcatctttctctttatatcgctgatgtgcgtggagatgatagattcgctaacattgaaactatatgtcagctttcccaaaaaatggtggacacaagaaaacatatttgctatccattggtttaccggcttttaaagctagcattggttttgcctgttgccactgctacagttgaaagatgtttttcagccatgaaaattgtgaagacgtatttgcgcaatcgcattagtgatgaacacttgagtgattgtgttatttgctatgttgagaaacaagaattgatgaaagttaccaacagtgcagtaattcaccgatttgagaccttaaaggcacgtttacatgatgtttttactaagtgatctcttctcttttctaggcaaaacaatatgtggttttggaggtttttatccttttttgctcgttttgtgatggtggatcaatatttcagtaagcacttcattcctatgactttataactctgtgtggcacttaattatattactctatgtgtcatattggttattaatattgtgtgttgtctagagctatgatatgcataggaccccgggtcatttttgttctgggttcaccactgatcctcgcctttggccatgtagcgatgcctgccttgggacgaaggcgaggcatatcatcacctactcgacatgatttttgatgagcaggaagtaatcgagctatacagctatacacatcctcttgcttgcttgccttctcctatgctgctacattggtgtgtttgttgtactgctgctcgactctgccgaggctgacccgtggagcattgtgggggttggccggattgccgggctgggttcgtggattgcatcctcggagaccgccgccatcacgcatgcggatacgccgaggtcgaggtcgatggcgatggggactgccgcgtcagccatcgccgccgccgccgctccggctcccgcttgccgtcgccgcccttgcctgcagattacgctacgagagagaaggtgaagagaaaggggggagataaagagagagaacggggagagagggagggggaaggagagagaatgacatgtaggcccacatgtcagtggggcccacaatactttttatgtgtgaatcacatgtgggtccatagttttttttaattctaatgccacgtaagcgccacgtgggacgaaaattaggtcaacattgccacgtcaacgtcacatcagcaaaaccaccctccaaaaccaaattgcactggtttcaatagtttagggagtcattctatccggttttgcggttgagggtcacatattagattcgggttacttttaagggagtcaaagtggacttattccttaaccgaaggcacaatttcgcatgggccgggattgtttcctcgccaggatgatccacggggattgggccccgatcccggccattcccggcccaaccgaacaaggtctaatgagtattgggctacaaacgttcttatttgttcatatctttcacggtacggaaggacgaagtactagcggatagttttaatcaaccaagtatacatggtgacacgctttttaaatggctaaatggtgtgcttcgtgtgaaaacttattatatgaaagttgttctaaaatatcagattaatccatttttcaagtttgtaataattaaaactcaattaaccatacgttattaacacctcattttacgtgaaacacttaatcttcatcttcagtacattcaaacaccaccatagtatcagcagaataaagatatgatcagtttacaacagtggaaaaccaaatcctagataaaactcttcctcacccttttgtctacggatcaggagcaaaggaggaggaaccaatgaggaaccgagagccaacctggcgatgatcaccgattcaccgctctcaccagtccacgttcgtcttgataacggccgcagagatctttggaaaaccatggataggagcgccatcctttgcttcgcggctacggctagctgccctaggtgaaacacgaaaaaacaccatggatgggagcgccatcctttgctcactcatatctatttatgagtgagttgagtattgaatacgagaactcggacttgaaatcatacacccattgccattgcactatactaatcgagcactttctattagctttattgtgttaataaaaaatatctaacctttgattaaaagttgtgtggtcttttgaagcctaaccgatcttgcgtacatttgggctatcttttttcgaacgcgcaaaagaattgcacgtcaatatattagaagaagagagcagagtttgattacacaacgcacacagtcaaaaggccgttgacaggggtcaaggaaaaaaaagaaaaaaaaacaaatataaggaagataagctactaagaaagaaacaaaaactcctatcacaaggaagggtggggtagggggtcccactacactccggcctgcaccggaggcagggagctggagaagagcgaagacagggccatggcgtgatccgagggaggggctgcacgcatgaggtcgagtcattcggggccgcaatcctcttgctacgcttcggcactacccccacggtggcaacaacaggcgccggaggcaggggtagcggggccagacttggaggcatagacctggagcatttggcaaggaaggtgcgcaacgtggcattctcgacgaccgaaaacgggagctgcgccatcggccgaccatcatgatctagggcgaccatcggaacgtcgaacagaaccgtatcccccgtgaccaagggaatagtcggtggcaagggcaaggttgacggtggccgagagtagccgaccagtgggacctggcttgagagaggaggtgaccccgccacggccagcgccccgtggcggctacccgtcttgacggtgccttcaggcagggatggggtggggagagccgagcagccggtgctgtccctactactggcacaatcaaatcgtcggcgtccaatggggagggtgaaactgcgaccgcctccaccaacctcgatgatgggagcagggttttaaatttcaaaatcagcagttctgccgcagctgagcgatagaaccaaaatttcggaaaaaattttgtatgattttttttgaatttttgacggattttgaataaatttgaataaaaattgaccaaattcacaaaaaattgcaaaaaaccaaaattttcgggcgagatgttagcatttcggtgggggtggggggggcgaaatttccgaagaacagaaatttcaaacactggatgggagagatcgcggcggcatgggcgatgacacgcatcctggcgaggacagggccggcaaaggcgagggcgcacagattgcagcagtcggcggagacaggggcgcacataccgcagcggctaccactggcctcgacaaggagagggctagtggcatcggctacggaggagagcgaggcggcggcggcggcaagaccacgtcaagcgccaccaccgacctcggtgatgggagagatcgtggcggcggcggcgacgtgcaaggcgcacagatagaccaaggcgaggagaggcccggccacgccagcggcggcagcaacatgcacggcgcatagaccgcagcggccaccaccaccggcctagacgaggctggaggcgttggagagcacaacggtagtggtgatgcgcggggtagcacaggaggtggcccactgcggagcttggccggcggcgaagtctcgggtggcaacaaggggcctaatgacggccgaggtggcaaagacaacggcggtgcgccgctggtggcgtcactatcttgccggtggagcagacggccgcggcgatcgataagcttgtctgtgagccagtagtggtggccgacgagccagcggcggcgacgaacgagccggtggtgaaagggacagtggcggccaacgagcccacggtgagggaaggcatcgtgtcaccaacgcggcttgtcggaccggagagaggagacgacctagagaggggggcagcccatgggagagaggggacggccacgggggagaggccctcgaaccgaagcatccagaaggaaggggtagatggggaaaattaatatgtgttcgtttggctggggcacgggttgggttctgcactgtgggctgtgttacctcatcagtaacttgatccagttaaaccacacaaccaggggtgcttgcactatgggatgggtgtctttgggccaagtttttggactaggggtacgggctccatggcttacactgtgagtgccctcaaccgcttcctgctgatcatgcaccatctatcgctgcgtggcatctatctacccgcacgacacgacgcataaaagcatagctccacgtaaccatagtaaaaaaccggactgaatgggcggttgaaccggaaaaaaccagaaccggccaccttgacggttcggttcaactaaaagaccgcccctgcaatcgatccggtaaaaaaccggccggtttttgcttgaaccggtgaaccggtggcgggttttaagtatcgaacccgtttttatttttcctattgcagtatgacgtgatgaatatattatgttaccacaccatatttattttttttatgttgtgaccatgtaataaaagatatactggtttatttatgcatattttcaccaatttgtgatggttctatattaaaaataatacaaatcaaatatctctactacttaaaaaatgatgtttcctccgtccgtcaaaacaaaaaaagtagcgaaaaaaagtccgactcctaccgattccctattagaaatggaaaaaaaagtccgactctagatccgattcacccttaaaaacgaaaaataaaattgatgtgccggattgaagatctgtttgcaaaaacggaacctaccggttgagagcattccatttttatatgattttaatttttggatctatacttttgcatttgagtccctgtaatttttatatttacatttaagtccctataatcttgcaataagatacttgaggtcgtttttggttaaaaataataaaagggaaagaacaaaggcagaaagctgcataaaaagaaaaagaaaaaccgaacaaaaaagaaaataaagaaaaagaaaaaaaaacaacaacaacaaaactccgtttctcctaagtggcgaaaaaaccgtagatctgatcctataaaaaacaaaagaaaagtgaaaaaaatgctagatctgattcatttagaaacagaaaaaagtctaattcctataaaggcgaaaaaaattcaaaaaaacatctaaaaagttcgaccggttctctaggaagaaaaaaatggtttgcataaaataaaaatacgcgtgaggaaaaaatggaaggggtgaaacaacttccgatttctaaccaatatatatctcttcgctatgtataatctaatctaactatttaaaaggataaaatgcacgacaaaataaaaacggttcaaagaaacgtgtgagaaaaatcagaaaaaagcgcaaaaaaatcacgctaaaaaggttttccatcttccataaaaaataaaaaaacacgcgagaaaaaatatttccatcatcggtaaattttttttagaaaaacatgtgaggaaaaactatcagaaaaaacgcgtcatttctaaaaaatggtttgaaaaaatcgtgtaaaaacatcatctattaaaaaaaacaaatcggtccgaaaaaactgtcagaaaaaacgctaaattgatggacacttgagccagatatgatccatcgattttttatcatctactacacggcttttatttcgttatatattctcctgtattggaaaaagcaaaaaagaacattcgaaaaaacaagcaaaaaacgcgcgagaaaataattgtcagaaaaaacatgcaaaaaacacacgagaaaagaaaagaaaaaaaaagagaaaaatatggttttcatcgtcagtaaaaaaagcaaatgaatatgctaggaaaaaagtgttagaaagaaatgcgccatgtttgaaaaatggtttgagaaaatcgcgcaagagaaaaaaacattgtttataaaaaaacatgttgcttattaaaatacaaacattgtcattgacatgattatgcatgtaaaacgtatattatcattagaatttttttcacccgttgcaatgcacagacatttttgctagtaatattaataaataaaaaaccggcggttcgactggtgacccggcggtcagagcgggtcgaccccggtccggtttttttaccatgcacgtaacacgccaccgcacctccttcatggtcatgggctccaccaacaccgggttgggttgacgacccggcgcctttggcatgcagccgccctggttgggttgacgtacaggagcacgaacgagatttgcgtggagggtggcttcaggctgcagattgacacgagtgtaacccccggatcggacagcaaagcttatactactccctccgtattttaatgtatgaatgatgccgttgagttttttaccaacgtttgaccattcgttttatttaaaatttttataaaaatatgaaaatatttatgtcatttttaaagaatatttgatgattaatcaagtcacaataaaataaaataaatgataattttataaattttttaaataaaacaaatgatcaagcattggacgaaaagtcaacggcgtcatacattaaaattggagctagtaatatacaagtcgaccattagcttcaaaaattaaaattagttgtacacaataattaatatttaatctatctcacataatttatttatcggagtctaatccagtgctacatctggctactaacctgtttttttttctctcatctcattcttcctctacataagcacaaatacgatgtgacaacttgtataatccgttcatttcattctattgcagtcgctctaatacacatagcacagaggatttttttaggaaaacttagattatattaatgctagaaatagagaacatatttaattgcacggttgttggaagtgaagtcactggaaccgagattttgggcaccacgatttccttttaatttttggactggtatagggttagggtatcttggagcacaaatctactaaagaaaaaagaaaagagagagcacgcgctgggggagccattttgttctggagctaaaatatgcgctattaaattgttggtgctttaaaactagtatttaactaggtgaaaccccacgcattgctgcaggaatttagtatgataaaaaaagataacgtataatatagctagataacatcagattaagtaaactgatgtggtttatgataatttaaattcaaatagtatgtagaatgatgattcaaacgtaaaaagtaagctggtatgactttacagaagaagaaaagtagggagatagtttggaccgtagattaatcatctaaaggctaaaaacaattgatgtgatatgacttagttagaggaaaaaatgagaaaaataatttgaaccatagattaatcatttaagcactaactaagtgaggatgaactatataataaagatatacattaaaacattatgtgaattatgttggatgataatttaacatgtttgtatttgaaaagctcttaaattataataactataaagatatagcatgtttgcatgatgtttaaatgtgatgattgttagtggatgatgatgtggtatcttgttaattagtggattagtggatgatgatgtggcatcttgttagtggatgatgatgtggcatcttgttagtggatgatgatgtgacatctttgcatgtcaagcttaaggagttagtgggggatgactttatagtaagataggatttgctaccaaaatataccaacaacacatataaattgtgaaagaaattaattgacactaccaaagcttgcttaggattttgtacttgtcaaaatttagcattgaagaaaaccaaatatagcctagctatagtggccaactggccagtgggtgagattgaggaggttgaagatggtaaacaatatcagggtggtgtttggtgctttgattagttgattcacgtgcgctagtatatggggtggcgcgtcgtcttcggctaggacacggcggtgttgactcctcccggcttagaggcggcggatccggcgccgcccccgccagatctggccggagagcgtagatggaggggtggccggcggctgtggacgctggcgctcgcggaggtgcggccgcggcggtggaggccggctctcgcggaggcgcggccacggcggtggaggccggcgctcgcggaggcacggccggcagcgggggaggccgtgtttcgcggaggcgcggctgcggttgtggacgccggcgctcgcggaggtgccagggtcatcagcttcaagtgattgagctgatatactgcatactgagattctgcggactaaagatagtatattctttcatcatacaatttatcgagcttcatttatttggctaatatttcttatggaacacacgccgccgcatcctcgctggaaatcctccctgcgtggactgccgccgccggagtcgctgattcttccccgccatcggagccaccgcggccggttccgacctcggccccatctgctggccgattccgacctcggccccatccgccggcgccggcgccgaggtccaccgccgcggccggagctgactttccgcctctgtgacttgcactttgaaagtacatatttccccccaattcctaactttccatcacatcacatcacattcaaaactttcctacatacataaattttcaacttttttttccaaactatcaactttccccaaacttctccccaatttcagaaactaaacacagccatattcttgtgaagagaactataaatgattgtgcgccaccctcttaggtaggtaaaaagttattatgcaacagacaacagaagtatggttacgcgcttctgattgggaatttttattattttttgaactttttaaaatattaaatttaaaaataaaccatctcgatacttatttctaaaccttaaccttcttgtccactccgcctcgcctcacttggctatacaatagtcacaccatacacacttgcgcgtggcaaaaatggttcatattcgaaattaagttttgggaaggtttatttttaaaactaaaaatgaaaaggttcaaaaaattaaaataatatatctctgattggtcatatattacatttttatctgttggacctcatatttctaacgagcacagaacctttcagtatgattagatcaattccctgttatactaccttggagttgtatgcttgtgtcatgctcaaacagctcgactattcagcccatccaattttcaaatgatcataacgacttattgtcgcagggtagagacatacaaagaacaaaaaataattttgtttttaaaatagctcaaaagaatatttagtgaaattttatcggggtgaatatgttgggatcatgagttcccaatcacaaattctctggccgcaccaagtgtgccccttttcgatcaatcactggttctgtgtgttttacgtgacattgcaggaaaatgcaatgatattttagtacttttatatgtcgaaaacgtatattacacgtgcacgattactagtagaagaaaaagaaaaggaaaggccggtagcggccagctaagaccaagaggaggaggagtggaggccgccgaggaagagggtggcctcggagcggacgggcatccggcggctgcgagcttgcggccggcatatccagcgagggaggcgattgcgacgaatcgggaggcgcctgatatggtggggcttcctgttccttcgtcaccgcagatggtcggccgagctcgggacgactcgaccgctatgccgagagacatggtcgacagccatgcatgccgagatatgcatgcagctcatgcaagcaagcagatcgctcacgctcaggcagggcctcttatctctggctcggttgagctgagcaagcggctaccaattcaaacagaaaccaaaccaaaacaatccaaaaagacaggcatacaaacatgtagtaatgataatagtagtactcctgcagcacaacaagttactagtactactaaattaagagcgaatgcagtgatgttcatacggtacaacaactatggttgtttttctttgtattccagcatgccgccatcccgccatgctgcaacacatacaacaccggtccaaagaaacaaagaagatacatgcctccatgaggcgagcaagatacgactcattcgcagcacctccagattgctgcttcctacatatcaacataacaatgcaatgatggtctgaagaatataatgataagtcaattttgatcaatttgtcttacttacatctatgaatctagtttcctgtcacgaaatctctccaacctagtttcctgacgatttatctgcgtttttgttcgaaagcctgcaaaaaagaaataacaatccactttctaaattcacgtgcaaaagaatttgtatttgaaatcaattaatacatgctaaagactacacgacttacacgtcaactagatactgccggccttgggggttatgttgagcaaggcgcgctatcgcttttaatacatggggtagatattcctccaggcaatttgaaaatgcagcctcaacttcatgtaacatgaactatataggacaggaaaatattaacttcatgtaagatggttaaaattttgaacagtagaaatggagtagtactgaactcactctgttttgtgcatgtttcaagaagttgtttgcaaagtgaaggcatccttttggatcattagtatacaaaggatttagattatgccacactccatttaccaaatatgctcttccattgggaccataaataaaagcacgacgtaattctgggacctgacgactttgtcttgccaagaaaatgttcccagagcagatatatttgttgtagaatgtccaggatgtctaggataaatgttatcaagatgctctaattgtgacatcctctctaaataagattggagacaggggtgattgataataaatgccacaatagcctcatcattggaattctctccatttggacaattcctcaagtactcaagcagatcattaaagtacaatggaataccatgtggtgtaaattttgcaatgaatatggaataaagctttgcaaaatcttttgcacatgtcacaccattaaattgtactgtaagaacaccctggatggtaacagcaccattgtgaaatatgatgttgtcgctattgaaagcgccattgtagctcaggttttcccagtgcattgcagtgatgtggttcaaaaccttttggatgttgtatgatgcaaagtccgagaagtatcttactgataaccatggtagaaccggcggatttgtacgagtttgacgttgaagtgcaggtactaaatcaaccgtgtagaaccatgtgttcgcatggatatcatcaaacttctcatcaaatgtcatgggcctacaaaaaagacacacaatgttacaatgttagagacatgtataaatataggaaattaacatcacttaaaaacaaaaaacactcactggccggctcttcctcgaaaacggatttcaatcgttgaattccgatataaaggatagtctgacagtgacttattgacttattgtactctaaaatctttccacataatactgcatatgtgtccttaacatttactctcatcttttgacaagcagagttgattagataatcaacttttgtgttagataaatccacttgtacagatatattaaccccacatgccttgacaaataatgattgtaacccctgcaaataagaatcagcaaaaagagcatataaacatcaacatatgacaacaaaaacaaatgcgagattgattaaaacttgttagtaagatgaagtgcagcaatgcattaaaaaaatggcgcacacattacttaatgtatacagattgatctctaagctaaaaatgaggttatcacattgttgctctgacttaaaatggcatgggtagcgatgaggacttggggatggtatgcactgcgatgatgacttgggtgatggcatgcactacgatgatgacttgggcgatggtacgcactgcaatgaggaatcagatgctgatacatgcaggaacgttgactccgataatgacaacaataggtttactgacctaggtggtgacaacatattcaacatagattgtgataataatttcagtgatctggatggtgactatgaagatagcgaatgaaaattgctgcgaacgaaagctacacaagagcaacattgatcagttccatcgagaccatttggtatggttgaaactaaatagataggagcctaacattttgcttggtgatgtgtttggtatttgggatgcagtatgttgttttattaccttgtgcccatgtggtgctaaggtaatgtagcttataagtgcagacctgtaatggattgatggatgttttattaattaaatggttcaactattgaactgttggatgtttagtaattttgattggcaggtggaatgggtcatgttcaatttgattagcggagctgtgaaatagtggttgcagttaaaattttatttgctttgtctggcggttccaacttatttccttgacggctacaataactcaaaaatggataaacctgtcaggtttccaccctcaccaaattgcataataaatcttgtggtttaacaccgtaatgaaaatgattaaacctgggggggggggggtgaacaccgacacgaaaataaattaaactggcggtttcatccaaatctctagcggtgcacgaaattatatatgcgacaattagagggtgttaccgaggaattgggcaagaaagaagatggtggaggagcatcttgcttcacatggacgacctccttcacctcgtccagcgtgttgtcctgcagtcaagacaacccaaagaaaagattataagcaagggcagatagcaagaaagagattgctcgcatcttgtcaagcgcacctgatttttctttttctgatttttcaaaccattttttagatgtgttttacaacagttgaacatgctgcggtgctcaggctagctaggagcagtacctctcatcctttctcgatcgatagtgtggtgtatggagtacgtgatgcgtttgaggtttagggtgtgatggggaaagatgaagtgagaatgcaagatctaagggctcacgcagtcacgctcacacgcacacgacagaacgaaaaaacaccagcgtaaaagaaaagttttattcggatcatcaccttcttcttgcacagcgtagagtcgccggagaactgtctttgcgcccgtcgccgccgcgtccatgcagcccttggcagcttggtccccgtcgccgccgccgccgcgctcgtacggccctttgctcccgcggcgacggcgacggcggcggcggcggccgcggccgccggagtgaatcatggtctctgtgggagtcactgaggtggagaaagaactgagggaggaagaagaactgaggggaactgaggggagctgctacccgcccggccctccgctctccatgctgcttctctctctaagcgagcgaacaagaaaggcagggcagagagggagagatcgatagcctatgccttcctctggggctctgggcgctaaccctaggcgctagctagctacccctagcttgtacagtagttgcacctcacaggcacacattactgcaggacacacacacccagcgagccacacgcaaccagctgtccagctgcttttacttttgcttttgcctgcaacagggaagcaattcaattcaaggatacgcgggtgatatggtgattggtggagatttttacctgtgcgcgttaaaaaagatgacccctgccttctgtcactaaaaagttcaagcctccctttataccatcgtcgaactttatcgcgccctccacactattccatctgtttttagtcctaacagtgtcaaacagcgcagtcaaatgactttgttgtccttagggttgagagagaagagagagagagccgggacggagggcaccaccgacgaagagcactggacggcggcggtggcggccgcggacgccgcggcctcctcggcggcccccatggcggcgaggatccagcgcatccccgacgacgaccccgctactcacctgcgtcgacggcggcggtggcaaggtcgccggcgtggagcttgccagattccgatgggcgtggcgagggtgcggcgtcacctacgtcgacggcggcggtggcagggtcgagcacggcgatgcggcgcatgagcgagccagcgaggagaaggccgagcgccgcttggccgccttgctgccgcgccaccgagcaccgcctcggctggccaccggcgccgcttggctgccttgccaccttgacgccgcggctgttgcggcggcggcagttgcgatgacgacgaagatgggaacggcgttgcgacgacgacgacgggggcagcgctgcgacgacgacgacgagggcggcgctgcgacgacgacgacggggtggtgctgtgcgacgacgacaacctatatcgcaccccttccctccgccatgtgactcgatggagcgcgacgtccctctccctccgagcctccctcccatctccccggcgtgtgggcctcgccgccgccagtttggatggtgctaggaggtggcgcgtcgagacgacgatgacgcgcgcgcgggcggccgcgagggctggggcttcgggggaaggggccgatggtgaggttgaggttgagggtgcctcctcggtcgccgccgccatgggtcgcccgtcaccggctgccggccaccgctgctcacgagagaaagatgaagaggagaagaggggaaatagagaggtgagagaatgacaggtggggcccgtaactgaaagggcaatagcgatatttttcttacccgagcccacatgtcagagctatcaaacggttagatcctaacagaatagcgatggaatggtgtggagggtgcgataaagttcgacgatagcatagagggaggctcgaacttgaccaaacttttaaaattttttgagtatcaattttgtattttagtacgtttgtaaatttcgtatacgatatgagcagtacttttaaatgaaaacctacgcatattttctttcttattttaaactaggcattgacttggtcagatatttgaagctttagcaatcaaatttgatcaaatcttgtcaaatatttatgatcggagtatgcaaagggtgttctagatccgtactactagtaggatagaaggcatcatgcctcggggatatttcagggtggcatcgtactttttggtaaagtctgaagatcttgcatcacaattggacatgttttctgctcagttaattcgacggatgtgcttgacttaaacaccacgcacaataaaaaaaagggacaggaggattttgttcgatctgattccattcacaccactttctaattccgttaccctttgcatttcctctctccaaccaaacgcctccaatagtcatctctaataagatcttttgttatgctttgcaaaacatccaaggcatggagactgtgtggaattacggtggcttgactgggaaaatgaccctggggatagtgatgcaaagatcgtgatggtctagacaaaaataaaaatcaatatgcacaagttaccacagaatctagaactgatcttcagcgttattgcaagctagcagtgctgtagcggcaacggcacgaacgagaacctggtgtgaaatcttgggtgtgtttggtttacgatcaaggctggatgggatatggcggtccatattttgttagatatggcgatccagttttttggttgggtgaatatggtgatacaattttttgtttggttgtagggataaaggtggatttggcgattcaattttttatttggttggagggagtagggtggatgagcaggtgtagtcacctctcactttgagaggtgagtatacccccatcaaattcatatatactacaaatcacaaattcccaaacaaatcacaaattatatttatatatatatatatatatatatatatatatatatatatatatatatatatatatatttatatatatatatatatatatatatatatatatatatatat

SEQ ID NO: 38810 - DNA, 11258 bp, Oryza sativa
  unsure (1)..(11258): unsure at all n locations
cgccgcctccgcccgcatctcacgccgccgccgacctcgcccatccccgccgctgcagccgccgccgacctcgaccctccccaccgccgctgcaacctccccttccgccgccttcgcccgcatctcgcgccgccgttgacctcgcccctccccgcggcagccgccgccgacctcgccttccgccgccgcaaccgccgccgacctcggccctccccgccgccgctgcaacctcgccttccgccgcctccgcccgcatctcgcgccgccgccgacctcgctcatccccgccttccgccgctgcagccgccgccgccgacctcgccttccgtcgccgcgctctcgcctcttgacctgtggctgtcgctgatgcgcggtgaagcgacccgacctcgggcgctcgccctgctcgcccggccgctcgggcggttgcatccggcatctgcgaggtatattcctctttgggccgcccaatcccacttccgcccaccaaccaaacaggcaaaaaaaaaatgggccgccatctcccgttcacccaaaacctcccaaccaaacacaccccttactactccctccgtccaaaaaaaaattcattcctagcatcctgaggtggaattagtagagagtaagaatgactaaaaaaacccttaattattgaaaaaaatagtaagagtgatagataggtaaagggtattaaagggataaaacttctcgttttgcgtgttgagagtaggtagaatggtagaagtctgttttcagtttccacggcatgcggtcaggtccagcgtttcccaaaccgcagaggacggggttaccgcgccccggcgataagcacggttactgcgcggtaatcgtgaaaaccgtatgaaaccgtgtaaaatttatcaaaaatttgaattattttttaaatttatatgaatttaaggaggttaccgcggtttttctattactgtacctcgcggtaaggccggtaaccacagtaaccgtgcggttgtacctcgcggtaagatcggtaaccgcggtaaccgtgcggtgcggttatgaacggtaagttgaaccctggtcaggtcccatttattcctggtcataaaatggtgcaggcgtattgattggtggggcatcgtgtggattggctgcctgatcagtgactgacactgatggacatcactgtaccattttgccctccaacattagtaaggcccgttccctaaaatgttttccaaaaaatcagatcaaatcgttggatacgtgcatggagcattaaatatagataaaaataaaaactaattgcacagttaggaggaaaatcgcgagacgaatcttttgagactaattagttcatgattagccaaaaagtgctatagtaacccacatgtgttaatgatagattaattaggctcaaaagattcatctcgcggtttcctgatgagttataaaattagttatttttattcgtgcccgaaaactctttccgatatccggttaaacgtccgatgtgacatccaaaaattttcttttagccaactaaacaaggcctattcgttgttaacttgttattccctatgggcctcatttaccttctataaaaatgcaagaagaagtgaagagcagtgaccacctatcctacagtttcaccatggctctcctcattttcgtagcatcgcagcaagttcaaatcagatcgaatctttggatacgttctgccacgacggacaccatctcagctggccaaacgttggccaacgatgacaagcttgtctcaaaaaatgcaaggtacgcactcggcttcttcaacacaggtacaaaagcgtctggaaaaactaacaagtggtactaaagctgtgtttagttccaaagtttggatccaaagtttggatccaaactttagtcctttttcatcatatcaacctgtcatacacacacaacttttcagtcacatcatcttcaatttcaaccaaaatccaaacttcgcgctgaactaaacacagcctaaggaatatggttcaatcaggttgccaaaaaacttctgcatgggttgcaaatagggataagccgattgatgatcccgcatcattggagctaacaatcttccgtaatggaaatcttgccatcttaaaccgctcaaccagtgccgtcctttggactacccaagctaacatcaccacaaacaacaccattgttatgctcttaaatagtggaaatctcatcctaacaaacccctcaagctctttagaagtttttttggaagagctttaactaccccacagatacatttttccctggggcaaagcttggatggaacaagatcactggcctaaaccatcgtattatttttaagaaaaacttagtagacccagctatcggtatgtatcgtgaagagttagaccctactagtgttaatcaggccttgcttgcaccggtgaactccacgccatattgatctagtggagcatggaatggcgagtatttatcctnnnnnnnnnnnnnnnnnnnnnnnnnnnnnnnntaaatatggccatcatcccaataagagtccaaaattatatatcaatagtatcaaaataaaaatcccatatactttttagattaaaaaaatctaacaataattgattaaaatagcctttacctgaacatgcatttttagttaatgagtaataataataataataaataaataaattgttgaactagagaagaaaaataaggaggaggtcggttcacgctgcacctggtccacgaaggaagacctttttgcgtgtcttttgttgggagcagagggtagcacatctaaccgtccagccccagcaacggcgcgatccgcgtctccgactcagtcagatctccgtccgtccgtctgtgtctcttggccgagaccgagagagggttttccccgttctcccaccagtccattgccgctggtggcaatcttcttcttgttgaccaaaccctagctagcagcagcaaccatggcaaaccctaggcctccctatgtgttgctggagagagtagtgtttttcggaggacgcgagttacccgacggcacatggaaagatgccgcaggcatagtcatcggatggagcagagcgcggctgctgagtcggcgagaggcgatggaggcgatggaaccccatcccttcctcgccgatcctccgcaagtgagctccctgcggatgatgtcgccgacgcccgcgcacgcgcagcagctgggatccatccgcgacggcgacatcgccagcacccacaagggcatcgtcgtcatctacgccggcttctaccgaccaggctgctccgatgacctcgggggatgctacctcctctacgacgcccccaccaacgccctcaccgccatccccccgctgcccgactcgcctcgcttccccaccttgctacacctcggccgcaccgccgtcctcgtcgacgcctcccgctctgccgatgattacatcctcgccgatatcgtcaccaactccggcctgggcctccccgaagccaccatcttcgcatggtcatcgctgaccatgaagaagagcggcggcgagtgggtcaagtcctccattccccgcctccctctccctgcacatctatgtggtccaaaacacttgttccagatcgacctcgccttctccctggacagcggccgcatctgctgggttgatctcctacagggcatcttgttctgcgaccgcatcttggcaccggatggccccaagttggggttcattccgttgcccactgggtattgcatcgatgtccatcacaggctccgccatcagatgatgccactagcccggcgttccatggcctgcgtctctggcgccgtcaagtttgtcgccttggttggcttggaagatattcattgcccccccaatgaggtgatgctcaagacatgggttctgtcccctgatttcaaggagtggaaggaggatagcaggtccttatctgtggaagagatgtgggcaagtgagagcttcaagcaaatggggttgccatgtgttgtaccagtttcccctgtcctcagcctgacccaagatggggtaatgtataccattctgaatgtcatcgagcaggtacctgcacaagttgatgaatttgggatcgtcgttgtcgatgatgacctggtgcccattgccaattatatgatccgcttcgacattcggcgaaacaaggtcctgtcctccacaaagatatctcaacatggtgaattgcagtggcttatacccaatctcattgccactgacttcactgcatacctacaggaccaccaggtacttagtttacttgctactgcatgctacttaccctcagcgccacccagtgtacttctagcttcatatcctaactgttttactgttctatacttgtttgttttagacgtaagtgatatgtggacgcttatatttgtcacatcaagttagtttcacttgcacaactaattaaaaaatattgacatcttaatttggccagccatttatgttgaggtattgaacacagtttagtgtgtcatatgtgtgccagcttccctcttccggtcttctcatcaggaaccaatgagcagtacaaggctcatgttgaactttgctagtagtaattttcaaattaagaatcggtatcagcctaagtctattcaatgatttagtagagtgtgcactatgcagaggctcaaatttaaactgaaattttaaaaaaatcagcaacttccgtagcattttgttgttatgtcgacaaaaagtacaatacccttattaattctcacatttgcatttatggcttactgttttgccacaatacttattttaatcgattttttcttactttatagccatacgctatgatgctttcaatgtactattcctatatgggacaagcttaagatatccagtttgcggaatgcttgctaagtttcacttcttcaatacaaacctgagtgaattgtctaattaattacttaattaatgattgtagaggttttgaaatcaatttccgaatgatttgttgacacatggttgatgttgtgttctctttagtgtagaattttttcatagttggtttcacttatccaatacaaacttccttctcttgtcttaaccactgaaaattacctggctcatgttgaactttgatagtagtaattttcaaattaagaattggtatgagctaagtttattcgaagaggcacaaatttatgcagagcctaagcttgggtattagtttgagagtctttttctccaatataaacctgagtgaattatattgcctaatgaatgaatatagggagttcttgaaaacaattaccgaatacattattggtacaagcctaagttgattctaaaagatgcagcatgctgaagtgcaacgtgaatcttaactgatgctggcaacagtagcaacctttgtacatttacctttaactacattgatgccatggccactaacctcattagctacatgccttgaagtactgctgagtgcacactttccctctttttaaatgttcaaagtttattgttcaagcttaatttggggcatatacaacaacgggatcagatttaaaccatactgttttgacagtcatctttatttttgttttggtagagagctgaagaagcaggcaaggtaggagcaagcgccaaggggaagcgcaagcagatggagtactactgaatgatatgtagtatatttctgctatttatcatgcacataacatatcgctttttttagcttacatcctgtgactgtgagatgtaaggtcaaatgtgtttaggttaaccatcagagcttattttgtcactaccagaccttattttaatgactaagcctagcagttaaactgaatggtaaccagtatgtatgtgtaatcatcgtggatttatgtcatactactaatagtgttgggctcttcaaatccaacattgtaccaactcctgagttgaagtttgtgcttgatttcatcatgctttcttggccttaggtttaggggccggtggtgggaacacggccctgaagacccaggcagcaagaacagcaccaacaaaagggcatatccagtagacgtagaattgctcccatgtgttgtggcgattgttcacatatgcccagccaaacgcctatggaaatgtagataatatttaaccaagattagttaccagaaaacaaggaacagtagccaaaaggggcaaatgagaagagccgcaacttacatcagatcttactgaatgtataaatggaatacagtagcatgaattcaaattacaggaacagtttgcgatgcattctaaactctgcaaagatgtcgatttcagaggtatacaaggaatttccactaaattacctaattgaagtggacaggagtgaccaaatagaaattaactgagttaccctctgcagaatataagtataaccaggcactgtttttccatagtttttccccataaacaacaagctaggttttgaaataatgagatcactggcaagggttttatgcttatcgtgtacactccaaccaaaactgtggacgtccaataataatactggctccttcctgatgaaggagatttaaggaaatagtggaactttatgaaaattacacctatttagttgcttcatttgacctgttgcttagtactttgaaacaagggcaaagaaaacataaataaaaagagcttagcctggcagcatgtttggtaaagcaccataaatagatgaacatgtaaaaggggatgggtaatgcatgatcaacatttttattgctcaggttttcagcccaaatgacttgggactccgtttcctactcatcaacaagctaccaaactatcgcgggtgctcctgaattaatcctagctccatgttgtcttgaaaaaccaattgcatagaactagtaagcatcatgccgaattaatcctagctccatgttgtcttgaaaaaccaattgcatagtagtagcatcttatcttgggcatttaactgtttgccactggagtttaattatttatcacttatatctcaatgacgcgtggacctttatacgtataagatatgtagatccaagtgacaaatagttaattgccacatgcaggagtggtaaacagctaaatatcttatcttaccaaacaaaattaaatatcttatccagtgacccagtgatctaaagaaataaacaatacaacagaaaaaaaaaactttttgaaaatcatattattttgaaacgtgaagccaataataatccacgacaaatcatctagctggtgactgagatgatctctgctacaaaggcaacctccatgtcggctccaggagattcagatgccacggacaaatgcatctgccatgcttgggaccgggactaattcacctgtcaatcaatttggtcccggagaagcaaatgatcaagcttaagctggctaaatgctctcagatcagagctgtatctatggctatcaatgaagctcttcgactggtccagcttttcagaactgttcagacataacagatttagctttcactatttggattagatttcattcagaaaggtagtgattgggttatctgcacttgatctctgaacaatgcataatcagaactggaatctacagcgcgaaaaggccagtagcctagtggttacaagagtctaagtagtatcttaggtcctaagttcaactccctatgagagcgaattttccagaatttaacggctttgtgctttcagtggtaggcgatgtacccgtcgacagcgaggcgccacaaattcgtcaatctccaggatttgccaacctagtcttcgaagatgggcgccacgacttcgtcaatctccaagatttgccggcccagtcttcaaagatgcgggttgggtttacgtgcgtgcatttataggggtgagtgtgtgtgcgttgtgagtgtaactcgtttgcatctaaattagcagaaactttaagcggtggtaaaagggttgaagaataattccagttcagctgtcacatgagtatgctaaaaatcctctaaaaaaaagagtatgctaaaaatgaatagataacttttatttttttaaaaaaaacaaacaaacaaagaacagagtacatgcaagtgtggttcagctcatcagtcaaagaacttatttgttatgtgtgtagttgttcaggagattgctgattcgttcaacaaaaaagtgctcatctctgaagactagattataactgatcaaatcaagtctacatgccgctgccaaatgattgagaattaacgtgcagagagaggccacttgcctgcttgcccacgagtaagcaaagccagcaagtttaaggtatccaaagcagcattagcagcagcagatgatgatgatgatgattcagagatccattgattacagccttctcacatgatcacatgagagaagctagatcacaacctgtgagcacacacttccagcagcacgccttcagaaacattacttaaatgctaatccaaattgcatcctcctcgctggtttgacgacacttcgtcaggattagccggccaaacgccaagattctcaaacctccattaaattagggccttcatacagaacgaccggattggagctttttggaacataagttgaatatatgatatggtatggtatctttacccaagacaagctagcatcgtggatgaaaacataatttgcagattttaaaaaccgcacgaatctttccacttttttttttcacgaaactcttacatataacttccagaaaagaaaatgaaatttgttaaatatgctttgtatttcaatccgtgcctctacttgctagatcaagctagcaactgatcatattggtgcattagttagttgatgaagaaaaaaatatacatagaaaaaagtagcagatagttggaaatgacatggatacttggatccaaagggtatcatgggtggcaccaccacaactctgatgcaaaacaatcaaaagtctaataacagaaagtggcccccatgtgacagcctgacagaccagtgaccagccactaaactaatcatgcacattatcctcctcaaagctcaaatcaatgcctccctagtgacagagatgcactgcatttcctacttgtttctttctaatcactggtgccacatgcattccagtcaactggcagtagtgcagtactaatgtactatcatggatcatggcaaagctagtgacatggtgcttcaatctagcttcccagcaagtatgcaagtcttttgtttagcttctaatagaagtggttgtgaacatgcatcatacatgtttatttcaataatggagtagtacttacatacttacaggctaacataatcaatcgattttttaaaatctcattatggttattacactcgtaggctgcagctggtctgaaaatttgaagagtgcactggccaagtgtccgtccgtgttgaaaagatttacaaaatacacatatgggcattatgataatctgtaaattacatagacaaattttcttagcaacacataatcattcgccattcggattctaggtattctagaagacaagcatagcactgacacttggtgtctctaggtaaatatcatcaagaataatctccagttattcttcgaaaaggaaaccaagctcagtgctagtgagagagattgagcaagtactgataccttgaactgtagagaatacaagaacacacaaactaattactgataaatttataatatccattcataccatccaccagttcaagagcaaacaagaccaatgaatgattgaaattacattcaggtcgtccaatcaaattaatgtgcatgctcttgggtttgtcagtgttccgaagctaattacctaaattactttgaattaaatatggtggaaaggattattccttgtaccattctagctaataaataatgttgggttcttcaaacccaacatctgtaccaactcctgagttgaagtttgtgcttgatttcctcatgctttcttggccttaggtttaggtgccggtggtgggaacacggccctgaagacccaggcagcaagaacagcgccaacaaaagggcatatccagtagacgtagaattgctcccatgtgttgtggcgattgttcacatatgcccagccaaacgcctgtggaattgtagataatatttaaccaagattagttaccagaaaacaaggaacagtagccaaaaagggcaaatgagaagagcggcaacttaacatcagatcctactggatgtataaatggaatacagtagcatgaattcaaattacaggaacaatttgcaatgcattctcaactctgcaaagatctcgatttcagaggtatacaaggaatttccactaaattacctaattgaagtggacaggagtgaccaaatagaaattaactgagttaccctctgcagaatataagtataatcaggcactatttttccatagtttttcctcataaacacgcaaggtttttaattaatgagatcactggcaacggttttatgcctattgtgtacactccaaccaaaactgtggacgtccaataataatactgactccttcctgatgaaggagatttaaggaaagagtggaactttttgaaaattacatctatttagttgcttcatttgacctgttgcttagtaatttaaaacaagagcaaaaaaaacataaataaaaagagcttagcctgacggcgtgtttgataagcaccataaaaggggatagataatgcacgatcaacatttttatcactcaggtttttggcacaaatgacttgggactccgtttcctattaattcatcaacaagctaccaaactatcgcgggtgctcctgaattaatcctagctccgtgttgtcttgaaaaaccaattgcatagtagtaagcatcgtgccgaattaatccttagctccatgttgtcttgaaaaaccaattgcataatagtagcgtcgtgcaagtgagagcaattgatgttgatatattttgataataataatataccaagatcagtaactagaaaaaaacctaaaggaagaaccgaaatctcacattggcagggttcatggatgggccagtgtaggcagcgccggtgaggacgaggcaaacggtggagatggagagcatccaggtcttgacgatgggattacggggccccttgacgatgatccagagcacggccaaggtgatgacgaaggtgagcaccagctcggcggcggcacccgtgtggagatccaccttgagcgatggccccccgagcatgtgcttgtactgctccggcatcag

SEQ ID NO: 38811 - DNA, 5521 bp, Oryza sativa
tagtattgacatttcctcggctcgatcgagccgaacagtgtaggctcgagctcttgtgtgctctctccgtcaaaagaaaaacttaatctaagaggggatttgatcccttctagtacaataaatctggacaactctttgcccagattcattaacctatgttgagtattttttggacggagtgaaaagtgtttatgagaatgtgttaggattgtgcttgtgagttagcgagagtgggctcaagcccatatcaaacattttcggctcaatggagatacatagtgggctcaatgaatacatggagtagtagtcattatgaaaccaagaaaaagcgatctttagataagcaccgaactaccaattgaggtgatggcagagttgtggattcataacttcactcaccatgtccaaaatcattagctattacttcctccgatcagtaatatttgatgttggacaacaaccattgattctaagtgtcaagtattatagaccggagagccgtcctagaaaaaaacaacttcgagctttttttttttctaagacggatgagggtgtatggttgagagctgcaatacacaccttttggctcacaatacaacaactccctaccataccaagttcctaaccaaatagtaccatagcaaattgtagcacacgactggtctagtggccaattgtgataggttttggctgaaaaataggcaagtgatcgatgtgattattgacatcaccaagcatgatcacaacagtctgaataggtgaatttttggggattgtatatatggctattttctcatcaattatattatgctcaacgcatgatcgaccaacttgcaaagaaacaaaaacaaaataccaatttataactcttcaagaagaaaaaaaaagaagaattaatggtaccaacataccaagatgatgagcatacgaaaagaaccgcaaaagatcagaaggctgaagattccttcctttgccttttctttaagatgacaggcatttgattttgggcacaccaagatggcttccccaagaatatatttttttgggacctttctctttcaaacaatcggttgggcagcaattatagtgtgatgccagcctcatctttcatacgcaagttgatagtatcatttttgtcaacgatttctgcgaaatttgtttttatcagatttgttatcttcttttactaatttacaacctgatttctgggaaattaaacaagagttcgaccaatgaaaagtatgtgtttcttttcatgccaaatcaatggctcggatcgcttctactgtcagtattcgatcactgtgaaaattatttcaggaaaaaatgttagatatatctcactatcagcctccttacgaaatatggagtattcgatcatgtgaaaggttatttctaaaaaaaaaattggatacctcactatcagcctcttgatgaaatactagtagtttatatggtcgatttcgcaagcattttggtacattgaaaaatgaaaaggggagtagtccaatcaacttcacatgcaagggcacatcacctaatctacaagaaacatgtttgaccaagctgggttattatacctaataacttgcattatttattgcaaattattatgtgctcactttgaattggacgagctcgttgaaaaaaaaaaactaaagaagacgcaaaactgatagtaaccatcttctggtaataaatgttagtgcatcaaactaatcagatgatcttagcaaactaatcctcatgtttataaaaatatatttttgacgttatttaggaaatgctgtctactgctgtcaaataaatttaaagcttgcctctgatcatacatatctacacagacgctttaatagctggtatgtgcaaaatttggcagatgttcataaattttgctgcaattactgatcatgcatggaagagttttttttttttttttgcggggaatcatgcatggaagagttgacatttacagatggggacagatatgatttctcacaatttttgactccaaaattgggaggaggaggaggaggagaagaaaaggagagaaattgagagaaaaagaaaatcaagaacgagaaagccaccggttttctctccgacgatcgccgccgccgccgccgccgccgctgccgtcgccgtcgtcgtcgtctacacggcgacccgctgcagcaccctcgacgggacggcgaagcgcgcggagaaggagcgcgagaggttctccggctccacccacgccgcgccgtcgtcgaagttctgcgcgtagctgtaggcgtcgtagggcaccctcgccgccgccgccgccgacgacgacgccggaacgcagccggtggcgcagagcaggatccgcttcttgttctcccgcaggatccgccgccacaggccctcagcctcgtcccgcacccgcgccccgacgacgccgacgccgacgcaggagcccccgcgccgcgggacgccgcgccgggcttcccgtcggcgtggtggacaccgtcgaacaccccggcgccgaggtagccgtactcctcctcgtcgtcgtcgtcgtagtcgcccgcgaggtcgaagccgccgcggacgtagcggcgggacatggagatggagggggcgcaggagcaggaggcctggcgctggaagcgcgggctgtagccgccgccgccgacggcgtccatggcgagagcgatcggagtgtgagagaatgtgagggagaagaagaagaagaagggaggagtggcgtcgcggtcgtgtatttgtaggggggagggtggtttttcctttgctttgttgggaaaaaaaaccatttttgttaaccaaatcaaaggggatttattttatctactaatatttttccctccttgttgagtacataattggagggtattttctcacaccaaaagattttcccttttaaccttagaaatggttcatattccctcacaaatattcttcttttcgattacatggcagacacacgtacactattacacatctcagatcacattaaaatctacatctatgattttatcaaaatatagttaaaaacccacctatatatgcgtagtaggattgagatcctccgtagtcactgtaccgtgcctttgtactgacatgtgggcccggaggccatcgggcccacattgacaggatggtgcagttggctgcagaggatcctgatccatgcgtaatattcgtgaggcatcgagatttgaatcgtggtgaacagagtcatgcactcatgcacccatggactccggtgtttatcctgacacataagattttgttaatattgaataattactggataaaaaaagaaacgagtgacgggacaacctcagctattcaaagaaagaagaccagctgaaaggttataaacatatttttaataaacattagtttacttttgctagtcacgaaatgatacaaattttttttttcaaagcaaatgatatagagtcgagtccattgaacctgaagcatttctgtactgctcctgctcttgaagatactgttgtatactcctaagttgtaacttgtacagaacaacctaatcgttgactctcagtatgcccatcaacattttaaatgctccattgctcaacaagttttgcactttttgagactttaagtcatgttttgcaaggataaattattgtcaaaaaaagattatgctctgctataaagaaacatcatatcttcttttcagtgttactggatcgaaaattccttagtgctcctagaggtaagcgcatgaagtagtagggtaggtgatgggctcatgtcgccgtgtaaagtgaatcacaaattcacaagtggagagcccaattctaaagttgcaacaaattcacatgtgcaattcaatctttcaatctttataatatctgcttcatataccagatttcctactcttggatgctttgtagaaatttctaccccccaaacaagaaaattccccagcagaagaattttaaaaaactttatagagagacttatcacctattgttgaaggttttggagacatttataatcaaacagaatccaagattaaactatgaaggatttgaagaaaaaaaaaaggaaatacttttgggttgatttaattgggaccacagcccatatgttggaagttgacataatgtcgaagaccctacgtagtcgatgtggaagtgccaccaactgtaggatcaaaaccatctaaaaaaactgtgggaacaaaaaaaagcttttcaatttagtgttaaaggtgaaaaaaatgcattatcgcatattttcacaagaaaaatattaggctttagttgtatagtgcgaataatatcgagccgatgtaaattcatatattcatatattccaaaggagacctcatctcgcattgagtaaagatgccatatgcttaaatttgagtgtcgagatggatcaatgggtcaaattagtaagctttgcttgaaataagtttattaggagtgctcattcctatcattccagtattctttaatcttttctgttaaacaacaaaaagcacattttggcgcatgcttaggcacaattggcggtttgtcttgatgtttatcattgctaatcgagatccattactctggaatcaagacattgatcatgattgctactggctagcaccaatcctaccaaaagtgctgttgatcataaaaccaaagcctcattcattaatatatatgtttgtttatatgcggcggcagttcttaattctctggctaatctttctcttgccaaatggcatactataaccccttcggttaaccctaccatttggcagtttagccggagctattcatgtagctggagccatacatgtactaattatgcataaaatgaacatttttattattacagaatgtaacttttttgtgaaattattctgttcagaaactctgtaaatctgtcaagatttgcttactgattttgtgatattgcttgatttggatcaattcaattccatcatcttcaggggagtttgatgagatgaatcagattcaggccatgtgtgaatatgtgaagggcaccagcaggcagcagctgcacaagatagagtaacagtattaattagccatagttgttcagaacaccgaatttgactattgatatcagcatgttgcatgcagatctccaggcaagttgctgcgtacattgcatcactctctttgaaattgattctgtctctgcatgcatatccaataaatgaaagaatcagatggtcaaacaaagcgaaccaggtccatggatctgcacaaaagcctttcaaacttctttgacctgaaatttcaagaatcctataaactcatggattcacaagagaagaacccaaaaaaaaacaagaaggagaggaaagttcatggttgttcagacttcttagtcagaagaattccttttatcaaacaggacaggctaaactgctaaactggtggcaccaacctttcagtgtagtatttttctgttcagttctcgtttctaaaaaaatttgaaaagaatctgcaactcccaacaatatccatta

SEQ ID NO: 38812 - DNA, 5835 bp, Oryza sativa
  unsure (1)..(5835): unsure at all n locations
cagatcagcaagccccctcaaaaaaaaaaagatctcgtaatgaactgggaaacacatacgacgtttcaccctagttcctgatctttacaagatgtgcaatttcagttcttccatataaaagctacgcttcagaaaacagagaatttctggaatgcatccaagctgtttgcaagtaaatcgctcacacttaaactgtcggtgccactcaaaagtcttgaacaagatgctccgacttctggctccccagtcgattcagactgaaaacaagatgctcccagtcttggctccccagtagattcagactgaaaccaagtagatgacgatacataagaatcagatcagctctttaagaatcaaatagaacatatcaatgtttattagaggctctggtgagtaccactgggatgtctggcttcacattattgtcatcattggccaagagtgatgcctgagggttcggttcctctcttctatcttcagtagaacattgctgcagagacaagccgataagcaaatgcatagtgtccttggcaagaaaaaaggtattagaagagcaagtgaatggtggctaatagaggtaccttctcaccgtctgtaccagattccagaattgtgcctaggacagacaaggtactagcaccacaactgctaggagttgtaccaggtgtcctgcgtgaaattcgattctgggaaggaaatgcatggcacgtttcttctgcatcccaaagggatggagttgacaccttcggctggctacttgcttgttgccgagcaatcagggaagcaatagcagcatcaaatgaatcagcggtaagaggtatctgttggagacttgagttgttttgtggaagtaactgcttgctgtcttgagaaggcgcagcttcagctaatagtgctccaaaacttatattagatatgcagtcaatccatgaaagtggtgtctctttgctttgattatcctgtttctgaaaacatgtaatcagtgttaggtcaagtcaaaatataattgatgatattgaaagaaaactataacgtttgaacttaccatagtctttactgtgttggcctcagtggacggtgcagcaaagttactcgggaattcactcaaagcagtcatctgtttctgttccctgacaacaggatctaaaggctcgttgtcgattatattgcctgcagagtgcactaatcctaaagatactccactgttttgttccccaaaattgggtggaaaccaaccatatctaagaaaaaagatgtgatattcagccataagttttgtgctcaatatatgcatggatgcaaacaaaagtaaagtaaaccaggtctggagaagaaagcgaaccttaagcgaaatgtcgaagggctgccaacagcaacatgcacatcagctgctgtgcaagaatcactacgagtccatctctcactgccatttatgttatcaagcctagtaccgtcagggaagagcatgagttcacctcttgcacactgagaattgccccattttgtgttgagatgctgcagaactgaggatattttctttcgaggagccacagtcaattccaggtaaggattgtggtttttctgttaattatacagagcaagccacacattatggaatctgaacgaggtcgtatacaataatcacacatagaaatcttgcaaaagctgaagtaatcacctgctgcagggacttctgaaactcctcatctattgggaacagttgaagtgcgatctttccagaatggcagggtggtcgagcagacacattcttagaatcatggaacagtgcttccataaagctaccatcctttggtgcactttgtttttcagtatacaattgaggtgatgaggcaccagctcttctgtattttgtgctagcattgcctgaaaagtaaagcacatgttgagtttgagaccagttttactcgtagatgtactttacacaatggcatatgtactttactccataaataacttttatttctcttaatggaaaaaatgcgctccttgcgtattcccgaaaaaaacaatggcatatggatgggcacctaacgacatcatggaactgtcttgattcaattgtagcaacagacatttattttctacttcaaattttaattttgtttgataagtgcagcaggtacaccatacagtaaaggaaattgggaacaagattccaacacattacctgatgatttgttgatatattttccaggtttcaggctttgcatcgtactgccaccaagttttgccgccgttcctgtatcagttggtttacagcgctgctgaagaggtttcatggttttctgatattcagcagcaaaactatctggtgtgcaattttgtaatcctactcctgcaaaattgtaaaaccaacattagtttgccccacacctccatagttccattaattgtctgcaaagagcacggttatagcatcacctcaggaggacaggacctttttagcagtctgcccaaaatcacaagacagacaacttttttggtaatggaagagctaaatcttttttttttaaccaaggggaagagttaacacctagctgctacggctctgagattattccttagtttgcagcgatagtgctaatcagacaactagtacataaaaataaaaatcaaacaacagaaataaatccttttatccaattataaaaaagtcagatacatatcatatcattcaagcattagtataatggaccagcaccaaagttcctacacacaatgggaaagcccactgatctatctcttatgatgaaaacgagctatggattttaatgaaagaattatatctatgaattctagcataaattctagcaaacattagaaagattaagttctgaagtttctagggcataattgttctgatccctaattgtgaattataactataacaaaatcactcttatgcacaggaattcaatgggatgcaccgaatgtgctaaaggcagacttccagcggaagcattcattcgttcacgttcctttcagaaactggcattcgagttttgagtttctcgagtcgctcccctaaacctaatccccgaattctcccgcagcccaacatttcattcaaccacgaaatcacgccgcgcgtacccaccagtcacctcgctgtagcaagaattcatccataagaggcgtacctgatctcacaaccctagatctcctggaccccggagaacccgaggcggcgaaaccctagcccacccaccgccggcaagacccccgacctccgcaaccgcggagagagagagagagcgagcgaggagtcggaggcgagcacgaaccctcaaggccgcgaatccccacacccgcccgtcgccggagttcaccggaaggcttcgcggcgcccgcggcggaggccggcgagcagcgaatcgtcggaggcggaagagacggatttttattttttatttttttttgggaaatttttgaactctggtttgttcacttgccgcctcccctccgaaatggtacgcccgtatttatacccgtacagtatgacagacgtgttgggctacgactctaaatgggccaccatttggtggcccatgtagtttgggcctccattcctaggcccaaacagtttgggccggcccacctgcacccggtccacgggggcctcgtgcgccgctgccactgccaccaccataagacgacgccgccatcgccgcgtcacgccacgccacgccacgcgcacgccgcggcagcgccagcgcacggctcgtcctcgtctccgtgcgtcgccgacgtggggggtaacgggggtttggaagcttcctcgctagggcgggatggcggcggcggcgaagaagcggaggccggaggaggaggaggcggcgggggcggaggaggagatgcacctggcgttcaggggcgccgccaacgcgctgtcgcaggtgtacgggcaggccgtggccgcgcaggagaagtcgttccgcgccggcgagcgccgcgccatggtacgtccttggcctccgcctgcccgttcccctccccaccgatcggtggccgagtcgcctgaagaactgcgttcttggggccttgagtcttggggtccggtttagttttgggattttacgcggagatgcgaagggggatgggatcctgcttcgagttctttcgagttgctggtgcgttggggataggggaatttatgttctggacgaatttttagctgagaattatgggtgtggtttggtatggtgggattggagagtttctcggtgaaatgctgcggctgatcttgaaattagcttctgcagttgtaaattgttggaaatccatcagtctgagttcttggatgtgcttccatattgtgaacttatgattttattatcaaattgattcaatcctgtttctgaattttggcaggagaatgtctatcgatggatttgcagcaagcatcaagaaggtttggaggtgtctgttgccgatctagttgctttcctgcaggtcagtttgtctttatctttttctttagtttaatccctgtttgacatttatgctagccaatgccttgtgtcatatgcaaagattgagagtcagggtgacttactagtgttcaatttatagaatgatttttgcatgtggatcatgtcacacattgctggctaaccaataggatcaaatgtgactctactacaactgtgaattgtctgatgagtataatctttatgaatgtgtaataatgattcagtttcgagcacatctacaatttgtatagccagggtctggagattatactatgaaacaattgtactagttaagtattacgtcagatgtatgtacataagagccatgaaaatgtttagtgaagcactgaaggtgctgaaatcaaaaccacattgccttttgagaattcattcagtacaataggcaggccatagcgttcccttttctttcctttttcctttttttcccctagctctgttgttattccagtatgtgtatgcggctcaaatccttgcctgatgcttctcttctacgcacagactgagattgagcacagagcaggggaggtgccggggtcattgcagcatacaagtgcacagccagcatgtcaatttccttctgcaaatattcaaagcaattcgttctcttttgggaatgtaacggatgcacttaactcccatacagcgcaaactggccaaacacaaactgccggcgtgttaaatgctccgcccaacccattgcggcaaaatttacactcaaatcatcatccgattcattgttcagcgtatggcactatcaactccctaccagatggaattggagctcaaagcaaccatcctccccaacatcagaatttcatgcactgcaactcgtatgaaccctccatggatgagtcatgatgcttgttgaggatgtgagccatatgaaaacccgcagcttgtttgcttagttcccccggagccttcaagatctgatatcaccttaattgctggagaagtcccatcgattgccgatagatatgctcctctccatctgggtatcgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 38813 - DNA, 803 bp, Oryza sativa
attcctgcagcccctcacagtacacgcacactcacctctacaaacacgcacatgcacattctatccctttgaacacctccgaaaaactgaagcagcatatcttgagatcatgggcatctcgacaggtacatcgcctaccactaaaagaataattagctgtaaatgtgagcacctttgtcaagtctactcgtggaggagttgtgcacatcattcaagctctgaaaatttgtatcacaaccgccgttgttctggtcaagaaagtaataacatatgttatgttactgtacactaaattccgttactgtcaattgtcatgggtgtctggagtagtaacagaaatgatgcgggatttacatcatccttgaagtatgaagtactcctacgttttaaaaagaaacctcacattctcatctgagttggcctttttgggacagagggagtaaagatttgtacgtcactggcgaaactaacatcaggatgaagccgcagtatcgaatccagcactgaattagatgagaacccccaacccaaaaaaaaggaggaaagggagaatgcaactctgcgctggtagatttctctcgcggcgatccctcccgactcatgccgtcgggaagcagggcaggaggatttcgctcttccaacggcggctcggttgacacccatgtatagatcaaaataaaccacgaaacccatatgttttaatctataattgaatttattggttaaccacttacactcttaaccatcagtacctaagtaaggaacccaagtgaaacaagtccagcagatcgctactattggtg

SEQ ID NO: 38814 - DNA, 31269 bp, Oryza sativa
  unsure (1)..(31269): unsure at all n locations
ccaacataaggaataataagcaggaacctgctgaagttcgagatatgatgtaccattttacaaagtgactcttattattaatatgctgaaaatgaccaaacataagggggatacggaatttaccctcgagctaaaagcttttcaacggcaacatctatcccactttctgaaatgccaacctttacataagataagaaaaaggttactatcatgtaccataaggtggcactgatgctagatagtttgtaagtcgggtaaaacagattaaaagaacatggaaaatgctaagatgacaaatgaaatatggaaagcacaaagtgaccagaattaaatcaaaataaataaagaaaaaaaatgaagaactgtattgctataatcctgatttatttagtatttacacagttgttttggtcatgccaggagaaaggttagagggatgttttgattaaatactatagagtactcacaagtgaataagtgtgcattacttcactcaacacaataaacgagttgtaaatgacatcatttagacttggtggcaacagtatagcagactttcagaactaaaccattcaatgataaaaacaatactctagacagtactagcattcatacctgccggcactttcccaccccactgatagtcattttccagtcaagttccttttggccaatctcagcatccacctcatagagctcatagaattttccctagcaataagggaacaatcattgccataggttatacttatacaatcccaggtgctaaaaaatgttggtatttggtcgatgtatgtaactttgggaaagatttaagacagtaatagaaattctgacgtgtcggcaatctgggaggatgaacaaataaaaggccttaaataaggcaaatcattttggtactaggacagacagtctataattctagtttctgttgcatatctatcagtatgcatcaagtaatgaagctcaaattatggccagcaaacaaaaaaataaggggaactcctatgacaaaaaaacatctcctatttatggagttaggcaataactcagtatgacaccaaggcatgagagatgcatattatccacagcagtaatttctgaacttcagttttagatcatttgcccaataggcactgatgagacatcaaaaatgaaacttacagaaacatcagccttcagtgtcaatcaaagcagtcagggtaaacattgaaacttaccactttgaaaaacaaaacaacatccatatacttgcacttaatattccaatattgcttttgagatgtagacatctttctcaatgcatcaggtggaataaaaagagttgtcttatcataaagtgggtctgccagccgccttctatttgcatctctgatattcgaaggattcagccactcaaacttgctgcgtgcactttcagccatttcatcatggaccttattctcaactggagaacactgagctggtttcaccttcttgtttggaccccagaaaggagagcatgagtcgttggtagtcacacgttgatcttcttgaacccgcttcagacgaggaattactgctcgcatcactggtgtttctggtttcaggggactcggatcaaattccgaaaatagttcagcacctgctccaatgcgtttgtcattcttaggcactgaggataactttttcagatggttctgtgatggtgttccatttgaatcaaattctgtaaataattttgttgctttaatgtatggaaggtctgaaggcccagaactaagcttctctgaggattctcgtctaggagtataattggaatcaagtgcaaacagtgtagcgccccggacatattcaccattaggagatacaaatgagaactttgatggatgctgcaaaggagtttgatctgaatcagattctgttaaaggtgtatcagctccacgagaagatctccagaagactgtttttgaagtatcctgaggagtttgtacgtcaaactcttcaaatgatgaattagctccaatgcagttattattggaagactcaaagggtaacttctttggacaatgcggtggaagattttgatataaaccaagttccggggacagtgtgcttgctctaacaaagtcatctttggaaggccataaggacttcaggggctcctgcaaaggagtcatattcgaaccttcttctgcaatcaacatggctgctttgttatctccagcattgcaagattctaagaacaatgcacttgagcactcatttgaagtagtttgatttttcacaggtaaggctctctgctccacatgtctagcctgggaagcatcctggtctctgaaacaagcacaaggaaaatgtcatgataacgcaacaagacacgactattttgaaggccctagcaagtgcctggttttgtccatagcagttagcaaacaaataactttggtacatggaaaagaacaccctgaaatgaaataaaccaagagaaacaaagacggccgatttaagtaatcagtacaacaatccaaacctgcaaggctgcaactaagattaaggatggactacttcactaaaatataattctgaaccagaaatctgatatccattgaggctaatcacaatgaagattaataaagataaaatatgtgcaaattatcaattttgtagttgatgccgttttgtgctagaccaatccaaactcgaacttgattttggtttcaaaaaatgaagctctgtggatgggtcctccttccttgcctgaagaagcaaattaatcgcaaaagtacaatcaaaaccacagatcgcattacatactatctgaaaacccagacacaaacttgaaacaaacttagatgagacagaccgatcaaacatgactaggaccacgcattgcaggccaaaactaccatacatcgcacaccgcagcaatcaaaaccattaaacctcccattatgagtcaatccacagataagccaaggggacgaaagtaggatccatggcatattcacatcaatgtcacccttattggatacagacctacagtggcagtaagtactaaataccaccaatataagtcggcgcgcgatagcaactagaataatccgaatggcgcacattggaaccaacccaatagtacatcgattgaatccttcccgtctagtattaactagtgatacgaacgcgcttgaaaccctaaacccgaccaaaagctttgccgcaacccgactgggaaggcccccaaaccaccacccccaaaaccctagccgcctcccgccattcacagtacgacggctgcgttacatagaagcagccagcgatcggcgcgccgtacctcccctgctgctgctgccgcggcggccgcacgagcctctccatgatccccgcgaccgacgcggcgggaggccgcgggggcctctcgggcgtcgcgccctcctcccccgccgccgccgccggcttcttctggaggaaggagaggatcgactgctgctgctgctgccgccgccgcggctgcatcgtcgccggcgagggtcgggcggggggaaggcggagggtgcgagtttgagaatgggagagagaggggaatggagtggaggcgacgaggcggggggaggaaatgggatttttcgggggggaatttgcgagcgggaaatgcttgcggagcaacgaaggcgcgcgatgacgcgggcggtaagattgtttcccgcttccgcttttgggacacgggtttcgatagaggaagaagaagaagaggcggatgcctggacaaacatacaagggatcaaccataccgaattttgacttattttggtactgttggttttaccaaattttggtagagttttaaggaaggaagttttttagaaatgctaaaatttagtaagtagtactccatccgtttcacaatgtaagactttctagtattttccatatacatacagatgttaatgaatctaaacacatatcattaacatacatacatacatacatacatatatatataggcaatgctagaaagtcttacattgtgaaacggaggaagtagtaatagttgaagtgtgtgttgtttgttgcgtaaggttgtaagcagcaacaaactgagaagatccttaaacttaacttttaatgcaaaatttgatcatatatatactcctttagaattatgaaactttaacttttaatgcaaaatttgatcatatatatactcctgtagaattgtgaaactgaggattaagggtttgactagcaaaccatataaaaaattaacgatgcaaaaaaataatttagggtataacttctgctactattttgatgattttaaggtcaatgttaaaaaaatgaaacgaaaaacacctagaataattttaaattaagtttcaaaacttaaattttggtagccgctgtacttagcgtgatcttgttgaccccaatttctgtgtgacccaaatgtcggtgacacaagatgaataattcctctcaatgtttacctgaagtagtactagtaatatgatcaaatcccagctgatccacttctgacaccatcaaaaacagcagaaattcaactccctccaacgcccaaagtacaggcacaaaatatttcacagcaagcagcgacatcgtgataaacagaagttctcataaactagacctaagtggtgacgcgcgcagttgacgcatatgtacaatcaccacagcaactgggtggtaagtagtggctggtgctgcctgctttcccctacctgatacaattggaagctggtgagaggactgaactactgaattcacaagcttccaacaaacaaaatgcaaaagggggcataagtttatctaaggtgagccggactcctcctcagagtctgcaactatcatttcacgatcatcttccgagcctgatagagaaaactgctttgagatagatgttggcctctgcctcattgttttctttgtcatggatcgaggagtaagctgtcctgggcgcatgacgtcttcgtcgtttttcatatttctccgactccggcggagcccttgcggaggcttgtcaaaccgacgggaggcaagacgagtcctcttacgtgggacaaatacttcctcctcttcagtatcacccttgttgggatcataagcatcattttctccatcactgccaacatcattttctccatcgctgcctgacgagtcatcatccttaccattgtagtctctgtcttcatcctcatcagaactcaggtcatcaagggactcgacatcctcctgtccgccatctttgtcctgctccggattgacgtcagaccctccagcatcctcctgtccatcttccttctgctctggaccaatgtcagaccctccattggctcctttattgccctgatgtgaggcacgcttctcttttttgcctgcctcctgtggatcagattcttttgatttcctgcattcaagcacgtgaattcttttcaagaagaatgattttgcatttggattacttgagcaacaattcctaaaagctcagtgctaaataagcatggagaatgtgatccatacttcaagtttgctgtttctaaattctagtaaatctgacatgtcaattcctggaaccaacaagtctcaaacctgttaccagttatcccccccccccccctctccttctaatttgcttatactatcagatgctgctaatgttagtaatgagggactatgctgtaccacaagaaatcgaaggtatttaattgcttatattgttgcagtgttccaaatgttaactgccaacgaactagggggaaaacaggaagggaaagaatggttttaacttacgctgcagcttttattgcctcctttatagaacgatcgtaatcagctgcacacaaagcaaatcaagggtatcaatgccaagacatagcaattggtcacaaaacataaatactttgatcagttttactgagtatttaaaaatagaattagaatatgagcctgttgaatgctgaaaacatctgtattaacctatagcatttgctgcaattcttagagcttgtgttattagtgagagctgtcaacaatcatcattttccactaggcttacagttatatggattggaaacggtaaatgggtaaagtatctacacttctactaaatgagggactggcagaagaaatgagagatgcaacatgaaattcaatgtacccagcaagctgttggttatgcatccagactactattcgtaaaatatgatgaacagtctcaagttgtcatgcaccttgtgtactcaaggatgctaaacagaaagccccttacagtaattgtagctgacaggcctacgttcacgcaatgaacgggtttggaaacttgtagcataagctaaaagttcatccttcttctgctgacgttttaaatcccgctccttcttctgcaaattaaacagacaaaaatgtggtcataaatcataaaagtagagtatgagcttcatatcttgctgccaagcataaatcctgattccaaagtagaatataaatgcattcatgtattggacacccctggggaaatatagacgcaacagagtagaaagcacgtgagctgaaagctaccttttgaagcttctccacatctggaataatttctgtcttaagatgctcgccgatggcagattccggtcgacctttactgcatagtttctcctgttgataccatatgtcaaatatgggaacaaaacacaagctgcacaagaaaatgaacagccaatacacttaccgatatctcaacgaactcatcaaggttagtcgcaactgtttcccactgaatattgataactggctttgtcaaacgaccattctttcccttcaagttgcgcttgaaatcaagtgttacatactcactatacaatctatggccaatagttgagtcaccatcatacctaacaagcagaaatatttcaatggacagtgtcagcaggaaaaaaagaggacgcaaaggcatgctaacagtgactcattgattgcaaatgataacatgaaagtgaacagaaactctcttaccagtatatagttccgttactactacttcctaacttttcttttcggaaattggaaatatcaactcctcttttcatctcgtcattaacataccataccgcgtcattttgctgcaggatagataatgtctatcagaataatgtgcatttaaaagctgaaggacttgggggtatttgactaattagattattaaacctgaaaggaaactgcaattacaacaaggtgaactcatagaatcgttacctctgaacgaacttcacagagtgctttaagtatcaacaagcgtttaatcggatcttgctgtttatacgtgtcaatttccttcctgggtaaacaaataagtcgcgatatgaagttacctaagagtcatagtcaaaaagcttatttacaatgcattatcctgcataccctggattaattttgaacgggtttgcaccttcagcaacctgaaaccaaaatgatgttaatgtctgggactgctctagttatatttacactagtaaaaattttatgcaaactaaaacatacccatgtccaccaatctgataatttcttggcagttgccgttatccatccatcatcgaccttcagatttttgatagttggtggtattccctgatacacgtgactattacaacttagcaaacatcatttcagacaaacatggcaaaacagtaacataaacaggcttattcgtcattacatcaacaacaaaaaaaaatgaaacttagagaaaagaaaaggtatcataatatttggtctccctaatacagggtagtaatgcagtataagaataactgatgcaaacatcttgttactagtacacaatagctcaataaggaaagatgcctcccacagcaacgcagatgatgcaagcttgttttatttgtatgtcacgtgatttagaaatctcaaacaggcatgtccataacagttaatgaagttaatcagtcactatgtcactgttttttaacaagattaaaaaatgattgattgaacttattcagtactttcaaaagaaaaaaaaagagaattacatatagataaagttttttaaaagataactatggagaaacaggttatggtttttgacaagcctagctgattacataacctgcaacttactcggtgattgcaaacaaaaaggacaaggacaaagaaatgaagttttttccctttttgcagaaaacctgtcatggtttgtgacaaggttaaagattacatagaccaacgcaagtgtgtattcagttcaaaccctccctgcagatacacaatgcctctagtgcaaagcaagcacgaacaaacctacaggcagagtatctgctgccttaaacaaatcagatcaccaaactgtctacaatgcaggcattctgcaatccaaagcctacacgatccaaccataactacagaagtcaggagtgcataggtgcagcctgaaaaaacaaactacacctttataagcgcaatatggatgcgggcaaggtcgtggttattggcgatgagcgcggtctcgatctcctccgctgatagccccaggttcccctcgatcaccggctcaaacacctgaaaaccaaaaaaaatccccaaaccgaaaccccgtaagcccaacacgccaataccaatccaacccaacccttgaagcaggagagggacaaaaaaaaaagaaaaagaaaaaaaaaggaagccctagccgaaacggctcacccggagaaagtggagcaccgacgcgagctcccagctgcggcggaggaggacgcaggggtcctccggcgccggcggcgacgcgggggggtccaccggggacgaggccgggggcctcgcgcgcttcgccggcgaggccatcgtgcggggactggaggagacaggcgggaaagtgggggaaattttggtggtgggaggcgggagggaggggaggaaagtggagaggcgggggaggaggaggagacggcgctgcggctcgtggggcggtggcggtttatggatggtgcgggactgggagagtgtgggtgtgggcctgtggggtggtcgagtgggcttggctaccatttgggctttctgtgatgggccaaaatctgaaatgctgtattcgcatgtgtccggcccaaatctgatgttaggtaagggttatacattcatccaaaataaattaatctagaactgaatgtggtatatttattacgaatctgaaaatatgcatgtctagataatctatcatatgccaccgagtttaccttatttcaactgtttgctatcgactttatctccttttgtaaatatataccactgaccttgttgttttctacaataattttcaagaattgcctaaaatgctctttgagacatactacaggtgttgacaattgttcgatccactataatttaaaacaaatataaaaaattgtatttagccttagaagcttgtgtgtgagattttctttcatgctttttgaaaaaaaatgtgtagcatatgaaagagaaatcacatacatagaatatagccgcattagaaaaaaaattatagcatgtcaatgatgatgtacagcagtacagaaaagaacattaacacgagagtactatattaacaaacataaattacattttgtttaagttcatacatgtaaaatgaaaatcttgaaatatacacacacttctatattatgtagaaggctacataaaaaaattcatattttattgaaacttctagtaaatcaattaattgtaacatatattttcttgaaacttctagtagatcaattaattgtaacctcttataagccttgaaggtattattttgaaaagtattcaccccaataacatattatagaaaaaatgacaaagccagtgccatttataaagagagacaaagtcgatggcaaattgttaaaacggagtaaactcggtgtcatatagtggattctctcaaaatgttaactatcgctccctgtaccaataaaacttacaaaaacttagccaacagtatcgctgtaaaacaatcacaggacaacgttgtggagaaattagattgtatgaagattataatcataccaagtaaaatctctgatcaaagagcaggtagtacttagtaagccatgtcttgatatatatatatttaagtgtaactacacatccactcaaacaatgtgtatgaagcgagataggtacacgaggaaggaccgccagggtgaggtgtggcatggtgctccgggcacagccaacaccgggctaagccaacacgaggcttcgcgactcccgagccgaagaacggagagaaataatttcctctacaagcatcgtccgaccttgtggtaccacgcgcttgattgccaactcagttcggctccgatgtggaggctttagaccactggatagagtggaacattaggcttggccttattgatgttactacttatccatcaagaggatgtacggtttggaaccttatagcttgttggtctataatgttgttattggatttaactttttttaatgggataggacataaacaggaatggcgaaaagctgatagccatatatgaatgggttacagatgggatagtagagggatgagtaccatgaggaaagtgaaagacatgttaagtgttaacgatagatttgcacagaagaaagatagcttatgtcacgtctcaaatctaactttccagttgcattttattttcttttctgccacttcatgttatatgatgctatgaccaggacccatggtttctgtcgattataattaaaaaatgctattgtttaactaaggaggtgtttgacggtgctatattatccgtagcagctgcagttgccaccggaaaatcctcttttgctttttagcgtataaaattttgatttatacgtattactccctccatttcaggatataagatgttttgataaagtcaaactactacaagtttgactaagtttatagagaaaatagtacttcctccatctacatttgatagtcgtatttcatcttagcacacagaccaaggataagtaattttacttatcatccatttaaacatgctactagtcattcctcgtaaacaagcgattcattaatatttacatttctcaatgcccatgtagccaatcatgtgtgaaagaatggagagtcatgcgagaaagtcattaagatgatagtttgttgaattgaaatatgactatcaaaaataaatttttcagatttagaaatataactatcaaaagtagatggagggagtaatattttcgacccgagataaatttataaatattattttttttataaacttggttaaacttgaagcagcttaactttgaccaaaatcaaaacaacttataacctaaaacgaaggtagtatatacttatatttatatgtataaactttgtaactaaatatatacacatatgcttatatacacatctatacaaaattatacattatacatataaactttgtattcgtacatataaaattacacattctttagacatataaaaagtttatacatatacgcacaaactttatgcatatacaatttgtacgtatacgtatggaacgcgatgcgctgatcgtggattagcattttcgactaggtagctacatatagcattatcaaataccctcacaataataaatatctaattgtccttctaaagcaagtatttcctacgtatgttgaaaaaaaaacttatctttatatcttgggctactatgaaaaccgaactatctttcattagatacgcaaatatatattcatttgattatatgcattattatgaataagtgcgcgtagcgtataagcacatgcagttatactgtgttttaaaaatacacaatcatatttatagtcaggtaaacgtaaacgtaccatgtattcatttatgtaccgggcctgttcatctgcactatagcaggctacgacgcagtcacctcacacggtattttgtgtagcataattatgtgttggattgggatcaggtgcagtcccaactacaactgcacacgttagggactacacaggatcatgtccatttaaattttcaatggaaggttcagattaaatgctacagtagcattggtataataatttttgttggattatctaaatgaacagcgctctattaaatttgggcctttgaatttgcatcctgcggccatagtataactgtctaagttgcagtcatagtaataactgcataagaattaagggtctgttcactttgatgccaaaattttgacaggatttcttatatagttaccaaaatttgacagcaaactaaatgtagccacttttttttgtaactttaccaaaatttggtaaggttgtaaatgatatcaaagtgaaccggctccaaatccgtatgtgttgtagccgctttaacatgttgccgaacacggctgctgcaactttatagagatattatccttactaaataaaatacaccatcgatgtccgaagaagaaaggaaaaatcatattgaacgatcaaaccattgtcgccgtatgttggtacacggtattaaacgtgccaaaaccatcttccccctccccacagacgtcaaacgtggcgaaccacttgacaccaacgtgtgcacgtctgacttcttgcactccctatacgtcttgacccccccaccccccaaacgcccaacggatccttctggaacccactcgcgccgtcaaaccaccaccgcctccgtctccttctccgttcccgtctccgtctcccccagagagctctcgtcgcgcgcgcgcacttttctcctctccgactgcggggcccaccagtcagaagagaactctcctggcgcctctctctcccccaaccccaccggatacctgatccgggccgtccgttcgatcgatccgacggcggagacgttgtcctgggctcccacggcaggaattggatggttctagaactcacccgagtcccgaccaccccacccccaccaccacagccgcctctcatatatcaagcggccgcccacgcgcccctcgcatctttcgcgaaggcgattcaggcgagaagagagagagagagcgcgaggccggcggttctagaagcttccagacccttcggcgcgagcgagctcacctcccccgtaggtacggcccacccttctcttcccaggtcgcgccgcgagttggatccgcgccaccgcccgcccgtggatctgatcgtgtttcggcgatttgttcgttgcgtttttgattttattttatttttttctggggtctcagcctggggggatggtttgcgctgctcgggtttcagccgcggagggatgatgtttttcgttgttattttttttttcgcggtagctgcgcgggattttgactcgctagggttttagatcggtcgtggtgcttagagtaatctcaaatccttgaattgttacaaatttttatttttgcagctctgcagatcgagatttatgtgattttagtgttgatgtttaggtggttataggtttggatcctgctgtgagtaactcgtagatcctgatcctgattgattgtatttatgtgcgcaggagctgttcattagatctgaataagggggattgaagcagtgaggagaagatgagcgtggtgggctttgatctagggaatgagagctgcattgtggccgtcgcgcggcagcgcggcattgatgtggtcctcaacgaggagtcgaagcgggagactccggctattgtctgcttcggcgacaagcagcggttcatcgggacagcgggcgctgcttcctccacgatgaacccgaagaattctgtttctcagatcaagcggctcctcgggcgcaagtactctgatcctgagctccagcgtgatattgcggccttccccttccgtgtctcggaagggcctgatggatttcctcttgttcatgcccgttaccttggtgaagagcgggttttcactccgacgcagctcatggctatggtgctttctaatctgaagggtattgcagagagcaacctgaatactgctgttgttgactgctgcataggcattccggtgtacttcacagaccttcagcgcagagctgtgcttgatgctgccaccattgccggcctctgcccattgcggttgtttcatgagaccaccgcaacagcattggcatatggtatttacaagactgatcttccagagaatgatcaattaaatgttgcctttgtggatgttggacatgccagcatgcaagtctgcattgctggttacaagaagggacaactcaagatcttgtcgcatgcatatgaccggtcccttggtgggagggacttcgatgaagtcctgtttaagcactttgcagcgaaattcaaggatgagtacaagatagatgtttaccagaatgctcgtgcctgcattaggctccgtgtggcttgtgagaagctcaagaaggtgctgagtgctaaccctgagtcaccaatgcacattgaatgcttgatggatgagaaggatgtgagaggttttatcaagagggaagagtttgagaagattagtgcatcaatactggaacgtgttaaggggccactggagaaggctttagcagaagctggtttaacgacagagaatgtccattttgttgaagttgttggttcaggttctcgtgtcccggcaataattaagatactcacagatttctttgggaaagaaccaaggaggacaatgaatgcgagtgaatgtgttgccaggggatgtgcgctggagtgtgctatccttagtcccacttttaaagtgcgagagtttcaggtatgtgcccgctttcaccctgctgccttctctgctttggctatctgcacaatacattaatagaaatcttgctgcttcatgccttaaaatctctaattaaggattgtttaagacgctcatcctcatgtgcaccgtcattaaagtttaattggatagtccaataagatttgtctccttacatgactccattaagatcatgcaaccatcaccaatagttattcatagtgtcgtaattttcatgacaattttatccggtactccaatgaaactgtttccttaatatcatgcaacctctagttataaccaataggtttatgcagaatgttcgtcataattttcataacaacttagcgtgatacttaacatgactcaaatatcatgcaacctctattcatgagttttgtgaccaatatggcttattatgcagaatgttggtcataattttcgttgtaatttaatctcatactccaataagattgtttctaacatgacttcattaagatcgtgcgaactcgcttatgcagagtttgtcttgttggctccttgaatctgggtttacccaccaatttaattcttgcctaataacattgctggaatctataaagctttcagcatattcttactgtttaaggataacatatgcactgaaggcctgatttgaatgagtagtatttggttcaaaaatctatttcactcccttgaagtcttaaaattaaaacaaatcttagtatactactactcaaaatcattttaggataacactaacactaggatttttttctttcgtgagtttacaataaatcatcctagttcttgcttgtacaacactaaagtatgttttttccccagctataacgctaaaccctgtgcaggttaatgatggtttccctttctcaattgcaatgtcatggaaaccagactctcagaatggtgataaccaacagactgttgtattccccaagggtaacccattgcccagcgttaaagcattgaccttctataggtccaatacatttcaagtagatgtcacgtatgttgatactggtgatttgcaaatatcaccaaagatcagcacttacacggtaactgacttaatatttccttttttatgttctcgaatgtgcttcgagtccaactatcgtgtattgatcatgttcttttgttgtgtgtgtttatgttaatgtataggttggtcctttcaatcccggcaaaggtgacaaagcgaaactgaaagtgaaagtccgccttaacatccatggggtggtcacagttgaatcagcaacagtgagtgataatgcaggctgttttttttttgtagttcttttcctaaatgattttcgttgaaataaatctgagagtatttctattggtctggtgcagatgttggaggaggaggaagtggaagttccagtagcagctacaactgagcctccgaaagattctgccaagatggagacagatgatgcacctaatgaagctgcttctggaactgatgtaaacatgcaggaagccaaagcccctgcagatgctgctgccgannnnnnnnnnnnnnnnnnnnnnnattctgaggaaaaatcagtccctatggaaactgatgccaaggtaaattttcattactgacaaaatcttgaattatcatgctagcaggtgcctgaagccttttaatttgaaaccttttgctttttgaagtatcatcagtacaaggtggaagttgaggaaacagtattctggacatgttttttattcagagctaacatatcttgcctttgtagtttatatttatagataaccttttgaagcttacatgcgcaagctgatctgattagtccactgcactgttatgccttcgatttgacactttccttgcattgattttatcacgactttttccatgccaaccacaatgtgccagtgtgcaacaaattcgttgcaattgctgtttttgtggtagttatctatcattctattgctgaaactatacttgatacaaatatgatcattctttactggatccttcctactgtggttcaaaatttggttttatcttttcctcaattcctcagtctgtttcagtttgccctaaagggacaagtgaattgatgaaatgcgatgaaggaaaaagtaaactgtatcagatgaactaacagttggcacattttgatgaaaaaactgcaggttgagccatcaaagaagaaagtaaagaaaactaatgttccagttgctgagttggtttatggtgccttggggactacagagttgcagaaggctgtggaaaaagagtatgaaatggctcttcaggacagggtgatggaagagacaaaagataagaagaatgccgtggagtcttatgtttatgacatgcgaaacaaggtttgatcgattccactctttcctgacttcatctttagttagaggcagaaactgataatatgttatttttcagctgtatgacaagtacaatgattttgtgactgctgaagacaaggaagcattcattgctaagcttcaagaggttgaggattggttgtacgaagatggtgaggatgagaccaaaggagtgtatgttgctaagcttgaagaacttaaaaaggtttgtctctttcatttattttgctccttacatcttgttagtttgtatattaaaaaaaagctatgatttttggtcacaggtggggggtcccattgaggcaaggtacaaggaatggatggacagaggcccttccatcgaccaacttgcttactgtatcaacagtttcagagatgctgccttgtccaaagatccgaagtttgatcacattgagatggaggagaaacagaaggtattcaatgcatcaactacaaaattagcacaatatcttttctctatacactgattgcaatgctagttcacgaactacgttctgctagtgaatggtaacagaaataaaatccttttattagggttacaaagtaattgacatacgccctgcttggccctacattggattatagcaattttgaatgaattgtaaagcttgatttttcagaataattttagatagacttttcactcgtcttagttgatcccaccgatagacggtattaaattcatttgcttgtcacatgcaggtgattaaccagtgttccgaagcagaagtctggctgagagagaaaatacagcagcaagatgctctgccgaagcatgctaaccctgtcctactctcttctgatttaaagaaaaaggccgaaacggttgacaggtccgtagataaatctctcttgacgccacttgctgttcctgtatcctatgtttaagcatacttctaacgcccattctttttacaggttctgcaaaccgataatgatgaagccgaaaccagctcctaagccacagacgcccccacaaacgccaccgaccgagaccccggctggcggagcccaaacaccagagcagcaacctcagggagctgaagcggctggcgaggccagcgagggcggcgccagcgaatctaccggcgagcaaatggagacggacaaaccggagggaactgaagctgcctaggctgcagctgcggaaacgtttttcagtttcctgcaagttgctgctgctcggtctgcattcgttatcagattccgacaccgaagttcagtagaggttcgctagggatggatttgtgattcaccatacttcgtgaggatcatctgcgtgaacgtacgtttaggtttatatcctactgtaccaatgtgttgttaaaatcggctttccctttttaatttttctgccaaggggttttctttcaattcgagatataagggcacgtttcagatttggtgtcctacggggtgggtgttatagcgggacttacaatggaactcaaatttttaagtccgatgtatcaactgattcttgttccatgggatttgcacgctcttctggacttacttttgcatgtgttaatgtgctggcctgggtttaatggcctgctagtgtgcattcttttgctgctggccttggtcttgggtgttttaagttttaaccggtggctcgttgcttctgcttgcgctcatctggacgacattttctccattaggacagggtagaccgtagacctagagaaatcaagaggctggaagggcactaaacatcatcagttactgatcaaggtcaagttgcaactgtgatacaagggcccattggtgcaaagggagccttgtgtgctgtggctgctcgcatttgttgtacgaggctccagccggcccactagtcctgtcgtgcaaagcaagtatggatgaaaacggaaaggatagttttcgttcgttccgaagaaaacgaatacaaatacgggtatgatactggggtttccgacaatatagatttggaatcctgtgaacaatactattcgggtatccgttcaagcaatgagatatactcaatttcttaataaccctacgaccttcgatctacatctttttatatttaatagtagtctatctttcaacactagtccacactattaatattatttaaaattttattattttataaattatattatattttatataaaacaagctaattatatatgatgatatttatttctattataaattgaggtgattttcgtgttttcagaaaaaaatgtttccatattcgtgtttgattatattcgatctttatttgtattcgagataattcatatttgtttccgtatattacaaaataatatgaaaacagtattgcatgattatccgttagttttcattcctagttgcacggaagtattcgccaaatacttcagtgttaaattgtaacgaatgctagacaacctcatggcgaattacagcggggctaaaaattaatagacgctttaaatagttagagagtgtagcttaattaaccgatatgtagatagaaccctatcgaggatgtatatgtgcatattttcttggaataattaactattttttcttaggcatgttttgtatgtgttgggcgccgcgtgggtgtaaatgttattgagagagtgtgcgttgcacgagtcacatatcatatgagatacgttgaatatatatagagtaaagttctgtacatgtgttaagaaaaactgtacaaggtctaatcgatatggctgttttcttccccctattttactaacccacatatctcgtttttcgcgtgcacgtttttcaaactgaaacggtgtaatttattaaaaaactttctatatgaaaactgtttttttaaaagaatcatattaatctatttttttaaaaaataattaatacttaattaattatataacaatacgagcagttttacgtgccgggaggagggttcccaccccctcctccagaacacagcatataggcgcttggctcatgcgagcacccacgttttagctcctcattttttcgccccaaagctatagataaaattccttgtgatagaaaattttctcattcttttcctttcatatctcctaggaaacgagggggatgaacgagtgaagactatgttttggcacatcgtatgtgtttgccatcgtttccaaccgttcgtgcactgaagtggtgtgccgccagcccgccactctgttgggtctgaatttttgcacatccatgtagtagtgagcatcctctaaactctccttgtgtatcgacattaattgcactgtaaagtggaagactatatatctcctacacttgtcaacaactcgacatagggggtatatggagttgttggattatcctcgaaccggtagtctatctggggcccatactttggtttggattactagccaagcaaagcatttgtattttcttggtgcccacagcttccagataagcatgccaaagttggttcggaccaacccaaaaaactatgcattgtatgccgaggcaatttgtgtgtacggggcatggtagttgtgtatggggcatggtccgtgagtttccacgaggtctggtcttcctccccctactcagatgtttttatcaatgcaactatattagagcaggtacaatagcagactataagccagctgcaaacatattttaaggagataaatgaggagagagaagggcagcgggctacagatttgtagccagctgtagcacggactccaagacacagtgtgtgtatgacaggtgggaccaggtactaatagtgtagtatataactattgtatgaatgagctattagattggctatagatgaattggagctagtagttggctatactattgaacttgctcttagtactagtactcatcacaagaaatttaaatgcttgctttggaaaagatgactaggaggtaatcaatgagggcagcaatgtaatttgccatgtcttttactatctccgtccttaaataaataaaattagttcaatttagcccaaaaatgtgtccctaaaagaatgtgcagtggtccacagtccactagacttttttttaatactatgttttcttctcatttttagtcgttgaactaataatactcctctttcttctcataatctcattttctttctatatcttttaaccccttacttaataatccattcgttaaaaaaatataagggattttgaccggatgtgttacacatcctagtaatacgaatctagacagaacatatgtcacatcagattaaaatcccttatttttgagacgaagtgagtatgtctttgctagctaaaagcctaaaactacacttaaatgaaatgaagggagtaatacagtgtgagatttgttagaacgacatatgtaaattgtaatagagggaataatataaatgcattgcttatggttagaaatgaaaatagcagttacgtttcataaattattttgaagcaaggccatggcaccttggcacgatcgatctgagcaaggcttgagtatacatgtaaagagttgatttttagcattcaaaatctgtaaaaaaaaaagatccttttatctactggagtattggtctactgcacaaagtacaaaccaaagtagtattaaattaacgagcattatccattcaatacctctcaattaccttcctaaacaataacttttttttattaatagagacatttttctcttcatactaatttttcctataacggttataaatgattttttttgagtactccctctatcctataatataaggcgcggtcaaagttggcacggtctccaaaactaatatttagcttataatttctcgtatgctataaggtttgtagcaacaaaattataaccgtatgaaagtaattttaaatctcaatctaatgatataatttttaacaaataaaattcatttcatattatactaagcgttggtcaaatgttttaaatgttgaatcttgaaaatgcatgtgcgccttgtattatgggatagagggagtagtacactttcaagttttaacgtgtgtctacataaaactcagagcgacccctaacaatttgaggattatatatgtgtaaaatgttaaataagactttatctttagaaaatactaatcgcatatataatagatcaagcctaaatattttttttacaaaacattgggatgggtctctactacgcatgcaaccagtgtccctccataaaagctacgatcaaataatactcttttctttagatatatcctactatcaaacgaacaagaattgttcacaaccataacacttagagctatgtcaaagaagctcacctacctacacatcaattcagtttattcttatttttagggtcatgtatagtcgctgtcatcttacacgtgtatattacacgtgtatagagacagatcttgtaaaactacgtacacttctaattgcgatgcatttagtataacttaaaaatacacttatacagagaacacaactaaaaatgcgaattttgataccttatggtttgtgtgaaacccacaagcatgctttgcacacattttccacccacacaaataattaactccaaaaatgaaactctcaaagcataaattaaaccaagcatgcccaaattaaggtgcaagggcaagggcaaggtccctcctttttctcccctctttcccccaccaaaccagcagccatcaccgcatgcgttactacgtgtgtgcatggcctccctcaccatcaccaccagcagcagccagcccaacgtatactccactactactactactacgtcagttacactccaccaccgcgtccgcgtccgcgtctcgccgctcgccgcccgcgcgcgctcgcgtctctcgcctcgcatgccaagtgtgcgccggccgccgcgccgcgccgcgccccctagcgcgcgcgcgcctcctcatgaccaacgggaccccacccaccaccaacccccgcttccgcgtcacgtccgatcgcctccgaaaccacacggcgccgcgctggcgctctcgctctcctcctcgctctcgctctctcgatcgatcgaatcgattccgctctcccgaatcatcccctcctcctctcgatcccctctcctctcccctccccgccgcacgaaaccctagcaaccaccgcgcccgcgcaagccaagatgcctcttccccgccgcgccgccaccgtgaggatccgccgcggccagatccaccgcgtcaccgccatgccaccgccgccgcagcaagccccggagccggccgggctgcaactgctgctgcagccggaggtggtggcgccgaaccacccgccgcccgctccaccggcgccggcggcggtgcccgcgccgccgcagccgcagggggaggcgaggtaccgtaggccgctggtgcggctgcaggccgtccccaacgaggaccacgtccccgacaactacggcgacggccccgacgagctcgggatcacgccggcggtgtaccaggcgctggagcgccacctgccgccggatctcgccggcgcccccgccgaggtgaagcgctacttcatgcgcagcgtcctccgcaactacgtcccctcgccgtcgcagcggatcagggtaagtgtagctagtatacgcgcttttactatttaggcgtctcattaattaattcatttcatcaaatcaagcttcattaatttttgattctctagcagctatagtcataaatgcagtttaatttggcttcatgtacgtagtagtcagttttgcttatttacaactgttttaagtttaattaaccatgagtagtgtgtcttgctattgcatgcatatgatgagttggatatatagtgttagtgtaagtacatacgtagtgtgtgttgttaattaattaagatgaattaatcacgtcgtaacttatgtataatctggaaactcgtttgcagacgcagaatcagagggagtacagggaaaggatcttgtccgcataccaggtacgtattttcttaagcattcatttttttttaaaaaatgcactcttgcactataatcaaaatgtatacacgtattagataatatattatgaatatgtagataggaactcttttttttttgtacatgtaaaaatgctactccttaattacatgctatttgcctagctagctagctaagaaagtattattgcttgaaatgtgccatagacacatttgaattaaaaagtgtgagccacactatttgcacattttatatataggtgaacacacaaactcataggtatatcatttaccctataatatgtacacttacagattttttttttcttattggatattttcaagccattacatccggagctgtacacaaatgatccatcaactttcatcctaccggcatttcttcaagccataaatggcaacaccgaagaaagcatcacaagcataatgatggagccagcaccgggagtgtttgcatttcctatgctgaagccctcattctgccagatgttaatgtcagaggtatgtgattatattgcagcatggaatatcattttggatatatcatgtagtattattttgctgctaattgtggacactaattaattagctttgtaaacgtatatatataaggttaagcaatatcggtaatgctcgtgtggtgtttattctcgcaggtgaacaattttttgaggtgggcacaatcagcgaatcaaaggataatgagaccaacatccttagataggcatgggagaggtgctgccctctctgattttggcttgcaagagatgttagacaatctgatgaaggatttcatctcaccaatgtctacaggtcaattacttgtctcacaacttgattttcttgtaggataggaaagtagattaagattatgatattcatgtatcaaaattttcctttctttaaaatgaaacgattaatgacttaactccttgatcatgcagttcttttccctgaagttggcggcaatacactggactcccaccatacattcgttcttgagtatggtgaggctgatggtgctagaggtatgctataaacatgtaaccacgcatctatgaattaatgactagaactatatataattgtgctacataactcccttagttcattttacatttaagttttagaatatgtgttgccatactttgatcatcatatctacgctctacactatatatctagctagattgatgatataaaaactatatcaatagatttaaagtgtgaaataaccttaataatattttaaatttttaattagggagtaccctaaatatgtacttatagagatatatattacatgtcgacactcaaaccatttgtgtacatgacatattacacacacttttgatgcaagcgcatatatagctaggaagtaatgttttaccatcattttcacagtagctatgtactctctctgtttttattttttgaaaaaaccaactacttctgccacatccaagtactatggaaaaaaaaaaactagtgcagtactacgtgataaaaatacatcaataattaattctatatctgtgtctcctgtagctatcggaaactgtgccgcacacacgatcgaggacattttggtcttttgttgttagcactaaatttgcatcgggcttttggaaatcttttttttttctgggacatatataggggaagctatcaagctatgcatgtagaaattaaaattgctgtcctgaggtaacatattaacatgatcagctttttcttatatattctaaacaacaattgatggagattgcaggtttccatgtggatgatagtgaggtaacactaaatatctgccttggcaaacacttcactggcgctgacatgtacttccgtggtatacgttgtggaaatcatgttaattcaggaacacatgatgaggtactgattgatgtataatttgtaaattaaattaattatgcacccattttatttagatgcccattaattgccatggagcaatgcaagtttttagtaaataaaaaaactattttcttttagtgttaatgctgatcatatcatccaaacctttttattcctttgagcatttctcctttagccttaacttttctattgcttcaggggttgaaccccacaagtcatctacatcctcaccttccttgaacttagctttgtttctttttctaatccatcagtcaaacaataacatttgaatgagaggatgcatgcatggctatgaatatcgacaaaggtgttgactaaagcttgactgtattgacggccatgatgatccagtaatggttggctggaagacatttagagcgagtagaaatgtcaacactatcacaaatacagagatctctaacagctccatgaaaaagaaatccatttgagatggttctaactagatgtcaaatcactaaaaattaatctggaatgggtcgcccaatattgaacccgccacaaacgatctttaatatctcctaatttgcaaatcattacagatcagtgaataatgaatgcaaagaagaggttgttcggagctaatctttatgatctaatgcttaacctataacatgatcatgtaattcataatttcttgtgcggaatttggtatacgagaaaggcggtggctgtctcgcagaagagggatggatgagacagaatcacgagagagcgtgagggagggatgatgacagtgggcacgcatgctagggtttgggtttggggaaggagaggtcaaggagggagtaggaggtagcgggcaccaagtgcatgagaggtgacccaatcgagctatcgtttccagttgatacgacgaccaatagctgatgcgtgctcggatcctgcctccgtgcatggggcaatgttgatagcgcaagaggcgagcacaccttctcaaaatgccatgtcagcactagcttggggaggggggggggggtaatcttcaaagccattagaacctctgtgtagtcaattgcctcttttggttttgccattgaagtagaagcagtctctcgcaaatatggttgctagcttgatgaccatcgtcgctagtggcagtgataattaatcttgtaggtgtcaatgtccctccagggcatcacctacattgcttgaaatggctgtttgggtctcctccagtgctagtgaggatagggtttcattaggttttccgaaagtgggcttgccgtgtgagagattgtcgcttcacgcacagggccggtttcccccatttaaaaaggccttgcggggcttgagggcatattcacaaagaatgaaacttgactccgatcatggggcgtacgtaagggaagtgatcatacggctttggttattcatgcaagatcttgttagggaagtgcacataatcgtggggtgggccacttcccaaacgtgattctcgggttagccaagatcaaccaatagggaacatggttttccccttcgttcattggtttaagcaataaatggatttcggactttcttactattattattgttttttaaatggagagcattatactttactttatcttatcactaaaatagtagacaaacataataagaacatactgcatcccacattccaaattaacacatgcgtacgaatcaaccgatttctacaacacaaagacaattgttaaacactttgttctttgtctactggtgtatagtgggggccatataaaccgatgaacaaattagcaaaaaatgtacatagctagaattgtatagaaattctagctatgtgtgatatttatccctggctagaggattgaatgtctactatttaattcttttagcacttgtatagcagatttttatcagattaattaacacatggaatttggatgtctgaaaaatttctgtaaatctgaaagtaggtttttatttatctataagtaggaaatatttccgtaaatcttctgtaggaaaagtcatgttaaaagagatcatatctacatctaataggtttcaaaattgcattattctagtttgcagatgtgtttttgtgctcatttcctttaattttgttactgttaatgcatgattatgcaaattaacatttgacatcttatttttgcccttcaatacttatacgattcaggagtattttgtacatcccaacgtgcccggacaagtcctgctgcatcatggtagtcacaggcatggtgtcttctcagtaacatctggacggagggttaacatggtcatgtggtgcaaaaggtaacactcaatgtaatatttttacctatatttttcttgtatgtacagtatgttggctactttgtttaggtgaattaatcaatataggaattcatatagtagtatgtccatgtaaaatcatgtcccttagtttccaacacttctaataaaggtgagattccatgagaaataccagctttcttgtaaatttaattaacctgattgaattggctgttgttaatttctgggctgatctggaatcatacatgcatgaaaaaccctagtatcacctcaatttatcgatctgtagctgaagtagtgtttcttgtatatacagctcagtgttcagggagatgaagaaattcatgactgatttttctgggttttgttgcgagtgccagtttcagaggacggcaagacaggtgcaacatcttcaggaattgacggtttgttacttaacccaactccaatatatagaaaagtagaagcgatacatatatacatgaatattcagtaaattgcaagcatgcagatgccatttaatttctgccaactcccctgaagttggaaaccaataatagcgagtacatgaaacatttaatcaggataaatattgataaacacactggaatcaatttaatcttatatactcgctttatttcagtatagccttgctaggatttttgtaacaccccacttaatttccattaatatattggccatcataagatagcatgatcttttacctttgcttctctattcaagttgcaaggcttaaatattttatttttcatatgaaactgttacattacagttagtacctatatatagctaaccagcttgactactaccattctgaaatcgtttatgatcacttgaaatatgcaggctcgtatctctatcagcggacaggagtcagaagacgaaactccttaattaatatctgtccgatcgagttggccggccaaccagttcctgaacaattatgaacagtgaacagtgaataattaagaacatgttgttatgtattgcatgctataccgaatttactagtgttttcaatgtatgtttgtatgaacctagctactggttcattgaaaacttgctgcaactgactcgattggagctcaggattaaacaacttagccggttagagcctatgcttggttaattttcaggttgtgtttggttaattttcaggttgttggtttgatttcttgggttatttttagtttatttggtgtatagtggagagcggctgttgagttgcttgttgctctagatctaaggagtagccacaggaggagaattcgatttgggtgaaaaagggtgagaatacccatattttacgaccgaaactaagtcaacaaccacttcaagattgacaagagagaactgttttgccgcgctattaaaaaatttgcccctccatgaaatgacatgatacctagattatgagtgataaaaggtgcaatcttccgatggcgcaaacaaacaagatgtaggtgtaaatttatgggattgttttgtcgttttattgatttgtgggatattgagaggtacatttataggatagttttgttgctttattggttactggatatatcaaggagttgcggttgccctaatttataagcgacaaaaaagattgaagcaatcttttaatggcatggacaagcgagatgacatgtagagtggatgaaattgctcgtatgctaacactgggtgctccttttttagcataacggtttcgcttacccatttaggcactagtcctttccctttttataagtcagtgatttagttaactacccacaccgtacgaacactgcccatgtacttgtgaatccacgtgctatttgacttaagcattattttcagctaggccttgagcgtacgggactaagtgcactatcttttttattaattattaatttgttttggagttattttgaatatcttctgaaatttgagtacaaattttatacctttcatgtgaaagttttgtgcagaaactctctctctctacacacacacaaatttcataaaaccctaaattttagggtacacgtgacataaaaccccatatattgtgatttgtttcaaattatcgcaggttttaggccaaaatgttttatttttacgtcaatactcatattcattattacatatatgatattttaagtatatatttacattggtaggataataaatttacacacgcttctctattcaagttggaaagctcaagtattttattttttgaatgttattacaggtagctatagctagtcagcttgagtaccattttgaaattgttgctcgtatatctataagtggatatataggacgaagctgctccttaaatcttaaataactgttggagccaaccggtccgtgttgctccgcgagcaccagtatgttatgaattctggacaatgagtaacatgtctttatgtattggatgctatgaaataccaaatttaattaccagcattttttatgtttgtttgtgtgaacctaggtatatattggtttaaaaccttctgcaaactgaggcgattgacagccaagaatgaataacctagacctgtgcttggttaatttttaggccgttggtttgatttcttgggttagttttagtttatttgatgcgtaaaccgaagcatctgtacatttaactagtagctaaggctgtgttttaaaaaatcatattgatctatttttgaaaaaaagtagctaatacttaattaattacgcactaatggactgctccgttttccatgcgcactgtgcatattgcaaacatatgattccaaagacaaccttaagtgcagaagctaagtaagcgaatgctgcaacccttccagcttgacgaggtatataacagttttgccacgatattgagaattttgcccctcaagaaattatatgggacctaatttatgagcgacaaaaagatctttcaataacaaa

SEQ ID NO: 38815 - DNA, 11320 bp, Oryza sativa
ccatcagtaaaaagcaaatttcagaccaaccaataatcacacaggatatatgtcctaaaaattcaccagtccatgacttcatatataaaccattgtattacccaggaaaacagtgagcattcagtaacatcaacatccagtccaaagtctaaaccatctttagtgatggtaagattgatgcccagcaccagcaccatagccatggccggctccaaatgtcgctccaggtccaccgtacagcaccccagcacggcgcgtgcccatggagcttcccggtgcgaagtgcggccgagcacctggtgccggtccgacaaaaccggcacgatcggtgtaggggaaagagtgggaggccgggttccgaaaagatgacccgtagttcgagttcgagccccttgagtacttggagggagggaaggactgaggcccggatgctccccgagctcgcttgttgttctggaatctgttcatgccactcggcttcctcctgtcagccttctctttctccatccttgcgaccttcttccttatgccatcgaggttaaatgctgatgttagctggcatgtctcgacacacctgatgatggacttgtaggcgttgcactccgagttgtttgcctcttcctgagaaagaaaacatgagcccttctttagtatgagagtatactaatgtaggacagaacaaataacaaaagatttggtgcaagagacaaaatacggtagaagtccatgaaaagaaatgccaagtaaatccaacactagagatcaggctggactagagatatataggccaacagctctccaaaattctcaacagccttatactgggctgttatttgttaagaactcaggtaaaatacatttcgaataaactgttaagaactgaaggtagaccgggcagggtttcgcagaaagtggtatgcaggtactgctagcatgctaaacctgctaatattaagtcacaaactgacagaatcataggtggtttgacaacgatagtagtaatattaaatcacatatagaccataaaaaaggaactcctcgtgcaggtggaggcttcaagtagagaaaaaaaggacctgcctaaatgagtcatgcaaaaagatatgctaaacagtaatacataaggcctctgactaaatagaatcatgtgctaacatagtaacgaaaaatacctctgcctaaacagaatcatgcacaaaacagtaataagaagatatattgggatggaaatggaatggagagtcttaccacaacagaatttgaatgtcttccacctctcagtgcaacctgagtcttgttagttattctctttatataagacttaagaagcggtacaggtggaaatcgctcaagcaaaccagcctcatgggcgatatgaatagcttctatctcatttcctgactttatgaattcctcaataacatctgaaacacaaaaccatattagttttgtcatgttttattttctccaggttaaaataatgctaaccgtgatagatgaattgaaatgactaaaattagtaattaaattgtgcgaagttcaaaatcaactcaacaaaagattgatataattcaaagtaattgcagaaatcactttatcactggaaagtagatattggtcagtaaacaaagcatcaataaaaaatgcattcaaatgcagcccatcgataaaaatagcagaaatcagttgtgatggcttttagttcaagataagatcacggtatcaacagcgatagcagatatcgcttgtgaaacttcatcattcaaattgtagctctacatcaaacaaagccatgatgagttgatctcttcagtaacctaaatttcaagtccatactcttttagcagagactatggagccctatacttttggggagtttcctctgctggagaaggatagtagtgaatgaagatgaattttagatgaaaaagtagcctgttttaatgaatcagttgctagcacacaaaaagatatttcataactaatagattgagcagcggttcgtatactgcctgaaagggaatatttattatttgcgttatatcctgccataagaagaccaatagaaacaatacttgaaatggcaattcattacagagcaccaatgctaagacctttcgactcctaactaaagaggtagccactgaagtatcacaagaacaaatatctaaatagaaagaaattgatgcttaagttgccgatttgaagtaacagcccaaatatttctcaatctaggtattgactcaagattattataatcctcatatgcagtagtacttttaattcttattgatatagttcataacctgccctatgatctcgattcaacaaacctaggatatgttcttaaatcagttcaatgaaagcgaaagcaacagataaaagcaacacaccattacctctgaggctatcctcgaaaccaaggacgcaagcgattctggcaagttccctcctccgtccattatcaactaatagccgcctcaagaaatctacatcatacctatcttttagtccaaatgcagcaaccatctgcaggaatatctgcacctctgcctgtccacccttctctccctccttcacctctcttcccgacgccttcttatcttcctcgactttcctcttctctacttcccctgtcttcgccgcattggccaccttggcttccgcctctcctccttccttctctacttcctctgggtcctcttcttccttctctacctcctctgcatctgcctcttcctccgacgcgggcaccatttcctctgggtcctcctcttcctcctcttcttcctcatctacatgctcttctttcttctctgtcgctgttgcgttctccaccaaaggcgcttctgtcatctccacctcattgttatccggtgcatacaattccatcttgatcccaaatttctctgaccaattcttggcaactccggccgccctctcaaccagcgtatctcctatctccggcggcttccggccatcggaatcaaacaacgagcgcagcagtatgccgagcacccagaactggtcctcacctgcaccatcctccgcggccaagaagtcggcgagggcgtcgagcacgaggcggggcgggtcgaccgacgcggcgacggcggggccgacctccttccggacggcggcgagctcccgccgccgcgccgccatgaagcgccacagcgcgggggcgtccatgcggccgcacatccaccggagcgcgccgcggacgtcggcgggcgggggctccgcggacccggcctccgcgacggccgcggacagcgccgcctcggcctcggcgaggcgcgccgggacggcggcctcgcgggcctcgagcgccgcgagggactcggaggtggaggcgcccgcggcggctagggcgtcgtcgagcgacgcggagcgggcggcgaggtcctcgtcgagcgaggcgaagtgggcgagcgcgcgcgaccaggcgtcgtggcaggaggcgaggagctgctggtgggagtcgaggtgggcgaggaggcgccggacctcgccggcggcggcggcggaatcgccggtggcggccatggcggtgagagcaagcaggttgggtttggattggaatcggggcggctcagatgtgggtggagatggaggtgggctttctattgggttttaattgggccataatggacttgtgcaatatttaatgggctttctgttggatttttatttgggccttggtggtgagacggaccaaagcaggtttgggtttggactgaatcggggcggctcagatgtgggtggagacgaaggtcttggaataagttcactttgggtccctctatttgtcgaccattgaccacaaaaccgggtatgacccgtcccccaacttacgaaaaccagacaaacgaggtccataggcggttttgatagtggttttggctgacatggtgcctacgtggcttgtttgactaggtctccatcacatgtggcactgatgtggagcttacgtgacaaatatatctacgaaaaataataaaaagcgtggccccatatgttcgctgcacacaaaaaaaaaatttaaaatggtggggcccacacgggccccatgtcagcctcactcctctctcctttcctttcccctctctccttcctggacagcggacggcgcgggtgggcggcgcagcaggcgagctccggcagcggcggcgggcatggtcggcgccgccccccgacaggagcgccgcgtacagcgcggcgtaggcgagcagccacgcggagttggagaagttgaggcacgctgcacggccgcggagagcgggcatggcggcgtcgtgcgcgcgcgtgacggtgtcggcgccgtcgaactgccgagccagagcctgcagccgcggcgccccagcacgcggacctcgcacacccaccgccccgcgcacatctatcgcgctcgccggcgaccgctcgagcaggccagaggggcggcgaagcgggggtgagcggacatcgtcgcggccgtcgaccttgccgggtggtagaggagcggccgtcgacctttcacatttttttggtaagtcagacaacgaagaactagaaatgaacaaaagggatttcatagctatgctgaaccttgacccacttaggaaattcataatcaactaaaattttccttttcttttccacttcaatgttgcaaatcatcaataagaatcaaaatcatagacagtatattcctccctttattactagttacgagtagtagtacaatcgctcagcggcgacatgagggataaccaaagcggttggcttcaacagcgccggacgaaatcggtcacgacggcgagctccttgacggcattgtcgcagttagggatgaaaacggatcaaatacggtcggaaactaattatatcatattcgttttcattttttttttcggaatcgaaatcggatacggatacccggatatgaaaacggaatcgaatattatcgaatacaaatatggagcaaatacgaaacgaaacgaatacggtgacgaatattaatcagaatataaagacccctcaaactaagcatcacaaatcaacgaagaaatataactcattattttttctaataggacatatcaatattttcaaaatttagcaattaataataaacaactacaaacttgcacacactgatattatgaaataccatccatcatcatgtgaagtgaaaaggcaaagcactactaggcatgccagatactgtcaaccaatctttttagtctaaactctgaagtctgaaccacagttttttttcaactgaaaacacatgtaaaattcatagagcatggtaaagccacagctgcagcctgcagaacaaactaccgcaaggcacaagcctatttatgatataatcacacatgaatacacaatcattaacacaaacggcggcgacgttggcttggcccggcggcggcgtcgccttgcccctgcggcggcgatgtggcaagccagagggctcggcaggcgaggaggcgatggggcgccgcggcggcggcgttggcttggcccggcggcggtgatgtggcgcgtgacggcgcgaggaggcgatggggcgcggcagagccggcgttggttgctccgacggcggcgatgtggcgactgggcgaggaggcgattggtcccgacggcggcggcggcttggccccgcagcgaggaggcgacgacggcttggccccgcggcggcgccgacagggcacgccggcggcggcgccggccgatgaggaggtgaggagtgcgcctgtgggactctgtctgggactggacagtgggagactgggagtggactggatctgaatggatggagaattggagacttctagggtttcttgtaagtcagatatccggtgaaaaaaaccggatagtttccgactattatctgattccgacggatatcacctatatcatattcatttttgtatctgcaaaaaaatatctgtatttgtttccgtatccgaaaattttcgaatatatccaaccgaaacaatctgtatccgaaaaatggtccggtcggtcggaaattatccgaatcactttcaaccctagtagcagttgggcttgggcaagaagaagatttcaaccctagtagcagttgggcttgggcaagaagaagacatggccctcgccctcggtctcgtggaactccagctcgccgtcccactcgcacttcttgatcccctccgcgtacgagcgtgccctctccacgaaccagtagtgatccgccgtggtgaccaggacgcggctggccctgagctgcctccactcctccggcacgccaacgagttgacgcacgggcggtcgaggccgagcttgccggcgctggcgaactcccacgtgccgtggaacgagccgcggtagccggcgtcggtggactcgccgcccaggggtccttcccctagaagtagaggtccacatgggcccaccatttattattatgtgtgtgcaactgacacgtgggtcccatgggttatattattttttgcggttctaattgctacataagcgccacgtcaatgacacgttggacaaagacctagtcaaaatgagccacgtaggtgccacctagggataaaaccggagcggatagtttccgtccgctccggataaaaacgaatacggatacctctcggatcggataattctcggatagttcggatacggatacgaatacggatattttctctcggatacgaatacgaatatggtatcaggtcggatacggataataattcggatatccggtgaacagtgctattcggatatccgcagaagccaccagacataccccatttctttataactctatgaccttcaatatacctttttagattttaataatagttcatctcttaacactagtccacattattaatattatttaaaattttaaaaatatttataaattatactatattttatataaaatgatctaattatatatgttgatatttgtttctattagaagttgaattggttttcgtattccgagaaaaatttgttttcgtattcgtgtccgatcatattcgattcttattcgtattcgagatagtccgtatttgtttccgtattcgagctatccgtatttgtttccgtatccggcaaaaaatatgaaaacgaatatggtatgagcattatccgtccgtatccgctccgttttcatccctagtgccacctcagccaaaaccaccgagggacctcgtttacctggttttcataagttgggggacctgttgtacccgattttgcgagcaagggatgaaaatcggactgggcaacaaatagaggaacccaaagagggacccaaagtgaacttatttcggaggtctttgactccctcaactatgatccgagtatgattcatggcctccaaccacaaaactgtgtatattgactcctccaactatcaaaaccgatgcaaactatatccttgggtggttttgaaagcggttttagctgacgtggcacccacgtggcagtgttgacccagtcttcgtctcgcgtgtcgtcgacgtgtcgcttatctacatgtaataaaaaaacttgtgggaccgacatgtcattcacacaaaaataaaatagtgggacccccggacatgtgggcccacatgtcatcctcacctctcccccctctttctctttatcttttccactcctctcaccttccaataatagacgcggggcggcggcgacggcgacgacggcacgggggaggagctcgccggccgtccacactcgggggaggagcccgccgtctgtccgcgcgcgggggtggagctcgccggccgtctgcgcgccgggggaggagctcgcctgccgtccgcgcgcgggggtggagctcgcctgccgtccgcgcgccggcgtccgcgcgcgggggtggagctcgccggccgtccgcgcgccgggggaggagctcgccggcgtccgcgcgcgggggtggagctcgccggccgttcgccttcagggggaggaccggaaggagctagccgtgctttaatttgggcatacgtacatatcgatccatcgatgcaaatgcatgcttgcatatgctttcactgttctggatatggtttcagataagctaagtagctcgtccggccgtccacgcgccgcgcgccggggaggagcttgtgcttcgtgcttcggccggctgatggaaggtgagagaggaaaaaatgagggagggggggattgaaaatgtggggcccacatgtgggtggtttttttttaatgtgcgaatgacacgtcggtcccacaattttttttactctgatgccatataagcgacacgtcgacgatacgagggacgaagaccgggtcaacaccgccacgtgggcgccatgtcagccaaaaccgcttctaaaaccacctagggagggatatagtttgcacggttttgatagttggatgagtcgatatacccggttttgtggttggaggtcatgaatcatactcgggtcatagttgaggggggtcaaagtatactttttccttcctatttggattgtccgaattcttcatgttgggctggtgggcacaaaacgaactctacatgggctgcacaagcgctctcatagcacttaaggccttgttcggttccttaggatttaatccccaagtggaatatatccagggagggattgagtgaatccctcccatatgtcactcgactcaatccctatgggggttggaatcccttgctctctcctattccctcttttaaaccccatgttcgttttagccagagattttagctatcaaaatatgataaatctcatggctgctccttcgagcagacctgcttttgttctatcagccgactgtaatcagaccagaattacgtcaaagttttcatttgcaatggctgtaacgagcagctaatatgagcagcgatgcttcaaagcttgtcaggacagtattgcagattagaagcacaggaaaaacaatgatgggtacaaagaaaaaaaatgatgtcgacagtatcaaatatcacacatttcactgtgtgggagcactcagtttaaacacattttttgtaactcagatacatcacaaactaaacaggtttatgagtggaatgagctgagcagcaggagacactataatgatgccctgactttcgtcatgctgtctgaagcaataaatcttcaggaacttcagaaaattactaccatcaaataaattatctggaatttccctaccagtcgatttcatggaacctacaaagcataatgagtaaacattagctttcctatctcacaaacagataaaaggaaacaaaacttgagatgattgaattttcagaagatgcagaaatcatgtataacaaatatatatggccaatgcagaaatcatgtttatcttgacttgtctgcattttcagaagatgcagagatcatatatacaacttatatagatatacaataaaataataattgtcaatgcacggctacatgctttttttgactttgtattgcagtacagagaaatggagactgctatgttatctagcagctacaggcaaaaggtcaaaaagggaaagcaacatgtatactgtactaattagtaatttactatagataagaatggtcaacatttatgaagaacacacttcagtaattaaattcaaatgaaaagtaaacagtggtaactatggctgaggaacaatctttgcggatggcatgtaaaaactaggatttgcatcagtgtaggatacatataagtgattttagggtatctagagaagaaaaagaacttggtgacaactcaaagttatgcacaagacacgaactaggatcatcgtcaacttttggcattcttaaacatgttggacatgacatgaaatagaatctgtttcaataactagaatatgcttcaacaattttggccgttcctgtatcaaagtgcaatagaagataccaagaagacctagtttactcaaatacagaaaactgaattgctggctccctaaaatttgccttgttgttttttttttgggaatttcagttatgttcattttggccatgagttgcagctaaacttatcattggcacaaaagacttgaacatgagttctcaaaaaatctataaccataaaacatacatatctatcatacagtaccaatcttggtaatcaggtagaactagttcttggtgaatcaaagacaaggaaaaaaggaaaatctctgcactgcaagtctgcaactatatctacatgactctgaatttcttcagattttgcaatcttgagaagaatcaagttcgaatcctgcaactttggaaagtaaaagaaagaagaaactcttctgtactgcacctgcaactagatgactctgaattccttcagatttcgcaaacctgcaactgcaactacatgactcagattccgacgtggagggtgccgacactttgaaggctacgggccaagaaccaagaaccctctcctcctccttctcctcctctcctctcctctctggcgtccaagaaccctcccgtgtcccggcaatgccaccgccggagccgaacaaggacaaagcgctgccgaagccgaagccacccaagcccaagccccaagccagagccgaagctgaacacgcggtcggcattggcgccggagcacgaccagacggccggcccctacggcacggtgcgtgcgacgacgggaaagccggaaagggagaagagaaggaaaccctaccctaactttgaaagaggaggggagagggggaagggaagcgtgctcactggagagaaggtggcggccggagaagagagctatgccgtcgccgtcgccgtagccgtcgcctctgggtcgcgccgcgctccgcccccgccgtcgcgtccgtgtcttcgtagcgccgccgctcctctcgaggaatttttccgctcctctcgagtaggtgattttttcctgggcctacagaacagggaaatcccgtggtgggctgggctaaaatccatgctagggattaaccgaaggaataagtccactgtgactcccttaaaagtaacatgaatctaatccgtaaccctcaaccgcaaaaccggatagaacgactccccaaactattgaaaccggtgcaatttgactcccttaacgattttggacggtggtttcctacgtggtgcttacgtgacggtgttgatctagtctggtcttgacgggcgcttaggtgacatttaattaaaaacatatttgtgggatccatttgtcattaaaaaaagtggagtccactgacatgtcatcctctctctttcttcttcctccctccctttctcccttctctctttctctccccttccaccgtccgcgggagcac

SEQ ID NO: 38816 - DNA, 2229 bp, Oryza sativa
gctccagctagctcccgtgtcagctcccgccggccgtcaccactcgggctcctgacgacggggaggagcctcgacaacgggaacaggtcagcgacgccgaacctagtcgccttcttctgcgcctcacccagtgtctccaggaactcctcacgccaccggaagccgcactcccccatgatggcgcgcagcgtcaagtcggttagcgtcccggtgatctgcctgctcacgttcagtgccggcagcggcggtgatggcgccaaggagcgcacccgccaaagagtatccccactgtggtgccgatggagtccctcactgtacgcccagccatagaggtcaaagcccccgggccaggcgccaggaggaggccgagctccatgaggcgggcctatgtaggcctaacaggtgtcaccggacaccgggtaattttttgtgtcaagttatagtatataggtatatacagcatgggacacccaaaaaaaaattggattggaccccggcctgtccagataacttactaaagcccaactaaagaaacaatccatcaaagctcacgttagcccaactagagcccaactattcgtgggaaggtgaaacgacgccgtgtatctcgagactgaattaactgcgtctccggctctccgctccttttcctcgtcagtcgtcggtactcttcgagactcgagacactgaggggctgtttggttcccagccacactttaccattacttgccaacaaaagttcccacatcttgtctaaggtgaggtgatcaaattgttagccacaacttactaagcctaagggaatcttgccacacttttttgagccattgacacgtgggacccaatttgttggaggagaatcttgccacaactgtggctacaaccaaacacctgtcaaatttgcctaaccttaggcgtggcaaactgtggcaaagtgtggcttgcaaccaaacacaccctgaatcgctgctcttgctcgatccttcttttcgctcaatcgctgctctactcagatcaagatcaagatcaagcaccgcgcccgcgcggccgacgacacgctgcgtgtaggccacggcgagcggcaacagcatgcattcgcgtacgctcgacttccagtcttccaccagttgcaacttgcaaggtttgttttctaccattagtccagaattcagattattggattaggacattagttcattcaatattctttagtgctgtcagagtaggagcatcaaaacattttaatttattcaatcattttttagttgtccacattctgtatcgctgcttactgattggtgcttgcactagaataactggttggcagtgagctaagtggttagctaactgattgacatgggaatttatggaaaagtattacaagagaaaatctccatcacatggagaagatgttgccccatcgcagccatcacacagacataatgctgctacatttaatagaagagatgttcctgaagatatcaattgggaagtggagattcaatttgatcctggcaaaaggaaaagaattgaggattatcatcccaatcaaaaggagatggtaagaagaaaatacttggacaatgggccttgtcaacctcgtccggatgatctccctgttacaaatattggtggtagagatagaaaatttaatcctgaatggtatgatgagtttggcagttggcttgagtatagtgagtccaaagataaagtttattgcttttattgctttttgttcagagaccctaataagaaatcagcagggtatgatgcatttgttacaagtgggtggtctagttggaacaaaaaacacagattgaaggaacatgttggtgatattgatagtgttcataaccaagcaatgagggattgtgatgctttactgaaaaaagagcagcacattgatgtttctttgaacaaccaaagtaatgctgagaaaattgcttattatactcggttaaatggctcaattgatgttactagaatcttactgaagctaggtatgccttttcggggccatgatgagagtgaggagtctctcaataaaggaaatttcaaggaatttcatgcttataccgcagagcaaaatccagctttacacaaggttgcaggtaaaaatgctcctggtaacagtcagtatacatcttcaaagattcaaaatgacatcatacgttgctttgcaaaagaggtactgcgttatattcttgaagaagttgggctgcaggaatt

SEQ ID NO: 38817 - DNA, 31523 bp, Oryza sativa
  unsure (1)..(31523): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaataaagcaaagcataacaacaaatgatcatttacaggatagtctaaacaaaacattccatatgtaatcacttgtaaccaacaacatgcacgtttctattgttctccccaaaagaaggtgtgttgctgctaacagcaaggttttgacatgccaacgcaatgataatactttgaagtctgtattaatctcattgatttattcaagaaattcaaagcagattatcaaagaaaaaagacaaactgttggccgtaaatttcaccagttaacagctggtaactggccttgaaactggaaacatctatgtggatgtttttgctaccattagaactcctcaggttcacccctctaataacacttttttcaaatttaagttctatacaaaaatactccaatttgcttccactgatacagtgtaaatcccaaagcccaactctaaaactgaaaaggcaaaaaccagacgcagccagatctggtttctgatgcccttgtgagtgatatcatttaaacacatctagatgaggatggaagaaacgatgagctgatttcttgtatatagatagatcatgcttactcaattcaaataaaccaattgattttccaaaactcagtcctgctacatatgcactagccagtttgccaagccatgctataagcctataactagcgtagtgccgtagttccataatactactctattggcatattaaagaaatcggctagatagatattatatttttaccagccgaccagcatcaaatgatgattacctgtaagcaagcgaccacacacaagagttatgtcccactagcggtgaaacacaacgaccagaagatatatcccacatcatgattgttccatcttcatctccagaggccatgtatcgcccatcaggagacattgccaatgataaaaccatactcctatggccaataaacatccttatacattcacctgtttgaacatcccatagtcttactgttttgtcactagagccagtggcaatgtagttgcagttgacatgccattgcacacactgtcaggcaaaagtattttttttaaaaaaatgcagacatcaatataggaaattagagaataagcatgtatggaaatattccaacattaagtgatcccatataagaaaatgaccaaaaccatgagtacacttacatcaacatcagataaatgcccagccattattctcaaaggctggattttatccatggaccagattctagcagtcctgtcatgcgaagcactagcaaagtaatgtccaactggactaaactgccaaaagaaaacagaacagtgtcaacaactatcatagcacaaggactacaataacagaatcagataacttgcatccaaaagaatttgacagtgagcttttcacaggacatataagtacctagtactccatcatggagagtactaacgatgaaatactagttaggaatagttcataaggagcacacagaaacccatgcttccttttttctttttggcattgaaaacagctttgtatccacactaataatatactaaaagaactggtaatcacatacttggacatcccaaacagggtagttgtgtcctttgtagcaaacaagattagcattcaacttggtgttccataagcgaactgtagcaagtcaaaaaaatatagataaattgtgaattctaattaataaagtaacaaggaagagaatgatacaaaacaagcacaatgagaaggctttacttgttgagtctgcagatgatgacaagaggaagtccccaattgggctaaacatggcagaataaactggtccagaatgaccttggaataatgtacaggatttacgcgcttcatctgatgtcgatacccgctcaatctgggagggtccattctcgccttgtgaacaagctgaaaattatagtttcttcaatcagtaaataccatcattgcataattgactttgatgctaggaggattaatgttctaagactatcataaggttctgaacaggttccagagtcaaatactgtaatgacacaagtgcatcagtacatccagcaagtatgactgaaaaacatcatacttcttaggacttgtaactggaacttcgaatgatacaaatgaatgtaccattatagtatttttaagaaggcaatagccaattagtcacataaaccagacgcaaatttatataagtgtttcagcataacacaaagcagaacaaataatcaaaaataaggagtgaagaacaactaacatgctttggaaggctggccaatctttgacatatcccaaacctagtgaacaccaaggagattttacactttttactattacgaattaatacagaaatcacataataagaagatgccacctaaaaggactagccttcactgatgaatcagcgaatccaccaacgaccaatgaaccatcatgcgaaatcgatgagcaatttaacctgagttccacatataatgattaaactgaaggaggaaaaattgaaaataaaaattgtcaggcattgatccatagttaagtttacccattatgtgtattaaggaatgtatagaagctaacagatggcaatgacaagctattcaattgtgcacggtttcgcaagtcctcaagaattgactgctcaacttcaacagacctgaaaaaaaataatcagtaaacgtctatcagattcttacagataaaggtaaggctgatgagtcaacaaagatgtccaacaaataaaagtaaacatgtgtacaaagaaattattacaacttaatataagaaaaaaacatcactatagaaaatcttatcagtgggcttaggctctgtttgcaagagctggttcccaacaccctactctcgttttccacacgcacgcttttcaaactgttaaacggtggtttttttagaaaaagtttctatacgaaagttgcttaaaaaaatcatattgatccatttttgaaaaaaaaatagcaaatacttaattaatcacgtgctaatggaccgctccgttttctgtgcgtactgtttgggttgggaacctgtttttgcgaacagagccttaatggccatgtcgtgatgatagtttggaaggcaaaggaaatataatctttggttttgttaatgtcttacaaaagtgcttttgaacagctcaaatattctacggttaaacaacatctaagcaataacatattggcaggtggacatgggataaccaaatcatttgaacagtgtggatgaggaagcaatatgttggtgcatagaatatgcaggcccctttgaattggagaaaaaacaaaggaattgaaatcctatagggaagatcattgttcatgcctttgatttgtaggaatgaggaaaggaaaatcacaggagattttcctgttcctacaaatctagaggaaaacataggaaatttaacatccattccaagctcatgtttttgttatctcgcgttggatcaaggcaaatctagtagctcatggccacttgtctattcaattagtgagggtaagatgtgtataagtagataagaaacccaatttactcttataatccaagcccattgctatgtttttcctacggtccaatcaacctacaaaattcctttgttttccatattcctaagttttttaatcctgcgtttcaaaaggggcagtctgcaggaaaaatgaaacaatggccacatgaatttaaaaaacatgtggttgccttcttcccaaccacggaccaggaaatggatgcagaggaagttataattttatcataacctaaaatcctgaatcatttcaggagaactttttaaccttaggtcacaaaccagacaatattcaaaattagatgaccaaattggacttctcaaaagaaaatttgaagtgattaaagatgtattgtacgacgtacgtcattggaagcgttagctctggtttaactcgtggtgctatagaaaccatgctagtttcagatttcatgtttttccctgtggttcctacaaacttgtcctttttgatctttttatgtgagccaccctgctttccaccttctgaggatcttttctgtagcaaaaataagaaaagagtgaaatgagaaggctaagaaacatcaatggtgagtgaggaacatagttccccctatgcagctgcctagccttcccaggtgctaggttctaaccagtctgcctgctagcatttacgggagcactgaacaaaggagaatgcagaattacatagtggaacaaatcaatgaaacattgatatcatatacagctgacagccagtgcacatcagaaagtactgtttttataataaagcaaccataaaaatcacaagttgctaacagaatcgcacgcactaaaaaaaaggaaagcttgtgtttcaatgaccgagggcataggaagcaaaatgaaaaaaaagactggcatactacaaaacagtttcttgccttgttgtcttctgtgtctgcatccttgctttctatttcagttttatcagaatctgaaattgccttctccatacgttcttcaagtgaatcttcaagtatctgcattacagaatttaaatcacaaaaataaaatgtctgagcatagtgaacaaataataaaaacggctagaatcccattaaatattaactgatcgatctatataatttcaattcgtttaggctgtatccttaactattgataaaataaatgatgagaattgggaaaccaccagactggtacagaacataccccccaatgcacctccttctgatttatctgttttgtcaagtccttgctagttccaatcagaacaacagcatccgagtcatcaatgattaatggagactgcccaggggatactatcaatattgtaaaggaaagttggaacagaagattcagataactcacaaggagcaaatgcaggatgaacatttaggtcactaatcatgagtcataacagattggggaaacttaccttgaaaatctatgcgttcattgattattccaagcaccacaagagcttgtgttttgtggagatactggagaagcaattcatatgaatactgcaataaaaaaagacagaaactttaattgggacagctgattatatttccagaaaagcaattttgcagcaatcaagaaattacagtggctatcatgaaatgctgccccaaaaaatagtacatggtacagggttgaaatgaaaggggatttggaaatggtatacaacctcacatagcttaattctgaatttattctgccttaaagatcgagccacttccatttgctgaaattacaatatttagaaggataagccataatttgtaaactttgaggagatagaatcaaataaacaaaaaataagtcttcattcaaaatagggtagtgcaatgtggaaaagctgagtcactaacttccaaatgtaaaggagaaaggatgctttccagcttcttgagatccctcgagtgttcatggtcttcacgaaatgtgtggaaaaatgagcaagctgcagtgctcaaagttagtgtatcaaagaaagaactgccccgaataaactgatagaaagcaaaaaaaaaaaaaaactgacagaagattcattatcatatccacctactagcattaccttcctgtgtatgtccctctgccactaaatccatgaagcagtggaaaaatagtggataaagaatgcggagtaattcatgctacaatagaaataaaaatttagaaagagattatatagcttaatttaggaacattaaaatacatataaaaaaattatacaaaataaaggtgcaatggtaattatgtacattacaaatcgcaggaagcaaaacatactttctgcctgtgtaggaagtacagatgtttataggaatactattttgctctccagaaggtgggcagcactggatggatggaagagaatacacgaaagaagactcttcaagtaaatgctccatctgaagcaacaaactgtgactctagaagcttgctatacaaaacagacttgaacatttttaacaagagaaacaagtgatcagctctatgtgaataacacagaaaacactcttaaaagatggtataggctgtaacacagtaacaaatgaacagattggatataacagttccatgcctcaaagcagctaaaacacatatggttgtaaaatacaaaaaaaaggggcaggttatgaaagtgaattacaatctgcgcatgtaacacaccttgtagtgatcaagataactgtatgcccatgttcttagtttactatagccatcatagtacctcgctggatcgttttctgacctgtcattgcaggcaatgacacaatcaaaatgatgtagagggtaaagataataagaacaacacaatgagctaggaattagatgcggaactacccctgctgcagtgagaagaagtgctacagtagaatccatgcggtaattaagaatatgtggttgaacacaatatatgaaaatcatgacagaattcctcgtagaaatgtggttccgcactcatcctcgccgtagaaattgtcggttgagagttaagcgctcaaattgatcctaccaaattgcttcctccacaaaaccatccccaaacacccaagcaaagctagtaatactactacaaaaatggaacaaattactcctgcgtgggggaaaccacacgaccaaattgaggtcccttagtactagttgagtgtgaaaacaacatctcgaacaaaaaaaaatcaatttataacaataataattgcactacgacactacaaattccaccactaggtttccgaaactccggcggctgagccgagcgcgagaggccgcaagagcagaatccgggaggggagggggaggtcgttacctggagagcgcggcgtcggagagggagtgggaggaggaggaggcggtggtggtggtggtggtggtggcggagaggcgggtgcggtcctcgagcagcgcgagccccgccacgcggaagcccttccgctgcaggtactggtgcaccttcttctccatctcctcgtcctccattgccgccggggcggagaaggttcggggagctagggttttgagaagagctcggatccgtggcggggcggggaaacgtcagaggaagaagaagaagaagaagaagaaagcaaagcaacagcagcacgaggaggagcagaggcaaagggaggaagaacgcagcacagcgtcatgtgtgcttcaggcagaggcccagcccaatccgttatatggccttggcccaggagtacgcaattgctcctagaaaggaataagttcacttcacgtccctcatcctacggtcgagttacaatcacatccctcatccgcaaaaccgtatacaacacattccttatcttataaaaccggcgtaaacaacgtcttaaggcagtattcagcccggttttagttaacgtggtgcttacgtggcactctaataaaaataaaataaaaatcatgttcatgccaattatttttctctcttctctacccttctcctacatttactggtctctggttcatcgatgccgatgggaaggtggaaacgttgtggtgtggagaaaggagacagcgatagtagagaagcagcagcaggaaagcttagcggagaaagggggtggagtcgccgccaaggagtcatcgggtcgagcgacgccatcgccgccacttcctgtcatctaggcaagtccatgacgcgcgtgcaaaggaaggcggcctcatcggtgacgcagaagggtttcagctaggggtggaaacggtacggaaatggacggaaaccatatttgtcgttttcgttttcatagttttttcggaatcggaaaccccggatacgaaaacggaatcgaatattatcgaaaccgaaaacggagcgaaaacgaaccggcgcgaatacggtaacgaaaacttatcggaataaaaaacccctcaaactgataaatccaattgaataaattatctatatttaaaagagtaatgttgttgataaatcccaatgtaggacaaaaaaatattcttatgtaattttagatttgcataacaaatattttttaaaaaaataacagccaaacaccatgatattcactatttagtgcttaaaaagagaatccaggatatttcagtcacaaaatttctggtaatttcgagaaaatttccggaaagtttccgaccgattccgagttccgacggaaactgcccttatcatttccgattccatttctgagaaaatatttctgaattcgtttccgtttccgaaaaattccgaaaaaattccgaccgacagattccgttttcgaaaataggtctggaatccgaaaagttttcgtaccgttttcacccctagttccagctggtcgcggaggcgacagcagcttgacgcccacaacagcttttggttggagaggagtcgtcaatggagagatgaagaaaaagaggagagagaggaggagagaagatgacatgggttccacataaaaatgccacatagccaaaaagaccatgtcaaattgccacgtaggtgccacatcagttaaaactgctttaaatactaccgagggatttgatttacatcgggttttaaagacgagggatacattgtatttggtattgtatttggttttgtgattttttgtggttgaggaatgaaatccaaactcaactcttagatgagggatgtaaggtaaattattcctcctaggaaagacataggccgaacttacaagattgtgggctcgtttggggattttctgctacctacaacttctctagaataaaaaaaaaactcccaaacagtttaactttccgcccatattataagaagttatagttgtggaatctgaaaataaactagaagccagaagatagtttttcaagttctatagtagctggttggtacccagattataagataatctctgcttttcgcccatattataagaagttatagttgtagaatccagaaaataaactagaagccagaagacagttttccaggttctatagtagctggttggtagccagattctaagataatctctgctttccgcccatattataagaagttatagttgtagaatccagaaaataaactagaagccagaagacagttttccagattctatgataaactctgctttatagtttattttctagattctatggttacatataatcagaatctacagagtttgaatagctgaatatcatggaagaaactacagctagaagctttcctaaatagggccgtaaaccctcccaacacaatacgtttaaccctagttaatagcttagcctatcatcatttgctctactaggttatcacccgtagaaaaaaaaacgaaaccaccaaaaataatttctaaatataactttttatatatttttgtgttcctagcaatttaaaaaccaatgctacaaaataaactaagatgaaaaaaaaactttaaaatcaattataaaattaagcttcaaaattcaaattttagctacaactgataagcctagtgaaactcgaaatgaacatagtaaaacaggaaaatacggctcagagggtctgtgcgacaatgaaaactttcttacctactcagctccaagtgaagctatatagagttttaaattgattacaaaacatacaccatatgtcagttgtcataccaaaaggtatctatggagaactgacggtgggtatcttcacataataagcatacacataacacattacacaacaaggattttagcataatacatggtacataatcgtccactgcgttttattgaattcactttcatacatcaagaaaattagaaacaggcctacgaagtagacgcttcatgggatggtcctctggtacagggggagtgctcccaatgcttcgcgctctgcgctctcctttttcacctgaaaagcatgatgtgtcaaacagtagccagcaaaagatggttttttatcaaaatttaacatgagttttgtttcttaaggcccacacatcagagtagtcaaggattgatttctttggaagaaacatctgctcatatacgatgatattctactaccaacagaagaggaaacaagtgtaataaaaggagtactacccaaatcatttataccgataacagcagactgtttctctggacaatcaccaacagccaatgacacactattagtggatagcaattaaccgtcagtaaatcatttgaatggggccttgagcagaaataacctttgcaattatgcacacaattttttagatactaaatcagcatgaggaaccaacattcaggaattcatagtactgaaagccaatcttaagacagcaaacctagtattttcatacagtagtaatagttgtacatgtactttggctaattattggtcaaaatatacaaagtttgatctttgaaatcaaaatacttggaaagtatcaggtaccacaaacatgtataatgaaaacaattgttcaagtaaagtggctcctaaaagaacattgtgatgagcgaagttcattttattccagtatgtatagtgccaattgccagctcccaagttgtaatccatggttcaagtaacaagaaaggtaaggtgataaaaaaggacacttaccagtgctagcatatcagataaatagcctctgaacggtgtctgcttcgcctgccaaaaaatgaaaattaatggtgtcgcaaatcacaatatatgagatatgcagataggtcctcttaaataactgatcagacggtaattgacaggagaatgtcaaaacagaatgtgatgaatgtggagaaggaattaaaggtcttatagcttcaaagggaagctcactatattctgaacacaggataggaagcaagaactcagtacaccccgaaaacaacaaagtataagaggtcaattgaagcaaattcaccaaacgatctcaacaaaatagacctaacaaggagacacaagcaaatgtatcagagagagaggacaaaactaacagtgccatagcatcatttagtaacagttccattccctatcacaagcatcaaatcggtgtccaccgcccattcctattcaccaattgtctaccagttgccatccttctaattcctacgtcaccaagccacggagcgtcgcggtctcgcggagcaaaagctcgaggaacgaactagccacatcgacaagccacgtctccgtaagtccccggccacaattgaccgtatccacattgacaacgcaaatggaagaaacaattctactaattccacaggtcgcgcacacattcatacatacatacaaacagaatgtgggactgaaccaaaactaccgaggatgattgcgaaatcttgttcaacctgggcatcggcggggaggtactggtgcttcatggagaggtccatggcgcgcttgaggcgctggttgcgggcgtccaccacctcccgcggcagccgcgccagggcctccttgatgtcgaggtcgtggtaggggtcgtacaggtcgtcgtaccggagccctgcgcacaccagaacccccgatcagagatccctcgccgcggcaaaaccctaaccctaaccctagcggcggaattcgaagggggggagggggcagctcaccgtatttgcggaggcgggaggcgacggcgttcatgtggaggcgggccagcgggttccgccgcgggttcaccagccacgccgacagggaggacagcatcttcgagaaccttccagaagcttccacgctctctctctctctctctcttctccgatgtggcgggtgctttgcttgggtttggtttgacgagagaggagaccgtacggttgcttggctttgggtggttggggttgggccgcgaagcttgtggaacattcgacggtgatgggccgatgggccggcccatcttcatttaaaaaaatatcagagtaaatttcattttcgactacctttttattgccgatgtttcagtttgggccacccttcaaccaatgttttcactttggactaggtaattttaccattttgtcactttaaagtgcactcaatttttttatccatctactttgttctatgtcaaagcaatggtctacatacaactaaagaggtttattgatgaataggagctgacatattcgaggtcgttcatacacttgagaaaagagttagggtggttcaaaataaaacaaaggtaagattatccagtccaaattaaaaaaacattagttaatctatggtctaaagtgaaatattggtaataaaaagtaacccaaagtgaaatttactatgaactatgaaactgatgaatttttgagtctttgtaggaattgaattaattcctgtggaacttatgtcttgaaggagccttggagagaacttgtattttgttttcgtgcctctagtcctttttgaaccgtgggtatatttttttcgaatttcatgaaaatatcatgtgctcctctattgtatatttgaggtgttttctatttttcctaaatcaattttttaaaaaagtttggagaagttgatggaaaaatgtatacaacaccaaattagtttttattaaattcacaattaatacatttttataggatattttgtctgttttgtgttgaatgtgttgctacttttttcaacaaatttggtcacaattaaagaatttggacttaaaagacaaaataaaacatcttatatgatatgtgaaattcttatgtttcaaacgtaccttaggtgtatcttttagtagcttcttttttcttgcgaggtgtcttttttttttcgcccacctgctttacatgaaccatactcacaccaaaaacatactaactcgtacttagttagaatataatatgtgcacttacttgtgtgtaatcacaaaaaggaaatgtacagttatgcattgcggttgagaagcactacgtggcaaagcaccagcatcatattcatgtatactagtgctctgtgttgctttagctggttaattagatgtcatctgtttgtttcggagccggcacgaatatctgcccaatcgcctccaatgcagagacatcccagctctcagcatgtctagtgacctgaacatattgtaacagccaaaatattcttagctcttgaattaaaatgaaagagaaaaaaaattagaaggttgcttccttttcttttcacctccttaccttgtattcttcatccaaatcatatgttgtattccctctgatggcgatgaggggtctccatggaagccttaaatatgtcctgtaagaaaagcatattagttgaacacaagaaaaaacaaagtagtgtgcagtatttaatacaagtttctgctaaatccttctgggttcatagagattttagttcagttactctgaacttgcaaaagatgactagttttaccccacctaataattaacgaaacaagatttaatattacagtatcaccttagtgtccatgttgccatgatgaactttgtttcaaccctcaacccctgcttgatttgcaaagagcatcaggaagttgcaaaatgggtatagcttagacaaaactttgacaaatcacactgtgccagtataactaaactagaagctaatcagtaaaggcacatctgcaataaaaatagcttgcatgtttactagcacaatataatggcattccttacagttcagaacagaagggcaatctggagatggaaattgacatttggtaagttggtagctacatcaattttagcaaaatggaatggaaaagaaagaaaagacaacaacacatgcattgcagatgcatcactggtcacttgacaatttcagcaaacagtgttaccttttcaatgttttcaagctcaagtgaagggctgtcgaagaacggtacaagcagatctaggttctgggaatatctagaccttcctaccaaataacaacagtgcatttagcataacaaaaattcatagtatttctttgaaattggagcgaatcaaattaaacattgcttgacggggcttgcattgcgcatttgtgaggtcaaatagcaaagaaaattatcgcaaacctcggaactttattgtcgggtcctcaaacaagcaatcttcggtatatatgtccggagtaaagttccctgataagaaaacatccgatgtttcagtgcattataacttcagattctgaaactatttggcatgtgtactatatatatggcagtcgattaacctaaattttaagttctatgtaaccatcatcagtactaaaaagtgaaattaaatgtgcaatttccaactcttcaatttatcttatgttctctatgacatggcagcatcaacagacagagaaaactcatactacataccagtgaggaaatatgctcgctggtaatcggcttcaagaacagcaatcacatcatccacgctgcgcggcgaatccaactctgctcctcctcctccttcatctcccttctgaagatcatcatcaacaactctgcaccctcaaattgaatcccagatgcttgcatcatcagcaaattagagaagaattctcaaaaaccaaatggtgaacagcaacatcagatgaactcgagcactttgcatgcctggggttcttgggagtcaggaccctgagtagctcggtgacggcgctgaccgccgccctgacgagcggcggggcgccgccgccgccgctgtccggcgagccggagctgcaccggacgccgccggggaggcggcgatggctctgcagaatcctccatttctctgatccacaccatagctgaagaactgcgtttctgccgcgagaggagagggaagcaggccgtttggcggttaatcttggcgccatttttctttttcttttttgtttttgcagttggctcatacacactacatgctgctactactactacatggaaattggaaagcattattctcaatgttgcagaggcagatccagaggcaatggccaaatggcaatccaaccacaagaagctcacacttggacactgctggggatcggcagattgtgaggtgctcaaggtgacacgccacgccagccaatggcagttgctgttttgccagagagcccaaagaaaaacacaagtcgctttgattttttttcccaattaagctttagaagtatgataaaatttatggaaaattatagtagtgttttcaatataaaacaaatatattataaaaatatattcaacgttagattcaacgaaactaatttggtgttttagatttattactattttttttctataaatttgattaaaactaaaaaagtttaatttgtagaaaaattaaagtgacttgtaatatgaaacggtgctgcctccatgatggtgctggcgtgctgcaatccatattctgaccaaaccaaaaatttcagtgctttaggtatgcttagtgttatcctagatgtaaaagatgatgatcatttcattttcaataggacatggaaacttcagacttcaggcatggcaaggggaaaaaagagtcaaatttccaccatccagtatcgacgaatttcagtcacaacaattcaatactacctcctttgaatattttttttctatattccatattttagttgcgcacacttagcacactatctcacaagacatctcacaaggtaattttactgtccttgataaattttactgtccttgacaaggtaccgacttggtaccaaaattttaagataccaacagcttactagtgtaaaatttaagtaactcgtacttttaagtatctaaaatttctcatctcacaatgttcaaaatatactccttataaaaactctaaagctgccttataaagtacagcagtactcaccaaatttaagcaccatctctcacaagattttaagtgatgtgtgcactatataaacatcatcatcatcatcaatgggttcaatgatcggttaagctgaacaaaacacacgctgcctgatgtaatcccgtatgccacctttggttcccaatcacaaattcacaataacgaagaacacaccattgacgggcgaacgaacgatcgtgtcaaggcaaaaagggcagcagcagattggacctaaatgctcaatcaagtaggatttacatgagagtcgctgcggaaatcgcctactacacccaggaagctgtttttgttttgggcatagcaatccactcactccagcatgtgtcatttgaggaagctcagcttgtctgaagggcctcgaccttacccctggccttctcgctgtcgtcgacaatgagcttctttcggagggcgagcagctcctctcctgcaccacagatgtaggccgcggttctcctgcctgagagagttgccccttccatgctgtcaatgtagtcctgcaaacaagatagcagattatgagttcatgggatcgtcgatcatgcttttacaggagcagttatatatgtttcatccaatattacgaatatctaccaaacgaaccttcctgcttaaaatctaaatttacagaatcaaaacaattgtatttgatgagcgctgattgattactggtgacagtgactaagtcaatggtttagatacctgttttgtgtaagagccagacaggaagaagtttttaactggtgtcttttgatcaggtctaaatggatcatttcctggtgactcgcggtacaatgattgaccgattttcaccacactcgaccatgtaagttccaagccttgtgatgacgggaacaattctaagacctgcatgaatcataaatggatttgcactgaagtgagttttgaaagaatgaaataattaacaaaagcagaagaaattatcctgatttaaaattaacacgcttcattatttgcaatggatctctaacaaccagttctagaattttggtaatggaatacaagaataatttgatcaacagagtggtatttacaaacccacctgcttttgaaccttgctaattatctcctcattcggcaatggcatgtaaggatcgccaggggttagcacagctctacaaatgaagtagtagcacacggtgattttaattgcaacagttatcaatttgatgcatgaaattcaacagttctactacactagtcaccaagtaagctgcttgtgtaaaaataaaccataattacaaactaacagctacaatagtgaatgatatcaaatgtcaagaacactgaatggtcaaacttaattccagaccacaaaagcaaagaacatggaagagaaagtagccttactggatcaaggaaccttgtccttcaatgtagtagtcagcaggagatgaaagtgcaaggtctgaaaaacatgaaaaatctgcatctggagtgtagagaagattatccaagccaactgcctttttcagttgtctacatcaaagataaacagaggtatcattcagcatcatgcaaaaaagcagactgcatttgtacggccattgttcagtacaaacaaatgcactctttatgaaaaaatataatgtgtgcatcacgggcattgataaaaatattgggctaactggggaggggagactggagttaccttgatttctccaaatcttgaagttctgtaacccatccattataacgaagctgtactgtgactacaggaacaccatctaacttgtagatgttgtcaaatgtatcccattgcctccattcagaaggtaaaagtcttttgatccccgggacatcacaagctacaatcaacaattccaatttaatcttgcatggtaggacgtggtagtcaaagacaaaatggaagagaaagaacctgcgacatatgcatctgctttgattatctctctacttgtagcctaaaaatgtccaggcatggcaaaagtgtcaattaaagtatcaagaaaagggttaagctaagcctacagcaatgcacattattatcaaccataatctagctgtacagtcatgcaaaggataaccacacttcatagataatggtgctaaccttggataggagaaggcctttaacataggtttccccatcaggtgacttatcatagagaacctccctacatccccacctcaggtgaaacctgaaggatttgttaaatgatgtaagctttcaacggtgcagtacatactaatgcaaaacaaatttcggtctttgccatcatacctaccacccctgtctgttatgtacttctttattggaccactcagataaacatcaggtgaaccctttagcatgcgtaataaagatgcctctgtttttgtggcaaacagagtgaaaatggtaagcatgcaacgtgcactgatattatcacagtcaatgaaaccaagagcataggcaacaggatcccacatccttgtgatgctctctcgagtaccacctttcgacaagaaccaatcgctgaaacttacctgaaaaaagtacacttgcaaattaacctttagatagaagctatctacctctgatttttcattaataacagttctacgatatttatagtgcatatgtttatataactaattgtgatgagaatgaaacagaaggaagtgcactagtaacctatgttccagattcgagatataatgatgcattgcctagacagtagatatacactcctaatgacacttaaataagaggagagagatacatacatcatccaaatcccgtacttgctgcaatgcaccatctggatcaacaagagctcgaacaactgggcttagagcaagagcaacggcatttcttgctttatcataaacctgaaacatgattcaaatattttaattagtccatatattgaatccatctaacaaatatgtactgtataaaatagatgggcaaagttgaaggtttatgaatccttatagaatccttaacaaatatgcttatcacccttatagaatctttcaattatgaattataacaagatttagaagaatccatatcacattctatctggtgacatggcaatcaagaactagctatgcaatttgcatatatagacaggtaggaagacattacaatgctttgattcatgacaatacaaatatcacagaaagccacatctttagtagattatcacagtctgcaaggaatattaaacagaccaatcacttttaggagctttcaaggaatatttacactcaactcagctgattacattgtgccccaaagcgccaagcactatattcaaaaagtaatggcgtgtgactaaaaggtatgaatacagagtataaaaatgaggatactgttagaagcgtgggcatgactttgacagagttcaaagcaagaatattacaataagttggaaagtcaaaatattgtgattaaacatggtcaataaagatagtcaaagtttgatatcctagttaccggacatgaatttagagtaattaccttgagttggttagttcgtaggaatgcttggataccatgtaacggagctcccacaggaaaccgaaaatcaagttctgtatagcaattagcaaagcaaatagtatgaaagtttagaaaataagtggaatataaatacatagcaaaatacacttgagttagtttagcacacttagtagaaatatggcaagttgtcttatcagtattggcctaatgcaagatcaagaaaataacacgccagagcactttttttttgccgcccacaaaagaacaattagtgttctagcaaatcgtctcatagtaatttacactttgtaaactttaaatattagcaacggtttaactttctatgaaaggtagctcaaaagtaatgaagaatgatttcagcacgacaagtaaaaaaacaccacaactcctacaactgttaggcacatgggtataggataactgaacataccaccaatcgtgcctcctttatttacaaatgtatgggtatgctccttcactagcagattattatcagctccaacctgaaacaaaataaggttgaactcgattaacagttagtgtcaaacctggctaatacagaaaaagtacaaattatccgactcatgaaataaagtaattgactacatgcttcatatagacaaaaataaagatagcatgttctcctcacaatatactccgggagtacagatttaccatactctagtaagtgcaaacagatggcattcctaacttttcatgatggaagaagcatctaactcagctccattatctacttagtgcagtctagattaacaaaatacttgaaaagtagacattctccaaccatctgaaagaacatagaaaattaccttcttcataaggcggaaaagattgctgtaacacccgaagaacacgtgcagccccatctcgatatggttccctttcctatccacaaaagaaccgactttgccgccgataaacggccgggactcgtacagatcaacctgcaaaagaggaacatcaccccaattttggtaaaccaaaaatcactgtcttttccctggaagagcagaacacggacatcattgcaggcaatgaattgaagaaacctcatggccctggtccaagagctccaccgcggtggacatgccggcgaggccggcccctatgatggccaccttcagcttcggccccctgtagtgctccggctccggcgggaacaatcctttcggagctgccacacacggaaaaaagatccccaattcaattgctttcagcctttcacagtcagcagcatattcaggtaatcctgtagaaagctactgaatgaacctagaaaagaagaatctagctactacacatggtcagactcatcacaagcaacaactaactaactaactaatccacaaattcagttcagttcagagccaccaaaatccagggttcaagaatttgtgtctccttggttctatccatataccaaaaccgttcaagaatctctagggggagagcggagtggcaccgcagaagaaagaatcgaccggagaaaacgaaacccaagaaaccctcaccgttgacggccatgtcggagacgttgctgtcgagcgagcaccgcacccccacccccacccgcaccctgggattcgggcaccggcgccgcctcctgctgccgccggcggcggagaacgacgccggggccagcgtggacggcgcgcgggacgtggcagccatggccatatgcctcagctcaccaaccaacgctgctgctaggagtagaggaggaggaggaggaggagagtataaatggcgtgagcgcgagaggtggaagaggatgcgggtgggggaggaggcgaagatgccgtcgagcagcggatttgtcggcctccgtggcgccaccacgcgcgcaccactgaagtgaacgccccttttttttggatggatgggtgaaggctcattcagttcagacgattttcaccaggattatcgtagaatttagggacaatgattttttttaaaataaatcgtttgttttgcatgaatggattctactactaaattccttaggattttagtcttacaagctaagctaatttcataggattcttagcataagatgatactacctctttgttcttaaggaaatttcgtaaggaaaagtgtacgtgtgacatcctaattctttattttctctattctttgatctggaaattatataaacaaaaataaagggagaaagcgacaaaaaaaaagaaaacaaaacaaaaaccttgtgactgggggtgctccccctttgtgctaggcgcacacacaatcacacacacatgaagcgtgattttagatttctttggggaggttcgtagcttctcgaatctccgcctctcagaagtaaattttacataactacgtaagttttcaccaaaatatcgtaaaactataagatttagcgttaactttatcacaaaatttcatatttaatattgaagttatcgcaaaactacaaatcgtattgttttaatccaacactattgttgtgcgcgagctatagacatgtagtttactgattaaattgccactaaatttgtagttttgggataaatttgctacttaaaatgtctgtagttttcctataactctatcttaaatctatagttacatgataatttgttgctagatctgtagttttgtgatataaacaccttaaatcttaaatatatagttatacgataattcggttaaataatttactcttttaaaaataagaatatacagttgtacgatctagaaaattatgtgcttggtaaaaacttaaaaatggattaatataatttgcgaagtgagcgcaactcaactggttagatttccttgtggtggaaccaactcaccccggttcaagccctagacttgatacaagtgttcgcatttatggctaattattctctcaatggtatacgatatatccgtcgatagtgaggcgtccgtggtgatttcttcaatctcaagatatgccggcccaatctttcagatgtactcataggggtagggtgtgcatgtgttcacacgttatgagcatctgcgtttgtactgtgtttctaaagaaaagattaatatgtttttaagcccatctttccctatggaatttctttttttttcgcataaagcacaccttttactcgttcagaaaacacacatgtgaaaagtgagaggagaagttggaaaagtgtattatataatacactcttacggaacttctggtataccagtaatcgtgcacgtgcaatgcacgtctccgcaaatacatatttcaaacacaagctatgggtaatgtaacacaaaaagtggcggtacattcatgtgacatacaacaaaaacaaagaaaaaccctaaaggtacatttcaaaaccagatgccgtgcaaaaaaaatatatatttttgagaaagcgcaccactctcggttaccctgtctggtgctaagagggagatatcccaaagatacatttcaaccaagtgtcatccaataaaaatactatgagaaagaacatcccagtggagagttacggttgccctggctataccgtggggacatcagagtggaaattgaagatgcttcaatttattgtgaatggattatacttctgtgaggattgtgtcctccaattattcatgttagcttctagacaaaggtgtcaaacaatctgagttttctgttgtaatcacccacacctattttgaacttcctctgtttatctgcattctaaacctgaaagaacatgacagacaaattaacatatcaaaattctctaaatctgaaagacatgcaaacaaattaacatacatgtctcaccgtcttctttgagttatacatgtacattgactgccactctaaatacacccttccacatatttccaggtcaagcagtacatgctatttttctacaacaatttaccagtggtaaaacttctaaacgctgaatactgcataattggatctcctaagatggctagcacttggtatgagtccaaaatttaggcacctttgcttgattgtagatctgtcacaagcaatcttcctatttccacaaaaaaaatctattttttgcaagcatgtctgtcaaactacaatccaggtttctactctgaagtatataaaaccgtggcattatattaccttgatccctttcagtgaataactgaagtaccttggatattatacaacatgctttgagtggctttttatgattcttaacggaaattcaagctttggtttcataacaagctcaatactgtagctgcagaagtggagagaatctatagctcaatgagcacacatttttcttagacaatcccatatccaagaggtagttgattcactaaacatttgaatactgtcagacctgaggtgaaatccttctttaaaacattattagaaagctaaaaagactttaaaaatgcagaaaaaagcaactataatcaaccaagttggcactgtaattcatcagaaaaaacaattcttgaaatcatcatctgcaaacacaaatatttagtcctctcttaaattcattaaaattgacattttatgaatatgaatttagagaacagaaaataagaaatttgaagtgataaagaagcgtgttcataagcaggtatctcaggtttcgctagtcggtgggcacagcggtcaggatcaagctataaaattcacttatagaaggaatatctgtaattcgttaagcctcaaaattcttcctgtttctcctcagccttaacagtaatgacaagaaaaggtattcttttttctttctcgaacacgaaaattgagtattctttaagtaatggcaaaggaaaaatatagcattacagaacatgacgaaagaagttgtgaggcatcaaatagttcgatacctaagcattgcatgaaaaaaattagttgctaagctatatggttcagattttgcaagacttgtgtgcatgctagttttttttggacgcctagtaggaaactgtcaagtgccaacttacacttctcaaagtgtcaagcacctgtgtctaactacatatccatgaaaatcaagcaagtcttctcaaataatcttgcattctcaaaacgacataattgtaaacttggttgctcaaggataacaaaagtgaagtgtttgctaaaaaatgattaatttgaatgagatacacgccttatgattaacaaaacccctcagctgttaacatgcaaaatatctgtgcatcaagtgaactgcagaaggctttacaccatatggtgaagatggcagcggactacatggtgatggatgtattgtcgtgctaaatcctcccatctcaacttccaaccacagaagttcttctcccatctcaaattttctgttcaaactccatcttgattgaattcatcaatagcttgtgctgattttagcattttcctgcaaggtttgcaaattagatatgcttatgagaaggacagaatggatgcagcacataattttagattaacataaacatattttatatgggaattaaataagtaggggtcttcagcccattgcagcaaatatctagcagtcagagcatctctaagtaaaaagattgatcacaacttgaccatgttacatgtcatgttcttactactgcttagtacaacttaatgaggtcaaactcatgtacttatgacaaaaaaattaggcttcactttttttttcgtcataatgcacagtcgagtagtagaccaattagaacacactgctagatcaatatcaatataagttagtcaaccacctaaaaatcactgctaattgacatggcatacacatactttggatagagcaacaattcacaagaattgacagagagcaaatgcatagttacctgactcttagaggaactccttgaggtcgagacttaagttgatagatatttgtgacctgataccgtgtacgaataaaatatttgccaatcactttcacaactccctgagtgtgtcaagtgattaatcaggtgtgcagttaattctatagaaattactcatcattgggtatggtgctcatcctatatcagggcatccaatgttttatagagaaattaagaaaatggaggagtgggagctgttgttaccattttatttacctgccctctgtccttgccattgttgatctcatgatctgtagttctacacacaggaaacattaaaggttaaacttgctaatacttacccaatatagttccaagcttacaggcaatcacccaataggccaataactgatggaacatagagatcgtttgatgaataattgtgtgaaacatgaagaatgaaaataattcaattgtttcgaaacatatcattccctcgatctagggagcaatactgaaatttttttccctaactatgatatcaattgcaaaccaagaactgacacgacttgcaagtgcatgcctcgtaccatctgattatgctaaaaatagatccatcaagaaagatgcattgagaattgacatgaaaacttatgccattgaaaagatcactttataataaaatactcacaagggaatcagtgtaagaaaaatgaaattcttggcaagaaataggagaggttaccttgcttcgtcatggagatggctgggatgaggtgcagcggcactgttcttggcaagggagagcgaggggtcggcggtgcgactgatcttgccgatggcgagtgagtggctggcagcggcgccaatctgagagagttggggtgaggtgggaaggaggaagcgtcgtcgaggccgtgctccgcgggagcagagactggttttcgctcctggtggatctccgtcgcgccacctcaaactccgtcgtcaggcggatctccggcgaggctgcgtacagcggtggtgaaggagatggccagcaagatcaagcggaggaggaggctgagcgattttgtggatggtgaaatcgtgtgtaggctaatcgattttgtggagagcgatatcaaggggaagaggaagctatcggcagcgtgatttcaggggaaacgattttttgctgcgccagggtatcagtgcgcgaagggatttacagcggcggggatggggattcggtgcgttcacacgtgggcccagttttctctgatttggcacgtatgattggagggcaaactactcatttttatattagtatagatgtagctttttctacaatctccgaatgtgaaaagctctcctaaacaatttaaattgtagtaatagaaagttgtagaatctagaaaaaaggaattagaaagcagaaattagaaaactcaaacttttccagattctcgcaagccagcttcttaaaatcttaagcttccttgtttgaaagtaatgaagataaagattaagtactacatgtacgtaaaatgggaaagtttttagcacatgattaattgagtttaattattttaaacttggaaaagaaatttatctaatattttaaagcaatttttatatatagttttttttgcatgaaatatattgttcaacagtttgaaatgtgtactgattaagataaagtctgtaccataattaagaaaaaacatggccggctagagaatgtccgtgtccttgggaggtgctagtagcatgtactaagccactgtttggagaactagtcaaaagttattttaaaaactgttttttagcacaaggaaatagccctaagttgtcaagagttattttaagagttattttttagcacaaagaaatagtcctaagttgtttggatccaagggtattttgagagctatttggcctttaatgcactttcccatggagagagacaaaaaaacactttttcagtggaccccacctgaaatagcctcaattagcactccttgagagggatagttttttttggtgggttgtttccgaataactttaaaatagcttatctgtttagaacttttgagctatttaggactatttaaaggagggctaaaagataacccatggatccaaccagggcataagacgactttctttattagatgggtcttgacaaagacttccctatgtgaaaaaactgtatacaactccatgcaagtatatgaaaaattagaaatgaatccactactcattggtaaaggagaaaatctcttgtatacctctaaaattttagctaatcacttctatacccttaaattttgcttacttctttttatacccaaaaatttgattttatcccttcatgctcctcatattagttgaccgcctaatttctataaaaatgaccatttttactctttggataaacataaaaaattatgaattgtattattgagaatgtaaatgtttgttacatgagactattatagttatgagtttgttgtgcgatacattatttttgacaaaatttgtttttagataataaaataaaatatatatatttatttttttagaaaaaagacgtaaaaatgaggagcattcgtataaagatagtactacagatgctcacgatatttttttagtgctcccgataaaaaaatctattgttatattaaatttcaaataaaattttaatttattacatttgttttatttttaaaatctatgtcaaaatctatctgcagagaatgattgatttatcctccctatctgctgcaaaaatctacagtataactgtaagaagaatctatattattgtaaacttaaaaaatagattaatatgatattttagaacaactttcatatagaaagttttcgcacgaaacacaccgtttagcagtttgaaaagcgtgccacaaaaatcttaatcttaatccaactctaattggagaaaagaacggggccattgttgcacacggaccatataatttttttttgaaattgtactgttgaagttattttttcttagaaatatacgagattccaacaaatttatatgaatagaccgtcgtggcggtttggcagtggaaaatcgcgacgaaatggcaagactaacacgcgatattgataatgacatgatgacgcaagcggtgttgcaaggggacagtacgagactgctttgtctcgctggttagcctagcgagaagggggtcccgcttgttcccctagcgacacagccggaatgacgtaattaataatcctaattagagattaattaattactagatatgctaattaaataataattaattgttaatgatgctaattcatgagttaatcgcgcgagttagagcagcctgcgcgtaccacgatcactaattctcgcgcgcgtgtcggcggcgcgcgttttaggcccagaaggcccagcgccactgcgccggcgcacgcctcctccacgctttttttttggtttttttacctttttttttcgttttttccccactttttgctgattatttttaatctttagcatgttttgagtttgaaagttttaaaattttgagttgaaaattttcaaatctgaacttgaaagtttttaaatctcgacttgaaagttttcaaaattttcaaatatggatttgaaagttttcgaatctcaagttgaaagttttcaaaattttcaaatctggacttgaaagttttcgaatctcgattctcgagttgaaagtttttgaatctgagttgaaagttttcaaatctaagttaaaaatttttaaaatttgactttaaaatttaaaacttgaatcaaaagatttcaaatctaacttaaaattttttcaatccgttagtaaaaaaagtccccaaaaaatatccagaatctttcctaattactatcattagtgttaagtatattaactaatataggtagttaagactaaaaggggaagtgcacgctagcggcacgcacgcgctagctaggagcccccgcgcgtacatgccacgcgacgtcgcgcacccactgcgctggtatatttctaccctttaaacgtgtatattcatgtaaaatcgatgaaaaaatatatattttttaaaaaattcactgaccatagatgaacacattcttagtggcaatatctgatgaatgccatgtgatcatgcatatagtttgattaaggacatatcgcacataaaaagtcaagaaaattggcgtggcataattgttggtgaatatttagataattgttaccgtggaatattttggacaaccgtttggaaggttctctaaatatatgatttatgaggaaaatcacatgtaaaaaccagaaaattatattattatagatttggatatatatatagctcttgtctagctccaaaaagtaaatttcatgctggacatttttatgtatgaattactatcaagtatggatttgaaacattgtataatcatgcgcatccatctttttcttatgcttatgatttaaattttaaattttaaaacttaatttttagagttgactttgtgggtttccatcgtttataacattcaaactaagaatgtgtatataaaaaatattaaccataagttaatgtgtttttttatttgctactaatataagtcatacttcctgcgtaaaaaaaaaaactcaatcctaagttgggtattttttacggaaggattagagataagtatatgcacaagctaaatggtggagcttcgctcattaaatgtttgatagtaggacccacatatgttagtagatgttaggggggaaagtaagcgtgtggacatagacaacaagaggcatgcattgcattttgtttgggcggcagtaagtgcgccttatcgagtctacctcccatggtcgtgggtgaagcaccatggtcggcgaccaatatcctctttttcgtttacttggacacccaacgtacacctcagcctctttccttccactccaaaataagaccagtgaataaatgaatcattaactctccattaggtttaggaaatcttgcaaaccactttaattgtgtgtattaaaaattattggtgaaaccgtttgtgtgcctgttaattaatcgaggcaaaaatactatgtaaatgattttcgtatgttccaactcccaaacattgctttttcacatgcgtctcaaaatgtccagccacctttgcctcaatgtcaatggacaacctgtggaaatatagaaaaccatatgcagtaatggtttcaaacttttaaaattcatggaaaaaatcactttaagtttgattgaggtgaataaaatagctctgtgatctttacaacaattaattcacaaaatattttattcaccatagccggactaaaaatgttttttttcataaattctaaatggtccaacatcatatactctctgtttccgaatataagtatttttatgatgtagattgtgtactccctctatcataaataaagtacttttgaaacattgataagtcaaactttttgactttgattgtcaatagcaaaagaaaatcatagagattacgtatgcaagaataattttactagatttatggtgaaacagactatcataatgtttaactctatctatttagaataaagttatctttgtagcatatccaaacatgcttatatttatatttatagacgaatggagtatataatataagcatttccaaggcactgattccaattaattcacgggaatccaatcatttcggttaatcatgtgcttaggtgggaaatccaagcaatttaaaattcaaattttgatcaataaggagactagaacatagggcctgttcactttgatgccattttcaaccttaccaaattttggtaaagttacaacaaaaagtggctatatttagtttgctgctaaattttggtaactatataagaaatcctgccaaaatttggtaagttctttttagcatcaaagtgaacagacccataatcttttcccttgggcttaatctctactaattaaacaacctaaaaatgcttatatctgaaactgatggagtatttaaaatagacgtaaattcatcctgaaatttttacaatttggtcctttttgaaaacttattttacaaatagacccctgggaaaacttaaaccggaaatagtcctttttggggcgccagagtggctg

SEQ ID NO: 38818 - DNA, 4770 bp, Oryza sativa
tggcgccgtgcccgtgccaccgtggcactagggctgtcgtggaggtgctgactgggcagaaagggggcgccagccacactggcgccgcccctcgtaccacggcgccagcatagctggcgcgcccctcctctgtgccttaaaccccgtgggccccaccacctttctcctccccactcccattttcgccattcccagcccgagcagcgagctgctgttcttctccctctctctccccctcacctctccacctcaaatccactcaatttgaagccgtatttcgcgggatttgttgtggaaatcgaagagaaaggtagactccttcattcccccttcttttttttcatttttattggttgaatttgtagatcggtgggtaaccctagaaccccttttttacccaaatttgtgatttttagcatttgttcttaggattggcttgttgtagtgctacatgtttgcaatgtactcattggtgtcatgatttttttaaccatatatgtggtaatgttaatttttggatggtttggttggatggatggatgaaaaattatggttgaggcatgacggaggtttgggttgtatgatagagtatttgtaatattatgatgagttgttggataaagataagtggtctcgtgcatacgatagaaatggccgccggtggggttacatgacaaccaacatggccgaacagttcaatagcgtgctagttggtgttcgtaagcttccagtgacggccatcatatcatttacgttcatgaagtgcaatgactactttgtgaacagacatgatgaagctttgaagcgagtccagttagggcagcgttggtccaccaaggttgacagtaagatgaaggtgcaagaaagtaaggcgaacaaacacactgcaaggtgtttcgataagcagaaaaagacatacgaggtcacagagaggggtggtataacgcgtggtggtgttagattcggcgcaagagccttcaaagttgaaggtgaggggaactcatgttcttgccaaaggccattgctctaccatatgccttgctcatatcttatacacgtttatctgattcatgcaattgataaggaatctcccaaccgaatgccgtatcagttctcttcaagagccgttgtgaaaacatgggcaagtcgctttgagccatacctcgaccccacacagtggccatcgtacaatggtgaagaatttgttgctgacccaaatttgaagattaaaacaagagggaagaggagatcgaaacgattcaagaacgaaatggactcgggtctgggtggttctggaaggaaaccaccttcatgcgttcaacttgatgctgcgccggtgcaaaatagatgctcgttgtgtcaccaggagggtcacaagaaaactaagtgtcctaagcgtccaaaaaagaagaagtccaaaaaaaatttaagtgttagggaggtaaatattttgttttcctactcatgttctcgcattcattttcttttaatatatgtcacattggtaactaacggtgaatttattactttttcatgtaggatggccgaggagggacaaccgccgacttactacgaggcccgtcatcgcggggctgcgatcgaggcggggagggtatgaatcggcattgattcacttgtgcataagtatcggtagcgtgtatttgacattatattaactaattgatttacaattgctaatgcaggtacttcaaccgctccgagtcagagctcatgcccccccagtgttcgacgataggtacatcccgtacctaagggctgccgggttgctcggggtggccttggtcgtgagcagaggaatgccagtgttcaacgctcctacgttgacagcacttgtggacagatggaggcctgagacacacagcttccacctccccagtggtgagatgaccatcactctacaggatgtggctatgatcttggccctcccattacgggggcatgccgtgacgggcaggacagagactcctggatggcatgcacaagtgcagcagctgtttggcattccactgaacattgagcaggggcaaggggggaagaagaagtagaatggaatacccctgtcttggctgagtcagaacttctcacatcttgacgacgatgctgagccatggcgtgttgagtgttatgcccgtgcatacatcttgcacttgttgggaggggttctgtttcctgatgctgggggtgacattgcttcggcgatatggattcctttggtcgccaaccttggtgatctgggccgtttcagttgggggtcagcagtgttagcgtggacatatagacagctctatgaggcctgttgtcgtcaggcaccatcatccaacatgagtggttgtgtgctattgattcagatgtggatgtggttaagactaccggttggaaggcctaagtggaggcatagcttcactccttggccctacaatgagccagacatggagaagacagtggcctacctttttgagagtactgccactgcacatgctcgggatgtggcatacaagcattatgtcaatgagatggactgcttgcagcctcaacatgtaagtacttccaatatcacttctagttagacatttacttctttaattgagatactaaccaacgacatctcttcaacttttgcagattgagtggttaccataccacacaaatgaggcttcaagcctgaccctgaactcgatgtgcaatcgagactctgactatttcatgtaccagtgcccattgatttgtttctgggcagttgagtaccaccttccgcaccgtgtcatgtgacagttcgggaagaaacaagattggccggttgaggacatctcaactggagttgaattacacaagtaaatatttcttatctttgtttgctttcattgtcaatgttcaattttgtaccatttaacccttgtcgatgctcactactgtttcatcaccttctacttgtctaggtatgacagggtgagaacaaagaaggtgaaagactggaggctagagcataatagatacattgatgaatggagaacagccggaaggaccgataggtacatcgagactatacaccaaaatcatcttttctcagagtaccttcgttggctgcataggacatataaactgttcctccgccctacttggacggaagccgacatagaggatgaccgcgactccgatgaggggcggaatccctatgatgtccggactagagttggatatcaaatggagcacgccccacttagagacagagtcgtaagttttcttgcatttgtcaaagttacttccatttgcaccctagaccctaacatatatcttttcacgctttcagtcgagagagctcctcaggagtgtgaatgaaatggggcatgccctctaagctccgaggggtggtgaggacacggagaacacgctccgcaatgttttagaggtaaaatttatttagcactttgcatttacttgagttatgcctaacaaacttcttttttttttgaaatgcagaaagttcgtcaaaggtgccgaaaacttgcagcaagattaggttgcaggtcggttggattggacgacgtgtaccaaccggggagactaccaccaccactacctcaatccgcgcgtccaagtactgctcgacactccatcaggatagaagagcgtgaaggagttggtggctcgtcgtcgtcacgcattaagcaagggaggggaaaggggaaggcgccggctccacctagcgacgacgatgacgatgaggacgaggaggatgaggactatgtcgcaccagacgccgaggagatagacatgtcacagcttcccgacgcgcctcaggggacgcaacccacgcaatacaacttgcgatccactcggacagcgaaaaagaggtaaaatgagcttaccattctcaaatgttatttgatttcccttattttgtttttaaaatgttttaaacattggattttcaaatgtaggtacactccgggctcgcaagcaattcggcgccaacggaagaagtaatttgtatgaagttaatctattggttggtagtatgacatatgtggtgcactatgtgatataaaatgtgatggactatgtgaggactatgtgatggacttttgacattgtttcatgtgtggaatataggatggactttttgcattgtttgatgtgtgggatatgtgatggacttttggcattgtttgatgtgtggaatatgtgatggactatgtgaggactatgtgatggacttttggcattgtgatttgtgcaattggaacctgttttagtctgtacgaatttgtgaattgtgatttgaattgcaaactgtgaattggtacatttgtgcaatatggatcttcaatttgcagagaggcagagggcggcgccaaccaccctggcgccgaggttgggaagggcggcgccagccagtgccgcgaggcagaagggtttcgggctgggggagggcggcgccagctaccctggcgccgtggtccatgagggcggcgccagccgaggcccggaggcagaagggcttcgatggggggaggaggggggcgccagccaccctggcgccgcggtcgggggggggcgccagccgttgcctggaggcagaacagacttggcgaaaattttggggggggggagaaagttggtggggcccgcataggaagggcgcgccagccatgctgacgccgtgatatgaggggcggcgccactttggctggcgcccccttcggcctagtcagcacctccacgatagccctattgccaccgtggcacggg

SEQ ID NO: 38819 - DNA, 13246 bp, Oryza sativa
aaaatttcagtaaattcatctcctacaggcacttttttttttctgtggttgtattaattctctattacttagatgcagtcggatgctcgtaagcatggacgtttacaaacaaaacctatatcagtcaatagtttccggatttgctaactcgcgcgtactcgctgcgggcgagcactccggcccaccccggcccacgtgtacacgcggtccatgtcgctcacagaggagtagtgcgattagcgcgagggaaacctgattagcatcaggattagcatgctgatttttttacgagtagttaggccgagtagttagaccgtaattattatttcggttaaagtttgaaaactttctactcaaatttaaaaacgtttaacttatatttaaaactttcaatttaaattttaaaactttgaaattaaaatttaaaatttttaagtcattttaaaaagtttcaacccagatttgaaaactttcagcttaaaatttgaaaactttcaactcaaatttgaaaactttcagcacaaaatttaaaaactttcaactcaaaatttgaattttttgaagtcaaatttttaaaactttctacctagatttgaaaactttcaactcaaaatttgaaaacttcaactcaaatttgaaaactttcaacacaaaatttgaaaactttcaagtcaaaatttaaaactttcaactctatatttgtaaagaggtgtgtgaaagattgaaaaaaaatcggaaagaaacaaaaaaaaagaaaaaagaaaaacgcgttggaggagaaaaaaaatacgaaaaaagaaaaaaaaagcgcaaggacagcccagctgacatgctgctggcgcgtacgcgcgcgctaggaagccccaatagtttcacatgagtaaggaaaatgatcatgagaggcctataaaaggaccatcatatacccatatatacatctcatcttaggaataagtccacttgccgtccctcatctttccgctgagtttaattgttatccttgaattgcaatactagaaatcttcgcccattatcttcgcaaaaccatacaaattaaatcagatcccatagtagtatgcacggtcgttttaactgacgtggcatcatagttagtaaaaaaagagcccccaattgtaagtggcctctaaatcccctattttctctttcctgtttccccttgttgaagcggaggtgccgcggcaccaggggccgaccaaaggaggttgcacttcttgccagtggcggcgccatcatgaagcatcaaggggcgggccatcgccagcacgaggagccggtggagatccattgcattcatgcagtggtcatgaagcttgaaaaagagcgcgttggtggaggagccgtccttcggggtggcggcgacggcggcggccgcgagtaactagcgtatgcatttggatggagaggtcggcaaagcgggggcaacggaggtggcggtagatgtggaaggcccttctagtgcaccaggttcaccgttgtggagaccaccttggcctcagtctcgtgctcatgctcggcgctgatggttggggccacttttttgctgcggagtggagagggaagtactagagtgggctaacaaggggtgaggaggagaggcagagctcgccgggggccatcgactagagggtagacgaagctcgctggtgggaatctacactgccgccatgccgtctccccccacggatgcgccgcccagtgacctcatctcgaagctcgatgcagcggtggccagtgaacacacttgtgtaccgctgcccgcggcacatccttcacccacccccgccgaccgatgacgagtgtgctccgattagttcccttttgacgctgaggtgctgatggtggaaatggtgaggaccagtgcggtggccaatggcatggaggtcgagctccctcgtcctcttgctccgtagcagcctcgcaagctcctgccacggcctcagatgaggtgaagaccggaagagaagatgagagagggggagtagaggaagaagatgagtgcctacttacatgtgggccccacatgtttatttttatttttcgctaacttggctgctacttcagctaaaacaccaatccatactgctttgggatctattttgaacggttttgcaaagataaggggtgaagatttgtggtattgcggtttagagatatcaattaaactcggcgcaaacatgaggtacgataaatgaacttattcctctcagattacatggtctgagagtactccaatttgggccggtcctggaagtttcttgtgggccggaaggctccatgtcaggagagaatatcactttgcaattggagcatagagagcataattagcatgattctgccactataaccactatataagcatatgtactgttggtttatattcttccttctacctattgaggggttacactttttctaggcctatggcaccaataggcatataatgtaacgctctaatccgacatgatgatatctcctgagtattcaatgaccacttgattacctttcttctctgactatccaaagtttttgtggaaccttctatttttctccaagagtaggcgttgggcattgtttctataatttagctggtacgaattatctaacttctgttgtttaattaaaccacctactaaaattaagtaggataagtttagacatataaactatacatatggactacttatatggaaaatttgggaaccatctgaaattctcatggaagccactttagcaattatgaagatccatggagaccaatttcaataaagccttatcaaccaaatgtgttcttgtacaaatatttaattgcaaaagttatacagtgaataaacatatacattctagccatgtgtacatcctaagccataggagaatacacactgcacactaccagagaaaacgttctgcagatggccaaaacacatttttaagacgggcaaacactccgcttgtaactaaaggcctgaaaaaaacaatttttacaggggagcattcatccacctgtaaaaattaatttttttaaagataggtaaagctgaccacctacagagacaattttcggcaaaaaaaaaatacatttaaaaatatcaccacgcagctgccttgtccggatcaggcacgggggtgactgcacgagcgtgcagtcagcacacatccaccgtccgagccatcccacggaagcccacgctcacaagcgatagactgatagcggacacacctctggactccgataacatatgcgttcattgtcgctatcgccgtcgccgttcacggcagggactgacccaaagctcttcaccgggatgcgccgccaccatagccaccgggagctgtagcttcctcgttgtccccttgagcgtcgtgcacgtactccactggttcatcttcctgctaggactggatatgcagcaattggaagcaattcaacatgcatgctgcctgtgaaaaaacttggaaaatatggatgcaccaagaccaagtagtagcataacacgattacagttacaatgagcagcaagcaaagcttgcgttctgattcgatcgactatgcagcaagcaacgtattacgttatgtacgcattcaatcagctggttttctacagaaacacaacgagaacaccttgtcacgcttgcctccagctgctgctgcgccgctgccgctacagacttgtcctgaacggaagatgggtcggcggagattgaacacgacgtactctctccatcccaaaatgtaagcatttttagcgcgtgtctagatccatagctaaaaattactatattttgggacggaagtagtacatccgaggagacagcagtgaagcccgggtctcgtagcggtcaatggtggcgtatgccggtggaaaagcttcaggtcactcggctgacggcagcgcataccggcgtttgagctccgggccactccccggcgcaggcgggcacttcatcgctgctacttgctgggttttcgtgggcttcacgatggctggttctgtcagctatggcgtgctgcctcctgaggcatcggatggtttggacggtggatgagtgctgaaggcacgcgcgtgcagtcaccccgtgaaggcagacaatcttgatccgccttgtcccatttacacagaagaagcacaatgcaaatcaaatcaatgtcatcacacaaatgagaatagcaagatttacatattccacagaaaaaagaggaaataagggaggaattatagatctgaatgtgatgtgagaatggaaaaaaatatacagacgttttctgcacatatccaaaaatatttttttctcaatcctagaaggtacgtgaatagttagataagcaatgactcacttaactcacattaatgatttgatatctatatacctaataattaaaaaatacgcaaggtttccggtagtaaatttcgtccgtcccccggtttatccacgcgagcgatccatttttgaccgtgcgtttaacgagtccgatctgttatggcggatgttgcctcactaagaatatttattattattaaattttagcaacaccctatgacacaagcatcataattcctagttggttacccaacgaagcttctaaatggtaggtttggagttcgactcccaccaccccttagttttctgctgcttaccctctcctatttttcctttttctctcctaagctgattatatatttttaaaaagtacatccatatatctgaaattcatattaaaccaacaatatatgcaattttttattgtgcttttctacactttatcgcctcctcttattaatttttttttgaaaagtatgtcctatttttttctctcttctaagcttgattatatattttttttaaaagtacatccatatgtttaaaattaatattaaaccagcaatatttttaatttcccattgtgtttttttatcacctcctcttattaattcattttgaaaagtacgtccatgtgattgcaattaatattaaaccagtaatatatgtaatttcctactgtgtttttttacattttatcaccaactttgtatttttttttaattgataacataaggaatatctttcaaatgtcatggtgaaattcatgttaaaccggcatatatataattttctactatatttttctatacattatcatcttttttattaaaaaaaacctagcattttatcatcgatcttttaaatgtcatggtgtaaatcttgaatacccataattaaaatcttgtgtcggccattgggttggttgtgtggcctcgtgcgcacatgtcttccaggatcgttatcgatcaagtttatattatctattttctccgaactagaatttccataaacattgcaaatatgttgtgctactgtgggacccacaccatcaaggttcccaacaccccttggatcggaactaccacatgcgaactcaagtgtgtggttagacggactcgagccgtcgagcgcatgagtagctgcctgctaatgatgagacgcaattaatcctatttaatactacatctatcttaaaatgcaagtatttttacctatgtccagattcatagttaaaaatgcttatattttaggttagaggtagtaattcttacttccaattaaacaataatctccaaactagaatatattttaaagtatttatcaaatttctaatcatgtaaaatatcaacaaggtgaaatccatagtcattatcttttttagctatctatgtgtaaattggtaaagctgaattaaattaggctaaatttccatttgattatattgttcctttgtagaggtcgaccaagttgaaggaatctattcttccaatttgatgaaaattctaatgcatttttttaaaggtatacatataatagcatacattactttttaaatatgtatgatcaaattagatttatgattggctacaatgcaatcctgatcgaattggaatacagatctggtggcttgtatttctcaatgcctaggtgggtccttggttatcttcatattagtgctatcattaacaaatttgaattgttatcatgtttctcctcacgtgataaatcatattcagcttcagtaacacaccgtttattagttcgaagagatatttgcaattaagtgaagcaagcgctaggagatagattgccatgtgggtcaacatcatgatccatgatataaaaatactacgcatgtaagacgtcatgaaactaaacaattagttttttttcgatgcaacacacgggcattttttctagtatattttaaaaatagaatgacctacgtgacaccaacaagttaaatgatccttgttgcattttagtcaaatataaaatgtgcgggtgtgcagcacatccaaacgtgtctatatcttcgtataaaactatggctctcaacaaacatatctgcaacatatctctttcatttcgaacggtcaacaaacatctcttctttttttatattaacaaacaaacatctctttgaattaacatggagatggcacacgtcaaacaaaaaaacaaaaaaaaactgggaaacggaatcaaattccagcaacagcataaataaataaataataaataaataaacagcataaataaataaataaataaataaataggtctgctacaaaacgggatcctgttgtaacgggatagacatattaactatttcttgcacgagtatcacaggtattaggtcctaggtatcgcaggtaccgggtaacaggtatcacaggtatcgggtaacatgcagctggtaccacaacagatatcagatatcagtactgtctcttcttataaggataccgttgtctaggttttctgataaataaacccccaaacaagcggaaggagccaaccaatcaccaatcaccgaaaacaccgtgcagcagcgaaacagcagaaacccgcgagcgcagaacggaaaaccgaagtctcctcgatggactcctccgcggcgtcggcggcggctgcggcggcggcgccggtggtgctggtgacgaacgacgacggcatcgacgcgccgggactccgcttcctcgtcggccagctcgtcgccgcccgccgctaccgcgtcctcgtctgcgcgcccgacacgtgagtgttgctccgcttccccatctctccacccccttccccctcgtgatcgatagagcgagtgagcaaaccctcgcgtctgcctctgagattgatttccgtagtagggggggggggggagcgcggcggtgctgtttgtgaatggtgatcgattggttgggaattgggagttggagttgaattggtaggattaggaactaggaaggagcatgtgggagagaaggcgaggatttcggatgaggaatgctcgttttgcttccctctttggctttctcagctacaaagaaaaatatgaatgaggagagtttttttttaataaaaaaattttacccctctgtaaatttcttgctacctacagaagtacagattatatagtttacttcgtttatgttctccgtgttgatcgctggtcttcgaaatggagaaactaattcagaatcaggaggattttgataatgaaaagtagtagtggtgattagatttttgttattcggggatgtttttctgtggttttggtatgctgtagtttgctaaaagaagcagattttagggaacatggaacctataacagtgtaactgaacttctcttttcacatgatggatcatcacaaaagcaaggaaacaaagcatagatttaatcatagtatacgggtatcaagttttgcaagatgctgtgttcagaacatggaatctgttccgttgaagaatattcttacctgatttttagctccaattacatcattcggttgccaagttgtggtaaattaaaatgcctttgtgggggcaagtgttttccgaatctatgatattggtgtactaaatcaagtaaaggatggttcattcactgagttatttcctttgcaaaatagtggtattcttgagaagaaaactaacacactatgggagcttttaatgcctcgacatgaaaaaaaaaacagagggcttccagtagcatttattcgcggcatgtgatcgtgttcctctaatggcattattcttgtgcttcaaatatgcagagacaggtcaggtgttagccactccatcacatggcgccctgcactccgctgtaaacgagttgatatagatggtgctacagcatttgcagcctcaggtcttgtatttttgactgatatcatctacatatgaacttccttatagactattcaatgtcaaggacagtgcatgtcaaatgcctaacactacacttaaataacaatagggactcctgctgactgtgcttctttaggcatatctgggaagctctttgatggtttggttcctgatctggcaagttttggaatttcttcatagataaattgatgtccttttatggttttatgtcatcttcaactacgaaaaggtttaccagtaacgcttggttttcattttactttatttcatccataatgcaggtagtcagtggaatcaatgttggcaacaattgtggatgccatgtgtaagtgtatcaatccatgcatattcattatctcaaacatattgtcatattgcttctcccgcatccgcttatttgaatacctgttggtactttacatgtgcaattattgttataatttccatgtggaattgcattctgatattttcaataacaattactgccatgatatagttttgctgttttttaccagcggtatagtgttaaaattaactgtctggattgtacagatcataaaaataaaaataaaaatcaacaaatattttctgacttctgactgaagccattgtttgaggtgtcctctaaactatcaaggaattagtactgtaattgcactggatcatgagaactttatgcttttattatgcagtatctattctggaacagttggcggtgctagggaggcattcttgtacgggattccttcattagccatgtcatatgattggtatgcaaagatttttttttctttgctattattcgctgtatttgctcctctgttgttcaaataacacatttacatattcagcatctactagttatctgactagaactaggttttactgtcatatgagttgtctgtttcatgtagaatgtatatatagattggcttctacagtttatctgttggtcaagctttcagaactatggacttgtttttatagttagttatatccattcttcagtacatcctgcgtactgtcattgcataactaattccaagagaaaataccattgaaagtggactgcaatgtggaagatgatggattggagtactgttatctacagagtagctgatagtttataatattctttgaggtttttctttccaacggatgtttagcaaacggtatgatttaatagatactagtctaatatgggttcaagttctttggcctccaccccaagtatacgaatttgccaatgactctcattcatgaagcaagatttatttcttgtaacattccctgttcgcacattggaaaattttaagtaactgcactaattagtagaacctttaatctgtattctacatgttgggctctccccctgaaggtcagtgagatcccattagcccgttgggttctttacaaatctaccaactttcagctgttaaacattaagttaatttgatgtatgtatgatttaatgtttgcaagttcacctttttattttgacttttcatgtgctcaagtctatgaacgctactagttagtgaaaactgaaaactagagtatccagtttgacatcccaattgcaactctcagggtcgcaagtcagagcagtgttaacgacctcaaagtagctgcagaggttgttatgcctctgataaataatgtgatggctgagataaagaatgggacatatcctcaaggatcattcttgaatatagatataccaactgatgctgcacaccacaaggtaaatctctagctgtaattttttagtaaattactccattctcaaacagatgttgttagtaaattacttttatgctgcctatctgtagggatacaaaattacaaagcaaggaaggtatatggccagaattggttgggagcaaacagtttataagaagcctgcggtagaaagttaccagacagcaaacatggatgttgacagtgaaaaggacagtgaagtagatacttcatcagagaatgacctattgtttaaaagagtggtaacttcacattgctccaagaaacattttattcttattctttcaagcacatttgaactgcatctgataggtagccttctagcaaaataaaatttactgtaagatctgtagcataaactgtttataaaagaattttggaattgactctcattcttctaaagtcgtaattattcttcatttcttccatataatatcaatggtaatagcaaaccgtttataaaaagagcttaaatgagaagtcctgtaggtacaaggtaattcacattccacactcataaatggggagcactcttacatgaatgataaccgttacccatggtatatttatgctagctagctattgattattgttggaaaacattagagtaaatataagtttgttcttttttgtgagaaattttgttaactagctctgattaaattctgaacagcttgtgaggcgaagttatgatgaagaggaaggggatgatatcgaccacaagtgccttgtagatggatatgtaagaatgacctaaatattctcttcataaaaaagaactgactactatacactttccattttctgatagaattcatcctcagataagtatatattgtttgttccagattactgttacccctttgggagctctatcccgcgcagaagctgatgtcataccatactacaaagcttgcttgtcacgtctgtatgatctttcttcttcctccttatagtggctatttattgcacttctttatttgaggttattttcaattgtggttatttattgcacttctttatgaggtcattttcaaatgtcaattctattttttcttgccattggttacttttgatctttcatcttctagattaaagaggtttgagtccgagggttcacctcggacctacatccttttcaagaaaatgccacagatttgtgctactctttttttttccgttttttacaccaaaaaaaacacactacacccagagacataggtcttttcaaacattacgatatactccctccgccccaaatataaggggttctaggttttcttactataatgtccctcattatgtggtgaatgggaatgttattgggtgtaaggttggaagaaaaattgaactatggatgattaattggactagcattactccacatcgtccgagggttcacctcggacctatatccttttcaagtaaatgccacagatttgtgctagtttttttttcattttttacaccaaaaaaacacactacacgcagaggcataggtcttttcaaacattaggatatattcccttcgccccaaatataaggggttctagtttttcttactataatgtccctcattgtgtggtgaatgggaatgttattgggtgtaaggtgtagttttgtgatttttcctctagaagcttcactccatttcctttctcatctactatacatatacattggtggaatgggccctattgggctgaaatacacacgcctacactcaacactccccctcaagatgggcgataaatatctatcatgcccatcttgctacacgaagaagtgcactctctagcacctaatgccttcgttaaactatcagctacttgttcaccagagtttacaaagcctaagtttaaggttccctcatccattctctctttaataaagaagcgatctatttccacatgcttcgttcgatcatgctggactggattgttagcaatatttatggctgatttgttgtcacaccacaacttcatggaagtgcttgtcgacagcttcaattcagccaaaagatttttcaaccataacaattcactcaagctcattgacattgacctgtattccgcctcagcagtcgagcgagacacaactgattgtttcttgctcctccaagataccagattgccaccaataaatacacagtagcctgatgttgacctcctatcatcaagacaactgccccaatctgcatcacaatatccctccacatctaggtgtccattcttcttgaaccatatgcctttacctgggcttgccttcaaatatctcaaaattctatacacaacatccatgtgaccacttctaggatcatgcatgtatcggctcaccacactcacagcataagttatatcaggtcttgtgtgacaaatatatcaaccttcccacaagtctttgatatctctctttattaactggatctccagattcagcacataacttatgattttgttcaattggtgtagaagctggccgacatccaagcatacctgtatcactgagcagatccaatacatactttcgctgtgaaagaactattcctctaggagatcttgcaatttcaatacccaaaaaatattttaattggcccagatccttgacctcaaactccttgcttagattttgtttcaacctagatatctccaagcaatcatctccagtgataatcatgtcatcaacatacacaacaagaatagttttaagacctctattatggcgatagaaaactgtgtggtctccattgcactgtttataacccataccacacattgcacgtctaaagcgatcaaaccatgctcttggtgattgtttaaggccatataaagattttttcagtctcaacactttaccttcagtttgtgaggtagcaaatccaggtggaatttccatatacacctccttttgaagatctccatgtaagaatgcattcttgacatctaactgatgcaatggccaatcaaaattagctgcacaagagataagagttcttaccgtgctcatctttgctactggtgcaaaagtttcatcataatcaattccatatgtttgactatatcccttagccacaagccttgccttgtatctttccacatttccatcaggattttgctttactgtataaacccatttacagttaaccactttcttccctttagggaatggtacaaggtcccatgttttgttcttttcaagagcctctagctcctctagcatagcttgatgccaccttgggtcttgctttgcttcc

SEQ ID NO: 38820 - DNA, 6232 bp, Oryza sativa
  unsure (1)..(6232): unsure at all n locations
tgcgcctccaaagaccttgttttcctcctagtataaacttgtagattttcttcttcacgtggccttctccaatttttctcatgaatgggttcactaacaggatatgggattgagccaaccacaaatttcatgcttcttgattgtgtgtcttcttcagtacctgatgagccattctccccctcttgtccatcctcatcaataattggattgtcaagattaacaaacaaggaactcaaatctgttctttctccatagaacggaacagactctctaaaagtaacatccatactaacaaaagttcgccgctcagatggactccaacatttatatcccttttgcccagaagagtaacctataaaaatacacttgacggctcgaggatccaattttccaacggatggtctatgatctctgacaaaacaagtacacccaaacacttttggaggaacaatgaattcatttttcccaaacaccatttcatatggagtcttcatcccaagtattcgtgatggcatgcgattgatgagatatgttgctgtcatgactgcctcactccatagaaactttggtacattcatcgtatacatgagtgaacgagttacctccagaatatgtcgatttttcctctcagctactccgttctgtggaggtgtgtcagcacaagaagtttgatgtactattccttctgctgagagaaaactcctaaattcatcattcacatattctcccccattatcgctcctaataactttaacacaagtgtttaattgattcctaacccaagcatagaaattcttgaaacatttcaatacttcactcttgtgtctcatgagatatatccaagtcattcgtgagtggcaatcaataaaggtgacaaagtactttgctccacttaccgaagcaataggagaagtccatacatcagagtgaaccaacacaaatggcaaaatgcttcgaagtcctctgcttatgtatgtggttcgtgtatgttttccatactcgcatgcatcacacattaatttgcttttgtccaccttactcatctcatcaggaaataccttagacatagtatcaaaggacatatgtcccaattgacaatgttttagaatcaatttagcctcctcttcacttgtgctagctaacaaagcactacatagtgctttgtccgtccctcttctatccagataccacaacccattatgcctaacgccggttccaagctttcttccagttcttctctcctcaattagacaattctctcggtcaatagtaattcgacaatccatatgatcaaccaacgagcttacggatactaggttaacaggaaaagagggagcatataaaattgacgacaatgtaattgatggagtacatttgactgttcccactcccctcacatgtcgtaaagttccgtcggcagtttgaattgtttctttaaatgatgactgaaatggagtatatgatgtaaactcactcgacattcctgtaacatgtctagatgctccggggtctaatatccaagttgagttaggtacctgcataggatgtgcgagattaacaaagttgccaagcactgttgttttctccttcactttctgaattcttccccttatttcttcaacttcttcagccaatttctcaagtatttgctcaattccttgaatttcccccatggcagatcaaccaaatcttctaggatactagccaaatcaattaataggagtaacaacactactcctcagtttctcaccaaaaacagaacagcagcagtagcactacttcctcccagcagcactacttttcagtttcccccaaatcagcacaacagcagcagcaagccaagctctcgtactcagtttcttccccaaatcagaacaacagcaacagcaaaccaagcttccgcttcacctccaaatcctcaccttctcaagtagcagcagcaccagcaacagcaccaccaaagtcaccaccactggaacggacaacaatagccaatagcaccaaatccttctctgttgatcctacagccaatagctgcgcgtctctcagccgctgtgctccctacagcttgtgctgcaccaaatccttgcgcagctcaaccagcgagcgtgcgccctgctcctccttcacgctgctcgcgtcgagaacctctgcagcagccgtcgccgcctccgccgtcgacactgccgctccacctccgctgtccgacgtcgccgctccgcctcagccgtcgacgtcgccgcagaacccctctggtcacagcgccgccgccgactagggttcgcgtcggcgaggtcgccggtgacccagctctgataccatgtagttttgtgatttttcctctagaagcttcacttcattttctttctcatctactatacatatacattggtggaatgggccctattgggctgaaatacacacgcctacactcaacataaggtgggaagaaaaattgaactatggatgattaattggacaagcattactccaaatccgttatattcggggataaaatttgaatgattctatcccttatatttggggatggagggagtagcattgttccccacaggcaaagtgatttttcccacttccacgctatatcatttttgtaattggcctggcatattctcatacattgacctatatatattgtccgttaattcttgccatgttaattgttagttctcatacattcctgtttgtgtaatcatcacgatggaaaaaaaaagcattttaccttgtttcctagcatcgcaactttgcttttcttgttcgtcacaattaccatgttttgtagctggtggtgtggtaaagttcatatataaattcggaaacaaaagatgacatgttacttcagtatgcaactgacttttctttcatgtgatatttttcaggtgatcaggatacttttgtggcccactaaactgaaaaagttggtgtcatggttgcaagttgcaaataaagttgcatgaatttcagttattctagatgattgttactgatgtattgccatattatgtacttccgtgattattcagagcatatgtatcacatagctcttactatttataactacagttccacaataattctttggtattatatttttctgagacttgttgcatatagagctatatcaattacgttttcaaacttctcccaacttattgaatcttgttgaaatccacttgaaagacatcaatggaacttatacaatatgatgaaatcttcaggaaaccggtctggaaaacaccaagaacagataatctgaaaaaatcatgtactcttttaccgtttcagaactgaagcaaaatccatagaatgtcaaaattggaatttgaagcatcattgaaaaatttgaaactagtctcaaaacgtctatgaaatgtgccagaaacctactcaaacgtatgaagtatctagaccacaaatcccatctcattgcaataaatattctgctcaacaaaataccaaatctttgctcaccaactccacataaaaaaaaccaatataccgaatacttgtcttcttggtgatcacaacacctcatgctattgtcggcatgccatatttcactgaagatattttgataatttctttttacaaatacagttcgtattgtcatgtactccacagccatttctagaatctttccaagatcaagaaatttaatttggatcccatcattccatgctcactaaatcgttaattaatatacctaaaacacacatcatcacagtggtcctgtactcatatacaatttcatgaggatgaccacttggcaggcacgcttgcaggagaaaacgagagcaagggacacatcaagcaacaagaaattgacaggctattaaattattatataaccaaaagcagagacagatacactctaccaacctatctccaataccacaatcaagggtaaggcatttgagcaagtattcaagtatgtatgtatgtacaaatgagctcagcctcacactctttatcaacctcaacacatgacactcacaggtaacaacatttcacccacactgggtgtttttctttctttttttttcgacgatggaagcgaaactcctagcctccgcaccaactaaggatgcacacgaccgaatttcacattcactaatacaggatgcgaatcggacaccgagaaagaagataaacaaacctcgatatttttttctctcatttcttttttggagtgcatgaatgcaaggacaatggccaatgaggatcatcatcatcaaagccaaaaaccacaccctagaatgacttctcaggaaaacccttcccttagtctctacacaaagtagttctgaagttttgctgctcatgccatggcctcaaacttcagagcttcagcttcatgagagccggatgacggtgcgagtcgatgaggatcgaccacaggacatgaacatcctcatcctggcaggactgaacatccttgtacaagatatacattcccctacctatcaagaaatgcacatatatgttcatagagaaaacaggcagcatctccacaataacatgttcgaaatgaagaaagaaaccgtcatgaagaagaatgtcgcatagtttgaaatgcatagaaaaaccatcatgaagaagaatgttgcatagatttgcaggttcatgggcagagaaacttacggttcctgcgctccgaatgcgcgcaaacccagagcctcctgagaggggagaagagggagtggagccaccccattgaggaatggtgaggaagagatagtgtgcaaatggaaggaaatagagggggttggggggtagtagggttagagaggaggtaaccatcagctctgttgcttttggtgatgaggtgaagtctattgcactttaccatattgttgtgcttccttgcaacccaatcaggggtgtcatgagcaatttattctggtatattgtccctttccactccttggtcttccttctacctcattttttctcccattggaacggctatttctcacactttaacctaacctccaagagaataacaatgcaaggtagtacaaaaccggaatgattagtttgcaaaaatgattttatttatgtgcatcttctgcaggctacaaatatcataattcaacaccaaatttgtggggttctttggtccatccttcaatttgtctccattcttatgtttggtgctatatcttggtaaaaaaaattaaaaaaaagagataagaagtgactaaacaattatttttgaatttggaacctattggatttggatcaaatattttaaatactagctaggtgtaggcttggtttttagtttgtactagtaccacagataaataaaccaatcatgtatttcaagtaaccaaataagctttcgaatttatattctactcgactgttagcatatacattttttctaatcatgtctactcttctgccggtgtgctgctcttatcaatgcgtgtatatattttgcccttgacaaagacagaatgaccttctttgagatgcaaaagaagaaagcacatgatagtgctataaacgttcactagtgaattgaaatacaacaaattgattttcttaaattgatcatattttttttagaaaaacggcatgcatgttaatacgactaaaaggaccattattcatgttaccatggatttcatgtacttagaagaagatactagcagaaaataaaactgaagagagtataaagtgctatattcgtcctaaaatataagaagttctaagcttatacacaggtattaaaaacgttagaaattatattttagaatagaatttcaatgttaaaagttgttatattttaggaccgagaagtagcaaatccctcaacagcaacccccccccccccacccnnntnnnncccaaaaaaaacagacacaaaaagggnnnctgnnngncgacgtatgtttgttcttctaaaaatggtcatgtgttatgaatcttcgagaacttattctagtatatgcaccaacgttaaattgtaaatgcaaccgtaatcgcatatgttttacttacggattttgccttctagaacacagttaacgtattggtcaagtgcgtgctgttcatactaaaatcctgaaagttattaactggttagtggtctgctagctcagcaagcgtcctaaccttccaggctggtggggtgtttgttttatatttttctaattactagcaataatgcccgtgcgtttcaactggtgatgggtaattttaa

SEQ ID NO: 38821 - DNA, 25778 bp, Oryza sativa
aaataaaaaaagttcaacgatctaaagtgaacatattccatacggaggtgtgtgcagttcatgaggcggcccaatagtgtgggcggcctgggaacagaatcggggacaacttaagggatctaaagtgaacttatttcgtgtgggcggcctgggaatggtgtttggcccgacgcgagagaagttgtagctgtacgatctgatggacggtcctgattgatcccgatctatataaaagttcaacagcccaaccctaaccctaaaaacatttcctttcccccctttctctctctcaacggtggcggcggcgcctctccccctccgccactcctcttccaaccccaccgcgcagcgcctctcccctctgccgctcctcctctcccaaccccaccgacggtgctgctctatctcgccctcttcccttccggcgggagatgaaggcagcaggtaggggcggcgccctctcctccgccggatctagcaggaggggaggcggcggcatcccggcgtccctgcgaggcctctcaccttccgcgcgcggcggcgcctgtaggatcgagatgtcgactagaggggggtgaatagccgatttaaaattaaatgacacctaatcaaaactaacctaagttgctaggcttggtgagggacaagactaactaagcaactaagttatgttttgcaatcctagggtgaaagtggctcaagtatatcactaggaaagtaaatcacatttcctaagtctagtttaggaatcctatggtgaaatgatctctagtatgtctctagaaatgtaaatgcaccaagtaaatgagacaaggagacaagagatttttcaccgaggttcagaaactcgccggtttcctacttcccgttgaggcgagcccaactccaacgctcaaccacgaagccaccacacgcccccttcgttaaggggtgggcaaggcgggagccggcccatggagaggactagggtagttcttccttcactccgaaggtggtgaactccaaaccattcacaaccggcgccgggcctcctccacaatcttctcggagaggtcaccaggcaacttctccacaagccgtctaggaggcggcaacctccaagagtaacaagcaatgacccggcgtggagatgatcaatcaagtgccacactagctctacaaatggaagcaatgcacttgactcttggctaattaaccctctaacacactagatggatgaacacaaagctcaagtgggtgtgagagaggtgcaaggggtgtatgcaattgaattgggtgccaagagagtccccttgctgctggaggtggagtatttatactcccaccaaccaaaactagccgttgggggcgaaatcccccaactcagtgctctgccggtttgaccggaggtatgtggctggtcagaccgtgctactctacaacggctagttttctagccgttgtagggctgtcattgggccccactgcctaagccggtcagaccgacatggggtggccggtcagaccggcctcggctcagtcagaccgccatcagctcggtctgaccgaatatggctttggcggctcgggatcggcacacccagagcatgccatcccggccatatggctggccggtcagactggcatgtacccgccggtcagaccgccactgcctggccagtcagaccgctactctctggccggtcagaccggccagggccgttggtcagaccgtcactatgtggccggtctgaccgcccctggtcaggccacagtgaggggcaaagtgtttatgtgtgtgttgggagaatgtgagcacaagtgaaaatgtaatgatctaatgtggcaattaaaatcatctcattgctaggccattaccccccttgatagtacgacgaaactataaataaactagcacaattttgatcgcccaacgcctcgatcaattcaaaatgaaaacactagtttaccgtcttctcttccttttgctttgctccgtcaattttaatccatcgataatcatccatgcgcacacatgatgtgaacctaacttaaagatatagctcaaaagaacggttagtccacaattagcgcttgtcattaattaccaaaattaacatcgggggcctagatgcttcagcgcccctccgccctcacctcctcttcctcgccatagggccgcggtagggctcgacggtggcgggcaacgctctcccctccaccggatctaggaggggaggcggtggcggcccagcgtctcggcggccccctccaccggatccagtgggaggggagcagccggtggtccggcatccctgcgacggcggtggcgattcagcggcgacggtggcaccctccctttccggcatcggtgttttcttgtgttcttgaatttatgcggactcgttttttaccatcggagaaggattgaagcaggatcgatcgcacgtgcggtgtaaaaatttattttttgacaatatacgtatatagatagatagattgaatcagactttcttttttacatgttttttgcgcccttttctcgttattatgggtgacagaaacatttttaattttttaagtagtagggataggctgtgttcggcactacctgttcccattctctcctcctcattttccacgcacacgcttttcaaactgttaaacggtgtgttttttgcaaaaagttgcttaaaaaatcatattgatctatttttgaaaaaaataggtaatacttaattaatcacgtgctaacggatcactttattttccgtgtggaggaaatgggttcccagttcgggagaacgaaggcagccatagtctttcaggattatggtcttataattgtttatgctttattcaataaaacttcacaccgtctaagtatcggttaaaaaaaaagcatcctaggcaattactgtttttctttttcaaagtagggatgtttttctttttgggtggacaagaaaaggagcaaacttacacttgtgggagcttctgctatatgttgggatctgtggttgagtaggaatgatatggttttgacaaatcaccatctatttcatatatacaggtcattttcaggcaacatattggctccggttttaggcacaactataaaggtgtgatgaagatggagagtttttagaagttgcatgtcataagtttgagatgatggttatgcaactttttaccaattatggatggagattcacaaataaactttaataaatgtgtactccatatcttacattggttatttcttatttttggttggtgttttcaatttttatttgaactacatgctttttagagtgctagattataataattggctgtacctcttctgagcaaaggccgggatgttccattccattatctaaagaaaaatagggatgttgagtagtggtgaaaacgggacgggtatttcctgagcacccacccaacccaacattcgcggaaagaatatgggaaagaaaatgatatccgttactatccgacttcgaatctgaaacctaaaagaatatgggttaggataagaaggagttatatcatctgtttatgccccatattatgaaacccaccaacaaacatggtaaaagataggttaatcactattttacgagctcacgtgtaatattgtataagtttttcattgatgtgtctctttgaacactttaattgtctccttatatttaatatctacgaattagagatacaaataaatatttattcttaatctgatttaggagaaataatatgagataaaataccagatgagtgatatgttatccgacactacccgtacacaatttcgaaattgaagaaaagtataggttatataggaatggtgtgatccgatcgaacccatccgttttcacccctttgttgtggtctgagcatatgcgtccccatcgttgttgatgaggaaattttaaagcttaaatgggtgtttggcattagctggtgattaattaggggatgggactcgaaaaggtagcttaagcttgatgttgatcaatgatcataaaacgtgcaaaagagaattgaatgtttggtttgcatcgatgtgaggtaagattgcaacctcctatcaaccttcttaaatgctcagttgagacttgagaactcatgtgctgacttttttttatataaaaaaaagcaaaaatagtattctttttctaaaagaaaagaaacctcacatgttcggatacttgtggagtcttaatgcaatttgtataaataatgggatttgctccaagcaataagtatctcggggtactggtacctcaaagaactaaattgtttcccatcgttgaaactagctgggtaggatggacattattagatccaataatcggaaataatttggtaccggtactacctcgagatactttttattggactaaagtaaatctcataaataatacaaaattcaacctgcctagaggtgcaatttgcttataaaaaagtcctgtttagttcccaaaataaaaattttcacgctgtcacatcgaatgtttggacacattcatagagtattaaatgcagaaaaaaccaattacgcagattgcgtgtaaattgtgagacgaatcttttaagcctaattgcgtcatgatttgacaatgtggtgctacagtaaacatttgctaataatagattaattaggcttaataaattcgtctcacagttttctagcagaatctgtaatttgttttgttattagactatgtttaatactttaaatgtgtgtctatatatccgatgtgataaccaaactcaaaaacttcccctaactaaacaaggccaaaatatatggaatcggagaaatcaaacatcattttacagaaaaatcaagtttccttttttcctatgttagtgacgtcataaaaatatatatgaccctagtccccactgctaggacaagatgtcatccatcccgagaaagccctggatgaaatgctcgaatgcatcgtctttctatttgtttcattaacaagaatctgatgtcccagtacatgttctgatgtacacaatcatactagctagtatactgctctccatagtcaattcaactggaaattattttttagccaataaaaagatatacatacaatttctgcctttgcaactatggatttaataaaagaaacccccaaaaaaagatttaataaaagaaactgaaatatagatagcatcttggttcatggaagtcattagagggtcactaacaggaatcaatgaatcaagattatctttgttagcactttattagagcttaaaaaaaaccaatctgatgcatgccttctgctcctatctccccacgaagaagaaagtggacataaatatgaaaataaataaataaattatgcatagaacttttatctttgtactattctcggtctaaaaccaatgctaaaaaatagactactaccagaaaaaacccacaattaactataaaattaaatttaatattcaaatttggctgtaacggataagccaacaaaaacgatcttacactgacatgtccttttgatttctcagcataaaaaaattaagttaaaatgttttttcattatctggagttctggacatgttaacttggtcataatttattgactttcctctaaagcaaggggttactggccacattccaagcgttattctagccctttaattttttttcattgaatatctatacttctttaaaaaacactagtggtggtggcaaatcactctttttacagttttaattaacccctgatattttctgatattatggaatggttcaatatttgtttcaaacaagtgaatatacttacatactcttttaaaaaaaatactattggtggtgctagtggatttgcaactgccattcactgccattaccacccccaccactgtttttctgcagtttttataaattggctcttgattttttatattatggaatagcccagtatttgtttcaaacaaatcaatatacttacattgtgttcgcgaggtggagtttggaactcggagaaaagaacttagccatatatactcatagcagaaaatggagtggataattagcgcgtgattaattaagtattagcttttttaaaaaaatagataaacatgatcatataaaattattttgtataaaccgcactgtttagcaatttgtaaagcgtgtgcgggaaaaacgagatgagtgagttgagaactcaaagaaaagaacttagctatatatatactcatagcaaagcatgggtatctcctgctccctccgtactcgtaaataaagttgtttaggacaatgtttaagtcaaaccttgggaatataaatcatgaataactcttaagttgttgagtttgaaaatgtaaaaattatatgaatagatttgtcttgaaaaatacttttataaaagtatacacatatcacttttcaataaatatttttatagaaataagaagtcaaagttgtgttttggagaccgtgttgctgtccaaaacgacttcctttacaagtacggagggagtagtttccaaaaatggaataatcaactatttaccacttttacgagtagtgataaaggatttgccactgaacccacatattatagacacataagggtccacgtgttatagatacatgagaacccacatgtcatagacagtgagtggcaatccttaattgccacatcttcgaagtgataaaatagttaaatgtccctaaaaaaatagagacagcatgaatcaacgggtgagtaacacacagagccaaccaagccagatctgttttaccaaaacttttgtaactgactccagcatgtaaaagttcttttctcggaaatcagcatgtataagttcagcttgattcaaaaataaaacaaaacaaaaaggtatgcagaatggactccacggagatacctaatacttaggatacagcttcaagctttaataaagttgatcgaatttatgcttctcctacagctaaatcccctaaccgagaatatttagatagaaaaaagataccaaagtgaactaagggtgtgttcgctacagccggctcccaacgtgtacagtacacatgaaaaacggagcggttcattagcacgtgattaattaagtatttattatttttttaaaaaaaaatagatcaatatgattttttaagtaacttccgtagaaactttttgcaaaaaaaacacaccgtttaacgatttgaaaagcgtgcgcgcgaaaaataaggatagagagttggtaaccagctcttgcaaaccgagcctatgtcggcaatatgggtgcctcccttccggcagcagaagaatatatatatcccctcatggacatgcccacaggattttcgataaacaattgaaaagactgcaacaggaaatcgtcatcgatatatatgggcaatcccaatcctccacctagaatgatgtctatgacattaactacattgccatgtatgacttttaacttatgtggcactatattaattaagagagagagtgaagagaagaagaaactgggtctcatacaagacacagcttcaacatgaaaacctatgcactagacactatcaagttttgcattgtgagagaatattgtcttcataatagatgaagaataaatatgattggtagagaagagagatgatgtatttattaatggcccactttaaaaaaccataggttgtaaagtatagtttctattgtgatgtcttattgacatggcaccatagacattgcttatggacattatgggttgggactgccctaagcccctctatatttagtttataagccgctgtgaaatttaaaatttaattttgaagttgatttggtgttttcatcatattttattttccataatttgctcttacatatcgaagaacccatataaaaattttacccataaattattttttatcgctttataagtcataacaagctttattattaggcgaaacgatgtggatgaaactttttgtttattgtttatcatcaagataaatggctatacatggtgggccaaattataggaaatttgtcatatatgtataacggaatcgggttctatgcattaaagaacaaaatgtagagaatctacagtacatgcattcggatatgttcttttacttatgctgtttgatccacattcaatgggaaaggataaagatacagtatctccaaactttacgaaaaataaagcaaattctctagtggtgttcgtttctattaaagataaaattaggacacgaaaaaaattagaaaaccattagcgtataactaattgagcttgaaaaatgaatgtatatgatattttaaagcaacttctacataaaaaatttccgtacaaaatacaccgtttaacagtttgaaaaacatgctgatgaaaaccgatataaaatatgtatcttaatcaggcctttgtacaagtagcattgttgctatacactgttcaatcaatgattctctgcattgcaatttgcaatagaggatatatttccatgcatagtgggagtaccagtcactcgtccactcctatagttctatttgggccatatggcctagattatctgaggctcaacccagccccaagcaagagaacagtgtaacattagtggaactggacaaagagagctagacaaacacaagaggaccacatgttcaatcctaaggaactagaatattttttttgtctgaaatctgagtgagaagataactattgctggatctgtaagagacatggcaatcctactttcctactatgagagcaaagtcatgatcattgataatgtcttttttttccaataaacaacacgagttcttcctagtttgacttatatccacaataatagttttccttttttttgagaaacaattatgattttcaattggttaatgaatataatgatttataagctctaactcctctcaaagagatgaggcttatgatctcatcttaccgaccgtgaccccaggcagccgtccggactccttttaatgtttttgataaatttgagatgaaattttaaaagcaaacacttgatataataaagatttgcataggatctgaaacttttctgtatccaataagtcaacaggacctttcctgacaacccttgcccccctcctcttgccaaccgtctctgtcccctatattgaaactgcagatatgaatttgcaatttgtttcacaaacaactttcagtcatctaaaatgtgccagaattcggtaaattccatcacgaaaacgactagcaagtctatcaaatgcaccgtacacgcaaccgtatgtcctagaaaaaagacaaatatcaattaacacatgcaacaaatgttttccttttctttctgttttctattgatgtcagcctcatcaacaatacaattatacaaacggtttgagacttgtcaccctggacaattccagcccatacattttcacctcacaagaaacttgaaacttgtcagagttggctttgttctgattgacagtagatttgtttgctattgagatatttctttaccttgatttttcttggaaatcaattgtattgcagtgagaagactaagcgcattttcagtggttaattacttaattcgtgatggcaatgtgttcctgtgctagttgacagcagggagttctttcagattcagtgcatagttaggcatggtacgaaaacttgagtaaacccaaatattttttctagggtgaaagttcattttcgcaaactgaagcgcagataacatgaaaaacaccaacttgttcagttattgttaccagttcaccaatcaaaaacaactcatcttcagtaaagtagcttctccatcattaatgaacctattttgacttcaggcacaagtcaaacaattgttattttccttaactatcatcttaataaatctataattccatcctcatcatctatatgtgctaaggtctaagaacccaattatttacatctagtgtacacgtagtaaacacatagctaaggtgattgcagcatatatgaaggccactagggagtagggtgccatatcaaattaagttgctacttgctacaatggcaactttaattgtacttgaccatacacattgtaataattaattggttgatcaaaagccctcatagtagccaccaaacgatatgtttgccctagttgagccaccccctcccatcacagatgacattgcctggttcagccttgatgtctgctgcacaacctgctgcattctctgcagatcaacaaatcaaaccatgattcaggcaaagttctcatggataagattgagtagctaattttgttcagttgtacattgaatgaaaaaacatggtgtcagtaaccaattttcttttactagaacgtaaacgatatgatggttttagattctgtatttgtatcagcccataataacatcgtgccaaaatcattaagatttcttcttgtgcttctagtagaaacttcatattagaaaggctcaagctgcatctgaattaattaattaatttaggtatacatatgcacaacagcacaagtaagctactagcaagattcaccaaaccaatccagagccaaaaaccaagaaatcaatgttttttcttggttttgacgaaaattgtttgaaaaccattgactaccgataaaattttatcaaaaattaaaattatagtttgaatattttctaacttgaccaacaagctaaacggtttgtattcttgagctggtccgagaagatcggttttcatcggttttgtaaaatctggctactaatcgcatagttatagaaggattaggatgtttaggatgttctaccttcaaagtcacgtcacatatcagtgacaaagtcacggtgacttcgaaagtaaggatgagtgatcgccattttggatgattctactaaattatatgagaaaaaaaagtaatcttccatagacaaaagaaaatgattgatgatggatttggtagaaagtagaaacataggactggaaatgagtcaccaaattaaccttgtcatcgccatagagctgaagctggatcttgtgctgctgctgctgccggtggtggtgctgcagcctgccgccgacgaggaagacgcagacggtggcggcggcggcgacgccgaacgagcacagcgccccgatcccgttcacccgcagcttccccaccctgaacaccacgcactccgcccccgccttcttcccctcctcctcctcctcctcctcctcctcgccgccgccgtcgtcgtcgccgtcgaccaccttggcatcggagccctggaacgcctcctcctcctcctcctctgttaccttggccgccatggtctcttcttggctcgtcttggtctcggccggcacggccacgtcgacgccgatgtccttgcactcgtcgtcgacggccatgtcggcggcggcggcgtcaagattcgattcctcggtttcttgagctgtcatccaatcgatcaccgcaacaagaatgagacgcaatctttcgtgacaaatcccaagagctgatgctgatcttaccaccaagaactctgcggccatggccgccgccgccatgggaggatgagctcagctggtcaggcaggacctcccagtcccacatgtccatgctcgccgccgcatccatggaaaccgaagcacctcccttctccatcttggcaaataacaaccaaaagatcgatcttttatataacaaacagcagtgatcaatgaaaaagattcttgctttggggcctctccaatggatgctccccaagcatcaattttggttgctgcttttcaaggctccaagtgatcttttttttcctcaatttttttctcctttcttattatttgcagggaagcaaagggagaaagaaagcaatatatgaaggggaagagaagaggtgtagagactagagagatatcagtgtcaccacaaagccttgaagccagtcctttgcaaagagctttgtgtgtgggcttgtcctaccttgctaggtgacaaagtggggtgaaaatggtgattggggcctaccaccacttgggacttcttcctcctcactcatcaatcactagttggcacttgggatgtctctgaacaattgtagcaaacatgccaaggattattcagagcaacccataataggaaaaaggagcaagccatgcaaggtgtgaagaaacaaaactagtggagaatatctaaggcttgttgatcaatccatctcttttttgttggttcttaataaatatttttagttatcctgcataaatggtactacaatccagtgccttcactgagtatatattcaattcagatcaaagttaacttgagaatttatcccttggtagctccgaagaattatattgttcacttaacatgccatatgtcctaaagagcttctaagtctatccatttcagttgtgatagaaaaattgagaacattcctgaaatgttgatcactatcagatgccgacctctttgaatattgaatatatgtaattttattaaacaagttgtggtttgcaggacggtttatagacaggttcaacgttacgatactgtacatcatcagcaaaggagttgtaacaaggaataaaatgtacaaaattcaggaactttaatggaagaagagtacacaacagggtgccaggatagggggccatgataatgagagacaagataagaaccttctgtagaaaaccacatcaaaagttaagatgtaacacacaagatagtgatggtctgatggataatcatgcaggagttgaaccataaactaaacaatttcaaatggggagatggtgatttgaaacaaacttatattcagagtaaactgttaaagttcagctcacaggccaaagaaagggtattcaatttcaacattaatttattttttgcattgttgttccatccattctagatagtagcctaggcttctttgttttacattgtagttccatcaaggttcttgggtcaagttgtactttattgttgtggactaattcaggttagtgtcaagaaacttttgcctaaggcctagtgttttcttcttcaacgaatggaaaagctcctacttttcttttttaaaaaaaaagaaaaggaaaggaaaactatcatgaatcatgtcacctatggttagaagtagttgtgcagctatcagcaccgtagactttactagaaaaacgaaaagaaagagaagagattggatctcagtaaactaagcatataatgggtacatgaagtgttttttttatttctacatggtgaaatttatgtaaatttttttgtttaaaaggaaacctaatctgttgagtggaatttaatatttaaaattttctgggcttagctgcagattataatccaaagtagttgtgaattttaaagtttgattttctataatacttttaggtagatttgtattgcctatgtatataaatatatgatattattaattttattcggtctttatgtgtaacttcgaccactattttttattataatgcaatgataatatagaaacaaacatatattattaaaaatacttataaaaaatattcccatataaatctttatattttcaaaataaatatgttgaaagctagtcaaagttttaaaagtttggttgaataaagtcaataatgtcatatatttaaatacatcttcttcttagagatcataaaaagcccttaaaagcattaatcctaaaatgaagtgacattctaaaatttaaatcagcttcgaattataactcaaagctccgccaagtagattctcgaaccttacgagtgtgtttgagaggagaaagaaaagaaaaagattgagaagatacacaaaatgaggtgagccattagtgtatgattaattaagttttaattatttcaaatttagaaaatgggttgatatgattcttttaaaagcaactttcttgaagaatttttctttaaaaaaatacaccgtttagcagtttaagaagtgtacgtatggaaacgagggctttctctctttctacggttcaaatgaatgcttcgcagtataatatttgaatcctataaaattcctaaaaaaaatccttccattcaaatggcgcaagagttgtgcaagaagttggtttgagatgaaatttagcgccagacgcggcccatttgggcaccaccgcttctcggcccggcccagcagcggttgatttgggccgagaccaacccaccaccacccgcggagtaggcgacggcggcgaagcccacggcggaagcttctggaaggttccccgccccctcacgcatctctcccctcccttccgacgccgcattctagggtttagctgggttttctccgctgtggcgctgtggctgggcaggcgatgggggctctcgaatcgtattctttttgaattgattgatcccctagttactatcctagttccgtttagattggaggagttgagatcaagatctggattagccctagagttggtaacgaagctcaccatgattgttcaggtttatcggggttagtattgtattattagtttctgtcgtcaagatggagttctttggctgccatctatttgttgatgcatgtgttcttgttaatcattatcttaaaaaacaaatgtattcttgttgatgattgacaggttagtatgtccacagggacattgacaatggatagaggaggggcagcaaaacgagaggcgtcatgcggaacaatctagaagtggtaaactacctccacaacatcttgtagtgctcctgcatttgatcttagagtaaaaaacatcttgttcgcattctgttattaatggggattagaacaggggcagaacaagaaaataggccaagcctagggatgtggaaatgtgtctttagctaaccattttttatgccttcaaagttttcatagtatttttgatggaatctcaaagggttatagtcttacagagatcaacctatggctcaaatcctccacgcactgagtcaggaataggataactatgaaagtgagcacagtaataacttgttgactgctaattttgatggcattggttttcttctagctttagtttgctaactacaattacttgtttccatcatatattaacaattattcccaatactaaattatacggatcttaaactacacatagtaatgatattgtagaggattgcaaattagatccacagcctgctttggaatttatcttttcagtttttgagaaagaactaaagcttgtctccaagttattcacttgttagtatctgaaatttccgatgacaaacagaaactttcgatattttcagtttttccgtggtcacataaatactttgtcatgtgctttgcatcagtcaacacaaatattaaccttccaaactacaatatcatgaaaaattgtgtgctactggtgcagtaggaagctacactacaaggttgtcacggtatgaagatttctcataaataatttgaaatctctgaaaagaatccaccacaagattttactgtattgaattttgcatacatagggaactagggatgtttccgttcaaaaaaaaaaaaactagggatgataaacctctatggcacattggcacctatactgctttgcatctgccatacgtgttaaaaaatgctaaatatgtagcctgacagatcaaaatcaaaaggaaaaaaaaaacttaaaacacatgaaaagcccttcatctaatcagaagatacatccgtcacattactctgcttgctggccatcgttcctcatacgttttgtatggaattggctcatagagcagaagatggactcaaaaaggaggaatcttggtatggggatgtctagttttgtttgtctaatacattaatacttgcaggacagttgacaaatagggggcagatcccacaaggagtcgcacagatcattacccatatcaaaggtttcctgctcctggatgccattcataccatgggagccttgcttctctgccttcatcttatcctggtctgaggccactgggcaagcattgctgcctgacatgtcgcatccatccccaatcggtagtaggctggtgttgagtgcccatgactgatcatattgttgttgtgaagaagccagctgcaattcttcacctccactcatagcaaaattagagaggtttgtagcaaaattaaggcttgagctgttgcttctgctggggctgacaccactggtgcttgtgctggttgcagcagcagggacagtgctacgagcatggtgatatactgcggtgctgaaggtgatggtaggctggggcatgctcttcttgagcttcttgtgggtgaggatggtgcggatcctcgacgcgagcggcgagtctggtgcagcctgcgttgcgaagttggtgcgcgtgtttgagccccggaggaggcatgcggcctcgtcgtaggcccgcgcagcctcctcggcggtctcgaacgtgccgagccacatccgtatcttctgggtggtgtccttgatctctgccacccacctccctgagggcctctgcctgacgcccacgaacttactgctgctgcacttggttttcgctttgttcttggccactgtcacggttggcacttggtaatggcattgctgctgctgggattgcccttgtgttggcttctggaactggagctccatggagaagagagggaagctaagagagtgcaatgtctgtttgccagtttgtgtgttttccagctgtggtctgaactttgagggaggtgctggagtctgaatttaaggggggggggggggggaagaaagggaggttgagatgttgggttagtgggagacttgtcatgttgtgcctgtctctactgttgaaaatccttgtggtgagttcaagaggtgactgagttttctatgaggcataggagcataatgctgcattctgtagtttgtttcaatgttttctgatgtggtcttagtggctggcatgtttgttctttaccctgcaggttgacaaaagccacctttgtttcaggctgtgcgataagatcgacatatctgatgcttctgtttaggttttactgaaccatgggctgcaatccctcccttattgttgatattacagttaactccaaactgttggccttgaaaagcttggaatccttaacagttcactaagcatagaagtttatcttcaatattattaaaacatcttttgttgctatgttttcagttcctactcccatcataaaaccgccttatgatgtttgaaaatttttaagagttctctaagcaaataattcaatggattgctttaggctaaaatgctgtgcagtcctttagattagtttagattcacctactaaatgtttgcaaggctatataatgatatggaaattgcttttgcaggcgtctgacacttgctgcttccaaggaattggtatgagaggatccacatggttctgacattgtataggtagcaattgccatccaagtacatttcatattttcctaagtagtggtcttcaattgaaaattgcaaacgattctctctctccggcacagcattgttttaaacatttgccgtgtgttctattcaaatgacgaaattctagtttatttgttttgtccataactgcccaactgcctgtttaatttgcagatattttacatggcacaccatcactcctaccaaagggaactaagcaagtcgtgaggacacgattttttttgccatttggcagcacctgtgggtttaattgcttcatggcttcatgttaggtgacaagattagagaagatgttggcattctacgagaggagattaaagaatgaagctgtgtgattagcatataatctaatgccatggccgggtgcagaatgttttattttatcaatcagatgtgccaagatcaggtagtgcattatttacctgatgaaatatttcgagtttatttcgctacgtttgactcaggttgttcaagtttcaagatatatactatctttgcttggttaaaattattgatatatttttctgtaaagtggtaaccaaagtttggatggattttgaactattattttagttgtttacttcgttggcggtttggcactgaatatggttcttcccttcaaaagaaaagaaaaataaagaatatgtactatggttctgatactgtaaaatcacagaaattccacgagtactccaattttgtttcatttcaccacattttaatttcatgatcagagactttggttggcaagtcaactgtagatgtggcagcaggttgcttgtgcctcgaatgcaaagattatccttagctccttgaactaacaaattgcgtagaaaatagaatgaaatacctgcgttgagaaatgcagaggtcaaagttaatggaagagcatcacctcacaatagaaaaggaaaaaaaaagatgaaccgtaagaagagtatataagtataaaatgaagagaaaatctcacatgataatacagaatcatcatatgaataattaaatacacatcacggcctggaaaattaaatgtcttgagaaacatgtcggacttcttttgtgtgaagtggagatcatggtttaggtgtacttctcagatgttcaactttatttttttatcaatacaataaatgttttttttggtcaatgcccacgtatttttgtcgagtgattgtgtccttgcacaccaaatgtcaagttgtgacattggtcatagaaaggcctaatgtggtactatgtattatatgctctattgcaaatactttcttccagagtcttgtctaaaatataggccaagtttctccttcacctcatctaaacatattttctataccaagaaacctgagagaaagttgaccatgataacttcagaacttcagcttattttaggcatttttggccaaccagaatgtagggccggcttgcaatttgtgctatgtgagggtccagtaccaccatactgatggtgttgatggcaacaaaatgtgcaaatatcaattaaccatattatgatattacaaaaacgacacaattgacctctcgttttgcgatgaaccactgagaatagcttgttttcaaacaataaaaaaaaaaagctttaaccaacaaataacgcagtagaagcaacaaaccgtatatgcacaagcgccatataatgatttacatggaaaaatctgttggaaatatagtcataatttgacatattttaatccagaaatataacataataaacatgacatatacaatagagagtgatcctagcatgatggtaaacatgaatatgctaacataaacaatagcatctaaaaacatgtttaacaccgagatgagaagaaaatacctggagaatgctccggatgataagttattggtgttgttgttgcctctgttgccgttgtcattctctcttccgttaccgttgttcctgtctcatcctccctagattggattgctgctctccttcctcgttactctagtaacagacagtgacaagcccatctgagaggattgctgctctccttcctcgtctctatcttcttcttcgcgcacgggtactcggcctttctgttcatcctccccagactggattgctgctctcctttctcgttactctagtgacagacggtgacaagcccttacgagaggattgttgctctccttcctcgttactctagtaacagacggtgacagaacttcgtccatccttctgttcatcctccctgaactctctgtcttcttcctcacgcctgggtaggcgagcgatcaagtttttgggaccacattctatcgcgctattgctctcagcctctccttcctcattactctagtaacagatggtgacaagcccttttgagaggattgttgctctccttcattattctagtaacagatggtgacagaacttcgtccatccttctgttcatcctccccgaactctctgtcttcttcctcgcacacaggtaggcgggcggtcaagtttttgggagcacattctattgcgctattgctctcggcaactctcgggactgcttcatccatgtcgctctgcttcctctacggcaatgtcaaccagtcccgggaacggtgacaacagaggagacaggaacgactggagagaacaacaaagacaacggaagcaacaacaacaccaataccttatcattcggagcattctccccccgaactctctatcttcttccttgcgcacgggtactcgggacgagcatgcctccggaacttcgtccatccttctattcatcctccccaaattctttgtcttcttcctcgcgcatgggtaggcgggtgttcaagtttttgggagtgcattctatcgcgcgattgctctcggcaactctaggcactgctttgctgctctccttcctcattactctagtaacatgctgctctccttcctcgttactctagtaacagacggtgacagaacttcgtccattgttctgttcatcctccccgaactctatgttttcttcctcgcgcacgggtaggtgtgcgatcaagtttttgggagcacattctatcgcactattgctctcggcaactctcggcactgcttcatccatgtcactctgcttcctctacgacaatgtcaaccagtcccgggaacggtgacaacagaggagaccggaacgactggagagaacgacaaagacaacggaggcaacaacaacaccaataccttatcattcggagcatactccccccgaactctctattttcttcctcgcgcacgggtactcgggatgagcatgcctccgaaacttcgtccatccttctattcatcctccccaaattctttgtcttcttcctcgcgcatgggtaggcgggcgttcaagttttagggagtgcattctatcgcgcgattgctctcgacaactctaggcactgcttcatccacgtcaagctttgcttcctttacggcaatatcaaccagtaccgggaatgacaacaacggaagagacggcaatgtcaacctgtaacactagagtaacgaggaaggagagcagcaatctaatctagggaaaatgaacaaaaagggcgagtacccgtgcgcgaacaagaagatagagacgaggaaggagagcagcaatcctctcaagtcctctcagaagggcttgtcattgtctgttactagagtaacgaggaaggagagcagcaatccagtctggggaggatgaacaaggatgaacagaaaggccgaatacccatgcgcgaagaagatatagacgaggaaggtgagcgaagtagaagatagagacgaggaagagcagtgctcgtcccgagtaccgtgcacgaagaagaagatagagttcggggatagaagatagagaactctgttactagagtaatgaggaagagtagcaatccagtcgcttgtcaccgtctgttactagagtaacgaggaagagcaatccagactggggcgtctgatactagagtaacgaggaagagcacctctcagaagggcttgtcaccgtctattactagagtaacgaggaagagcagtgctcatcccgagtacccgtgcacgaagaagaagatagagttcggggatagaagatagagtactctgttactagagtaacgaggaagagcagcaatgaggaaggagagcagcaatccagtctggggaggatgaacaaggatgaacagaaaggccgaatacccatgcgcgaagaagatatagacaaggaaggtgagcgaagtagaagatagagacgaggaagagcagtgctcgtcccgagtaccgtgcacgaagaagaagatagagttcgactagaataatgaggaagagcagcaatccagtcgcttgtcaccgtctggggaggatgaacaaggatgaacagaaaggccgaatacccatgcgcgaagaagatatagacaaggaaggtgagcgaagtagaagatagagacgaggaagagcagtgctcgtcccgagtaccgtgcacgaagaagaagatagagttcggctagaataatgaggaagagcagcaatccagtcgcttgtcatcgtctgttactagagtaacgaggaagagcaatccagcaatccagtcgcttgtcttttactagagtaacgaggaagagcaatccagtcgatagagttcggggagcgcgtacccgtgcacgaaaatttagagtaatgaggaattaaccgctcaacaggtgctctcgattagcagcctatttaaatcgaggtccctctacgttggattccaaggtggtattaatcacttaacattaattatgggctcataaaatttactaagatttgattgggcctagcccatttagttttagcaaaaactccttgatgagaggagtaagaaacacggaaccaactagtatgctccaagcctccaagcttccacgtaccatttacaaacaatggttgcaccacaactgcagcaacaccattaagatataatcttggtatcgtcaatatcaataacaaataaaaacaagaagcttaccaccaggcaaacaatgcaatttatacccccttagtatctcacaaaccattgtttggaacatgaaacatggcaaaaatgtggatttacaagttcaaatacccgtttgacacttcagactaactttttactaaaattgttatcatccaaaccgacaaaactcttctcaagtttagtgctatactaaaccgatcctcaaacaaacctttttcttttttggcaattttcttggtaccatcacaaaaataatggagttgggaaataccatcatacatatcaatgacatgcaggtcccgggccacacatgtcattttcaaatgtgatggtattttgcaactcgtgtatctccacaatggtattttacaatgttttctcttttttaaagatagtgatcctcaaaccaaataaccaaatcaaaataatctaaatataaaatgagcttgccgaatttagtacacatcgaaattttaacctataaacattggcctgatgaagacaatgttagaaccacttatttggacaaagtaacgaactactcctatttcttctattttctagtcatttttcactcaaaggttgctctttttttctctcaggaatacttaggtcttttccctgcaaaacagcaaaagggtaaagctagtcagtctttggaacacaagaatatttacaggatttttacatgagttagtctaattcccacaaaaattctttgaaattcctccattccaatttccaaatgatttaggacatgggactagctaaacttgcttcgttcatggttgttcgggccaagggatcttcctgaacaggtgcaagaagatcctctagttcggctaatatatctgagaaagcaggtcggttggatggaatgccatcccaacatctccgcatcaagtctaatacttcctccgtttcatattataagactttctagcattgcccacattcatatactcccttcatcccataatataagttttagagttggacacggttattaagaaagtagatagaagtaaatggtggagggttgtgattgaatgagtagtggaggtaggtgggaaaataaatggtggagggttgtgattgggtgggaagagaatgttggtggataagttgttatatttgggacaaatcctgagggctaaaagttgttatattttaggacggagggagtatatgttaatgaatctagacatatatgtgtgcctagattcattaacatctatatgaatgtgggcaatactagaaagtcttataacctgaaacggaggtaatagctgggaatgtgcattttctgggagccctgggcgcaatcccttgtatacctgtaaaatgtcatgcttagtgcatttcacaatgtgcgtattatggtacaactgtaacaagtaataactgacagcatattatttgaatagaagaaacctgcatatactacacacttacagctgcttggagaggggtcatggtattataagggatctgaaaataccagaaacgaaaatttgacaagccttagcaaacactaataaatgcacaatgtagataattgtgagcctatagtcacagaaaatagtgtaccttggacgttatgagctcccaaagcacaatagcaaaactgaacacatcagctttgttatcgtagggttgatgatttatgacctagcaacaccgcatcaaatatatatttaccaggaatataatattcttgtacctttactagacaataaaaactaggtaactatagaatgtccatgcaaactatagaacattcagatcattgaaataaagaaaaagtattgtctagcaccttgaaccttaagacaaagcatctaaaaccctgagctttacaatacgttcatataacctcctaaagtggtttttgtctaagtggaacacattggatgggtttgcccatgtcgcgtaaatgctgtaacatacagatcaaaatctccacttaccatctcctattggacaaaaccgtttgttcaagtttccgtataggcaaaaccaccatacaaaacaactttaggggagggggcagttgtttaaagatggtattgcaaagtttgggggttacatactaacctttaaaattcaagggctagttggacttccattaaaagcttaaggggggaaagggattggaggaggaggaggggggggggtatgcctatagggaaatttccttgaaacaacaaacaaatctgaactattcactttagcggtagaatatattattgtgataaccgtcaatcaagttttcttttcgagacttcaaaaacagtaacaatattaggcacatttgaaacagaatcactttgctccagcaacagagttgtatctctggtgccatccatctgtatgttccagtttcagctgtcatgttacctccttgatcctgaaaatgagctacaccaaaatctgccactttcacaacctagaaaaataataatgaagttatttattagttcatagatattttctcttaagtgcaaagcagatggctcctgcacatacaaaaacacaaatgaagcatgattgtattccaacaggtaccatttgcccacttgcatacactatactttcttgtctttttttccccctcatatgttcatcaataaaatgttgaagattataggctacgtacatgatctttgtccattagaaggtttgcactctttaaatctctatggataatacccatctgatgcaagtaacacatccctctgcatagatcaactgcaaacttcagcagagttggaaggtccaagacattatgctgcttgtgcaaaaagtcatataggcttcctccagacatgtattctgaaatatataaaagtagatgatgagcattagtaggaatcttccagtccccaagatataaattaagaacccgctctttgtctcataacaagcataattatatggaattaaaaattagcatcttaccaatattatgaaatttagtattgtgtaaaaattattcagcacatgctttcttttaggaacaaactattctttgcaaattccccagtgagaaccagttgatgtcataaatcttaccagcaattatgcaaaattgtggtggttttgtgcacgcaccaatgaatcgcacaacattagtatgctgaatcaaggcaaggcataaatatttagttattggtacttgcatgaacatggcaatttcagacattcttattctaagaacagtaatgcgctaatggctaagaattggatatgcttaaacaatttatttgcgatggtaaatgctaaaaaagaattacttcctccgtttcatattataagacgttctagcattgtctacattcatatatatgttacatacatatatatgaa

SEQ ID NO: 38822 - DNA, 16212 bp, Oryza sativa
  unsure (1)..(16212): unsure at all n locations
gtcttataatatgaaacggagggagtatataacagaacaccttattttaatgttaaataccttagaatatatacttcctgtgtgaactcattccaaacattcttattcaaatgctcagatcttagaactttaacagcaacatcctcaccgagataagtcccatgataccttgacataaggataacacaccataaaacaaagtgcaataaatacagtgataaaacaactcagcagtatacaagatccagaagctcatccctcccatcttcagcagtcgtttgtcaatgtaggctccggttatatgacgataagtaatcttgcttctagtagaactcatcgttataacaccagaattatccaatctggtgctgctttactcactaatgataaacacaatgaggctcatactgaagtggaaggaagtttaactgtttgaacctccaaaattttatgttcaggtagtcaaatctatcactaactttggcatacctttttttacacatatttctagcttgcttcgttcagtaagcatcgccctcagagcttcagtctataattcagttctaggtagcaaccaagacagtggcatgcatcttgtaagcacaggctgcttattaactatgttgcatctggtcctcgatacgactccaggatggctccttcactattcctttacctgacatggcctccctgatctcagcagcattaccccaacggccatcaccagcaaaggcatttgataactgaacatgaacagatgagtcatgaggatttagctcaattaggcgcttggacacccggattacaatctcaaggttcccatgaatctggcaggcactgagcagagctctgtatactgaagcaccaggttttataggcatgccattaatcaagtattcagcttcattgagatagcctgctcgaccaagaagatcaaccatacaagcatagtgctctgtccttgctcccacaagataccctttatctttcatcaagttgaaatactcgagccctttatctaccaagccaacatggctgcaagctgtaaggaccgacaagaaggttatgtggtctggctgaacatgtagcctcctcatttgttcaaacatctcaactacctcctttccatggccatgttgagcacatcctgacattagtgaattccaagaaaccaaattaggtgcttccattgaaatgaagacgccattggattcccctattgcaccatgtctggcatacatggaaatcaggctgttctggacatccacaacagaatcatatccaatcttcagaataagagtatgaacctgccttccctctagcaatgaggatgagctacctatagccttcaatacgctggcaaaggtgaacacatccatatcagtgccgtgccttctcatttccaagaagtgttgaaacgcctctttacctcttcccagacaggagagcccagagatcacggaattgaatgatacctgatcttgacatgaaacagacatctgcaccttgacaaaattttccaaaatgccgcacttggagtacatggtcacaagagcagacagaacaaactgatcgtgctccaagcccttcttaagcaccgcgcaatgaacttgcttcccatgatctatgtcctccgggctcgcgaatgagctgagaaggctgctgtatgtcatcaagtttggtgccacaccagagcgttccatctccctgaccaacagcatggcgtcatgaggccttctgcttagaacgaaccctgccacgagcgccgtgaaagtggccacgttcttttcttccatctcccgaaacacctgctgcgcggcgcccagatgatggcatttggcgtacatgtccaccaaggcagtgccgacgacgacagaagcacagaagccatgcatgaggccaacggagtgcagcgttgctccagcagcagcatcctccagcctgacgcaggcgaccaggacgctggacacggacgacgcggtgggggagacgccggcgcgcgccatgcgcgcgaaggccgccacggcgaggccgggcgcggccgaccgcgcgtggccgtggatgagcgtgttccaggtgacggcggtccttgcgggcatttggtcgaacaggtgctgtgcctcggggaggcggcgggatcggcagtagaaggcgaggagcgcggtggtggcgaagaggttggaggcgaggaagccgagcttggttgcggccgcgtggcactggtcggcggcggcggcggaggggcgcggcggctgggcggcgaggagctggacgaaggcccgcggggttcgcgcgtcggcgtggcggaggaagtcgcgcatctcatcgttcaaacctgatgtcgtcttgggatggatggaggtagcgactgctgtgtagtagtgtaggggaagatcggaggaggcaatggcaaatctagcggcggttgtcgtgggagaaggggtggcgctagtcataatgaacgacactatcctccaatcagccgttgtctaaagaatcttactttactatagtactaattgatcaagcaattagaacaaatattcctatcatctatacttcaaataaaattttcttttaaattactcatccgatttacaatccgattacaccgttgtgttcgtaacaattaaatctttacaacaagatctcacatgattatattttgataaaaaatcacaaattacttttataatatatctaaattactttagatctcactaagttacttcttaaatatataaaagtaaattcaataaaattttaaagtaattaacatataatataattatagaagttactttctttttccttttttttataagttacttctataatatatgtaaattacttttatgttatattgaattacttttatatgtttaaaaagtaacttagtgaaatctaaaagtaatttagatatattacaaaaataatttatattttttcatcaaaatataatcatgtgagatcttgttctaaagatttaattgttacgaacacaacggtgtaatcggattgtagatcggatgagtagtttaagagaaaattgtatttgaagtgtaggtggatagtgtttatcatagatagagtggtagctggtttgtcggtttagacaaaccagctagcactagctgtgtagccatgtccatgaaggaggaaaatgaaaaacggaataatcctagggacgtggaaggaccttgttgcaaaacaagtttcttcaagggtggacaagacattttattttacagtatataagccttgtttagtttttaaaaacaccacctcgaatctttgaacatatacataaagcattaaatataggtaaaagaaaaactaattgcatagtttgtatggaaatcgtgagacgtatcttttgagctaattagtctatgattagacataagtgatacagtaacccacacgtactaatgacggattaatcaagcttaataaattcgtctcgtggtttccaagcgagttatgaaattagttttttcattcgtgtctgaaaccccttctgacatccgcttaaacatccaatgtgacaccagaaattttcttttcgcgaactaaacagggcctacatataagagccagtttaaaagtatagtcaactattagcttcaaatcatctatagtcaatgtaatagccaattcatataattagctacctataaacatatactactacacaattaatatctggtcctacctgtcatacatatattacgtcttgtagtctatgcttaagctggctacaagtctatagccgctgctcttatctctcatcatttatcttctcgatatatatttatagctagcttatagtctgctaccgtacctgctctagatctagttctatttctcaactccaattttctcaatttccgttagcaagtttttcaaactgttaaatgatattttttttaaatattgtatataaaagttatttaaaaaatctcaaataaatttattttttaaatttataattattaatacttaattagtcatgtgctactcgttctgcgtgagtcgaaaatctctctcgaaacagacagatcgaacgcagccgtctcagccccggcgccgtcatcttccgtcttagcctcaccgctccgttccgttccgttccatttccgccttgctcgagccagcaaccaaactgcaaaaccgaccaaccgcacccacccaccccacctctccccacccccaacctcccaaaccctaactctctctctccctcgtcgccggcgaagcttccagaggcgggggcagcgcgagcgcatggagtcccccaccgccggcgggggcgggggagggggcgaggccggcgccgcgtcgtcgtcgtcctcctcctcgggcccctccacatcgtccgccgccgccgccgccaccgcatcggcatccgcgtcctcatcagccgtcgccacccgctacctcgccaagcgcgtgctccgcgggagcgccgtgctccacgtcgcccagggctgcttccgctcccccgactgcgtcgacgtcgttctctgcaaggtcgggaaacacccccccgcttcccgcactcccattcccctgatcggcgaatcgtgtagggcttccgatcgccgtgcgtagaggatggacccccaagggtggctgggttttttttttttttttttaattttatggtcggctcggagcgtcggggatgatgctccttatgccatagatcatgcggttgttattcggtttggaggtccggtctggggtaaccatggttgctctgcttttagtggtgtaaggacatggaggacatgttgccccagtgattggaattgctaaacccaaatattgctgtcatgctaccgattgggttgttgaagctagcgtcggatcagttccattaggagaataataaatgaataattcaaaacatttgctacaccgtcatctatgcctggatgtccctttgttttaccatatttgaataaatttgtgtgccatgctggtagaagaaacagaatgcgggacgatgggaaaagataaatgaaaagctatagacttgtatcactgcgtatattgagtgagctgcttaaattcttacactctgcttgtttgatctatggttgataagccgtgggaaaatgaaataagcaaccaaaaataatttgtgggctaaacttttatatctgtgttcttcgcggtttaaaagtcaatgctggtaattaaactacgatgaaaaaaaccctcaaaatcaactctaaaattcaaatttggctgcggctgataagacaacaagcagacgacgagaggaacatgaatacatatcaattaacatgtgaactcactgtatgatctctgttacaaggctgctgggttagttctgcagaatcctggtacttatttttctttcatccttttattgaaaatattggttattgctgcaggaaaattcactggaattggttgttattggtgaagatggtgttttacaatcaatctgtgaacaaaccacatttggtattataaaagatgttggtgtcttaaactggcgctgtacacactttggtttaatgccgaaggtgcagttctttctcatagcaaagcataatactttgcaatacttttcctgtgcatatggctgtctctacttttcttctgatgacagatgggaagataattatttgccatattcttttcagatagaagggaaagaaattctggttatactttcagattctggaaagctatctcttctttacttttgttctgagatgcataggtcagtgctgctcctttcttatttgtggcatttttttctatcttcacagatcaagctgcttgtataaactcaagacccaaaaatataattaataatgatccaaagtattaagtactgtaatagcctaatgattacatgcaaccagaggaaacagtgagaaatttaaaaaaatggaaaggatgccattttttttatgcctatcacatcacacttgtataggatgtgtatcacttttaacatccaactcgtgtgattgtgtcgaaattgccactagaaagttattaaaatctggaaacacatgcatattagactaccgagaattgaagtgaattgcactgctttttatcactaataactaagctcagttgtacacattttattttttttaatatactgtgtttttcacagtgagaacaaagagcaggataatatttttttgtaaggttcattattcacggaagaatattgtttgcaggtttatcttgtgcgtggcattttcattctgcagttgttatcctgttttgtttgagatttacaagatttgctttgatatattgccccaaaaataactgttgacacagcattttgtatcaatttattgtaggttctttgcaattgcaaatattgaactatcgaaaccaggaaatttgaggcatcggctcgggagaattttagctatagaccgagagtgagtgaaagttcctctctcttgaagtgtttgtttacataaagcttcatttgttacatgatagaatagtctccattatttttatcattagttggtgatacattaattgttgtactacatggcaaccaaaattgatatattaattgctggactgtgttcttgtaaatgggtgcaatttcagtgtcttatagggagaaatatgaaaaatggcatggtatttcagcaaacggcatgaacaatggatgtccaatagtaatgtttcccttgattatgtggcattaagaaagttaaatctttcctgttggtgactgtactctctgctcatgtctgatgtctgatggttgacagttgatgcttatgttcgctttgaacaaaatggagctgtcaccgtttctctattcctgatttcaagtttgcaacacccaggttattagtttatgggaatgtctttcatcaaagtgctattagatctaatccatggacacaactaaactgtagaacttagtgtttgaatactctgggaggcctgtctagtttgaatgattatgaacttgtggtcttgattgacaattatttgttactatctctgtcacaaaataaccacaattctaggagtagtagttacaatttttcttttgttgcgtaatgcttttaggtgtatatgataatatgatatcgtaaactgcattatagttgtccaacgcaatactctaatacaaccttttacattataattgcttgatgtgtaaataacctttttgaggacttaaagttaaatggtttatgaagtttcttaactttggttgtctcttgtcagatctaggtttgttgctgtcagtgcatatgaggatgagtttgcatttgtacgtgtttcagtggatcacaaacttcatgctcctaatggaggtaaaatttctgaggtgactcttgaacgtaaacaatgccttttgtgactctcattgcttatgcttagtataatacttacagtacattgttccagactttgaagatttcccatgtcataatttcagaaatatttttatccaccagaaattgaagaggatgctaaaatcatcagtactgcatataataccagcagtatccatggtacagtttggagtatgtgcttcatatcaacatgcctggatgaagaatattatcctgtagttgcaatgatagttaacaggtttgctccaaaatcatattcaatagagctgctacttaagtttgtggcgattacctggcattctaatttatattctgaaatatctttgtttcaacaggggctctgatgtaaatgacttggcactctatgggctagattcccataaacgtactattgaccgcatatctacttatttagaagctggacctttggcacttgaaatctcagaaattccccaactgtatggctttgcacttatgtttcgtgctggtgatgttctgttgatggatctgaggaacccaaaggacatcagttgtatccatagaataagcttgtcaactagtctaattggagatcatgtctccgttgaagattcctgtaggggattagatgtcgatgatgatgtggcggcttgtgctttgctggaactgagagactctggaaataacatgatgagggatgacagttacatggacattgacggtactgataacaaagctgtagtgaaatcaaggattgtttgctcatggaactgggagccaaatgccatgcaaggacatccaaggctgatcttttgcttggatgatggagaatttcatcttctagagtttagtttggatatggaaggagtgaaggtattgcctgagtgtgtccatagaggtttgccttgcaaacctcttttgtggatggacaaaggaatggtagttggatttgtagagatgggagatgggatgatcctccaacttgaaaataatagattggtgcataaaagtgcaattcagaatgtagcgccaatattggatctagcaattgctgaccaccatggtgagaagcacgatcagatgtttgcatgttgtggaatgtgccctgaggggtccttgcgagtaatacgtaatggtgtcaatgtggagaaacttctgaagacagatcctatttatcatggtgttactggtttgtggactttgagaatgaaaagaactgaggcttatcactctcttcttgaattgtcattcgttgaggaaaaccagaatactatcagtaggactcagttttaatgacatctgtgatgctgtaggatttcagactgatgtttgcactctggcatgtggtttagtagctgatggtttgcttgtgcaaattcacagcaaatgtgtaaagctttgtttacctacagcatgtgctcaccctgagggaactttgctcccgtctcctgtttgtgctgactggtatcctgatgtcactatcagtgttggtgctgttggacataatgttgttgttgttgctacatcgaatccttgttgcctttacatacttggggtcagatcattatcttcgtttcagtatgagctgtatgagatacaacatgtccagttgcattatgaagtatcttgcatatctattccacaagaggactggagacttgataattcatcttctagttgtgcaacgagtggtgattttcggaaagattttgcagctaatattcgcaagtttgctgtaattggaactcacgaaccttctgtgcatatcatttcgttggaacctggagaagcatttcagcaacttgctgttgggcatatatcagtaaacaacgcgctcggcactcctatcagtggttgtatacctgaaaatgttaggtttgtagcagctgcaaggttctacattcttgcaggactaaggaatggaatgctactgaggtttgagtcacaaacaagcaaagggcattgtttccctggttccttttacaaggagtcctctaccccttgtgatgatacatcccttatgttgattgctgtacggcgtattggaatcactcctgtagttttggtaccgttgcatgacagagccaatgctgacattattgttctcggtgataggccttggctattgcaatctgctagacacagcttggcatattcatccatctcatttctgcctgcttcccatgtgacaccagtgtcttctactgattgccccagtggtctgctgtttgtttcggagaactgtttgcatttggtaagtttctaggactcgtgaaagtgaaatccacaagcaaaacatgcacatattcttttttagggatcaagaataattacattattgcttgcatttcatgctctgaattattaggactcataaaccatgagattgctaaaatctgggatcgaatcccattataatgagttctccaaatagatagtcaggaacatagaaatcatggctgttgattgttatcttataattttctttatgcactcggtgaaaccgtattctctcttctggcatcaaaatttcacacttctcttttttgctgctatttctttagtatccgtttctcttttgccactatcgttggtcaacatccgttgaccatcacatttgccaataaaaaactgttgtacccttgcgaaactaacaaaatataagaaattcaaactatctaggaaaatacaatttacctttttagtttttaaaggttgtacaaataattatggtaggaaaattttcagttagtttaaaaggttcccacgtgtatcttaaaaatggaatttttaaaggaaatatttttgcatatccacatacaaatcaaacagcatagctaccaatattcatgtaaacaaccatgcacataattccttagtatagattattctgtgaaacatttgagaaccaaatcattcccatgctacatttttaaagattaatattagtgataatataattcccaattttatgtttttctaaaaaagtgtattaagtggccataatttagttttcttgataactttatggtataggttaaaatgtcaagtgctgcattattttggaacatgtacaggggtataatggccttttaggggctaacttaacagtcaatggatgttgactagacggtaatgatgaaacaaaaatttgctctgacagaatagtggcaaaagagagaagtgcagattttcgatggcggaagagagaacacagttgcaatgagtgacaaaaagaaaaaaaatcccttgttttattatacatagaactaatttgattcgtgacatcgaaatggtactcacagattttccatccatggtttctctcatatcattgtatttgagattttctttttgctagcatataatttttgaaaactactccctctgtcccataataagttcatttttggtttcttctattttccccaaaacaagttcatttttgaagaatcattgcagagtttgtggaagtaaggaatgattatttgggagaagataaagtgaggaatagttgcattgcgatatgataaagtagggatattctagttgtatatgtgtgggatgggtgaaaaatgaacttatttagggacggaaggagtaactaggtaatgtcatgtaccttgtagttttctctaatggggcattttaccagaggggtggcaatgtagcagagagtgtgtcaccatgtcaagtaaaaaaccctcccattctgtattctattttccccatggccaaagggactttagtccttttcttgttcgtctgaaacatgaaatctcttaatcgtagtcatcctgttttagcctttccctgttaagtttatgtgcttatatttcaagtagatttcttttgttccagtcccttctgttgatctgccataagtatggtgcaattactaggataatttattctaaaataccaagatgataataaaatcatgaccttgtgggtattgttgaaacttgaaagcaatgcttatattattctctcactattggtatgcatgtatgtgttctcacatagtcacatgtttatctcctaaaagtggcttgcatgtgcatttcattgtactgtcagtttaaatcaagtttatcttttcaggttgaaatggttcatggcaaaagactaaatgcacagaagttttcgattggagggactccaaggaaagtgttataccacagtgatagtagaacactgttggtgctgagaactgggttaaccagtgtatcctgttcttcagatattgttcaaatagatccaagtaatggggcattgctttccagattcaagtgcgaacctggtgaaacagcaaaatgcatgcaaattgcaaagatagggaatgatcaagtattaatcgttggaactagtaagtccaatggccgaccaatgatgccaaacggtgaagcagaaaggtaaggacgacaactcatgttttgtttctgctgaaccttgttttgtcaagtttgaagtgtccatggtcccttagaatttttgcactactaatgtttaacttgcaatcctagtgttttttttttgcttggtttgagtataattattaatattaatgatctgttgttttggtctccacttttttgttttctgtctgcccgttgtctggtattctgcaaaagtgacatgggtatgaatttgcaaagcttgcaaccatgaggcacattttttggtttctcactgattgtgacggtgttgccattgcgctattgatcattcaatgcatatttgcagttggatcatcaatatttttttcttgttttttctgcacttaatttagtttttccatttccatatctttgaattgtgtgtatagttaaaagctgcctttatattgttattataactattctctttggatgaaacagtatcaagggtcgtctaattcttttaagcttggagactattgaaagtcctcgtgagagcggttcgtttactgcagcttctaatttgaattcatctcatgctggttctccattcccggaatttgttggatatgcagcagaggagctgtctagtaacagcatgtgcagcagtcctgatgaagtttgctgcaatcaaattcaacctgaactcatggcaggccatttgagatcactagtccaacatacattcaatggcgctgttcttgctgtacatccatatctagatagatatgtgttggcagcagctggaaatgtggtatgattagaagtcaatttttatcatatatgatagtatatctattaaagagtagcttagctcggtaatggatctagataaataaatttgcaaagaagcttgaatgcttgattggcaagttccggactcttgacatcagaatcagttaatcaacatttatcctggcaaataacactatttatgtggatcgtatggtgttggcttctttcacttctatagattgctagaacaacagaacgaaggtgcattagcactttagcatatgagccacattaatagcagaggatttttttttgtaataactactggagagatagactagtgacgattggagttgaggagatggagattggaagggttatttgccattataaaaaaaatcctgaaagaatatcccaacaagagtgttattattttccaaaacaaacagttatcatgacgtcactaaattttctatcattctgttactatctggtgctaatatgttgatgctgacagatccagtttgaataccacaatatttgaaaatcatgatctgagattttctctgccttatcttgacagctttttgtatttggatttttaaatgaaagtccccatcggataaaaaagtatactacgagtaggacacgatttacaataacctgtttgaagacgtatgcatcacggattgcagtgggtgattgccgcgatggtgttctcttctattcttatcatgaggtacaagttgattcaattgaaacaatacatttttatgatgtttatttttatggagcttctttgtcgttacctctaatcctcgtattgatttatgccagaatcttaggaagttggaactgatctattctgatcctgcccaacggctagtgggtgatgttgcccttttgagctgtgaaactgctgttgtatcagatcgacgagggagcatatctgtactgtcttgcccaagattagaaggtatgccttggtatagatgtctatgttatccctttctttttagtttgtacctgttcttttctctggattctttttaatggtagtgcctcctctatactcttctgcatcttggtcatactttgtaattttgtagccttcatgtttagtttctcaatctaattcctttattgacatactaaatatgcagtataaacatcacaatatagctggcataaaatttgccagtgtagtaaggccacatagttgaatattgtgcctagaagctttatgaatttcgtaatagaattcaaaattttgcattacgtttgtgtacttctcatcatatatgcattactttgtaatatctacctaaattaatttaaattttacattacgtcaagatttattttgactttttttaacatatcttgcagtatccgaaagtccagagaagaacctagcggtgcattgttcattttacatgggtgaaacagctatgagcatccagaaggtaagcttctgttggcatcttagggctaaccagtgtgaattccattaacgaaaacataccaaagagagggttttgaacatgggtattgggtagctgctttggatttaaaggatgaatcatgtgtttgtaacttgatgaactaatgggctgtttggtttgaggaatcaaatcatcctaggatgagttttttccagcatgacccatcatgagtaggggtgaaacagtgcggaaacggacggaaacaacctttatcgttttcgttttcatattttttttggaatcggaaaccccgaaaacgaatattttcgaaactgaaaacagagcgaaaacgaaccggtgcggatacggtaatgaaaatttatcggaatacaaaaacccctcaaactgagcttcaaacttttgtcaagtctaattctcaagtctcaacagtcaacaattcgtcataaaacacaattatatcaagtctaattgttaagtctcaacacaagtacacaataacacttaacacggagtgacggaggtggaggttgaggaataacacctgctggctgctgccactgggctgctggctgctgcgaggcgaggcgttgtcggcggtgaggaagagtcgccagtggggcttgaggtgtcgtagacttgtcggtgtggctatggcggcgtcgtcagtggtggtggcggcggcgaaacggcgagacggcggcgcgaaacggcgggacggcgccgcgagatggtggcggtacgagacggcggtatgggacaacgaagagcgactgcgagagaggaagggtgggcacggtcgcgaggacggcaggggcgaggtcacgaggagccgaggacggcagaccagcggtggcgcgggcggtgggcgctggggagcacgatgccgtgatctggattctggatgcgctgctccgccgccggctcgcggtcgcgcgatgccgtgctcccgtgcagcgatcagtgtgtctctcctctctagggttagccgctatttgggtagatgctgcgatttggattgggctgggaacttggggacgacttatagactattgattctatgggcctttttaacttcagaaattccggcaaattttttggaatttttccgaccgattccgagttccgacggaaactgctattatcatattcgatttcgtttccgagaaaatatttccgttttcgattccgtttctgagaaattctgaaaaaattctgaccagctgattccatttccgaaaacaggcccggaatccggaaagtttccgtaccgttttcacccctaatcttgaggtcatcccatgattttgatgggatgatccaatgatcccattcatctttttttttccaactaagcatgtcgctttgaggaatgaggtagaaatttagtagtccattctgctcttgtttggttcggaagttggacctgctggtgcattgagtatccaattacttagatgaaacagcccataattgatctaggagatttgccttgttatctctcatgatcccgttattttccctgaacatttggttttcattcatcatgacccgacccttttctttctatatgagccccatggagaagtgtgaccgaactagtttcatgttttatattgttgctttgctttcctatggttaattcggtcttgtaatttgctgtaggttgcatttaagcattggcttccaattgatgatttgacagaaccagtgttggagtcggtatacaactgtgtcgtcgcaagcactctgctggggagtatctttgttatgattccactcacaaggtgtagttttgaagattccaactctagaatctaaattcatgctattagctatttatctgtgacagctcagtcagggccactgctagcctgtcggtaacatctaaaccaatttgggagattgaatttgctttaagttaatcagggttgtgaactatgatagttttggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 38823 - DNA, 705 bp, Oryza sativa
aggtgtgcgcattttgcactgcggtcccttgccgccctctgcaagggctgcaagggggcaaatgtaattttcaccctgccaaaaatgcatttttctttcttttttcatcttgtccgtctctcacgtcaccctgccgccctccttgcaatatttacttctgtaaaatatttacaccggtacaatatttctgtaaatattaaaaaataaaaatttaaaaatgaaaaaaaattcggcaaaggcagcggttagcatttagcaagaagtcaggtgggcctattttattttcgggaaaagtacacgcaaggtccctcaacttgtcatcgagatacaaaatcgtccctaaaccgcaaaaccggacatccggcatcccccaacttacaaaaccggtcataaaaggtccctaggcggttttcaccccggttttatcccacgtggtggctgactcagcgtgggacccacgtgtgccccatatgtcatggagaccacgtcagcctcctctctctctctcccttcctctcccttcctcatctctctctctcacttatctgcatcatccgtcgtcgtcttgcatccagcaaggagccgcggcggcagcgggagcgggaggccgtctccgccgcggccgacggggaaggagcggcggaaaggagatcgaccggccggctccccacccggcgaacgcgagcgcgagcatgaggttcatgc

SEQ ID NO: 38824 - DNA, 933 bp, Oryza sativa
ccggtgcgctctagtagacgtaacgtgtaccctcgctcactttgctggtacctgaagggcacggaagctgtagtctgtaaattatacttctttgtaccaacttccctaattatttcaagcatctcaagctatcatttttgttggcagaaccctcaacaggatttatgttaggatttcagaataagggtcctaatagatttttttttttgcctgctcaaagcaccatgttttacaatcaatggatgtttgctcaacttatctctcagttccagccttttttacggctctcgtgttatttattcctatactgcatgccatgtcaattatgtatactcttgatgtttgtttttttggaattgctatagttacttcaaacgaattagtactagcacattgcattggagagcaatattgtttactgaaggtaataatagaccgctcatcgtgtaaatgcatcatgatttactgaagataatattgtttacttaaaaagaaggctccgtgcaaaataacgtgcaaaataagagacgcagttcgtaagttgtagatcatgattggcttgtgcaatgctccattaatttccttgagaacgttgttcagcttagtttcattaaatccaatatgaaacccaaataataccatacaacccaaattcataatttgaactcataagaaatccgcattgtagtaccttgccgctatgctatacatcacacaagacgtcatgcagcttctgaccatcgacaatagcaccagatcgaatagagtacaggagagactcaagcagcagacgatagcattacggacacaagaagccaagcaggagacgatagcattgcggacactagacacaagaagctttacccggttaccccgcctgggcatcagtcttcgtcgaaagatgaagatagtaggtttcccatgtgatctaaa

SEQ ID NO: 38825 - DNA, 29103 bp, Oryza sativa
aagggttaattctgtgatgttggaaagcaaaggaaaccaacatggtagttgtgttaactgacctcgaaggttcatacttttcgtaaatattggtggactggataatgaattgacaatgttgaagttcatcgcgccatcaggtcgccaaagtaataacgagcgaaggctgccgctgagcttctcaagagcagagatcaaggatgcccaggtgctgtcgtcatcaacaaacatcagtactccaagtttcctcaaccgggatagcttcgacaactcgctgatataatgtgatgtagaggtcgtgatttctacctgtgcaagtgttgtaagtgaatccatttttcgaagttcgttagggatatgtaaaccccagaactcagaaataggccaccgcccagtgtggttataggatcttcttcctccaagtaagtttgctaaatgtggaagattggttatgccaggaggcaaatgctttatggctgtgtcccttatatccagagtctccaacttcttcaggtttcctatttgtgcagggagttccgtaatatgtgttcttctcagattaaggtattccaattgaaacagcctgcacaagtctttgagatctctatttctcaggaattcgtagccttctaagtccaatattctcattaatttcatccaaccaaactgcaatgtttctccatcggcaaatatgctcaaggaccggacatggcataatatttctcttgtggcaatatatttcacacctctgctatgaacagttagccgccttatcttctcttgcggaaacaaagtgttctgttctcctactagagtgataaaattatcttcaattgactttgacacaatgatctccaacatcacatcatgaactcggaatgttttaaccttccctgtaaagctagtggtcactggctgaataatgctccggttaatgaattcatcaaagtagctttctgccacctcaaaaacactcagtccacgtttgccagtcacaaagcgttctgctacccatcgcctgagtatagttttccttctgatattatggtcctcagggtaaatgcttaaatataagaagcaagtcttcaagtggtaaggaagatcattatagctaagctcaagtattttcttcaatctatcaagtgatggattggtttcaatctctgaaccaagagagctataaatcttctcccaaagatctttactgtgcacaggcttgctagccaagaggcctgctatactgactatggataaaggtgtgccaccacattttcccagaatcttagctgaaatatcttctaagtgctcaggacaaattgagctgccaaatattcttttgaagaataagtctctggattcacaatcagtgagaggtttgatttcgtaagctcggtcgtactcatggaaacaacaggtgtgtgctacagctctgattcgtgtagtaaccactattctgctaccattatttgagtccggcaaagaaaaccgaataccttcccatgcagtcatgctccagatatcatcaagaacaatcagatatctcttattttccaattgctgcctgaggatgctcgcaagttgtaccacattccatgcttccatgcccttgagtaggccttccatgggacctttgccagctccagttgatggagaactcggttgattaactggttgagtgatttggagaagaatatctctcatcagaaccttgacatcaaaactctgggacacagttacaaaagcttgacattgaaaaggtccatttcttccagatagactttgatatgttgtcatagcaagtgttgtcttgcccaaaccaccaaaaccaaatatagacaccacccgtaattgttgcacatgtgcctccaataaccagtgcacaagatttccctgacgtggttcaatgccaacaagctgccttctctctggaaagagtgcagtaatgcgagtatcaacatttaaaagattagcttggctatcatatgcagccatgctattcccagcagttccagagatgagatgattggcactatacctgcatgcaagaacaactaagtaagtttgctgggtgatgaaatcgtactacagaagtagaaaagagattaaaaaaaactgtatatgctcagaaactgtactttatagtaatactacggagaaattgctaaaagaagaggtttctttttgatgacatgggtcattcatgggcaaattgcacaaccgtggcaacaaccaaacctctaagactaaaatacaactgcagattggtgcataaagcttgctcatacatgcaaaaggactggaggcgtagattaaatgccctagtgatttacagttgttgccttgttggaacacttggaaggagtggaacaggcaaacttttcaagaccagagccttcagtcacaggacatcgtctataagagcttttctagctagtttgtacgttttttgcttttgtgttgctcctccttaaagttatattttatcctcctctaatgcaataggcagagcacctgccttttcattcaagaaaaagaagacgacatgggtcatttcaagagtagatacttgaacccatgatctccaccttcacaaccatgtgctctactaggctatatgggtctccccaaacgtttttggcttatcggtgcaacatatttttcaacatataatttgtggaaagaattcaagttcataagcaaatctatttacagaagggacaactatagataaacaagagaaactttgctgccttttgtaccagattgttggtgtcctgctagcacctaaagctatcaaaaagcaaaacggcaatagtccagaatttgaaccatcattcgggaaaaagggacagaaatagcacagaagttaccttgaatttcgggcactgatattcatagtacgcctttttagttcttggatttgtttggcaatctgatgcctcactctggtggtctgcaatatgtgggtggccttgcggaaaaacactacagggccgctgccaccggcactactgctgtcaccaagttgatgtttgaactcatcaatacaatcctcgatatcatatgcaatctcacgcacatgcttcttccaaatcttaacttgcttgccgcattcatctctcccagaaaggtcctgaagaaaggctgtcatgctctccagttcatccttcaagtgttgcagttcaccccgaatacctcccagaagctgggcttcttggaggacgattgtgccgagctttcccaagagagtgtggatcgcaccttccgcggcactaacaacagcatgttccatctatctaggatagaagatgaacaaagaaccagaaacaagctctaccgcacttctgacctcaaatgaaagctgggagagaaaatacaagcttagagtcagcaaaatgggattcaccttttgaatcctttccacagtccaaagtcaataaaactgtagcctacgtcacttgagtagaaaatggagactgtttccagctttcttttgaaaaggagattgtttatagcctactcaaagataacctgatcagttgacttttgagttttatattgttcaggatggaagctttcttgacgaagttaacttagtttacttatgagtgtattattttactgttttcacttttcaatataatttgcacacaaattattattgggagacagtgctgtagtcatgtttgaccaaaaacctcagagtagtgctaatgaatcaagctcaaacttgcaaatctaaaatcttcaagcaacatagcatgaatacatctaaaggaaccctcagattatcataccatgcatgacactgcacaatggtaatctatccagcttcttgaatcattatcaaaagttcaaaaacgaaggcaagaatggactatttgctatacttcactaaaaaagaactattccctccgtttcatattataagacgtttaacttttttgttagtcaaaattctttaggtttgaccaagtttataaaaaaaatagcaacatccacaacaccaaactaatttcactaaatttaacattgaatatattttgttacaatgtttgctttgtattgaaaatattactatattttgctataaactcggtcaaacttgaaaatgtttgactaagaaaaaagtcaaacgacttataatatgaaatggagggagtatctgctattcctcccacaaagtcctcactatatgagcaggtcatctatacaattaccttgtggtaaaaaaaagaccaagctcctgagatgattatgatcaagtattatcttaaacctctgttagaagtccattcatcgctcttctcctcctatcccttgtggccatcctctcaccataagtcagaaagatgtccccaagatcaacatgccccacatccttcaacctccttccaacttcctcaaacatcgacaccccatcctcatttgaaaagtagtacaagaacttgttatagtcgaaccttggcacatccactccaccccacatagtcctctccacaaacttagttgcctccaatgtcctcccggccttcaccaacccaccaacaaagatgctctcaaagttcaccaatggatccctccccttccttcccctcttccccaagtgcccctgaagcagcataatgtatgtgtgcatgttcggctcgcaccccgtggcaaccatctctctgaaaacctccgtcgcttctcgagctcgcttgatcctgatcaatcccttcatcaacccatggtacagtgcaatgtccttctccttaacaccatgaaaaaccctgtatccttccctcaccctcctcctcaccagcagcccatacaccaaatcccccatcacctctccgtccacctccacacctctcttgaacatttcggcgaacaccatgtacgcgccccacatcctcccttccttgcacagccacgacaccactgcccggtagcacccgcctctgccaccgtctgaaactcccctcctccgcattccgtcgaacaccttcatggcgtccgcgacgcggttattcttgaacagcgtcaccacgatctcctcgtacgcggcggcgcccgggtcgagcccgcgcctctccatcccgttccacaccctgcacgcgtcagagagcatccccgcgcggcagtatccgacgaccagaagctcgcagcacctcccggtccgcgacacgccgtaccggtgctcggcctgcttgatcaccttctcggcgacgtcgggcagcttgcagacggagcaaacgacgtcggtgatgaagttgagcgtgcggggcctgtcggcgtccgggaagagggcgagcagggaggagaccttgccgacctcgcgggccggggcgaggccacggatggcggcgcggagggcggcaagggagcggagcgcaggcgggaaggagagcagggtggagtggagcaggtcgacgttgcgggacttggcgaggacgtcgaggaagcgcgcggcggtggccggggagtgcgcgaagccgtgggcggcggtgaggtggtcgaggaggcggcgcacggggcgccaggagagcgggaaccgcgcggaggcctggaggaagagctcgcggaggtcgtcggccgcggcggaggggagcggcagcgcggagaggcgccgccgcagcgcgtcctccggggcgtgctggtgctggtagagcaccgtgcagaggcggagcagcagcgacgggtcggtggggcgccccggcgcgggggcgggggcgggagcggcggcagcttccgcggcggtggagaggaggaggcggcggcggcggcgggagagtgggaggaggaggaggaagcggggcagcggcggcaacggcatggatcaatggaggtggccgccgtcacgccgattcgcggtggcgaggtggatggcgcgacaagattgagaaggggaagcaggccgcaacagaagcgtagggaatttgggctttgtgggccgtgaggtcgtcttgatcttcgcggtgtatgagaaataagatcactttgactccctcaactgaccaccgaatctaaatcgtatctctcaaccgcaataccagaaatcttgactccccaaatttacaaaaccggtgcaattcgactccctgggcggttttaggaggcggttttgctgacgtggcgccacgtggcgcctacgtggcaatattgaccgagtcttcgttccacgtggcgatgacgtggcacctacatggcggtagaattaaaaaatatgcgtgcgacccattagtcattcacaccaaaaaagtgggcccactgacatgtggggcccacatgtcagtccttcttcctcctccctctctcccttctctctctccccttcttcccttcgaccagtggcgcctctctctttctctcaccctcttcccttcgggcggcgacgggtggtggaagcgagcggcaggcggcgagagcgagcgacggcggcacgcaagtgaggcccggagcggcgacggcaggatgggcgagcgagcggcggcgggaggaggctgagcgggagctctggccgcgttctcaccctgcttcacgatggcgttgaaggcaacgctgcccttggcgtcgacggtgagcgcgaggatctccgggaaggccccaccgtcgccgaagtcctccagccgccgcggcacgaacccgccacgcttcccgtacagtggcacgggcttggcagggcccgaaggcttcggccagcagcagccgacgctggtgcagtggcgacggcggggcggacgatgctggggcagtggcggttggcggtggccgacgcgggagaagccgagacgatggctcctcctaccgcgagcgcgaggcgggtgggagggcggccggtggcggtcgatgttaggggcggcggtggccggcgatggccgacgcgggagaaggggacacgacggctcctcctaccgcgggtgcgaggtgggagaatgagggagggcggccggcggcgatggccgatgctagggtggcgatggcggccgacgctggggcggcggcggctccggcttcgatttcctccgctctctcctccgccgcatccttccatcctccccacccgcctccctccatccctccgtctgcctcctcacctccgtccgccttcccgcgcgggagagaaagagagagaagggagagagagaggaggaagaaggaaggaggactgacatgtgggccccacatgtcagtgggcccacatttctttttgtgtgaatgactaatgggtcccacgcatattttttagttctaccgccacgtaggtgccacgtcatcgccacgtggaacgaagactcggtcaatattgccacgtaggcgccatgtggcaccacgtcagcaaaaccgcctcccaaaaccgcccagggagtcaaattgcaccggttttgtaagtttggggagtcaagatttctggtattgcggttgagggatacgatttagattcggtggtcaattgagggagtcaaggtgatcttattccggtgtatgacgacgtcgtggtttgggaaaaagtctactttacatccctcatcgttctaaactgcaaaaaattacagatttttccccggtttccgttaacatgcttttcaaactattaaacggtatgttatgtgtgaaaactttctacatagaagttgctataaaaaatcaaataaatccatttttcaagtttttaataattaaaactcaaataatcatatgctaatgacttgtcttattttacgtgcgcacttaatcttcatccttccatcatattcgaacggggctagctccctgaaccgcaatatcagaaatcttgatctcctaacttgtaaaactaggttaaattaagtcttatggtactatatatatatatatatggctagtttttgttgacgtggagagttgattgtagtcaacatagctgagtaggcttgagcccccacatgtaaggctcctatcttcttcctctaacatctttctcgcccctcttctccatctctaatttctccacatctcccttctctttctcctggcataggccgtaaaaggatttgaaatttgttttctcttatcccatttgtcatttgccagtaacctttcacttcttctgattatatatattgacgtttgaaattagattcagttaaatatttatttaaaaataataataaacatatattactccataaatatgcaagcataattatgacaaattgcataattgcataataaaaaacaaaaatcaaacatggctgtgatcacacatatgctattttgttacaatttatggagatcgaatttgtgtatgaagttatatatctcatatcaatatatcttattatttttaaaaaatatatatatatattaatagttatttaataacatgtaagaacaacgggatatcccctcgaattattagaatccatgtccgccgtatacataagacaaatatcatattcgccaacacacctttctttgtgggacaaacaattaagctatgatagatgtttagggaagtacttagatgcaaactatactcatccaaataaacatacataagtaggtccggtacaccgatctatcaaagaaacaaagcagtacaatatacaccaccatacgtacatatatatccatatatacaacgcgctaaacaaatgctgaaacatcatactccctccgtcccataatccggttctaggttggtttttcatgggacggagggagtactcctctagcggaaactaatactacaaatcatcaatgagaaagatactgtatatagcaagcacatcatggatcatgccatcatcgatacatatgtatatataccagtctatagaactgtacacacatatatacgtacgtagaatcataacgtatttatcttatagatatataacgtatttggcaatgcgatgagtataaaaaaaatatagattggctaggtggagtgtgctctgcaagccaaagaaatgtggggggctaggaatccaggacttagagactcaaaataagtgtatgcttagtaaatggatctttaagttaattaatgaatagggagtgtggcagaatttgttgaggaaaaaatacttggtaaggaaatccatttttcaggtccaaaaacaaccgggggattctcatttttgggctagccttatggcagcaaaagaacccttccagacacttggccacttcacagtgaataatgggaaacaagtaagattctgggaggaccgatggttgggaaaccaaccccttcatttggaatttccaaccttgtatagcttggttagaaataaaaacttagtagtggccgatgtgttaggaagggtccctttgaatgtctcttttagaagagcaattgtagggaaaaacttggaagattggcttgaaattgtttcaaaggtggtgagtatcaatttgaatgataagcaagaccaattcttttgcaagagcaataaaaaaaagggttgttttatgttaactccatgtataaaacccttatgcttaatggtgtaatacctgggaaatctttaatttggaagctaaggattcctttaaaaattaaaattttcctttggtatattgaaaagggggtgattctaacaaaagataatcttgctaaaagaagatggaagggtagcttgctttgtagcttttgtaactctaatgagtcaattcaacctctcttctttgattgcataatggctagatacatttggaatgcgatctatcttacttttggagtcaagcaaccccgtaatagttcacacttgtttgaaaattgggtaataggttttgaacctaagcttaaaagacaaacttgggtgggtatagcagcgatttgttgggctttgtggctcaatataaatgaattatagtctttaatggctacaaccacgtatttttcttacaggtaattttcaaagtaactagttgtcaaggctttggtctttgcttcttaaggaagacgaaggcattgaagtaatcgcgaagtgcaagcttttagagaagtgtatgatggagctgatcttctctacttttgggtggaactttagaagaatgatggaagcttagcttttagttcctcttgcttgttatccatctttaaaacttatttatgttttacccatgtaacgggagagtcttatagtcttgtgtactcgtgtttgttacttttaggctgtgtacatcctcacaaggtgtagaggccaggttttttataatccattgtctaaaaaaaaaatactgtgtgtgtatgtacgatcatggctgcttggtctccggctccgggtcgtgaacctcgtgctccggcggcagctccgccgtgggcaatggcggcagctcaggcttcggtggcagcccgtgctttgggaaccccggcacggccgggtagtgcggcagctccggcacgacggggtgcggcagcatctccggcacgacggggtgcggcggcagctcaggcttgggcaacggtggcagctccggcacggcggggtgcggcggcagctccggcacgacggggcgaggaagctcagggagcggcggcggcagctcgggctttggaagctccggcagctcggggtgcggcggcagctcgggcacggcggggaagtgcggcgccttctcctcgaggtgcctcgccgtgctgcccatggcgccgcacgagagcagcagcgccgccatgagcaacagagccgacgacgacgacgacgacgacgacatggcgttcctgctaagcttctgatgatctgatctagctaagctaagctagttcttcttcctcgcagccagggatcgatgactagaacacaagggaaacctggtacttatagcatgaacagtgaagtgcagatgatatcatatcatatctaaccaggggtccgttgccattttcaaccttaccgaattttggtaaagttacccaaaaaaaatggctacatttagtttgctgtcaaattttggtaactatataagaaatcctaccaaaattttagcaagtcgccaaaattttggtaactacaccaaaattttgataataccaaaattaggtaaggttgaaaatggcatcaaagtgaacatgccccagatcttgatgcgtacgtgttgtttggtacatggcaggtgaactgctgctgcatcacacatctctgatccttctggtttcctgaatgcgtgttcgaactctcctgatctctatctgttccttcgtgttatggttcagttagttgggaattccgaggattgttcagagagagatcagtgatcacctaatcgctagctgcctagctgcgtatatgcaccggcaaacaggtgtgcaaacagcagagtcattgcgggcaacacgtgtttcaccgcgagatgtttatgaattatgctgctgtttggccacctgaaaatgcctgaactctgaaccatcccggtccatggtgacgaactgcttgacttgctggttacaaatctagttgaaaacgaccattgttgtacaatccgtacacggcaacttgcttaatgttgcaggttgccgtgttgatataggccgattttcaaacggcttacgttagaagacctatagaatatacacggcactgtgagtacatgactaacgtgggtattcagttgacaatcaggtgcagtgcaggtaagcagcagctatgtgcagagtaggtagcacatcttaatttcttaattaattaatttttctccatattttagataaatataggttcctcgatgtacttgctcaataactataaatgttttgataaaattagaacaaatttgccttgtttgttatgccttaataaatgatgattgctaggggacggcattccgcccattcgacatgatactttacgaaggtgatgtcatccgcacctccgctttatcctcgcaagtctacgactccgtcccaccccacgccacgtgctcatggctcacaccttgagcagaaccattggtcgacggaggagcatggtgaggcgaatgcatcggcgccaatgcctaggatgctaggaggtgtcgacacacatggcaacgctagccacagcaacactagggaaggaaagaccagagccaaggagaggcgttgaatggagaaaagacattagtgggaaacggttcgccagccagccaagcagcgatggcgagtgtcctactgatcaggcaccaatggttataagatggtatcggtgcccgaggtaccatgcctgatatctgtgcataccagccatgataccacgagtatcagacttggcacctatcggtatcaagcgagaattacacgctgcacagtgtacctacacacaatattgacgagcagcacgatggattggcaaacagcacaagctgccaatcgaagctctagatctagcaccttcgtcagcctttccctccatcaccatcggtaccagccttgaaggaagactcacaccagacaccgtcctccctgatggcttgtatggagaaggaggccatgaagccagcgtcgtccatcgcctcatcgccaacatgcactcagaatggatctagcaatgagaatggcctaggcctccagatctagtgacagaaagaggaaatggtggtcggcgagaggggggagcagcgatgtgctatttttgccagcacgagcaaggaggaagagaagagggcagagggaggatgtgaggaggagggtggcggcggacgtatgggtgtgtggctcacaaagatcaacgagtggatgggaagcacttagggtggatggagagcattaattaagtatctcgtccctaactccctagatgggataccatatcgtagtttttctgttaataaatagatgcactaggagcactaccattttttcaggaagaataataggcatcttgttatcctgattcactctgattctggtatatatatttacaaaattcaatagactaggatatattattcataaaatccgacggatgtagattatttgactttttatgtggattatctgatagatttgcctttttgatataggatatggtattgataaaattcgacggatgtagattatacgacgttttatgagtattattgcttcgggataatccaacaaaggctgattctatcatgtagggagccaaatagtttgatgcacatcgtctcttgctctttttcaaatggaaaagcttgttagagcataatccaacttatcaactatgggccaccgagatcacattaggcctgcgctccaatagaagtcacaactttatgttttggacctacacaatccaaaaagactaaactggtaggtgtgaatctttctcaccttttaagttatgtttctccaccatcaattttcgatgtaggactaaatctaacagttgtcccatacggggctagtagtacctaggctagacggtcagtgtggcataatctattcttgcacacaaagacctgctgtaactggcattcttaataatttttttaagactagaaaacaagtatatattgtaaagcacataataatgcataccacaaataagcaatattataggaagatagctattttattgatttatgaagcatgtatgatacaagtgtagatcgtgtgtgcacacacataaatcagcacatacgataacacaataactcatccaagaacaaagaaagctgccacaaaacaaaacacaacaacaacgtacatcatctcacacactcacacagctagctagatcatcactgaaaatatcttaggcaaacatcgatcaaagcttacacatgaacatacacacatacagcaacacgtagtaatttcaggatacgatacgaccggccgatcgatcgatctctggatcgatcatggcttctcgggataatggctctcaggcttgggcggctgttcatgctctggcacggtgggatgcggcacctcgggcttcggcaactccggcaccacagggtgtggcacctcaggctttggcaactccggcacgacggggtgtggtggctcttcgtgtttcggcaactccggcacagcagggtgaggcacctcgggcttcggcagctccggcacgacggggtgcggtggctcttcgtgtttcggcaactccggcacgacggggtgtggtggctcttcgtgtttcggcaactccggcacggcagggtgaggcacctcgggctttggcagctccggcacgacggggtgcggtggctcttcgtgcttgggcagctccggcacggcggggtgcggcggcggcagttcaggcttcggaagctccggcacggcggggtgtgggtgtggcggtggttcttcgtgctttggcagctccggcacgacggggtgcggcggcagctcaggcttgggaagctccggcacggcggggtgcgccgccgggtactccacctccaggcgtcgtgcagcgttgcccatggtgctgcacgagagcagcagcgccacgaggaagagaagaaccgaggaagacatggtgttctcaagctctcagtggcttctatctctatatcttttagtgtgagctagctaagcactctgtgatggctgggagaaaggcaagcaagccagatatttatactgctaaactgcaccttacttaagcagttaagctactaatgcatgattatatttgattacagtgagcctgctgattaattactggtaggtacgtaggtgatctgcacccctttttggttgtttgacttgtttcgatttagtcagtcagtgactcagtgtgtgatctccccttatctttgattgtgtatgcatggtttgattaattagttgggaaaaattgagacccaagaaatttggttggtgaatgctatagaaacctagaacggacggtgtccttgtgggtacttgtgtggccacatgatatgagggtagtgggaagtaagtgaatcgtgcatgacaaggacagagtactacatgcatataattcctacgtcgcaaagtaaaccaaactcgtacgagataagatagatgaagtatatattatctttccaaaaaaaataaaaaagagagtagcatatatattagctatacatcgtacagccaatgctgacaaattaatgcttagcttttccagttgtaagaaaagatatgaatatactgcttttaaaccgctactacatatggcatacatgtgagaacaatttagatttaaatttgaaaactaaaacataaactttaaattgtatgtgtataagtattaatgtgttctatatgttgagtcgatgaaaaattatgcgttattagtcatgcatgccaatattgaaatctaaatttaatattaaacccggtaaagtttagtcaaatctatgttaaatatcaaacatttatgattgtagggagtatatgtttcgttgggcctgcttgattactcaaagttttatttttgatccttaattgacaaagtacgggagatgtgctgcattttctaccgttaacttaaaagcacggtatatatttagatatcttctcagggaaggtaaaaaaaaaccattcttactcgtaattaattaagtcgttgaagaattcagtttcacacatctcttgttcatattcaaattcctatatatggtaaagtagaagttgttggcccacagtgttatagtaactgaaaaaaatgtcctatgcacataagctttgcgcataggtataacactaatgaaagtatatacacattatttttctagaattttttatgatatttgttagttagtgtgcatagtgagtgcataatatgcataattcattcttacacacaaagacctattgttactgtgcattttcaatcatttttttaagaaactaaaaacaactatttttcctgaagcatattatgcagtctgcaaataaattgtaggcaaataactatttactgatttatataatactagaaacataattcaaacataaattaatgaagcatatatggtacatgggtagatgatgtgtgcatagatataagcgtagcacacgcaagtacatcctccaagaacaagaacaactggatggctgaaacatcaagcatcactcacacattcctagcaaacaccacagtttacatgatcatatcatacacacatatacaaataaacccatgattattcaggatgcgatatgatgggcccgatcaataatctctgcatcgccatccgatcatggcttggccatcggcacctcggggtaatggctctcaggcttcggcggctgttcatgctccggcacctcggggtggtgcggctcttcaggcttcggcagctccggcacgacggggtgcggcggctcctcgtgcttgggcagctccggcacgacagggtgcggcggctcttcgtgcttaggcagctccggcacggcggggtgtggcggcagctcaggtttgggcaactccggcacggcggcgtgtggcacctccggctttggcagctccggcacgacggggtgtggcggctcctcgtgcttgggaagctccggcacggctgggtgcggtatctccggcacagctgggtgtggcagctccggcacggcagggtgtggtggctcctcgtgcttgggaaactccggcacgacggcagggtgcggcggctcttcgtgcttgggcaactccggcacgacggcggggtgtggtggctcttcgtgctttggcaactccggcacgacggggtgtggcggcagctcaggtttgggaagctccggtacgacggggtgaggcggctcttcgtgcttgggcaactccggcacgacggggtgcggcggctcctcatgcttgggcagctccggcacggcggggtgcggcggcacctccggcttgggtaactccggcacggtggggtgcggcgggtactcctcctcgagccaccgtgccgcgctgctcatggagctggacgagagcagcagcagcgcggcgaggaagagaaccgaggaagacatggcgttcttcttaaagaccatgctggcttagctagctatgctacctcactgtgtgagctagtgtgctttgatggtttggagaaggcaggcaagcctggtatttatagtgctaaactgaacattaatcaagatcaataaattaattaatgcatgattaattacaggagctagcctgctgatgtgttgattaattacttgtaggtaggtgaactgcactccattggttgttcgacctgtttcgatgtgtgagtgtgatctcccctgagccctgatctatctctgttggcatgccatctttgtttgtgtgtttatgcatggtttagtaagttgggaaaaaatgagacgcaagtgagattggttggtgaatgcagtatctagaattgtgtccttgcgtggccacatgatattgcagagtaagtgaagccgtgcatgacaaagactaaccaagcactatattatcttccaaaaaaatttgacaaagttctttttaagacaacaaatagtagtatatatattagctgtacgttgcaggtaatgctggcgaaatgcttagctttgccgtttgtaagcagagatatgaatatcggcggtaattaaccggccggttaccgctgatcatgagccggtaccggctgacatctgacataacaaggcagaacaatctagatttaaatcgggagaatagctaatatggtctctaaagttttgctcctgggttattttagtccttaatcttttatattgtccaaacaaatcctttaaatttgtcatgtgggctaatatagtccttggtcccaccaaaatcgccacatggatatgccatgtcaccttcctatgcaagatctatatgatttgtctaatttacccttacgcataggaaaataaaaaacaaaaggaaaaagttaaaaaaatatatggtatgtgtaagagtaaaaatatacctcaaaagggtgaaaaaagaagtattttttttctatggttatgtctaattcatccttatatttatttttctatgatatacgtaagggtaaattggacaattcattatagattttgcatgaatgatgacatggcatatccatatgatgattttggtggacccaatgactattctatgctttatgacaaaggttaaggatttctttggaccatttaaaaggttagggattaaactgatcctacagagaaactttattttttttgaacggaaaaagggcacaagattgtgccttttcattgaatatagaaggagaaaatacaacccctaagggtaaagcaaaaaagactttaagctataaactatacaatgcgtgggacgaattcgcgcaacctttttgcccctgctaaggcccacaggccagcctcctcttttatttttgctaggagaaggcctaccgccatctctttgtgatcgaaaatccgccgatttctctccttccagatttcccggactactagtaggatgagggaccgaaggcccttttttgggatgttgggagtatttgctaggctttcccaccattggcggactgaccgggcttcctcccactgggacggctccaattgatgatatcccacccatccggcaacgtggtgccagattctctttgtgtatctgcatgtggcgacaagatgcaatcccgtcttagcttcgcaacgacagagggggcaatggccgttgttctgccaacctcttattgcaagtcggtcggacgtccagactctattctggatgatgagccatgcatggaatttgcatttccccggggcccatgctttccaaatcaaagagttgaggtttgtacttggcgcccccaagcactgtgcatgataggccgaagaggctgtataatggccattgcatgtgaatttccatacaatctgatccggctcttcactaacttactgcacatttcggaccgctttcctacagagaaactttagggactaaagtagctattctcccatttaaatcttaaatttgaaactccactttgaaattgtatatgtgtaagtacattaacgtgttttatatgctgctggatctatggataaaaaaatatgcggtagtcattccaatgtttaaaaccaaaatttttaagcgattatgtgttctgcccttttcaagtcggtgaggccattctcttaagcaacttactttgttcttacttcaacaccaaactttataatacaatgacaggcagagatttttgtgttcgtggagaatggacaacgttagattcgcagcgtggtagttgttgagtagttgggttatttgctctgattttcatcacttttttagaaaaaatcttttaagcggaaatattgcatgacctttttaagtattttcaactggagggtatacccaatactgtaaatcttttatactaggtttgttttgctcgagaaatgtatagggatcttccggctagcttcatagggtggtgggctagacgacctcctaattatttaatattaaattattccctaatattcgcgtcttttaggtttgttttgctcttgaaactggtaacttttagttttgaggaaaaatacattttttttttgtttcggagattgtgttcatatgattggacttcaaagccggtagtcaattcttacgtttgctagaagtcagacaagagccaacaaagagagcaacaaagagagcaactaaacggcaactaactatcaaattaacatccgtgtaataaacggctatatatgcaccaaaggagaaacatagacttctagaaattaatccaaacaccagataatgaaagtaagatcttaccatttcagtcatgaaaatgtgccattttgaatatctggttcggtctttatgtacagatttaaccgttaatttctatttcaaaatatttttaaaaaatctcataaactcataattgtatgaattttttttattttcatacatcaacctaagagttgtttttttatctaatcaaacaaactcatagtttgaagtgtgagaacaaaaaaaaaatactttggtgaacagtggtgttttttttttgacaccttggtgaacagtggtgttgggctaggctcacgggagaggagatacgtcagaaaactgaaaaacggggttcttttgtggccagaaaaatatattttattgacgtgaaacatgcatgatacctcctctgttcctaagtatttgtcacgatatatttattatcaccgttaaaactttaactagtactacctccgtttcaagttataagacgttttcactttgatcaaagtcaaactgctttaaatttgactaagtttgtagaaaaaaataatgatattatcaacccaagacaaatttattatgaaaatatattgaattattgatttaataaaactaatttgatattataaatattattatatgtctataaacttagtcaaatttaaattagtcaatgaccaaagtcaaaacgttttataatctgaaatggagggagtaatatttttaaatagacaggctattattaacgaaagagtaatgtttattactccctccgttccaaaatataggtatttttggaccctgacacaggctccgagatactactttgaccaacaatatctataaaaataagatgttttaaataaaaattaagagttgtatattataatagtttgtttattaataaatatagtaacatcaattttacatgattgatcttttttttaattattattggttaaagttaaaaatgtttgacttgtcactatgctaaaatgtttatattttgatacggactgagtagtatataacttatattttcataatgtatcatccttttacgtatttgtcgttttttttaaaaagaagatacgaatggtcaaagttgaaatatgaataataactgatgacaagtacttgggaacggataggaagtacacaacatcagccatcagccagctgaatctctgaatacaacaacgagagtacgaaactctgaaacatcacgatcctactatatcacatcacaccagccggggctcaccacgaacaagatcacacgcaaaacgtcctacacttcgcacacccacgcgaatttgattcagatcactgactgccacacgcctgcacggggtgtaatctgatcgtcatttttcatggcttggcctccggctccgggaagtggaactcgggcttcggcggcaactcgaacttgggcaatggcggcagctcagccttgggaatctccggcacctccggcttgggcagctccggcacggcgaggtgcggcacctcggggatcttcggcagctccggtttcggcaactccggcacgacggggtgaggcagctcaggcaccttgggcagctccggcagttcaggctttggtatctccggcacggcggggtgtgccgggtgctcctcctcctccgccgccgccgccgccggcgcagcctcctccagatacctcgccgcgccgccgatggagctgcacgagagcagcagcagcgctgccgcaaggaggagaatggatggcttggtatggctggaagccatgtcgaacggtttgcacttaacttagctgatgaactctgggtgagtgtgtcagtgagaggttactaggcactagctgatgatcacttgatcagtctgtgtgaagatggctgggtgagaaactaagaagacgatgctggcatttatagtgatgaatgggagcttagatgcatcatcaatttgcaggagtctctgatctttggtggctggcagcagtggcaggtgatctgtattttggtggttgtttactatggtctgtgtctctgatctctgatgatttcagtttcatgtactatggtttagttggttgggattattgagaccctgaatcgtttggttggtgaaaatgcaagaccatctatgtctagtttaggagtgtatatacacctgcactaaggacctcaggactacagctgggaatgaagcaatgctgacaacatgtttgattgtttggttttggttgttctgaagtgttgaaaatggacagtgtcatagatatttttgcaaggcttcctttttaatgctcattcaacaaatttccaaatgaagtagatagttaacacttcaattaaatgctgatatgagtatgttcagtagcaagcaagtttagcttacatacaatccagttttataaatttggatatgagtaatgctactaatatttaggttgaacactttctttgaaaaaaaaaagattcaggctgaagatttgaagattatatgtgtttatttgtattgaaaatactagcttaacaaatcttgctttaagaataaaaaaaactctcaactcccaagcacggtcagtactacaaaaccatgtcataagtttgggtgcataattcgcatgtcatatttccatgaatttttacaacaaacagttaagtttcctacaacaatacacaatagaaaaaattcctccaaacagagctttgaacttggcttgcaaattaaattgtattggtagtcatttggatgtaatcaggacctggtcctaggactaagggcttgtttgcttgctgccctcagattcgcgcctggctcaggcgtcgatgtcaggcgttcgatttcggtcgcctgcggtcggatcgacctgcctgagcaacggtctccaggcgagggcagcaaccaaacagcccctaaaagcccatgtcgattttttgaggtcccttaactacaaaatcagaaatgtgtaccccaaaactctctaaaaccgttcaccggaggtccctcggcagtatttttacccggttttgctgacgtggcatcctagtcagcaaaaaaattaaaaaaaatacatgggacccacatgtcagctgcacatcttttttttttcttctcttttcttcttctcctcttctctcttcagcgagcgcggcagccacaggcagagcggcgtgacggggttctcctccgtggaggcgacgagcacggccgcggcggtgacggcaggttcccagacccggagccagcgcgttcagccggagcagcggctgctacaccgacgccgcattctccgccgcgcgctcctcgccgccgcccagatgctgctgctgcgcctgcgtcgccgccgggctcaccgtcagcttctccttgatcgctcccgtcaataaaaatgtggacatcattattgattgctaggagcactacgtgcttgcagacggcgaacggcacgacggcgccggcgaagcccgccggggccgggccgcagctgaagctgctggtggacaagcgctcgcgtcgcgtacgtgctgtacgcggaggcgcgcaaggacgcggtggacttcctcatcggcctcctccgcgttcgtctcattcgtcgaggccgacgccgacgtctcgctggaggagttcggtgactcgctgtgcccgccaatcccttgcgccggcgaactcttgaccctgccggatagcaactccgccgtcgtcaccgaccggccactgctctaagtgcaggtacgtacgtcgtcataaaacttaaactttgcaaattttgcaccatttgtattgtacgtgatctacgtgttcatgatgccatgcatgtaggtgacgaggctgaggtgtggcggcttcgtgttcggcacccagatctgccacaacctcgtcgacgcggccgggatcacgcagttcttgcaggccgtcggtgagctcgcggaaggcgcggagcgtccggccggtgtgagcgagggagcccctcgacgcgccacccgccgcgtccggcgtacgaccaccccgagtacgagccggcgtccgacgaggccagcgacaggctccgtccaggagacgagctcgtgcaccgcagggtcctcttcggccccgacgacgtcgccgcgctgcgcgaccagctccccacgcgcctcggccgcggtgctcgcgcttccttctcctcgagtccccgggcccagaccgccgctttccgctgcctacagctgccgacgccgcccttccgcctgctccggccacgcgccgccgcccgctgccgctcgcccgccgcttgtcgccggctcgccgctgcagccgcgctctcccactgacgccgcccctccacctgctccagccgcgctcgcccactgcttgccgcgtcggcgtcgtcaaccgttggctccgggtctgggaacctgtcgtcgccgccgcggccgtgctcgtcgcctccacagaggagaaccccgtcacgccgctccgcccgtggctgccgcgcttgctgaagagagaatcagagaagagagtagagaagaagaaaagagaaggaaaaaaaagtacagctgacatgtgggccccatataatttttaaatttttttttactgactaggatgccacgtcaccaaaaccgggcaaaaatactgccaacggaccttcggtgaatggtttaagagagtttaaggatatacatttctggtttcgtagttaagggaccttaaaaaatctcgctattcagtcgaggggcctctggtgaccttattcctaaatctatttagaacaagtgcctaaactaaaaatgcaatggaagaaaattctctgataaatagtattttttaagaagcgtggagaaaataatccgtggtaacgattcggtcaatacgcagaaaataacggggtgcacagttttcttgtaattaatccattctcataatctcattctgttccttggaataaacattgtgagttattagcaaaccagggagcatatatacattataaactatcaaaactcgaactgcagactcaaagaaaactctccattatattgatttgtacatgaatataaacacaactccatggttaacctgtaatcatgtactgatacaagccagtgtagatagtgaatacagaatacgtaaacagtgaaccatcgcaaataaaaaccacacacaagtattattcagtacagataaaatggcgcgcgcgctatacgcggatgctctatctgatcgctcgttcatcatggcttggcctccggctccgggaagtggaactcaggcttgggcaatggcggcagctcgaccttgggcaacgatggcagctcaggcttcgggagctccggcaccgcagggtgctcaggcaattcaggcttcggcaattccggcacctcggggtgtggcagttcaggcaccttcggaaactccggcacggcggcgccatgcggcagctcgggctttggcagctccggcacggcgaggtgcggcggcagctcgggcttcggaagctccgggtactcctccttgggcgcggcctcctcctccaggtagcgagctgcgctgctgatggagctccatgagagcagcagcgccatgaggaagagaagcgaggaggacatggagttcttggaagccatgtcgacgatcgaaatgcagttaatttctagctcgtctcggtgtatcagtgacggtgagagagctagttctttgtgtgatgggttgagaggcaagaggaagctggtatttatagagcaaaaatttaaggaatgttagcttgctgaatgtgcatggaagtctcttctgatctttggtgcttggtaggtcatctgcatcagtaatttggtgatcaattggtttcctaatatatatttgaggatggcttaattagctgggaatattcagagtttcaaacctgattgatgaaatgcaccaccaaggcaccaactaaatctagccctttataaaaaagtttgtacacgtgtgcagtgtgatgtgggatgttaatgcaaagtaagatcaatcgtgcatgtgataaacaacagctaaggaacagagcaagtgagactatgctaccgtcccagtaagttctgacaaaatgtctgatctggttgctgaagagagtgtcaaaaatagcagtaaaattctccaactttcttttctgactctgcgtggtttggcgatcgactgcatgttcgagtaggagcttacatagcacactagtgatcaatcggtgttaggtcacctgttcaagatatctgcacaaaaaagttcagggatttgttgataaaatcactacaaggtcaagctagtcgcttgtcagtttcagtgactgatccaaagcctccaaaccgagctgaaaaaccaccattcctctgtaacagccttcccgtggacagtgaaagaagtgaggaatctgaacacattggctaaggaagaagttgttctgaaaacgatggcttattcagtgtagtgttgaaggtagaaggcgctactgcaacctatctgctcctccctttgatctctttaacttgcaggtttggtttatggttgatagctaggctcatcagtgataatacaggacatggaaaatggaactataatttgtaccacaattgtacctgcagtttctgcactatctgtacttttgtacgtgctgcaacctctcctactccacgtaaagtatgacctgtttccaaggtactaaaagagcaccagctagctagcttgcaaacaatatttctaatattgtagattaaacaactgaaagtggtccagctgaaattaacaagagaagagacggtttacaatcctggaggccctgctgcatgctctgcacattctagctagtcagaaaatggtgatttgtggatttaccccttctctattaatataaaacgggaaagcttttgccttccttcagaaaagaaaaaaaaaacaagaaaatggtgatacagctaaccgttccatattgatttcaggttcagtttacaacaattaactgtggtcagatctgactagcgagcttaatttgcggaaaatgacaaatgtcatattaaaatgtgcacaaattaacatcctatcggcctttatccatgttgattcaacgatcaagaagccttttctttttggcgaacacattgggaaacatgatgacagatgtaatgtaattctgaagaagaaaacatgaagccatacagctctggaggactattctttcatcatgcggtcaatgaatcgatggcaatgatgactgatgaatgcaagtgtgtgctcatatacacacataattgaatccatttattataaacaaatatgaatatatgatctcacaccctcagagaagagatatgtgagctgctcatagcaacaaactcagcaagtaacacacatctacacggacgacagacatggcatgcacgccgttgatacaggaaagaaatacacaaatgaaacctaatgtagaatctggacgaatcaatctgaatggacctcttggtggtcatcatggtttttgccctcccgttaccaggaggtgcacctcaggaatgaccggcagctccggcttcagtggccggcgctttcttccggctatggtgaaaatgggatctcaccgttcggcaacggtggcatctggggtgcatccggctttggtggttgttcatagtactctggctgtggtggttgatcaggttttggcggcatgtcaggattgggtcttggcggttggtcaggctttgatggcccattaggattaggttgtggcggctggtcaggtttcggtggcccattaggattgggctgtggaggctggtcaggtttcggtggcccatcagggcaaggttggggtggttggtctggctttggtggcatatcgggattgggctgcggtggctggtcaggctttatcggcccattaggtataggttgtggtggttggttagggattgatggcccatttggattgggttgtgttgattggtccggcaccgaaggcgcataagaattgggtgacccatcaggtttaggcattggaagcatatcaggcttcggtggcccattaggaatgggttgtggtggttggtcaggctttggtggaacattaggattaggcagtggtggcccatcagatataggttgaggtggctggtcaggtcttgatggctcataagtattgggcaacccatcaggtttaggcatcggtggcatatcaggctttggcggcccattaggattgggttgtggtggttgattaggatttggcaatggtggcccatcaggtttaggttgtggtggctgatcaggacatggttgtaccgggggaatgggtggcccatcgggtttaggcatcggtggcacatcgggcttattcatcggtggcacatcaggattgggcagtggtggaacaccgggtgtgggctgcaggggaggctgatttggatttggcacaacatcaggtgttggcagcagcggtggcggctgatcaggctttgggtaatcgtagggtggccaagccgcttcctgcaggattctcgccgcatcaccggtgagcagcagggcagcagcaagcagcaataagagcagtgacgaagtggacatggctatcttgcgagcagccatggctagctagctagctcgcaagctaactatgctaagctcaggaagaagaagatgtgtttgagctggatcggtgatgagaagccgatgctggcgaggtgtatttatagcctcgcggcggccagaatggtagctatcgctggcaatgcatgcactgtgggtgcacggttgggcgtcgcgtggaggcaagctcagctgcgtgttcgtgtcactcacactcgttatttactcctcgctgcatgtacaccgtccggttatgtacctgccaccgtgtgattgcatgggtttttggttgggttgttggaaaagctatcaagcgagagatatatcgtggagccgtacgtatgaataggtgtgcacacgagatcatccactgtatggattattggagcccagtgccccagtatatgttactgtacgtcgacgagatttaccgtgagatcgagcaaccaaatggccggagacgagatcgatgcatgcgtgcgtgcttcttctccgatgcgtgcagcgctaggcctccgcgtgcagacgagatcgtcgtcggcgccgtggccgaggtcgtggtgatcgtgaggccgttgggctgaatatgggctggatgagaaaataaagggaaaagtacacgcaaggtccctcaacttgtcagcgaggtacaaaatcgtccccgaaccgcaaaaccggacatccagcgtcccccaacttacaaaaccggtcacaaaaggtccctcggcggttttgaccccggttttgtcccacgtggcggctgactcagcgtgggacccacgtgggccccacaggtcatggagaccacgtcagcaccctctctctttttctcctctctctctctctccttccttcctctcgctctctgctctcg

SEQ ID NO: 38826 - DNA, 13478 bp, Oryza sativa
gtataatatttctgtaaatattaaaaaataaaaatttaaaactgaaaaaaaatcctttgcctccttgccacgaaaatgcaactaactacagcaccgtatggtagtactccgtagtacgatggttgagcacttccttcctccatcccacagagctggtcgttctgctgttcaaaatttgttccgtaaaatttgtcatcctagcatcgatcttgaccagcgaactgggcatcaagtcaattccatttgaatttggctaatgattactctttctctgtacaacagtgccactacttaccatgtgatagataatagtattagtagtcattaattaattacgtacagtaaatttgttttgcaatctaaattgacaaatgcaactattaaatgaaggtaatatgatcatttttatttgatgttaatttgttggatcaaccttaaaacgacgggctttctgggacaaaaggagtaatactttcgatgttattagccgtttgcatttaccattttctccctatggtgataaataagattctgtcaaacttttaaaatttagatatcaattttatattaacaataagtttactagtattatgatggtattttcaatataaatatacacatgctatttattttttaaaactaaataaaactagtgattgttaaaattttaaaagttcaactcattttttttaggaacgggcatgacctctgccatttcatttatagaagaagataaaaacagtagatcacctcatttaatagaagaaactcatctgaacgtattaaatactccttttgtaaaaaaaacaaaaaaaaaacaacctcgtactccctctataaaaaaacaaggttgtcatttttgggacggatgaaatatttagtagtacgacggtaggaagtaacattctttttatggaaagttcagtgttgtagggaatgaaacgctggcaaaaattgcacactgctctggacaaccagatattcataatcataaatccatttattaacacacaacgactcaaaacaacgacatcgatcgaactcgcacacccagttacactcacatccatgctgaaaattaactatccacaagatcgagcccgcatgctcaccggcaacagttcaaatataccctctactcgatctacttcacaccggattaattaattgcacgtaattaatcgtgatcgatcatggcttggcctctggctcggccgggaagtggaactcggggacgccggggaactccggcttgggcggcaggtcgacctccgggaacggcggaaggtgagcctccgggaagaacggaggcagctccaccaccttgggcagcggcggcagctcgtgctccggcaccggcagctccgggaagacggcggccgggtggttcggctcctcctgatcttcctcctcggccggagccgtcgtcgacgacggctcctcctcctccagcctcctcgccgccgcgccgctcgcggcggcgcacgccagcagcgccgcgagcaggagggagatggcgatcttggaagccatgtcgttatttgcacgcactgatcagtactgttcactgatcagtttgcctctatttctgtcctgagatgttttgcaatgtgaattgacaaatgcgtggtgtaattaatttataggccgcggaaagcgcaaacacacgcgcgttgatggagtagtggttgatctgcaagtgttcttacttaaattcttagtagtggttggtttctgtgtgtttttgtctatgatttggttgagaaagaagctagtcgggttggcgagagcgccgcgcagatcctgtgtacaagggacaggtacgagaacgtatgcaatgctttgttggtcaccgccacaccggttaattagcaggaaacaagaacgtctaagcagggaagtagagtgccaacaaccggtggtcgagcagcattgttcgttctatcactgttaaataaaaaaatttccactctaggcagggtcgcaaggccgatgatagccgatcggttttcacggttttcgatgttttgatgtggcttgaaattatttttgggttggaatattcaatattacatattgatctatcttgtcaatttttttgaaaatttttcgtaaccatctagttgacatgcaataaacgggtggacgtccactcgagctattagaatacatctctgtggtcgaacaacattgttcgttctatcactattaaataaaaaaaattctctgggggcggagctccaaaccccaccgtgcgcgcggcatcatgctagatactagtaacaggcagggttcacagagcagatgacagccgatcggttttcgtggtttttccatgtttcaacgtggctcgaaattaatactccctctatccagaaatataggggactttgtttcattagtttgtccataaatacagtggatttctctttttcaagacaaccaaggaatgtcagccatccaaaatcaaccggtttctgtcaggattaaaaagataaagaaaacgtactagcactactactccacactgttcttggcagaaactaaaaataatttcagaaaacgtactggtactactaatttgtttattgtgcctaggatatcttttcagagaatgtactacttactcttccttaaaattttgttattttaggcataataccttatattccgggacggagagagtatttggttggacttttcaatgttttatgataaatttaagggaaaattggaaccatgccattataattttgcaaaatttaatgttttatgataaattttgatcaaatttaaatgtcaagcattaaatttgatcaaaattcggtcaggatttatcgaaagtgtccttatcaattttgaggcatagcgatctgtaaggtaattttgattttttcctttttcattttttttccctcgtcatactcccgtcggccgtcgtacacgtaccaatgtacgatacatatcgtatgaatcttggtatacgtacgtccgagccgtacgatttgtgtccgaccgagtcatgcaaccaatcactgaacttgtttactaccatgtgggcccagacaaacagcatatatgcttatacatacactagtcggacgtataggtcggacgtatagcaatttcgatatcgtacggagtattctacatgcaccaccacgtgtggcaccattctacgggggtggctaattggcgtgcacacgctggcaccccctcccccgcgtgattttttttcactttctttttttatgctttcattttgcttttttttttatttttttaaatctttgttttcaaatgtttgagttaaaagttttaaaatcttgatttgaaagtttttaaatcttaacttaaaaattttcaaatttagacttaaaagttttcaatctcgagttaaaatttctcaaatatgagttaaaagtttttaaatctgtgttaaaagtttttaaaatttaacttcaaagtttaaatcttaaagtcaaaattttataaaactaatttgaaagttttcaatcggttagtaaaaataatcttccagaaaaaaatattatcttaactattgtcgttatataaaactaatttagttagttaggctaaactactcccgaggtggtgcgcgccgggtagctaaatgggtgccacctatttactcaccaatcttaaagcatggacaaactgtaaagtaattttgaattttatttctcatcgtattcccgtcgtatttctgtggtacacgtacgatgcgtattgacggtattgtattctgccgcatccagagcctcgttccctcccctccagtccaggcctccactacacatcctcgaactcccctcttcgccgtcgctcccctcagcgtcgccgccgtcctctgcccgtgtgccgccgccgccttcatcctcatccgccttcacgccgccgccgccgccgtccgtgttcccacaccgctccggtattcctcctcgcctctgagcgtcgtctgcccaatctctggagtcgacaagattggtggtggcaaccgctccgtctcaccgccgtcggccgtcctccgccaccctcccgctgcctctcgtcggtccaccactacgtctaggcgatttccgcctcgatcttgctcgcccgtaaggtgttcgatgaaatgccgccgtcggggctttttcctcgtcgagcccttgccgagggagccggagcgctgggcaggtcactccctcttgtcggcggtggttcatggacgagactggtacatggcggcggcggggggtctgaggcggaaggcgaggagttcccgtacgccgacgtgccgcggcctgggaggaagtgggagcggaagccgtacgtgacgccgatgaaggtcctcatccggcgggccaaggaggagcggcgcgcgcggcgggagaacccgtgccgcgtgctggagcgcccgccggagaacggcctcctcgtgccgggcctcgtcggcgtcgcgcaccaggtgcacggcgcgtgggagagcctcctccgcgggctcaccaggctcgtcgagggcggcgccgtcgccgtgaggcggtgcaggttctgcccggaggtgcacgtcggcggcgtcgggcacgagatccggacgtgcgagggccccggcagcgcggcgaggaacgcgctgcacgtgtggcggccaggcacggcgcgggacgtcgtcggcttcccctactgctaccacctgttcgaccgcgtcggcaagcccagggtgtcgcacaaggagaagtacgacgtcccgaggctcccggcgatcctcgagctctgcatccaggccggcgtcgacgtcgaacgctacccggccaagcggcgcacacgcccggtatactccatcgaagggagaatcgtggactttgagccagacgacgacgaagatgacagcgccgacgacacaggcccatcgctgccttctcttgccgccgatgaagccggcaagatggaggaggagatgacggtgtgcgagctgggtgcacggacgctgcagtcgtggctggacatgcgcgccggcgcggcgaggctgatgggcaagtacggcgtggtgacgtgcggctactgcccggaggtgcaggtcgggccgaaggggcacaaggtgcggatgtgcaaggccagcaagcaccagcagcgggacgggcagcacgcgtggcaggaggccaccgtcgacgacctggtccggcccaactacgtctggcacgtccccgccaccggccatggtggcgacggcggcgccccgccgctcgccaacgagctgaagagatactacggcaaggcccccgccgtggtggagctctgcgtgcgcgccggcgcgcccgtgcccgcgcagtacaggagcatgatgcggctcgacgtcgtgccacccgcccgcgacgagcacgacctcgtcgcctagagcacgccgcccgtggcgcgccgcacggggttcgacacgagatgggatcatgggaatggctcctcgcctggcaatggctcctaccacttactacatatatacatctatatacattgtgaatgttgcaatagttaaaatccacaaatgtgggttccatctatatggattactttagctatatacattggtgttgcccttgcaacctgaggagatcatattcactgcaacagcagaaaaggacgcattcttcttgcgaattgcaataagatgagaggggatggaaggaagaaacttgtgggctgttgtacttgtgcccacatttctccaagtcaattattcgagttactgcggagtggagaaacattctgaatgatgcatatcgttgttgctgctgcttcagaattggacaaacataaatgaagaagtttatggcaactttgattgagaatgaagagattcgatcagatgaggttttcttgttctaccacagtggatcttgacatcgacctgaaagtcatggcaattttgattgaggaggagcaaatttgatcagatgagttcctttctctccctcttttgttaccacggattaacatttaaaactacgacattgctttctcaagtaccataaaatcacacttattcccaagtgcatttccagcagcccgagcacagtgaaccctggaatggtgaccaccagttgctcctttgcttcctttggaggagacactcgcgggcgctgctagcacgacggagatggccatcttgttggaaggcatatataatccagctgaagagatttcgagctcgagttttggacgtgtgagaaaagggagatgagcagtgcaacttgtatacgccacagaatacgacgtccttgatctgcaagtgttcttaattggtggtttctatactttatatggtttttgcctatgatttcagctatagcaccgttggtttctgtggtttttgtccatgattttccgcgagaacaccgtgcgtatccagtgcactatgttcagaaagtaagcgacagagcctgtgcagaagggacaagtatgagaacgtatatgcactcctatgagaacgtattcaaggagtgcatattggcgcaacaatctccgccgccgcagatgctttgctgaggagttatttttgttgcaactcctagtttctagtagcttggctaataacctgtaattgtacactaatacaaggcagggatcatcattgctttgctattctcttcgccaaaatcgtacggatacgcactctcaatgtttcatttctacaccgttaagcattcagtttattcaagtaacactagtacgacaacctagcagtaaccttcactataaaagcttcaactatctaaaagaccccaaacaataatttagaatatatgattttctgaggtaattccacgaaataaacaaacaagagtgataaacaaacaagagtgataggtttcatcagaaatgtggtgctttcccttaaatcatcttccttgtgcataagcagaccccatctgataaattatgtgatgtattgaatctgccaaacgattacacattgttccctaccaaaattggcacagcttccttttgcaggtatctttccatacataacattctgttcaattctgaacagcagttagatactagatcctggatatcaaatcaggatatttttcaatcaattgagatgaaaaatgtttaaacctggtcaaaaacgagggaacatcatcacactatttcaatccctgaagctatacacagcttggaatcagctcccccactgatgacgctatcccctttccaccagtccgcacataaaacctataatcaccaaaatttaggacctcgccttttgttcaaacatgtaaaaataaataccacaaaaggaataccttgtctttgtgtgactccacagaagccagtggccactgcaacagaacagaaccattaatggtctatggcattttgataaaataacttgaagagaaaagagtaatcaggaaggaaatatattattagaatcttactgctgtccttagatcccacaacattactttcccatcaaatgaagatgataccaaatgaaaccacgaacttggatgccatttgcaagcactgatccagcttttatgggaggaaaactgaaaaattggagctagagttcctgtttgaggataaagagtattagctaatttgaattccaaaagataattagagcatggttttgcttccacatttaccaggtttacgagggtcccataccctcaagacagggtcagagccaccagcagcgattagtgaagagctctcaccaccacaatccaagcaattcaaggccttcccagatacctatggaaaatatttacagacatcggatgaattaatttgtgaaacagagcaagagagtagcaaaagctttgactctccttggcaacagcacttttttggacagtgtgcagtagttaaaacatagctagtgcctttctaattcaaagtgccagattccacgaagcaaatttcagaggaactcaggacaagaaatgtgcagatgccaattgatgacttaatgagcacaaaaaaaaaatcccttgctgctattatgctggcagaacattatcatcacgctgtccatgcattttaatacttttatttttaaatgtgtagatattttttgcataccatattccatgtctctttccctgtttggacatcccactgccgaacagaatggtcccaagatgctgaatatattgtttgtcgctcaggccaggtaacagcagaaacgcactgcgtatgtcccagaaatgttgaagtggcagaaccctgaagtgcaacattccaaactgagatcagcagggttgtatcatgagttcatgacaataaatagtataaaacttcacaataaaagaattgccagaattaaatctcccccaaattttagcaggtgcatattaaaaattatcaaagcactggaaattcaaaatcaatacccagcacattataaagccaaataactggagccaattaaccaagagatgaacatattttagtacttcacatgatggcaccatgcacataagaccaaagaatttggactggaaagtaaaatgacctcaaacagagattcttcaggtccagatgaatcagaatttgtccttctcttcttcactgagacagtgtcaccatcttcttccgacccttcgactgaccatagcttaattgagttatcccaggaaccagaacatatctagttacgaaaaaaaatacgttaaaagggccttagaataaaatactaacatatagcactgatttggaagaccagaaggataattaccatgtttgtggaagggtctactgcaacactctgaacagatgatgtgtggccacggagaattttgtaagccccaatttgctttggaacactgactgatgtatcaaacttgagatccaggagtggagaataaatgttaagattggatgaagaatattactcatgaagcatgtcttggagggaaaggcaaaatagagtatcttactatctttaccttgaataagcgcaatgacctatcctttgatgcagtgactacatgcagcctgtcttcagtttcacctggaataacattattggaattagtagatatttaatatactgatgttatatactgtttggggaaaacaattagtataagggcatgagtgagcaaatatgttgtgtgcaagataacctttattaatgaagcgagcagaagtgattccgtcactatgtccttccaaaatatgtgtacattcagatgcatctctccatattctgggcaagaaaaagcaaatcagaaggttgagattgaagacatacaacagttggagttggtgttacagtcattttgtctaaaggggtagaattaaaaataataatagcatagacatgggagatgaataccttgcaagaccatcatagcaacctgttaatacgaaactgccaaaagacgaatagtttagtgatactggaaaccaagcgaaagaaaaatatgagaaaaggttaagaaagaacagtacatttgaattatcagcctatgatctattgtatacatatgtaaatgtattagttgcataatagtaatggtgataagtatggaaccacaaggaagacaattttgcgaagatctttagttgggctagcggtaaaattatgtggtagaataagagcagtatgagattaggatccaaatttagatgtagtattgagctcatacatggacttgttttgaatgcatccttcattttgtcttcttaagataggtaaactgtgcactagtcgagataggtgaactgtgcactagtcgattttagcttagccctgggatgggcaaatctttggctccacagtccattttagttgagttaagaaattttccgcagaatttgaaaatattgatcagcaaggtggactagatctaaaatcatttgaccacaagagcaatgttgctgataaaccttcttgtaataagtgaagacaatagtgacaaaatcagcaatccaggtatagttttgaattatctaaaagattaataacctgttatcatgatgctagacaaacatttgtgtcctgctatttgctcgaagcatgtcctatggaaaaatagaccacctaagtccacgtaaaacagaaaccatacctcgggttcgatccatcaactgcgctaacccagtcatcatgcgggcatggatcctcctgcttcctcggtgccacagcttttacatattcaagctcaagcaccctctcctgcaaaaacgctcacacgataaccccgcacaatgtcacagaaaggtccacaccacagcacagcggaattctcccccaaaaaacgaacatcgggtcaaaaattcataccactgagatgcccttggcgaggaggaactcctggagcgggagccgcacgagctcgccgtcgacgaggaagtcgaagggctgcgcctggtgatccggggaggctgcccaaaccggaggaagcgagtcagagagatccgaggtccatccgaggggacgcggggggctagggttctggaaaggggaggtgctcaccggcgaggaggaggctgttgacgatctcagagaggcccatgcgggtgaggtcggcggggacggcgatggaggtgggcggcgcgcgcagcggcgcggggagcttcgtcaggaagcgcacccgcacctggcgcgaggggtcggaggcgccgccggagtccatggcggcggcggcggcgtcggccggcggagaggaggcggaggaggcggcggcggcgggaaggggagggaggggttttgagagggtttcgaatggggaatttatttggttagggttttggaggatgtagggcccagtagcagtgacatcacgttcgaggcaggcggccagaaggggagaagaagatgtccattttgcagaaaacccctccaactatgtgtatgttcaaattggtaccaaaataaatcttaccaaaatttagcaatatcaaaattttggtaaattgacaatattgttaaaattttggtaggattttcttaataatgtcgtcaaaattctgtacacattgtcaatattggtaacaaactaaatgtagccatataattattaattttaccaaataatggtatagttgaaaatgtcatcaatttgaataggccctatattctgacagtgtttatgtgtatgaaccacctcaactgttaattcaaatattcaatcgcattactccatttttcataatttgcactatagaagtacccatatatctcatgattggaaatttagggataccaattgatacaaggttaatttgcaaaattcaatcgtcgtttattggaaatttagggataccaattgatacaaggttaatttgcaaaattcaatcgtcgtttattttgcaaattctaaatgccttcaacggcaactttagataaagatttaacctattataatctctagaacaaagtcaaatttatagagaggggcacttttacactggaaaaagtccacttccttcaaccatgggttgaatttcatttacgtcccttaaccgtaaaattgaatatgaaacatcccaacatcataatcaatgtaaatcgagtctctcgattatattaagggtacttttggctgacgtgaagactacatgtcttattaacttgatctctgtcctacatgacgcctactagcgtttacatgatgctagaataaaaaacaccgatggaacccacacgttagtggtaatttagctacttttttggaacaagtatgtggggatttggttaaaatttttggaacaaatatgtgaggccacatgtcaatgggtgtccggtgaaaaaaatgcaatggatccacgtgtcatcacccctctctctcctcttctcttcctcaatattctatctccccaatcttctcattggtagccctagctgtcagccaagcaacgtgctcgtcgtcaatactggcggtgagggtggtcgcggcctttgtagtgtgtggacaacgattcccgcatggccttggtgtgcacatcctgagctccagatctagacgacgactgatgtattttgttggaagaggcagggagtgctcagtggcaacccagcgtcctcttcgacaatgtacaagtcaccaaccgaaggggtgattaggacccacctctagcatctccgtgccaagtttgcgaattgcgaccactggcaccgattgacgatgggaggagctcaacagggaagagagggcctttttatctttgtgattgacatgtgggtccaacaaattctattaatatttaaggtataattatcacttgcatgcagacaacatatggcgccaacgttgcctaaaaaccaggtcaatgtgtcactacgtcccatatcagccgaaaacgctgtcaatattgtcgagagatttgaattgcactggttttgaaagctatgatgctctgttccagagtttctggtcgaggtatgcgaatcaaactcgaccaatactgaagaacgcagaatggacctttttagcttttcccacgctacctattctagcccaagttagcccacagatatcatatatcatataggaaaaagtacgaattacctccctgaacaattgcggtcgtccaatttaccaccctaaacttcaataccagttattttttaccctaaactttgtaaaccggatgaattacccccctagatcgattcatagcgggtttggtcctacgtggacgcatacgtggcagtctagtcagccaaaacagataaaaaaatatgggacccacctgtcagcccaatccctcttcttctctccttctcttcaccccttcccctctctctctcactccatggcgcaccgaggcaggcgacaaaataggcagcggtggcggcgaaagaggccgcggcagcagcagcggcggtggcaacggaataggcagaataggcggcggtgagcccacttgtcgtgtcggcgcagcggccgaaccaaatcaagaacgtcgtgtcggcgcggcggcgcgggagcgggggcgggggcaggggggagcggcggcgagcgcatgctgccggccgcgccgcggttggcttcccgcctcgccggcgtgctgtcgcggtcgtcgtcagggcccaggccgaggcgacgtcgtcgtcgttcgatcgatcgatctgcagcggaggtggagccgacaaaggaggagacagccatgtcgtcgaccccgacgggcggcggcgcgggcggtcggcttgcgagggccggtgacgggcagcggcgcgggtggtcggcacgcaagagtcagcaacgggcggcgtcgaggtgctcggcgacgaaatcctccgcgagatactcctccccctccctttccccaccgcgctggtgagcgccacgcccgcgacgccggcttcctcttcgtcgtcctgggtcgcacgccgccagtcttcctctccgccgcctccgcctccggccttgttcctcccgacggcggctgagcctccgccgagtgggagctcgtggactgccgcgactatctcctcctgttccgcaaccacggcgacg

SEQ ID NO: 38827 - DNA, 9778 bp, Oryza sativa
atcgccatccgcccgcccccgggccgccgcccaccacccgcccccgcgccgccgccaaccgcccgcccccgcgtcgtcgccccaggcggcggcggctggatttggggaaccggctcacctctacctccgcccccagcctcgcgagcgagctccgccgccctccaccgctgaccgcccgtgtccgtgtgcgcgcacgagagagagagcaggggatctggaagaggttgggtcgaagaggggatgacaggtgggcccagtgttttttatgttttttttttgctgagtagtctgccacattggcgccacgtgtgctagtactaagtcaaaaccgctcataacagtgttaggggggtaatttgtccggtattgaaagttcagggtgagtaatatctggttttcgggttcagggggaaattcggccgaccgcgatagttcaggggggtaattcgtactttttcctatcatatatccatatgctgggccggcatccggcccaggctaactgcctaactaggatttcagtactgccgctactaatactacactgaagagcacagtatagctagtgaaccaaagtaccaccaaacatggccccccatattaacagcaactggtctaacgaataatgagcagcaaatttcggttacggttccttgtgaggtacatacacggttgaagtcacaagggcccgaccatgtggcgctcgttctcttagcttagcttgatgcaatgatgtttgagttacaacatgtcaaagtgccaccatgtcgatccggcctctgcatcagctagagaatgtacacatgttgagaactatgagagggagtggtacacttctcgccctatttcttccttaaaaatggcacgaatatataccaatatgcatatgcatgatgcgcacactcgttcaattactttcttacttcctccgtttcacaatataagtcattctagcatttcccacatttatattgttgttaatgaatctaaatagatatatatgtctagattcattaatatcaatatgaatatgggaaatattagaatgacttacattgtgaaacggagggagtacatattaatcagatcttaccaaagaatattgatataattttacttagacatgcttctttccgggacgtgatttagcgagcacacgtgagtttcaccgataaggagaccacatgttgtcaatgataaaggtggtggtggcaccgctactatcttctaaagcagtatatccgaaagtgtttttcatgacaaatctagctatattatttttcttatgttaaattatagtattttttaattagttaataattaatggttgtaaggtttgattgcacctattctacaacgatatccaatcgagaacagaggaaggtacatggctggtgcagaaaagactcaaaatagaaggagaaagcaaagattctgatgagttctacacttgtctgctactgtcctacctaacgttttttttgacccttgtcagtggcatctaagattttggccgttgttattgataagattttagccgttttacccctggtcctcccccaaacctccggtagtacatctcgttaacctaaaagaagcaaaggcagcagatcaaatggcgattactttaagcagcacacactccatcactgctgtttgcacgaccgatcagtgtcattccccaagttcaagctctgccataaactgaaccctgcacgaacctactaacaaattatatttaaacagcattggcacttgacaatagactatatacttctatataaaaaaaattgtcccagttaggacagtggcgacatcttctcttgcgatctcccttttgatattcgatcggcgacgagcccatggagatcgagtaggcgccaaagattcgaaagctggaaagatgagaaatgcaggataaaaatagagggggaaggggcagcccggctggaccgtggaacatgcgcgagagcggctgcggtgccacagctgcaatgattcgggagtccactcgcaacagcagcagcagcatatattccatgagcaccagcggcagcagctagccgcaccaaccaatcgacggaggaatctggcgtacgtcgggtcactcaaaagcggacgagcagatcgcgccccgccgcggcggcggcggcggcctcgtcgtcatcaccgtttccggccgggtccaaagcgggcggcgccgcgagctctcgcgaagttgcccgtacgtcgggtgatgcgtcgctagcttgctcgtgcgtgcgtgcagggcggttgcgtcgcgtctgggcgtgttgctgttgtcaagtgtcaaccagcttatttcgtggtcctgatatattacttagtgttgtattggttggctttggacaaccaaaataatttggatagggattctatgtttttattttcaagggtctaaaagagaactagaaaacaataaaaaaaaacacctagaaccacttagaaaattaaattttccggtggcttataagggtctccagatgcaagaagcacccaaacaatccagatttttacccagactcgaaaatgctgggtaggtgtaaaatctagaaaataaactagaagcaagaagctgagtagcttcttcgcattaacatcatacttacatgtctagttcgaacctcaatgttcgaaactcttttcctcagcaaaaagaaaaaaatgatgtatattagcacataattaacctgatccatgtctagttcgaacctcaaggtttaaactctcttcctcaacaagaaaaatgatatagaatagcttattagcataataattaattaagtattagctaaaacaaacttaatgaataaattaatattttttttctcaagcaattttcttatagatttattttgtaaaatatatctttagtagtttgaaaaatcgtgcacatgaaaaaggagagtaaaaggccgttttggaaccgatctctctggcatggacaacggagcctctcgttaacgcatgataattaagtatcaactaaaaaattgaaaaataagttaatatatttttttacatttttttaaaaaagtacgtcattaagtatttcggtaaacgtgcgtgtgaaaaaaatagagagtaaaagataagaaattatagtgtatataatacagcctaaacgactgaacataccatctcattttatttacaagaattttagtcacggagtaaacaacagcatgaactctcctctattttcttccttttcctttttggagacgaacacttgttttgatatttttggtatttacgagtactgactgcggcaggatgtttttagcatgagaaaagtggtttggtcggatctgtcagcagctggggtaaatgcggttattgcaaaggggaccaaagcgtggagcggagtggaaggagtggcatgcttggctctggcgtcgtgggccctaccatcacaccaaccgaaaataatgtaacccggcttgcagcatcgtcttgaaatggaactgttttggaattgtttttgcatcgttgtcaatagaaaaccatgctgaaatttgatactagcagatttttcaacagaaatctgctaaacaaaattattacagagaatgctagtagacactatgtacaaaaattgtgaaatatacagaaaaaaacaggtgctactagaaatttgtgaagttagcttatggcctgtttggcacaactctagctccacccctcatagagctggagctcagccaaatagtttcagctccaccaaaactgggagtagagctgggtggagctctctcacaaaatgagctagagttgtggagttgggttaggcaactccacaactccactccagacccaactcctagagctaaatttaggagttggagctgtaccaaacaggcccttagtgctatattggttggcttcgactgttaattagtagtggaaaaataagcagtgaaatgagaaaaaattttaaggtatgaatatgtttcttagcgatttaaaagccaaaattaaaaatagaagtaaaaaaaatataaaaacacatagagagtttaaaatttaaattttgaccgcgacattaccaagaacaaacaaacaatcagggctcctttgatttataggattggcaaatgattttcataggatttaaattcctatggtttttttcctatatgttcttttgattcatatgaaagaaaggaaatttttcataggattgtatttctatgcttcacattttataggaaaaatagtaagatgtgtgacctctttgtgagaaattttctataggattatatttctatgcttcacatttcataggaaaaatagtaagacgtgtaacctttttgtgaactttcttttatttttcccatagcataagaaacatactactacttcaatttctgctttttctctatttctatatttttcctatcctgcagatcaaaggatcacaaggtgttattttgtccgtagctgcacatgaaactatagctacgtttgaatggttttgcactaaaaaaaaatcattgcaacagttttttattagtcccaaaagccaagcattccccgcaaaaaaaaaaaaaaaagccaagcattaacctcacgaaaataggctggcgtttcgcggtgggcaggagaacgaacagagaaacacaggaggccaaaactgcaaattgcagcaaagcaaaaaggtagcggtgggtgcggctcagtctcccaggggtcgcaaccgtagatgcgcaaagaagaagaagaagaaaaaaaaggttaaaaattccgtaggcgcccgtggcgcagatcaaactcgcacgcgcacccgacgcatcatacacacacactgtctctctcactcactctgcatctgctgctgctgctgccactgccactcttgtccagaggccaccacacactctctctctctctcactcactcactctcctctactagctcgtctccatctcttctactcgtccaggcctccaagaatctctctgttcttgctgcttgcttggtggtggtggtagctttcataatggaggcggtggtggtggcggcgctggtgcttctcatgtcgtccagtctcgtcgcttcaggtgagcgagcttaagctcagctctccccgggggagggtctttttctaacctttctctttccgtctcgtttagatttctgtcctgagtgagtttgtgcctcttaaataatggctgggaactgcaaaggctgctgctttttgtttctgaaggttgattttgttggagttttggggggatttgttcaggtgttgttctattctacacttctacttgtcggtggttctttttctttttttgttctttgatgtttctcagtttctgcttggttcatccattggtatgtttggaacttggaagaagagatctttctgtttggttcttccattttctaggaaagatcagcattgcatgtaggagtacacgctacttttgttatggtttgtgaactactttttttttttcagattcccctttcctaccttgctatgtcaaacagtactagccatgtactgcttagctcttgctgttcatctattgctgaagaaaataactcaacaaggaccaaggacaagaaatctcttgttctcccctctgagacagttggagatgtgttcttctcaagttgatttattttttttacatttttactttctaaaacaagcaaaaccgttactacgccgattttctcctagttttctgctctttctgcgcagacgctactctctcttcttgattgctttcgtcacattccgcatcccatctcttcatcaagaaactggcataaaaactgccgccttttaatgaaacgcacgagttaattaatctctctcattgaatctcttctttttttttgtgtgtgtggtgtttcttggcgaatgcagattggtgcgtgtgcaggtcggatcagccacaggcggcgctgcagaagaccatcgactacgcgtgcggcgcgggcgcggactgcaactccatccacgagcaggggcagtgcttcaaccccaacaccgtggtggcgcactgctcctgggccgccaacagctacttccagaggaacagggccatgggcgccacctgcgacttcaccggcaccgccaccctcaccaccagcgacccaagtaaaaaatgattcaccacccaagtcacttcaattcttgttttttttttttcacgaatgcgcaaaaggattgcacgtcaatatattacttcctccgtttcacaatataagtcattctattatttcccatattcatattgatgttaatgaatctagatagatatatatgtctagattcattagcatcaatatgaatatggaaaatgctagaatgacttacattgtgaaacagagggagtagtagtcacttcaattccttcccagcatttctgtccactgtctactgcttgattaaatttgcgctcgcgtttcgggttcaagaacgcgtttgagtactggctgtcataatgtcattgagcgcttgcaagtttttgcggcaagtgtttctgccttgcacgattagaaatgtttggatggtgatgagtgggagtggtgactagcaatgtgaaggacgagctgtacagatgatggaattaagatttgtcgtgcgttggggcaatgcaagcatggcgtaatgggacgtgctttaattcaaccgtaaagtatgttgaagttttttttagcttgtttgcttgtgtcaccttatctcaattataaggtctctcagtctgatatgttggctagcatttgagcttgtggtcagttaggacaaacgaaaaggaaaaggagatgtcggtgacatctttttgatagctggcatggaagttcatctgagtgtgggatgatatccattctatgtatttttgttattttcttcattggttagagacatatctattcctcacacaatctcatattatctttggttgcaggtgtttctggctgctccttccctgctagtgcaaggtacattattaacttcactttaactgactgagttttattaagtatcactaaggatgattgacgtttcaaagtggtaaccaccaatgaaacttttgcattgtgtttgagcagaaggttcttttgaacacactatctgcctccattatatagtacatgttcactctgaactgcaatactaagacctatgaactgaatgtagccatctgttcaatgaactgaatgtgttacaacttccttatctcttttgtttgcttgtcaaagtcgtatatgctttgttattgaaaaataccaaagagtcaataagtaagtatacatcaccattaagaaccaagtccatctgttatttaaagctagtcttgtacctcatcctcaactactcatccataccaaaatgcacacctatgcctttccggcctgcatttgtgatgtacacatgactcctgaatgatctatagttgatgcaagtatcattgaaggattcctatagtatggtgtgccatatatctgaaggcaactgagatgctttgcaagttgaaacacgcaagactcttctggatttcgttgattgtaatatcctaacaacatttccatactcatgtgcagtggtgctggaacatcaaccactccgaccatgggaggcacaactggaacaatgaccccaggaaccttcacacctggaactggtatgggcacaaccaccggcaccggcatgggaacagggactactaccggcaccgggctgggcgggctagggccaacaggcacaagcagcatggacaccgcggcagcgggattgcacctaagagccgggctagccaccttctgcaccgtgctcctctcgttcgttgcgatcgcatgagggttgcacccttgaagcaacactcattttcgctgattgaaagaacccgatttcggtggttgcaggagcaatgtgatctgtgaaaagaaaaaaaaatgaacagaaaccctgatcctttctgaagatgtcatcccatccgaaaacccactattgcctgccaattcttgtttggtgtcgatgggtgtttgtgtggggtgagtttctgtactcccttttcttatgtcgtgtactctgtaatttggtagtaggatgtctgtctctttcatgcaaggactcccactatttctttttctttttcccatctttattatcttgtaaatctagggaaaaccagtaggtaggctcaaggttggttggaatgagaaggttgttgttgggacaatgccatcttaaggctgttatcaacttatcatcaagttgctcatccctgaagatggttgtggctcacatccttttgcccttcagtatctctgaaaaccgcaaaaaatgagagtgaaaatgtgagaggcagaattgaacatgtggtactagtatagtaggaataagccccctttgattcaaaggaaattcataggaattctaaaggattttattcctataggaattttttctatatagccctttgaatcaaaggaatgaatcctatagaatcatgtgaaattcctatggaatgcctaatgccatgcaagttttgtaggaaatctagcatgaggttttacctcatggaaactttcctacgagtcttcatctctcctttaattcctgcgtttttcctgcggtccaatcaaacggctattcctgtgttttgcaatactctcgtttgcacttgcatttctgccagaattctatattttttcctattcctccgtttttccattcctacgattcgaaggggccctcagattgtgcagatgtggctcctgcagagtgacattttagccctttagctgttaggtaacgtggcgcatcagtgctgctactctgcatcgctgaaaccgtcgtccgtttcttgcgcccatgtgggggttccatcgcggcgtcgggcgtcttgttgttgcgtagcgcatcgagacagattctcggttgatacttgaaaaaaatattgtgaaacatgcacctgcagctctctgatgaccaatcagtgtgttggtacgaagctagtacaggacacaggcatgcatacagctaagctaagccaaggctgtgtttagttcagcgtaaagtttggattttaattaaaattagagatgatgtgactgaaaatttatatatgtatgacaggttgatgtgatggaaaagcactgaagtttgaatccaaactttaaatctaaacacagcccaaagccaaagctgccaatgatgatggagcaagagcaagagcaagtgaggaacttgatgaatgatgatggtgtcaccactgtcactcacgcgggcctggtgatcggcgcaggcaagccgagtttaatggaggcagtaatggccgcgcagaagcagggtggatgatgcaggcaggcggcagcgagaggggtggggctcgactggaatcatggctgtctagcgcgcgcggcgcatcaggcgagaggaatcagggggggttcggggggtgacacggcccagttaaccttcgggcccacgttggacagaacagattggatggaaaaagtacaccgaaggtccctcaacttgtcatcgagttacaaaatcatccttcaaccgtaaaaccagatatatgatattatgaaaaccgttctttttgcccagctcgctaccttactccgctcggcctacctctcttcggtccagtccacaagtggacccgcagggcccagctcgtatatccaattgccatctacatccttcggaagacagcccctatgataccggagccgatccttccattaaatccggtcgaatctttctcgatctcccaaaatt

SEQ ID NO: 38828 - DNA, 9071 bp, Oryza sativa
ccccgctcgcccctcccaccacgtgcgcacctgttgggcccacctacttctccccccctttttccacaaaagatgtttcacctagtgtacttataatgtttcactatttatagatctaatgttgcggtgaattaaaatattcttttgtaacaaaaacccacatattttggaagctctctattaagagaatttggtttattttttgtttcacctagtgtactcacagtgtttcactatatatagatctaatgttgcagtgaacgaaacattccattgcaacaaaaaacccacatattttggaaaccccctattaagggaatttggtttatttttttgttccaccgaaaaatgttttacctaatgtactcacaatgtttcactatgtatagatctaatgttgcagtgaactgaaacattctttcgctatttgctgaaacattgtttttatataaggtgaaacaacactcgatttaaacgagtgaaacattttcgatctacttagtgaaacaattccgatatacctggtggaatatcgtgcaatatttaaaaataattcaataataagataattttttcgtcggaatatatctatgtgtggtcttgttttgaagatttaattacaatgaatttaatggtgtaatcggatcatgatttggataaataatttagaagaaaaatcagtttaaagtagttttgcacgtaaatcggacgctgacgttaacgcccgattttaacctcctcccatcggacgcccgagcgggagtcacatccaaaaaaccggcgacgataaaaaaacggatggaacaaaaaaaataaaccggaagctttatgtatttcttttattagatatagatttaacaaacaacgttgaaaaaatattaaaaacaacttcaaattaaatttaaaaatacaaaattttctaactaaggcaatcaatggggctccttgtgccatgatcgaagcttaagggtacgaataaaaacaaaacgaagtctgtatgtacacgttgtaattctattaccaatctctctgttcagtgagttcacaataaaaacgattgctttgggtggccttcggttgtaacgagctgggttttggattctacagtcaggcgtgtcaatccgtgttcggttctgctactttttgttgtgccatgcatggtggccatggaccaacatcgtgcacgtagtgtcgaacgacgatggatctcgctgcttcgtccgtgtgcgaatcggacacatgcgactgacgtaccaagccacggtaaaaacatcttccccatttttataatagtagagatagagatgtataaaaaatataatacttatatgaactttttatatatacacaaacattatatggggagtggattctaatccctcgaggagatatcccctcgtatacctttttcttctaaattcgatgcaaatagttgtgaaaaattctgaaaaaaattgacaatgtagagtataatggtacctactagtccaccaaaattcatgttcaaatttgatctacacatcgagaaacaaaaaagacaaatttagatataaacagtacgctactattcatacgctgaatttgtcttttttatatctcaacgtgtgagttgagtttggacttaagattttgtggagttgtatatatgtgttgtatgaatgttgtcaaatttttccagaatttttcataaccgtttagatggtttttgagcaaacgagggaacatcccctcgagagattagaatagtttcccattatatgtatatatacaaagtccatatacgtctatatacaaaaactatgccgttccgtccgcactcttctccgcacttccacgtgcgtgttgtccggccctcttccgtctttcccacgcggcacgtggcgcgtcacacggtgggcgccacgcgcgcctaggtgcggattagggatttcgcaaggcagtgcgtgcatggctgcatgcactctctctcttaaaaaaacataatctctaagaacttttaaatgaaagatatattttttttctttgtaaataatatctctgtagaattggttgtttcaattgaacagaatcctcactatctaaactaacaaagcggcaattgctttgcatcaaacacgtgaataagtatctaaataaacactgcactgctgactactatcctcttaatcttctatatttagttgctatccttttgatcttctttagttgctgccactatcttgctcctctacatcatctaccggcttctccaaatcaacgccccaaatccgcacgaccacatttctcctagctccggttggcggagttgtcggcactagctctcctccatctccatcttcagccacctccgcttctgcctccaccgcggcgatggccgctggagcaggagcaggtgtaggtgtaggcggcgcggcgagttgtccgggcggtgcgagggagagggtaagatcaaggtccttcctgtagtgcttcctcttgtggccaccgagcgccactcctgtcgggtactctttgccgcatacgttgcacgggtgcttgccctttggcttgccggcgccgccactgccgctggcggtggccatcttgtccctgttgatgtggccagcgacatggccacctagcccctggtgcgactcgtactccatgatgcaaccctcgtacttgcacttgtacggtccacctgatcgtgatgctccgcgtgtgggtagccgagcctggggatgaacgggcgccgccacctgcggcggcagcgacatcggctccttctcgttctcggcgtgatggaccctcatgtgcccgtgcaccgccttcctgctgccgaactccttgttgcacaagtggcacgggaacgacgcctctcgtcgcgccgccacgggggcagcgtcgtcgtcgccggcgccgatcacgtcgccgccgtggtcgcggtcgctgatcgtcccctccgaaccggaagaggtagacggcgtgggcggcgaaggaagcagcgcgaggatgtcgtcgaggcggcggcgccgcttgcaggccgtcgccggcagcacgccctcctcgtcgtcattgtcgttgtcgctgtcgcggcgggattggaacacataccggcagccgtcgtcgtcctcggtcgcagaagccgaattcatctcgacctcttccagtggatcggcatggcggctgctggacttgccctccatgatcgctccgatgccccttgttcttgctccgatcgatctatctgatggagatcgggcagcacaagcaagtagggagtaagtaatcactagggcttaatttgcttgatcgatcgctaagcgagatttttcctagggttttgctgcagtggagagagagagagagagacagggaggaaggaggattgtgttgtgggtgacggcagcactgaagatatctagtagtagaccgtgaaatacacaggattgagtcggtatgatgcgtgggcgctaagtcgggtgatccacgtcaccgtttcgcaccacaacacagcaacgaaacggaactgcagtaacaagtaacaaccgagatttcgtacggatataggagtatatatcttcttttgtttctagaaacttttttataggatatttcttactcgtttttaggagagaaattaactagcatacgtatacgtacgtatacgggcgcgttctctgatcacgtccatcgatcaatctgcgcttgcttcaacatacatacagggaagatctttatttggatttcagaacaaattttaatttgggcctgatgaggttcagtaattataattagtgggaggtgctccttaacgtgatttctggtgtggataagaatactgtttcgactgttatttacttctgttttgctgtgggatttgacgatggccattgacaataacttcccaacttgtttgtgaattcatatgccagcctcaccactctctttgaggctcgtagctctcgacgatgctaaacgttcagggaggcacaggcaccgtggctcgtcaggaaacgatggttttggttggggtcgtcggagaagaaaactccgacccctactgctccaaattgctgggccctagccattttgcttttgggccttccggcccactagattcgatggcggcccactcgattcgacgggcgacactctgtggacttcagcagattcccctcacgatctgataaacctgcattgggactacctatacatttgtcgacaaatttttccccaaaaatttgacagatgtaattatagtacaatcgtagtgtaattacactgtaacttatatgtaattacactgtaacttgcatgtaactacagtgtaacttatatttaagtgtcacataattttgaatcgttagatctattacacgatttgtttaagtgaggaagaaaacaaatcatagcacacacatatgtgaaagaatttgttcccacgacctccattttaccgaaataacatgttacggagagatttttgaaagttacatacaagttacactatagttacagtgtaattacatacaagttacagtgtaattacactacaattgtactgtaattacatctgtcaaatttttggggaaaaatttgtcgacaaatgtatagcaaaatcgacctgcatttgctcgctagataggccccgtttggctggggctgtgccaaacggtctagattcaccaaataatggagcggagcggggtgaatcgctccaacaaattatactaccgagatggagcggcaaaaacgtcgctatagtttagtttattgctcagttaaagacggataattgagcaggaacgaatttaccaacggataattgagcaggaacgaatttatcattcatcaatccgttctcacagaatgtacgcacacggtatacatgtacaggtcaagcgaagcaagggattttgctacacaacacatcacatcagactatcagagctctcccagcctcttggcacagtccacgctgctgtccagcgtctcctccactccatacctgtacttgaaccctaaatccacaagcttgttggtgtcagcttgcactctcaccccctccccaatgaccctgcgaaagacgaacacaaaaccaatctcacaaattcacaacacaaatcagatcaaagccgggtcaatgaaagttgatctgatttcaaaaaaaaaaaaaaaaaagaatctcacaaattcagttactacatactgtattcaacaacaactaactaatcaagataaatacgtaatgaatactacctcatatatacattaaaggaaggaggtagcatatcaagagttggattggtgacacatactctttgagcctgatctcgatgtcggggaacttggcggcgaagtggtcgacgcagtccttcatattggggtacccggcggcgcagaggaatcgtccggcgatggacggctgatccatacagaagacgtgcgcgtcgcaggcgtcctcgacgtgcaccagcggcacggaccccagcagcgcctgcaggaacttgagggagttgtgggagggctcgtcgccggtgagcggcgccaggatcaccgggatgctgctgctccacgggcatggctggagcgtgtcgccgccgacgaccgcgcacgtcagggtgaccacctcgaacgccggcgacggcgaggagccgttgtagctcaggagctccttctcggagagcgtcttggatgacacatagccctgcattatgcaaaatccatcagaaaattagtgtcaccgtgagagtgatcgagttggttaattatgttgatcgatcgattacggacgttcaggtaatcgttggtgaagtcgcaggtgaggttgggaggagaccagcaggactcgttgatgaagtccttgtagccgccgccgctgccgtcctcccggagcggcgaggcggcggtgacggagcccgtgtggatgacgcgacgcaccgtcctcgatcgctcgcactggtccaggatgatgcgcatcgcgtccgtggtcgcttcggcggtgttcttgtactgcgagagatggaattaacaaattaagttactgatgatacatatgaaaattagcaacgacaagttatgggttaattatatggccttttgggttcaatagtatactccctttgtcccttgaaaaaccaacataggttgtgttcttacccccaagttttccaactcgtttccctcgttttctgcgcgcacgcttttcaaactattaaacggtgtgattttttaaaaaagtttctatataaaagttgcttataaaaatgatattggtccatttttttaaaaaattagctaatgctccctccatctacttttgatagtcatatttccaaatctgaaaattttatttttgataggcatatttcaatccaacaacctatcatcttaatgattttctcgaatttaatgcatgactctccatttttccacatatgattggctacatgggctttgagaaatgtaaatattaatgaatcgcttgtttacgatgaatgactagtagcatgtttaaatggatgataagtagaattacttatccttggtctgtgtgttaagatgaaatatgactatcaaaagtagatggagggagtacttaattagtcatgtgctaatggactgttccgttttccgtgcatactgttccaggttggaaacatgctccagcgaacacagccatagtggtgcaacaaagacatatatatatctctttatagattcgttatactcacgtcgttcaatactagattcgtttttccgaggacggatgcgagcataccttggtgctggtggggtcgtgctgcatcggggtagcgacgaggaagacgaactcgcagccggcgatggcgggctcgaaggtgtcggcgtcgtacatgtccgcctcgaacagcaccagccgctccgccgcgccggggaactctctcaacggcgccgtcttcttctcatctcctgtcaagatatattatcagttttatcaccatctccatgaattggaaacacgaagcagagagaaagagagggagagacattggcagagtattcgttgtactgcataccaagatttctcaaggttccatggacgacgcagcctcgttccaagagcttcttgacgaggtaggccgcgatgtagccgctggccccggtgacacacaccctgctcatctctctctctctctctctctctctctcttctgaaaccgatcgattcagtgagtgggacgaattgtgaatttgtgatctcagcagtagttgtcatcgcactgttcatatccatccattcctgccctgctgacctgtgtggctaactgagtgcacccaagactttcgttgtttgatttcctttcctgcacgcaagtgggtgtcatatgtggctctgaacgaaacgagtttcaggtccatatctcgcaggactgaccggcttgagctgaaaaatatatagctcccacgagatatatgcattaaagatcactacaataaaatcctttattcgtgatggatgataacctacataatgtatgcctcgtcggtgatcactagtaataagaaaaatatcaactgttacaagtgcggacctgtcagagatgactatatctcaaaacagtccaaaagttgtgatccgttgatgatgactataacccaacatttcctcacatctcggatcgatctgcgtttacgaatattcgagcaagaacgaatttgtcgttcattcgtttcttaccgaacacacacacggtatacccatgtgtataaggtcaagcaattcacgaatttttgctacacatcatcacatcagagttctcccaacctcttcgcgcattccacactgcaatccagcgtctcctccaccccatacttatacttgaaccctaaatctacaagcttcttggtgtcagcttgcaccctcaccccctccccaatgaccctgagagagacgaacatgaaagcaaccacacacaatttagtcatgattcatcaattaatcaagatgaattaatatgtaataatcaagattttttttggtcacacgtactctttgagcttgatctcgatctctgggtacttagcggcgaagcggtcgatgtagtccttcatgttggggtacccggcggcgcagaggaagcggccggcgatggacggctgatccatgcagaagacgtgcgcgtcgcagacgtcgtcgatgtgcaccagcggcacggagcccagcagcgcctgcagaaacttgaggacgttgtggcagagctcgtcgccggtgagcggcgacatgatcaccgggatggtgctccacaggtacggctggagcgtgtcgccgccgacgaccgcgcacgccaaggtgaccacctcgaacgccggcgatggagaggagttgtagctcaggagctccttctcggagagcgacttggatgacacataaccctgtacaaaatccatcagagaaaatgtcaagctctagtaccagttgatgcggagactgaaatagggattgggatcctctaacgtgaagtcagaggaacgtggtgactgagatatggaccccgccgctcacgggcccaccagtcagtgatcacgtaagagggtagttcacgtcggaggatcctcttccctgaaatagtttgttaattagttggtgattaatttaacattacgtccagatgagcattggtgaagtcgtaggtgaggttgagtggagaccagaaggactcgttgatgaagtccttgtagccgccgctgccgtcctcccggagcggcgaggcggcggtgacggaggccgtgtggatgacacggcgcactgtcctggatcgctcgcactgctgcaggatgacgcgcatcgcgtccacggccgcttccgtgttgttcttgtactgcatgcaaaaggcgacacctattattatctacgtcttttatatataacgtcgttgttttcttttaaaacgtttgatctttcgtcctatttaaaatttttataaatataaagaaaatttaaatcacgtgtaaagataaatttaagttatatttaaaaagttaacgataccctgtattaaaagatggattgagtatgttttgatgctatgatccggccggagcatgtg

SEQ ID NO: 38829 - DNA, 7882 bp, Oryza sativa
  unsure (1)..(7882): unsure at all n locations
aatttcagctacttacatgaacaggcacatgatctggcggatttagaagttcctttcacagaggaagagataaagagagcggttttccagtcaagatcagatagtgccccgggcccagatggtttcacaggtggtttcttcaaaaaatgttgggaaatcattcaacaggatctagtccaggctgtcaacagggccttctcctccccgccagaccgtcttagactaataaactcagcatacatcatcttattacccaaaaaagagaatgccttccgtgtaggtgatttcagaccgataagcctaattcatttcttcgggaaactgctctccaaactactagctaacagattggccccgagactacaacagatggtatcagcaaaccaaagtgcgttcataaaaggcaagaacattcaagacaacttcctctttgtcaacaacatggtaaaagagcttcactcctcgaaaacgccggcgattttgctcaaactagatatagccaaggccttcgactcggtcagttgggcctacctcgtagatcgactaaaagcgctaggctttggtcatagatggattgactggatcatttctatcctggcgagctcttcctccaaggtgattttaaatggcagggcaggactcagcttcatgcatggtaggggccttcgacaaggcgaccccctatctccgatgcttttcattctggcaattgaccccctacaaaaactcctcgccgcggcacaggaagaagacctccttcaacctctacaccgacgaatagcaaggtttaatgtcgccttgtatgctgacgatgcagtggtcttcacacggccagacaaacaggaacttcacacggtgcacagcattctacaacatttcggccaagccacagggatgatcacaaatctaacaaaaagtgaagtctactccattagatgtgagaaccttgatctacaggacatcctagcccctttcccagcacaacaaaagaccttcccctgcacttaccttgggcttcctctgcacatcagaaaactccggaaaatggatgtacaacccttaatagacaggttctcagcgcgactaccaaaatggaaaggaaaattgctaaataagacaggtcgctcagtcctcatcaaatccactctgtcggctctaccaacctatcatctcacggttttccctcttaagaagtgggcagcgaagaaaatggacaagatccgcagaggatttctttggacaggcgccgatcaggctaatggtgggcactgcctagtgaactggaaaaaggtatgcaaaccaaaaaatttgggcggactaggtataactaacttggagttttttaccgatccttgcgtcttaggtggctctggtatgactggaaagcagatgggaaactgaaagttcaagtgccattgatttggttttgatgattaataacaaatccaattatgtgagactaatatttttataagcattttttgcctagtctcatgtggatatganagtggagtgttggtggacctaaatcacaaggatgaaatgcatggagatcaagctatatgtatcactctttctcttcatatacatattgatatgtttgtatataatatttccacgtgattggcatatgcatgtgagactaatgttttgtttgagtattatctcttatttagtctatttacattgagaacgtggagatgatgaaggtatgtttttattttaatatctatatttgagaaatgtcttctattcttgtataggataagctctcaatgtttaatattttgttatgcatactcttgcttcacacaaatattttgtatgcatacatttagggggagcaaatcctatactttagttatgcatgtaattgattaaagttattcaccttcatttaattgggatctttacatttgaacatatatttgagtatatgacacttgtggtgttgattaatactcatcatttattcatatccttttatacatgcgatcggttggtcaacataaggaggttgacaaccggatcattgggactaataagtttattgagttgaatgaaagaaataggtcccaaggattacaaaagtgttgatgcttaagtgatatcattacacctaacaataccaagaatgacaaagtgaggatattgaagatgtgtgatacgaagtggctattatggcaagacggtgaagggcaagcgatgctcggtcgcgatggaccatgcggcggtgaagggcaagcaaggggcttggcgccgaagaaccaaatccggtggtgaagggcgagtgacggctttgtcatgatggaccatgagggactatttgaagctacaagtaaccgcatcaatcatttgaagaatatatggtgaaacggtatcggcattggtctccctcaagacaatgaaagaaagataaaaaaaaaggcattcctaatagtataattatcttcttatgtacatttgagtttaggaatgccgtactattaagagggatgcaacgtcgaggtgtttgtgtatgtctcggtgctcaaagtgacctatcatagtgctaccttgagagaaacccaagctttaacctatcctttgagtggttttagaccttgtttttcgttgacttgggtagtcctctgagtgagctttccatagagtctaagttcataaaaaaacggactcccgagcgaaaagttatagtcgttttactctgtgcttttcggaaagtccgaaaaattaccggaaactccgataatttttcggacaacttcgaaaatttccggacattccgaaaatggctgcgaatctgagatttgcttctgtaagttttcgaacttgtccgaaaatgcttttcggaaactccgaaaattacagtcttggcctccaacggctagtttttgaggggctcgggtatataaactcctccacccctcctttgagttgctgctgctcttggggagtattagacacatccaaagccaaatagcatccccatttccctacctttgtggtgcctctttgtgagggggatttgagaaggggagagagttggattgagagagtgaggagttgagagctagtgagcttcactccatcctttgtggtgcctctttgtgagaaggatttgagaagggaaaagagttggattgagtgattgagaagttgagagctagtgagcttcactccatactttaagcactcgagttcatagcaagcaaatcttcgattgtgtttgttactcttggggactaaggtctcctagacggctaggcgttgccggtgagcacccaaggttgtggtgtgccacggaaagtttgtgaaggcttcgatttcgcctccgcaagggaagaaatcaagagtgaaaccgaggagtgcatttgtgcaacctcgtgagaaaagggttgaaataggcccggcccttgtggctcctcaacggagacgtaggatccgtggattcgaacttcgggaaacaaatcgcgcgtctcccctcttggtttgcccgttcttgcattctctcatattgtgcttgagcttgtttttacccgatctacttgcatgcttatttgatttagttggtgaccttatatcttgcttagataccttatttgtcaccttttgattcatatacattttgtttgtttgagctacaagttcatagctagtgtttattccgttatccgccgaacttttcgattgagaccggaacttccaatcccataccggaagtttcgatttgaatcaaaagttatcatcactctaatgtgctatgaagttgtgataatttttaggaacacctattcaccccccctctaggcgacattaaggtcctttcagaaaccatggcaaggctccaccctaccatgcgatgaaacggacaagcaactcttcagggcctctacaatcatcacactaggcaatgggggcaagacaaagttctggcacgacagatggcttgatggccaatcccccaaagatctatctccttccctatacaagcttgctatgtggaaaaacaaaacagtggcccaagaactagaaaaccacaagtggttacggccactccgaaggatgaactcgacgaccgaggttcgagaatttatcctgctctagcacttgatacaacaggtacaactggatgaagacagggaggacgatctaatgtggaaatggaatgcgaatggaatctactcagccaactcggcctacaaaattcaattcactggaagcattcaggacaatcgtgctaacttcatttggtgagcaaaaacagaaaataaatgcaagttctttggatggctcatggtccaaaagaaaattctgacgtctgacaaactccaaatccgaggttgggacaacagtccaacttgctccctctgtgggacagaaccagaaacagcgacacatctcttcatggattgccccttcgcgaaacaggtatagacaaacatttggttgaaactaggactcaacatgcctaggtcttcttccttcaatggaaacatgatggattggtgggaagcttgccggagagaaatgatcaaagagcagagaagaaattttgatggcctcttcatctacacgacatgggggatttggctacaaagaaatgctataatttttaacaatgactatggtacagtgtcacatgtggttgacttcatcatcaacatgtgcaaagccttcgatgaagcgcaaatcgcttagatgataaaacgccgacttttgctgttagtggctttgcactttctcaaagtgctgtaacctcctccagtgtaaaatctgaagacacctcttggaggtgtccatgtacgtgaaactatttctttctcctctaatgaataggtagagctcctgccattatcccctcaaaaaaaaaaaacttcgggactagtagctatatatttgtgtcacattttctttgaaaaagtccaataattttttaggaaaggcaagcgtttttacactaataaattatacataaatcaagataatttttaataccttacactataatttttctattaagtagaattaggataaaaatcaatttattatctactttgaaagagaagagaagatagaacagatagaaactcaaaaggtaagtagtatacggtagcaagcatatgtaagtactcccttcgtttcaggtatataacatgttttgattttggtcaaagttaaactggttcaagtttaactaagtttatagacaaatatagtaatatttacattatcaaattagttttattaaatcaataattaaataaatttttataataaatttatcttgagtcgaaaatattactatttatttctataaacgtggttaaatttgaatcagtttgactttgaccaaagtcagaacatcttataacctgtaacggagggagtagtgactaaaagaatatgacgtcatattattttagcaaaattgtttttcttcccttgaaccgcgtgacatgacgttttgagcccgtttggtagagcttcaactcttaaatttaactctaggagtttggtctgaagtaaagttgtggagctgcacaaacccaacttcacatctctagttcattttgtgatagagctccacccaactccactcctattttaggtggagctgaaactgtttggctgggctctaggagaggtggagctggagttgtgccaaacaaaccatttcttttcgttttaatttggtccattaatttgacttccttttgacatatcgaaatcccgatcgacccatccaaatttgtgggcttaaagaaagcctgctttgatggagttcttttttcctatcgataagattcagatatatatgatccgagaaaaaaataaaataaaaagattgagctagatactttccacgcgaggtaacaaaagtcgattaatcggatgtcatcgacggtgacattttaaaagatggactttttatcctaaagtgaacatgtcctgtatatcatttgaaatagttttgattttttttttataaaaatatagtttgataagatatatcaataatcatcatatccctacacacacaaattcattatacctcaacatgttgcttaaaagaataaattatactctaactacaatacgcacaccatttcatgatcgtatttttttttcaccaaatttaaacttgtatgccgtgaagtaataaatcgtatattaatctgccttgtccttgtccattttgtttaaaaaaattcataactgttttcactgacttgcaagaaatgagagatggtatatatccttaaagagagagaaaaaaaatgctttcactcttttttcttcaattataaaagaaactatttttttcttattattatattgaaagataccacgtgcgcacactagcgcaaccgaaaatagaatagtcccaattaattcccaaatcactagtagtggaaccattttaatactaatccagtacaaacagacgaaccattggaaatatttggaaaataataagatttaagtcaaagaccagtaacccctatcaggacacgacacgctaaaatgatctgatcgagggcttattttaagccagatagcggtggacgagccgacaatcagctgacaaacacgtcctattcgagcccgatatctcttgatcgctttccctctagttgctgtcagccaaactcagactcaaccaactactgcactagacagtcaaatttaatttgaaataatgcacaaacttagcaagatttaaggagaaatttaacacaaactcacgaaggacaaagtggacgatatatatgataatggcaagtgtgtacagtaccttagaagtgacgattgacaacgctgtattttttttggacgggagagtaagccctgtttattttccaaacaaaatttttgactctatcccatcaaatatttagacacataaatagagtattaaatgtagaaaaaaaaccaattacatagttcgccagaaaattgcgagacgaatcttttaaccataattgtgcaatgatttgacaatatggtgctacaataaatatttgttaatgatggattaattaggcttaataaattcgtcttgtagtttcctggcggaatatgtaatttgttttgttattagactacgtttaataattcaaatgtgtgtccgtatatccgatgtgacatgtaggggtaaaattttttgccaactaaaccagctgttagtactactccctccggcccataataatatagtgtatcacatccatctatccagattcaatgtgtcacgttcctctaaaatctcttacattttagagggggaggagtgctagtttgttctcatcgtattcatgactgttcatgtaagtacttcatgctagttacatgattactcgcatgaacagtaacaagttgtcctaggaatctaggacgcatgccgtcagttcctgcatactatgtatatacaacacagtgtactgacaaagcagtcacgaggttgcacgccgtcgtgagctgtaaactaatctgccgatcgaccaatcgacgaccaaactaattaaccaagggatcgatcgatcgatcgattcgaggcagcagcgcacatgttgatttatacgcaccttggtgctgctggggtcgtgctgcagcggggtggcgatgaggaagacgaactcgcagccggcgatggcgggctcgaaggtggcggcgtcgtacatgtccgcctcgaacagcaccagccgctccgccgcgccgggcatcctcctcagcagcgccgtcttcttctcatcccctgtacgtacgatttcttcagatcagcaattaatccacagattctgaatgatggatttggcgatcttagcagctgagatcgagatcgaggtcgatggaattaatcatggaaaagagagagagagag

SEQ ID NO: 38830 - DNA, 771 bp, Oryza sativa
aacaacgagtggtcgcaatgaagtgaacggtgagaagagctctgaatcaatatcctcaaagttcccataggtattttcaaattcacgtagggtaccaaaagcccgctgaagatgaccaatggatgaatgagcataaatcttggcaagatatgcctctggcgtcggtgcccttttctggtgcaaggacttacgtaatattgaccaagcagcattcaggagatcagtgctacaagttctggcagcagcacttagagctgagagtactaaaccttcatcaactgaaagatgaagaggaggaataacacgctcagaacgagcaatccatcttgcaagatattccaaagcaaaaagacccagcttgctgttgttagcttcaaaagcagcttctgctatttcaacacaccaggaccatggtggacacaagactttgttctgatctgtagcctgaaacaaaataagtgcaccgttagtacatacaccgagaagattgaaacatatattcgaaaatgaagaatgttgaaggcccattggtagcccacaaacttataacaattgagaatttccagcattggaaattaggagtcctaactaacagtatataaacagtaaacagacttgtcagtctaaaagaataataagtaccttgcacttctctatgactgatgccaatgtatccaatctaccagatcttacacatgcccggacatactcaacaaaaacagaggaagatattgtgtagcctgatttaagcatcaaatccaaatatttcaa

SEQ ID NO: 38831 - DNA, 1473 bp, Oryza sativa
tgctcggcgagatccagcatctcgatcgggagcgccccggacatgagctgcgcgcggaggtagtggttgaagaggtcgacgtcggggcggttgggcttcccggacgccgggtcgagcgacctcacccagaactcgaacagctgcttcatctcctcccaccgctgctccgccatccactccgcgaacgtctccttcagctccgccgcgcccggggacgccgagtacgccgccgcgcgggcgtgcgcgccgccgccgacgaccgcggggaggagggaggatgaggacgggttggccgccgcggcggggttccgccagttctcgccgtagaaggggctccccgtgctcggcttcggcgggagcggcgcggcatcggtggcgggggccgcatcggccgcggcggcgggggagagctcgggctgctggaggagagggcgggaggaggagatggaggagcggaggaggagggggaggggaggcgggtggcggcggaggaggcgggaggtggccgccgcggcagccatggcgggagaggaggtggggtttgggctagggttttagtgaggtgggagtgagaggggaagaaggcggcggcggcggctcagccggagatggaatggaacggaaggagcggagaatggagggtgtgtttcgtaattttgacttgttacgagggtgaatatgtaaatttttgtgcgaccgttgcattcagttcgacggtgtatcactgcgataaaaacggtttaacccacggaattaacatcggagtacgaatttcgaaattgtttgtgccaaattcctgtgaagttcgcctgaattttgagcgatgcaaatggggctcttgtctatactagatcaatgttagagatggggctttgtaagaaccttggcagcacgtagctgcgttttgcattttgcaagagagtggcaaacttacaaacatgaatttgaggatcagatttcaactcccagtatgttattgttgccaatcggtttcttacaaaaagattgctttcggtcagttccatacaacgagaaatgttgccgatcatcagtttgcatactactcttaactaaaatcttctacaagtagttcatcatcttgtaactggatgcatgttcctcttccaaagttgaacatggcgcgtcggataatcgcatccgttgtgcagaacttcattgccaagaagctgtcagcactgtcacctttgaagatatacagacaaacataaagcacattacttcggggagccatagaaactccttgcagtatttgattgcatggaggtgcctgttgagtgcaggaacaacattaaaatgctaatattttgtcagctgcaagtcccaagcagcaaatactcctaagtatattgatgggacagaacctcaaacagcaagactgaaagactaatatatatatatatatatatatatatatatatatatatatatatatatatatatatatatatatat

SEQ ID NO: 38832 - DNA, 7358 bp, Oryza sativa
ctgcatgagagcaaacaggtgggataatatttgtttgaaaactcataatgtatgattcttgagaatactttttatgatgcaacaacctgtaatgtatgaacttgatccgagttatggacatgtaaaatccctttacaacgataaatatccatgtccaacttcctttcccaaagaagatcctcgagccatgattccaccttcagaacaaattaaatcaaacaaaaatgcatatatctcacaattgtatatcggtgttcattggtcatgaacggagaaacctaggaaatgcagtgtatgtgcttgaatattaaacagacttctactcttctctatagtagagcagaatatggagcatccttcacagatcccaataaatgatcatctttgaaatcatgacatataacacatctatctcaacatgaagacttcaaggggcaatattaatcaaataatgtttccagttgttgctgtagcatcaaccaggaaaagtgagtgtagagcttgcaatcacttgttcattgtaacttttcaaatcaacctaagcagtatggaatgtgaagacatattttagaaaagtaggtgaaacataagagcatgtacttcaaagtactaacagaacaatgggtgagtacagaaaaaaaaactaaatatcccaaatcccaatgatgtagttgtcaaccaaaatctatgtttttaagattaatgaataaataccctttcaaagttgtgcaagggaaatgttttctaaatgttaactgcagttaaaaaaaactctaatggaagagtaccttagacagggaaattggatcctgctcacaaatacacaaggtagaaatactgttatcatgacggagattaggtggtactgatttactgtactccagaagttcttgcagctgcgatgaattctatggaaaataaattaaaaacatgtcagaatcaaatccctgaataaggtgttcagattttgttgagcacaaggtgccatcgccagcaaaagcaataactacaaaataagtaccaaaagcaagtaagcaaatttctgtattgctagttagcatgagcaagcagatgctgaaaaaacgtctcaccaacactgatttttcgtgctgaatgattcgagcttttgttaagaagtgccatagagtttaatgacctgagaataacttagtttccatgtcttggcatgactagatttagtgcccatatgttgacatgactaattgatgtcatacttaatcaattaactaatcaaagttagtcttttttttgtccaaaaacaaaatcaaagacagattcctctgcattgaatacaaagaaataacaaaatgcaagtttcgagctaggtattgaccttggcaccatatgcttgctgatcaaatattttatttaagtcaacctggcagcggacagactgcaccactgtaacaagagcgttgacttcatgaatctgcctttccaaatcctcaagactgccttctactaggtcaattttgttcaatatcacaacatcctggtccaggaaagttttgacacttttgttattatggttgtttgcattttgggattcatcaagtaagacaaatttcagaaccacaaaatcagcacaaagaattccaaattctgtagtgaagacaaaatggtacaaataggataacactgaggaccaagttaccgcaaatgcaatttgatgaaatgcttcagggaatgatgatgacttattgtgctcatcaatttgcagcctgaagttttttgcatcaataacctgaccagtaaatatatatataagaaaattgtccaatacaatgcagtccttcaaactgttatccaaagtaaggaccaaagaagcaggcacatttcccgaacttgtaagatatagtcagactaacaaataagaacataaggttgaactaaccgtaatgatagagtctagtttaattgatgactccaactggtcgtctagccaaagaatagagacaagaggtgcaggatcagccaatcctgttgtctctagtaatatgtgatccattctgcagcacatagtatcttcaattcataccgtcgtaatttacaaggcactgtagtataatgaaactactaatgttatcagaaaaaaaaaacaccaatcttctttaatgaaagatcaaagtaagagcatgatccactttacatttttgcatcagtacatagcatacacaggaaagtgaatcaaaattttactatttccagaagaactagaacaaacaaacaaccatgtggactaaccaaaaaatgccagagtgtaaacatagttttgagctaaaaccagaatatcaatagcaaatcagaacatatcactaagtctttatacatcatgacatcactttgtactgaaaatcatagggaataaaacataatagtaggacacatacttataggatcaaatggtgtatgctacatatccatgcaagacagcaacatccgtatttacctctcctttctctgcacaagctgctcaagtgcttgaaccaggctgtgtttcaccgtgcaacaaacacatccatttgccagctctacccactcttcaacaagcgcgccaccttgcccctcattgatcattgctctttcaaccccaatttcctctccaaactcattcaatatcactgcaattctctttccatgttgcgcacttagaatgtagttgactaactgaaaatttgatgtgcgggagataagttatcccataacataccaattagttgaactaacaaactggattataaagttcacaggacacttggtcaataagtacaggttctgctaggagagtggtaaggtgagacatagtagaaacaaatgtcaacataagctaaatagtaaacagccactgacagattcattttgataaaaaagcacgggataaaatagtactaaacacatgtataaatcctcaatatatcatcaactgtgaaaaaggtgtttatccatgagtaactcggtaatgttaagtttagtctaaaaaaagaaagagaactagttactccacttggtgatataacattcaactacagttcaaaattgattggttactagttcaacatgtagatcgatgaaccttttcttatatactactagaactacaaataaattgaaaatgagctcctatgagaaacgaagccctcgaagcgagttcgagtcacatgacagctcaccaaatagaaaaggacactgctccaaccaacccagcatgttgagaactacctaaacctaagaaaacagcaagagctatggcgacaggcaagtatgcaactcgatcggatcaaactaccagccacaactccagtcctccaggaatcttccgtagaccaatctcggatcctacatagttccagtaatctgacgcccccaatcctccaagcactttgcagggagagcatggggcggggaggcggggagggcacagcctgcggagaaaagctcaccgtggacttgccggcgccgaggtagccagtgatgacggtgactccgaccggcgacgccgcggagggaccgagcggcggaggactgtacggcttctccggcgagagctcgacggcgaggggagggcactcgtcgtcgtcctccatggccgccgccgccgccgacgacgacgagagacgaggaaacagaagcctcgagaactacggaagcgtaggtgtttttgggccgtaaagagaagcgtaggtgttacatctgatggcccatacaagccgaatatgatggcccaaaatgtctcttcgttaacacttggcccacataaattgaagcccagcttgaagagtaggctcactatagtctcgtggataaaattagatttctgccttatcagtttaggctatacattaccctcaaaaaaaaaaagtttaggccacacattgtgaaaatctgaaatatttcaggacactcttttttttatccttttgacaatcaagagcttaatattaattagtcaatttccatttgaaattcagtccctaattattctggagtaaatttcctctaaatttctgctaaattcattcatatgttcaaatttgagccttggctaagagaagtaaatgtgtatgttacaaaaaaaacccaaaaaatatattcctaaaattatgcttttacgatccctaaataggtttttaggcgtgagcgaaagggcatgtagcctgagtatccggttgggtatagaggccgagtaaaaaaaacactcttctaaaaaagaaggtttttagatgtgaatagactcttttctccaacagatatctaaaaattaactcaaaattaacacccaataattagaagtaggtccaccccgaactaccacacaacggtcattccccttcccacatgatctaccacgcgcaaacttccatggatcagtgaaatgggagtttgcaatcttcataacttgtggagagcgagaaccgagatcagggtttcttttttttttttctagattggaggtctattagatccactttttccctatataactcaaatacttcaggattggggatagtattgggtatctcttaggcatgctctgtctgagctccagcacatgagttagaatattcaaattactattcgaattattctctcccctttacttatttgtcagttttgaccatgcacccagaccaaaacaataaactttttctatataaaatgatcaaaatacccctaacttagtgggatatagaatctagaggtttataaatacatatgccgcacatatatcaccttaattaggctcaccaagggcaaaagaggaatcacatatttaagtgcgtagtgacatatattcacaatcaaaagtgatgagtaaatgaaaatggaggtagtacgacacacgtgtcgtcaaaacaagagatacacatcctggtgttcaaaaatatctaagaatttgaaaacttttaggacccgtaaattggaggattgccataggaattttggagtattcaatttcataaggaatctttcctatgaaacccattgattcacataaaagtataggaaatttttcatatgattgcattcctatagctcaatttcataggaaataagcaagaggtccaacctcttggaaactttcctatgctttgtttgtttcctatggtgctatcatatagactctcctcatatttcccggatcattgcccccctctgcgatcaacgcgacgaaacgattgatcatctcctggtcgcatgcccggagtcccgacagctttggtggattgctcttagtgctatcggtcattccgaatgtctacctctcaacgagcagtcctttcatgcctggctgtgtgacagtcgcaaaaggatgattaaggatcatcgccgagggttcgacacaattgcaacactggtagcgtggacaatctggaaggaaaagaacaatcgggtcttcaaccagaagagcagaccttggatgaagatagctagggctatgatggggaagtggacctctggcggatggctagatcagccataccaaccatgacagtccattcgtttgttcttgggtcgccaaatcattcgggagattaggcttatgcttttcttttcccctctcctgtaccctgtccccttctttttggttttcaggcccgctctgtaaatacatttattcctcttaataaaaaatgtgtgtctcgtgtattcccaaaaaaatatttcctgtgttttctattcctgtaagactagtaaaacatgctactttaatttctatgtttttccttttcccgtgtgttttctatcctttgtttcgaaggggcccttagataatggattaaaacctggtcactacgtccaatacggatgaacatagccaaatcaagcagttaaaaacagagttgaatttgatttgacattttttttcctgatagatgctagtggggaacactttacttctaacatcagtctttgcctcctttttttccatcaaagctgttcgaatcctatttgctgatcagagatttcatgatattccctttaactgccgatcttttgctctatagtggaaattgatgcgttttcctcaaaggcgacaagatggatttgatatgtactttgtcctctgaatttttactgtgcggatgcgatcatacgaggaaatttgtctaataacagatttttcatgcattccaaatcttgtcaaatttacaagaagagtgtgacctgaaatgtttcagattttctagtaaagctaaatgagtacttgtagtacgtctgtacgtactagttagtaagaagttgacgtcaacagtgcaacacctgcaatgcaccgaaattgacaccaagttctgcacttttttcctgcaatattgtgttgttggtgattagttggtgagatcaagttggaatcaagagatgaagagatcataggctaactatatggtaacatttctgtctatctcaaaagttgaaaaataacagaaaaacggaattccatttttgtctgtttgttttgatttagtctagatcatcctctttgaatccaaagcttatgttccctaacactaaatatgtatttctttaatcatctcaactacagtgactgaaagcaagtagcatggcatgagatggtagctgattaaggcagcatttgctgattgctagatagagctatgatttgtcacatatttcagggcatgtaaaaagcttcagcttttctgtgaaagagtaaccaccaagcttggctggtgtgatcttggtcattatactaactaattaatcggccttcccaattattacattcttgaattcacaaatagagtctaccttagtttctggtagaccagtatatcatcaaataatgtaccgaattattaacgactttaatttaggccacaaataaaaaacacaaacaagctaaaatggttagctacaattaatgtcaggttaagttggtggctgcttacttacctggtcacatacagccaattagagctcttatctttcggagcattcacttggctaattttagcaacattgtactgatcacctaagcaggcaggcaggcagatctggatctgtgctgactgctaataaaagatttcttttctcttttattttcttccttttttttgagaccaaagaaaggttggttaagtggctgcattgttgcaatgcaatgcaggcatgcaggagagcaatggcttctgctggttaagctgcaaacttttgtgggagccacagcccacagatagaggtgtggcctgcacatcacctgacctctcatggctttattgatgcagtatcttttcattgtttttcttgcaatgatggtcattaatccgggagatctttgtttcttctctgcaggtgtatatctttctcacaagttg

SEQ ID NO: 38833 - DNA, 9543 bp, Oryza sativa
ctggcaataactttaaatttagttagtgatgagtgtgtgtaagactatggcacaatttatgtgcttcgtaaaagcaaaatggaagctactcatatctgacatcaggacaaattgtgcctaatcactgactaaactgagaattgagttcagtagaacagtaccagatcagccataattcagttcaactatgttgtgcacatttgagcttcttaattaccatcaaaccacgaactgatcactgatcagacatgctagtagattattgtggtcaattcaggccaacatccaaagttagcaccacaaaagaaacaaagagactttgcctgacaagtggatcgccaacatacatcgagagctccaccaaataaggatggggccgcagaagaacagcacaagaatggtccacatctgattgtcattgatatcacacaccctatttagcctctgccgtcccaaaattcttaactatcaagcgttgcagttttgcttgccttttggcattatattcagacacctcaattttcgacaagagctacatgataaccaacacacaacacatatggacctacaaaaaattgttttccagcagcacagtttactgaatatctcaaactgaagcaaggcatatactattgcagagtaacaagattgagtttaaaaagccaatgttggaaaattgactacgatgaaaaaaaccctaacatcaactctaatattgagttttagtactaaaaattttggtcgcggctgataagctaacaagtaaacgatgaaaaaggcctgcaagctgcagttaaaggatgcagctatactgtgtcctttgtgatggatagaatcatagaattataagcaacactattatagcagattagcaggtttctccctgacaaagaggccagccaggcagcctcgagtgtcctgtgtgtctcccaaggcaaaccagttcaacaaaggtaggcaagaaagagacatgaacaacacaatgtttgtgtgagctgtctgtgcctgtgcacctcctcctctctcttgagagagaaacaggtgagggaaagatgtcatgattaacaatactattaatctttattgaggaaagaaaacataatctagtttaagctgcaggcttgctaaagcaacaagaggaggggttgagagagaaaatgacaccggaatggtagagtgagaagacttgtcctggttgctctggtggacaagtgaacaaccccagaagcattgataccacatgccatcacacacacacacacatgcatgcttagtacctgcttcttcatagagacttgttgttagttgttacactgtactcaccaatcattttcatcactagtctgcagcttctctctgcttccatcactctctactcaccttgctgcttgcacaatgctttcttgattctttatcagcatttgcattcttgtgttctctgtcacagatagagataatgtactggttcttgggggtccaatgctattgttgcttgcttctctgctgcacaatgttcactcacagccacaccaaccaatggcatgacagtactgatgtactaagcatgcagcaactgaagcaagtggttactttgaggcaaccaagctgttgctggctttgctgctgcctgcctcccccaaggcagatctcggattagtgcagcaaaagtaggagcagagcaaaggttagcattgacccagaaattcacgggggattcagttagtatactgacacagggatagttgctaaaagcaagcagataacagagttaaaaacagttgctttgagctaatcttaagctattaataactgaatcagttcagatgctgtgagctcttatcatcataggcttattgtgatttagccccttcaaagaagttcaaaggagagaaaactaaataaaggaaatgttaaaaaaaaaagaagaagaagaaacaaaaatgaagaaaactttggaataacctgagaaaactctgatcacttgtcgatttttttttcctcaatgatcttggaaagcttggagctcgagattggaatgaatggaatgaattgaatctgtacagttccccattgatcgcctcgattttcggatcaagaaatctttggctccgtgcagctgctgacgcggccaattctgcttcagttcacgccaacctccgatgaggccggcgggaagttgagatcaagaaaccccgcggccgccgccggcgagcgctgctccagctccagctcggcgtagagctcgtcggaggagcacgcgccgccgaacttctcctcctccgctgacgacttgttgttggccttgcggtcgccaatgccggcggccgccgagcccggcgacgccgagggggagagggtgctcagcgaggcgtacgtctccgagctcggctccggcgcgggcgccgccgccgcggcggtggcgggggagaccttgggggcgctgcagctagtgttgatccgcttgtggctcgcgcggtggccgccaagcgcctggtaggaggcgaacaccttgccgcaccccgggcactcgtaccgtgtccgcttcgccggcgccgccgcgcgcggctgctgcttcttcttcgaggagatggaattgggagagtggtagctagcccttcgcttcctgctcttcgcgacgtcgccgccgtactggagcagagctgaatcctcgtcggagttgtagccgtagccgtagccgtttcttgggaggggtagcggcggcggctgcttcgccgtcgccttcttcttcttctgctccggcttctcgaacgtctccgccttgaccggcgagcgccacacgccggtgtcgcgcgagagcatcaggaggccgagcgcgacgtcctcctgttccttctcgaacccgcccagcagcaccggccgcggcggcgcgggcgcgggcgcgggcgccgccacgcgcatcgaccgccgcctccgcctcggcggcgccgcgatcacagtcaccgccgccggcgccggcgccacaatctcctcctcctccccgccgccgaactcatcctccacatccacgtcgtcatcgtcgtcgtcgtcgtgattcctccctccgccgccggatgcatggcgccgcatgtgcccgaacagcgagcgccacgacgagaacagcttgccgcactcccggcacgccctgagctcgccgccatcgccaccctcctccacctccacctcctcaccatcaccatcaccatcaaactcagacagccgcctcgtcttcttgggattctccctcagcccgtacccaaccacgccgccattggcgccgagctccgccgccgcctccccaaacgagatatgcgaccgcatgtggccaccgagcgagcggccgcacgagaaccccttcccgcacaccctacaccgatgcatcacgccagagagctccactccccccgcatccatggcgaacccaagaaagaattccaagaaaccccggaattcaggatccggggatcaagaacgaacgaacctgacccagctgggcgcgatcgcgcgggaagatctgaggcggcagcgagcattcgatcgaagtggaggtggaggagtagaggggaggaaaggtagggtagggtggggtggggtggtggtgtggttaagctgcagagatggcgaggggcgacgcgatcgagcggggggtgcggttgaggttgagggagaggggggaggagaaatccatgcatggaagcaaagttaaaaacagacggagaagagagagtcacatgggccgaagaggagagagaaagaagggggttacattggagagagaaagctggtccgctgtggaggctgctttgatgacgtgtcaagtctacgaggacatttttttctttttttagaaacataacctgcccatatcttttatcaaatttggacgcctcgctgtcgacagaataattagtcgtaaataacaacactcatgttaagttaggacttcgatttaagtggactggttttatcataaggaatctaatcaattgagttatgcttacttcacgagaataatatgaaatgataccttggtaagtgttcacacaatctataaaaatcatctctctttttctctcacggaatttacagtttttaagttggctggagttgacaaaccactcggtaaatcaatgatttttttttaaagaaagtcaaactgaattttattttttcaataaaatttaatcacttttcgtgaaaacttggaaacccaccaaggagacggctttgtgaaccctgatcatggtgatatggatatataccaccgtatatagattttctcgagcaactgtatatagctatctgtagggagcagtaatggtagaggtggccaaacgggccgggccaaacgggcggcccggggcacggccgaacctgtagcaggcacggcccggcacggcctgctacagtaacgggccgtgccggcacggcccgagtagccgtgccgtgcttgggccgctggccgagcccgcgggccggcacggcacggcacggctactgtagcggcacggcccggcacggcccgcggcacggcacgacccgtttcgccggcggcccgtcaggccgaaagcgccacgtgggcgggcggcggtcgaatgggaaggcgccacgtggcacactaacggctatttgaccgttcaaatttgaaaataaccgttgggaggctaaaaaattcataaaaatttcgaaaaaattctaaaaaatctcaaatttcgccccgaacggcccgtgggccgcaggcgtgccgtgccggcacgggcacggcccggccatccacgggccgtgcttgggccggcggctcggcacgtgggccggcacggcacggcccgtttcatcagccgtgcctaacgggccgtgccgaaacgggccgtgccggacccgtgcccgtgccgggccgggccgtgccgcccgtttggacacctataagtaatggcgatgaccagatggtgtctatctatctacaatgacacatacgcatcgctagttgttcatgggtaggctagtgtaagccgacaatattcattggagatagaatggcgtgatatatggtaacatcgcatacatcgtcttataataaagtagtggatatttgtctctttgctgccagctgataaattcatccactggacctctttttatgattattgcagattatattgcaggcttttttctgagtggtaggaaagaatttagagctttttcattattgtttggatacatttaattattcataacactattagtttaccactgagttttacctatcgtttggcctacaactaataagttgttttacgatttatcggtaaaataaataacttatgagtaatatttttatacgtgtccttagtgacttctaaaatctatgtttaaaaaacaaactataacgaaaaaaacctaatatcaactttaagcttaagttttaaagtttaaaatttgatagtggcttataaactgaagagatttgctccgatacctcacagtaccaatcatttcctatcgttggatcttaatgggcattattagatccaacgatcgaaaacgatttgataccgagaggtactggtaccttgagatactttttgttggaccggagcaaatctataaactgcaaggtaaacaatagaagctaccacgtagtttaccagtgaggtctggtagatataccaaatgattattttctaaaatatggtgctggactatgtagcaattgcatgcgtatccatcgttttcttgtaccttgtacccaataataatgaattagtaatgtacagtacgctattaccgcacagtgacacggcaatataacgcatacatatgtgttttatatggatgatctcctggatagttgcaaatgttatggcgtgcgagtgacagcttatttacacttaattctttcttaatcagtctagctgcttataattacccaaattgccgtttaatttcccagttgttgttgctaaccaagtctgtcagtttttttttaattcacaaggatgtcggcagatttggccgtcatgtagtatgtagtagcttcagtgatcaatcacacccatcaaacacttgttcaagactccaaaaggaaacaagaaagacgaagaaatgcaaattctctatacctgggaggccaccgccaacttgaaggaagtcccaaagaaagcacttcgcaagttaacacttctggtcaactggaaaatctggaacgagagaaatcgtagaattttccagcacaaagagctatctacaggaagtctgttagccaaaattaaagaggaggccaaaacatggtctcgggcgggggcgaggcatcttggtagctggcttgctttttatttttagctcagtaggaccgaaggtcctgggcctggtttttcttacttgtaaagtttactccttctctattcaatgaaattggcagcttgccgattcgttcaaaaaaaaaaattctctataccgttgagtgctgtgcttacttctcaatgcatgcaactatgcgcctatgcaaggtaataaggggtacatttgaatgtggatgatggatgaatctgagttaaaaacaaatgaattagctattacaaagtaaaataaaaagatcaatttttcttaagaaatgctctgtttttatattaagataacagaagattctattaaacttaatcaattacatcgagacgatacaattataccgagacaggactcctggcctctgccataagaaatgctcatgaaaaagttttagtaacaatcataacatttagaagattgggatgtgtgcagtgataatccgggacactattttaacagctcgagtggacgtccaccagtttattgcatgtcatctaaatggttataaaaaaaattaaaaaaatatgaacaagataggttaatatgtaatatatcaatccacaaacatgcaagttaaaattcaacttctacaaattgtaacaaaaataataaacaaaaattaaattactatatgtatatttacaactaaatttgttatttttgtgcaacttatagaagttgaatttgaacttgcatgtttgtaaagtgatatattatatattgatctatcttgtcaatttttttgaaattttttcataaccatccagttgacatgcaataaacgatcgaacatccactcgagttattagaatacatctcggtgataatccatcaaccataaaagtctcatacgaatggagcaacattttctatcaatatggcactttagttttacttgtctggctgtctgagaacgtgcatatactgactttaacaaccaaaggacattggtgagtaacacaactttggtgtgcaactcaaattgaagattcaggtgagaaaaaataatattcaggctaggctaactgaggtgtaaataggttctccttatgaacctaggcataaggaagatagaatgacacagttaattacaagattgtaaactgtttattaaaaaaatgtttcttcccccccaaaaaaagaaattgtttctgtttggaacaagcaacaaatttatatgggaacttatctagtcatgggaaacactgagtccactaaatggaactacaggacagcaagctgaataaactagtgcttcatgttgacatttttttgggcatcaaaaacaaacctaatcaagcttttgccaatagctgtgcagctcttcaaaagggagtacaatacgcaaagctagtactacgtaatttaactgcatgcatataattaaagaactgcttgataaactgtaggtatcaatatgaacatcactttctgtcaattagccattaggtcagtagcccaaagtcctttgttaaaccttcatccagtcctgaacacataaacagctaactttgctgctgtgtttaaatactgaaacaacaaaagttgctcaattaacaaagttgattaatcagactagtagaatcgccgggtacccacatgcctggtcagtgaatcatcacgctctgcatgcctgcatctgcatggaccagcattatgtggcgccaaattaaaactagttattagtgtgagatgaccagcgagtgattggtaaactgtttcagtggagttgttggaacatccaaacacgtcgtatctttgctgcagcctccccatttgctgcatcttctactggcatgtctccctgtacttaactacggccatcaaggcatcaactttgctttgcttgctgcttatcttgcatagatacggccggcttttcccttgggtgcacacatcgatccctgcaattaattaattctccatcgttgcaagttagccaatttttttcatgcaagattaattcttccagaaggatcattaacaagaactccagaaggtgactttctgttccttcctgaagaaaataaagggagaagtatcattgacaacgcatagaggctacactgatcaacctgaaaagaaaaaaaaagaaaattcagaaatctagcactagttgagtagtccttggcatggttggcaattggcaactttattaaattctttcatgatcttactactgggataagaggtatgaaatctagaactaacaattttttattagtatgctacttgtgtatgttgagctattatctaaaagaaaaaccttgtgtgtgagctattgagcaaagaagtgtcaaattgtacttataccgtttttagtgagtttagtcagtgcgtacttaaactgttgaccagcagtgctgggtaatgattttcccggatgggtgatgctgtcatagtgaagaacaagtggggacaagtgtgcctacatctgtgagacattcaagaacaggactagtactactagattaactaatgagctgcattcatgaagaaacacaaatgcacaatgcagttgcattggcagattgagtagcaaatgacaaatacacccttagtaatagtaatagaaaattatcctgagctttgctcgttcctttgtatacccttgaattttttttttattttgatcccttttatacctattcttttagctgactgtttaatatcaacatctcattttaacggtgcaaagtttagaatttggtatatatagtctcatgtttgacccatacaacgaaaggcaaaccccaaaccttatgcgtattgagtagtaatgtgctatttggggttgtccattgataatgaggaggatctgtctgtgagacaaaaccttggtcgcaaagcttagcattggaccaagtggattgcacaagttttggatatgtctttcttgcagctactgtccctgaaagttcctcccttatagaacggagaactaaatcgagcagtagtagcttagcttgtccaaaatttgatgaattttcgcttttggatgatgttttgaggtgaagcatttggcaagtttggttcacacattttctcatataggtggcgtgcatgttgttgtggccaattctcgagaaaggtgggcaaaaagcctctactgctttactccgtagcggcggcggcggccaagtccccaccaccctcgcgtctcacccccccactccggcgaccaccgccgccgccacccaa

SEQ ID NO: 38834 - DNA, 2843 bp, Oryza sativa
cccttcccccctccgccgccgccgccgccgccgccgcccgacctaaccggcgggcttgtcgtcggtcgccgacgccaagcccgcggccgggaactgaactcgcggtccgccgccggccgaaccctcctgcttgactgcttcccggagctaaggtcggaggcagcggtgggagcccaaacttgctcccgagtagctctcgatttcgtcgcttgctcatagtgattcctggtgtactgtatctatccattgctgaatctattcagaggtacacgctgttttcgttcagggcacggcttcggtatgctatgtaaatattggatccgcattttggtttcttggtttgcaactatagtagcatgagagtccatgttggagtgattgccaatctctagcttcgatatggcagcgtagtaactactctagtaaatatgttcttgtgcttgatatcacaggataatgtcatcttaattgagttccccaaattttctgtcagtagggcttatccgttgctttctttgcagatgtctagtagctccaatggcaatgggcattatcctgttaatggtgcaaaggttctgcaaaaaagagagaacaatcaagaggtacctgacatgtgtttcgtgatttattcgttgtaaaacttaattttttgggagcactggtattttttagtgttgtgagaaaccagtaatctgacattctttttgttcaatggtaactctgatattggcacttggaagattttctcccttaccctgcaaattaatgattgatacaaaaaaaaagagagatttttctcaagtttccagaacactttcttctcagcctatttgtctactcacttggtcacatgtgtaatgccaaattacctaaccatttcttgatatgcattgaggattaggttgttatttacactcaggtgtcagttcatatgattcatgtgaacttaagttaccactcctggtagtctggtatctaacctaagtagcttcatgagctttcctatgcttgaaaactgttccttgttattgttaagaaggtgagaagtcttggatatttccacctggtatatgtgtcaatctatcactgtaaagtggaaattttagctaaacagttgtttgatagaatcctcatatagtgtttataaaacatgtaaattgaacataactatgacaaactgtaagcctgtaaggtgcaagctccttcatggaattttctatgtactggcatgataatgtttccatctcatttcgaagtgacactccagatcatgtgacattttgatatgtttccaaatcaatgtaacataggatagtattgcgcatgttctccaaaacaatgtatcataagagagaattgtgttattgatttgttagcactccgatggagctaattgttttattaattaatgcagaaaatgctgctagacaaaaatgcagcttttagggcctgtcagaaggacaggcattacatcgagaaattggaaacagaactgaggaactgctatcaggaaattggtatattcctttgtttctactctctctatttgctgttagtccgtgctattgttaacacaatgacttgaacagtttttgttggtttcaaatccagactatttgcaggatcagctaaatatccgaaatgttgaagcaaacatcatgggagagcatatccacagtcttgaactgaaactaactgaacttgaaaagtttcctgaaagagttagagttatagatgatgagctgatgcggtctgattctcagtgctggcttctgatggaagaagtccgatgccaagaagagaaattgaaaaaggcagccttacaaatagagaagcttgagaatgtaaatttggattcacaatgtgagattgagagcttaaaacttgatttaactacacttgaacagagactgtttgatgctgacagctttggtcagcatgtttctgctgataaagccatagcagataataaactgagggagtatgagctccagctgcaagaggcacataagactattgaccatcttttacttgagaataaagaactaaaacggttgttccctggaggagttgccactgctttaacatctgatgagcaagttgacaaaacaattgagaagattgatggtcaatactatgagaggggcggtgcaatacttgaaaatatggcaaagcgaagtgaagaatctgaactactgattgagcagctcaaggttagtttatgtctactaaatgtacttcggcacttttgctttccctccctctattctcccgctgccacgtcctaccggtgtgttaactgtaccaaaagtagctaatttgaggatgtatctgttccatttgttttttatttgaatagcttcgatcatttggtgtaatgtaagcattttgtttttaaatatgttaggaagagcttcgagaacaaaaactgaaggcaaaggaggatgcagaagatctcacccaagaaatggctgaactaaggtaccaaataactggcatgcttgaggaagaatacaagcgtcggtcttgcattgagcaggcagctatccaacaaatccaggaactagaggctcaggtactgataaataaataagttagatgtgtaaatgtagctagaaaaacgtaagtatagactacgtgaaatggttgccccatgatttaaaaaaccaagtatgttttagtatataaatataagtgaatttgacttgtacctttgttttgatatatctgtggcttatctagtttactttttattttttattcctgatgcactaagcaggtttccaaagagcagagaaaattgagtggagccctgaggaaactgcaggaatgggctgcaggaa

SEQ ID NO: 38835 - DNA, 2005 bp, Oryza sativa
  unsure (1)..(2005): unsure at all n locations
atggtgaagccggctagaacataggagtgctagatgatcacttttgcactcatgcgtgcagttgttgtagataattctttgtaccaacattgttatatgtaaatggggttaaatgcacatgtatttgtaaatcttagttagctgttttgttttccagattgctttttctagctttctctgggtgttgatttgctttttctagctttctctggtgttgagctccaattagtagtgaaaaatgtatgttaaacttcatgtttttttcccaagaaattttgggtgtgccatttgtgcagcaagttgaatgctgcatcttttccttagataatgctagaagaacatgcatcttaagcagtcggaccaccttggtgatgctgtgtgtgttttcagcaaggggaaaatccaaatacccccctacaagtcactgctctttctactctcccctctacaactcaatattgttcaaaacactacacataagttaatttctcttccaatttcccaccctatttggttttcacgctttctctgatgcgctcaatttctcgttatcgtgggcctttagctcagcccatgagcgaagtttcctcgtgccaccttggcggcaaaagcgcgcgcatctccatccgctcttaattctgcgagccatatgggtaggacgacatgacgctaatataaacacaggaaaacaatttctagtccaccagtgcaaaacaaccgtgtctgcctcctgattcgtgattccacatcaatatgaagaatggcaacaccaagtcaaaaacacattccagaatatttaagacatgcttattgaagtagaatccccttaaaaatcacaattcaaatctgatagttagaagtacagaaaattatttgtcgtaaaaaagatggtactgagattaagaagggatcagcatcccccactaattgtagctaagaattttgatgtaaataatactactgcataaaaataggagatcagtttctcctaatttgcagctttcttccagtaggaccgatataaggcccatctggcacatgatggtagagaccaacaccaaatgcattgtccatatatactggtggctgtgtggatgttgttggaatatcatctcttgaactagaactaataggctgggaattgctcctcttcttcctcctagttatttgtgttttacactgagagaaacagacaacaaattgtgagaagtagcaaagtacaatgtctttatatgataaattagtagtgtactcacattttgagatgaagaactttggttgtcttttccatgctttctgctgttatgaccaaactctttgcagacgctacatctaattgttgtctttgcaaccgaccttccttgaaccctaggttcatcagatgctctagttctctttgtttttggcctccctggttgtgtcctagccacaggtgggtctacatctggaaatggagttttttcccactgtgtctcatcaggaacgggataaatcatcccacaatatgtcctcgcatatgcatcctttgtcaatatgtcatcaacatagctctctggcctttgcttgaaaccttgaatagctgaaacaacatgcaaacatgggattccagttaaatcccattttctacacccacaagtgtgcttgttcaaatccactacatattgattaccaaatgcggacacttgccaaatgcccctaccagcacacacagatttgcaatatcttgcctctctcttctctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 38836 - DNA, 272 bp, Oryza sativa
acacatgggcatcataggttgaatggattgttggtaagtggcaaaaaggtgataaatgttgtgaaagtatcaaatccattaggtaataataatacctttttccgctttccaaatgcatgcaaaagcgcattgtaagaatgtatgtcaggtgtaagtccaaacttttcttttattgcctcaaaagtttcatatgctcactcaagatcccaaatgtatgcacaccccaatctaacacagttaagagcagcaacagatatgtatggcgaatctgc

SEQ ID NO: 38837 - DNA, 7628 bp, Oryza sativa
  unsure (1)..(7628): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagttgggacggtccttacccaattttatgagagcaccaatacatgcctcagacagttggtgattagtcccaggaacaaaactaacaagaagatcaacaacttcactagtggcagcaatctctgcattgtactcctcatccagtagcctatttagagcacgaactgcaggttcaacaacaaaagtagagcctgacgtcattaatgatatcaggggttgaaggcattcagaggcaatgggtgatgcccttatagtagaattctcaaaaagaatatagcagagctgagcggcatcattcttaagctccaatgacgaactgaaggataaaattttgtagaggctttcaagtgtagtgccttctacatcaaacaaagctgaagcctttgagatattcccagaagaaagtttgattagagcaccaagtgctgcctgctgttctgtttcagttcctgactcaagcatatcaagtaatggcggaatagcttgccaagccacttcagtgtctcttatattctctgaatcaaagaggttctgtaacgtccttgctgcattaagcctagaatttcttgagcccagacgtaagacagctaccaattgatttgaagtgctaattgaggattcatggtaaagaagatcagggtttgtgtataggatccgcagtagattgattatagtagtttcagttgagtcttgaggacttaaagatagatactttgttaaagcatccaagactccagcctctgccatagctactttatttgtctcactgccttccgctagttgagtcagaaggtgcaaagcaaccagaggtgcgccttgtctgtctggcattggtttaagtagatccacaagcaacggaatggaccttcgagcagtagcactcgtacggacatcttcaagctcaaaaaggcttctcaatattattttacttgggttatctgccaacttgaattcttcagccatagcaacaaggtttggcatagtagattcgatctgtccaatcatagctatagtacccataactgcaccagaatttgcaatagcaagctgtatacttctgcttccagtggaaacaaggctagccagtgactgagcagcaaagtatttgtcaatgatcttgtctgattttagcaacgaagctaaagaaggtattgttcgcattattgctggagattgaacaagcattgaatcctgaaataaagtagccaaaagaagggcgcaagtccatacactctctgagtcttcatattggtcctgtaacatggaatcattgagggccaggaatttgccatatgagacaaaacagtataatttggtaacataaacataatataattaaggaataagtaaagctatcatatctctggtgtctagaacgactaaatatacaaggactatcatgtttctggacaaaatgctcagaatcagctgattatatgtagatagctaatcaggatcttttttttcagaaacagctaattaggatcttgaccgtacaagtaaatattgaattctatttggatatattttatcttttatacagcttaggcgcttcaaagtaacaaggtaaaatggtgaaatcagggggaaatggcatgatgtatccctaatctctcaactcaaataatatagcagttccaaacagtaagcaataagcatcttgaatttaagccaactgattgcagttaaatgatatatagaaatagtatagcgagtataggcacagagaaaattagaaaggaaaggcaaaacatatgcacctgttgattagtggtgtagctagcaagtttatcagatatagtctcaacaccaccgaggtccataacagtaagtttactactcaaatgagaagaacaaataagtgagagcaaccaaagcgcaactgtttcttccaagacctttcctgatccagacacacccagaacatccttatcatagttatacaaactgttttcggggtatggtttccaaacttcaatatctagggatgttggggcagaatcttgcttcatcatatcaatggatgcagatattagattcttcagatgccctgatgcttcaataacatcaattgagtgttccctgctgtgtctcattgcagatatgagggtgatggcactgccaattcttatttccatgtttgttgattcaataactctactagcaagggaagcaatgcatccttgacttctgttcaaatgctcaccaagtagagaaggttggtcctgacataaacttgcaagaatttgaatggccttatcttgaatcggtggaagcccaacactgatacagcgcactaaaggctctaagctttctggaacatcaagaaaggcagaccacaagggagaactaaagtgcgcgccctccttggtcctagccatccatgcaagtacattcaagggatccaaattagtagcattttctaaattgatgccagatagacacaccagcagtgcatgaattataaaatagcactgcgagtaatctggaataacttcattgagggggaactggttgagcaactgacagagcgaccgtgaagcactaatctttccttccaagctcccttccttaagtactctagtcaaagccaggacgatgttgccgtctagtgcttccttggcaatatgtgcatctgataggaaatttgccaatgcagcaattgttgtttcagcagcatcaatggatggtgactttgacatctctataagagtttgcacatagccttcagctatgcatgacatcttgttcttcaacatggcattagccgagtgggagagtgctcctaaagctcgagcagattgtgttgcaataacttggttcccacttgtcaaaagcttcatgcatggctgaataatttcatcagttcctaagatatcacaaatatcctgacgggtactgaaaatatcagccaccacagttgcagcttgttcctgagtttcctcatttgatgactcaagaatatcaataagagatctgagccctttattggctggagctccattctgcactagatctctctgggaagccatcacaagtacatgcccaagaactgtaatggcatgggcctttgtactaagagagtcactaagcagcagtgctcgtaactgattaattgtggaggaatcagcagaccgtataatcttcttgagtgctttagctgatgcctcttgtccatgagggctaccactctttagaagccaaagcaatgcaagaactgccccagcactctcgacacatgcactgatatcatcactgtgacaacacaagttccacaagatatgagcagcatcttcttttgctttttgagatcctgtctccagtagctggacaagtggaggaatacctccagcagcggttattgcccatttactgtcatctacttcatcactcaatatagccaacaatgaaacagcatactcctgatgctgctcactagaaagcccaagaaatgatatcagcaattgagttccttctctctttcctagagcatcccatattccaataccatcagagcacaagctcgttaaagcatgaacaagatttttctgcacatcagcagaagccatagtgatcagcccaacaaggaccttctttgcattcgagtgattaagcctaccagacagacatgcatttccatatagactggctaaagcctcaagaatacgatcaagcacaagattactatcataggacttcaggagcacaatcaaaatattttctatctcaatcggatcaaaagatttaccatcagtgccactaaataccatcaatgtatatgcaagtgcaccaagaatgtcagcgaggggaacaggtggactgggcacctggcagagctctccaagataaagcaacagagatactgttccaccacagatatttgataaagcatgaacagcatgactttgtagagaatgacaagtatccccacgcatgcactcttttgaaggagctacaactgctccaatgagaacaggaatgccaccagcatctaccacagccttctttgcaatactagacttggaagatagagcctccaaagcatcggccgcactttcacgaactgaaatgtcattgtctcgatttaggaggcgaagaagagccttaacagccccggcatcaataattttggggatgctatcaccaaaggcagataccaaccgtgctaaaagggaggcagcatttgactgtgaagtagtattcttagatgaaataagaccagttataatttctactccaccagcttcaagattggccctccaataaccatctttgtctccacagagattccttaaggcaccagtgacaaaaccctcaactactttatcttggtgtgacttaggtttgagcatgtcccagagggttggcacaacaccttctgtcacaaatattttcatacctatatgatcatctgaaagtccaccagaagacacttcaaaaatagcttcagcagccgccttctttgcttcagtagattcagacttcaaaagagagagcaagggtggtatgcaacctcctaacaggaccttgacacgcaggtcctcttccttgcagagtgcgctaagtagtgctgcagcatttacttttgctatagatgtcccacttctaaggatagatataaatagtggaatcgcctgagaatggctacctatcaaaacccttgcttcctttttttctttggccagttcaagcaatcttttagtcgtcacttctttctctggtagagatgtcatgctagtatggagttgctccaacaattgagcaactgtggacattgcactttcaggatcatctacttccgcaagatcacttctatccctatatagcagagaagaagtaaaaatgatgattgcgataccagtccatcaaagtacataaataaatgcatgaaataaagagatggagaatgcttaaaataaacacaaggaattacaatatggtaatgtagaaagtccaacctggtaatctaactttgcaaattacaagattttcttgataattccattgtattaatgagaaaaaaagaagaagaagaaacgagtcaatgttataccttgatctagaagatgacgtggatggtgaaggtgaagttggttctcggtactctcgtcgctctgatgagttggaattcgacatgattaaatagttgcaacttttaccacctcaattttttaatatgaccacctacagtataatagggaagttatttaacataactttgccatggtaccaaaagagagagaggaaagttaccacttaatatcatatgattaccatgacaaaagatactcctgttacttcaacaacaaaataaaagatacatataaccactgctagcaaaaagaatatttgcatattcatgttcatggacactagtgaatggagaaaacaaagacctcaaatacaagatataaccattccaccaactccaatacagtctgttgaatagcaatgcaagaataatcaacctctattacttcaaagagccaacttcattcatgctgcagtagcgaattgcccaacactaattagctgcttcgccatccatcagtttttccctcaaatacacaattgccgtgatctgtgccccaccccaacccccctgtgccagcccatcacatctctgcttctcttctccgacctgttccccctcttcttccccagccaatgccacctccatctccccctcccatcttctcctgctcctcctccctctctgtgcctccacattgcccgactgctgccatcactacacctctccttgaggatgccacctatgcacaagaagcggccactgaggagcttgctgcctttaacgcgctgctcgcgtggcccctgtcctttagcattgacagaacccgctggcctaacaggcacaagattgcctgcgcctccccatgccataatgccacctcttaaaccacccgttcccgccaattaatctgccatcatgcacgctactactaccttgacaagccaatgccgtacgagctggagcggcagcatctacctctttgcactcagagggagcagaacactgagccagaggccatccttggcgtgactctttttttgcggggatccttggcatgactcgtgagacaggtggatgatttcaggcttgactgcgtgagattgaagatgaccagccccttaccagctcctcctcttgagatgcctcagcacttgctacaaatgatctcaagaaaacactagtgtatcgtccaatttcgcaagaaaaaagaggaaaggtaactcccactaacttcctcacctaccgctctaaataagaaaattcccctcagctcctgagggagagagaaagcaacattttattggaactttccccagctttgcatgccatcttctcaccgatctcatttcttatacacttaagaaatatgcaagaaaaattgagccatattttgggcattgacaatttcgattcttagaaattggcaggtccgaggccgcacggggcgacaggcggaggacctgcgcaggcgaaggcgcgtgcggcatcaatggtgggtagcgtcgttagggggcccgggtttgctcggcgctggagcatgcatggggaagggcaatacaccggccgccgccggccgaagccgtcaggatcaaacgaaaccaccgccaaatctcgccgcctctacctcgccggcgggccaccgagcgcgagatctcggccgccacgctcgtcgacacccccatcgtaaccaccaccccgctcagctttagtcgatcgaattctagcgcagcgtcgcgtcgcgcctccaaccgccagaaccaaaccgatgcgagattggcagtataggaaggaaagcgggggcgggactcaccagatagccggagacggtggccggaggcggcggtcgctccggcgaagtgtgcgcgtcacagcgcaggagagagagagaggagagggtaggggggaagagtggagtggagtggagagagaaagggatggcgttattgcggatcagtcctgtcgttttcatgctattctggaaaaggacagccggcttgcgttgcgttgcgtggtgagaattaaaattttaaataaatgtgaatcatcgtttccggtttgaaaaaagatgcgattgcaacagtagaagggcccggtacagctcttacctaggagacattgatagtgacctaattctatcatcatcaataactagtatactagtaatatatatgtggtgtaactttatgcaactatcattgtggcgctttattgataacggctatttttaagttatggatgttgagtgagtacagtaacgtttttacgttagagtattataacgtatgagatatagatttattgactttcaagactaagagatagccatgtgtttttgttgttttatgcaatagttggttatggcaaccatagtagccaaataaatc

SEQ ID NO: 38838 - DNA, 26372 bp, Oryza sativa
  unsure (1)..(26372): unsure at all n locations
nnnnnnnnnnnnnnnnnnnnnnnnnnnnnnnnatattgcagtttgatgataagaatcaaacaactgaaaggaaccgtattcatatgttatgtttctgtgtactcaccggtagatgcttgagcaactcctgctgtacatatcatatacaaatgctctaccatcctcacaaccaattataacctctggatcggcataactgtggaaagtggaaacaaatgagcattgggggttaaagctaacaaaatctttatcataaaacgtttggacagcacacgaccctacgcaataatcctgtgcctctgagattacatgctttcatgagcaattcagtaatttcagtagtatatgtaacatctaacttttcatttgttcgaaacaaaaggcatgtcattttacaaacttaaagcatgttcctcacctcatacataagccacggttgaatgaggctccacgagattgaaaaatacttctcggctcactacgtctccatatgcaaagctgggagctagtcaaacctacaatcttcacagaggattggaattttataacatgtaaataataagtctatagatatggtgtggttcataacttaaatcaaagttgtttgaacctggtttactgcatctccatgatgaatagaaaagtttatacaatatacaactattagaatcaccaattcagccaatgttattaagctgaagatgataatatagaacatccaagactacttatgtgcaacctaatgcacataatggtaaaaatcccaacctacaaagatttccaggacaaagcacagctggtgtttctaatgagaccataaccatctccagttttatatgcacaccattttcccatatgttgaccactatcgtgggggggaaaaatgcacctacaagagtcagcaactaagcaatcattctcattatgcttgttgaatctcactaatatataatcgaattgcttcaaatgttatattaataatacttgtaaggatcaatagcataaatagtctattttgcagtttccattcacattcgaaaaagaaacatagcactaaggcaaaggagatcaaatgcttatatctgcacaaataagatgtttaaatatgtggctggagcttctgacatataggtgagctactacaaataggccttcttgtacatagttacagaacacttggaatttcatatggaacttttactgaagcaagaatcaattatagcccttcctgtcaaatgcataaggacaaagctagtagcagctagaaattaagaacagaagtactgaaagctaccaacatcgattaccttattttcatcaaaatcaaagttgaccagcattttagaacttggaacaatgtactcattcatgtatttgcaactttcagcagaccaaagtcggagagtctggcaaaaatcaaatgccaagatgatcagcatgattataagatctgtgacggtattaaacaaaattaaaaaaaaaagcagtaagcactaaaaatcttcaatcatgctttcaattatctaaaaacttcgcaatgtactcaggcagccatggtttccacaatcatgtcatgtcatgtttcatctggcattctgcactactatagcatcacctgaatagcgagagtggaaggccattgaccatacccctattttttaaaaaacaaatataaatataactttttttttgtatactacatcactacatttctttttgctaaaaggacctaccaaaaaggtctaaagcacaaaaattattattgtactagtacaaacattaattatttgtgcctgttacatcttacttttttatttcaaaaaacagccatttcacattgatgaaggataataagaacggcacatgatgcaaggctcaccttatctccaactccagttaagattgaaccactcttcatgcggcatatggtggccctgaaacaagaaatagaaaactgaaagaaaaaaatgtggatattgagccacaatcccaacagtgcagctccagaaaagaagatacttgatcaaatcgaacaatatgaaaaaactaaaaagaaaatgtttgagaacacgagaactcttttagttgatataactaattcactatgcacaagaaacagcctaaatacagaagctcagcatagtacagggctacaggcttactggttaggatgaccaatccactgataaacttcagcaggacctctagagaaagacgatgcatgttcatcaagtgcaagctccttgaagtaactctttattgaagtattagaccctgaacttcttgcttgtggattcctcttgtaatatagatccctcatcagatgagctgtgtcaataactctattcctataaaccaagcagagtagaataagtacgtacaaattttaataacaactgataaattgcttggtaactttggaattttcacaaggaagatctggcggcatagacgagaaacatgcatgaataaaattaccaaatgaaactaaaatgattagcaccataaatgtatttgtcagtatggaaaatggtagctggaaaccagaataacactgaatcactgaattaatagtcaagtcacgaactactggacagagtatgaataatatccaaactaaaatgattagcagcataattggcatagttgtcaggacagaaaatggtagctggaaaccagaaacagcgctaatttagcagtcaagtcacaaaccactggacagagtatgaatatccaaagaagaaacacacaacactgattagctccccagaggtacatggttaagatgcagataacaaacaaatgagaggttaaatgcatcttcaacaaatgttaccatgacgaaaactcatcaatttgactagtcattcagtgttctaagcaacagttactttgaagcatatatatataccatttaaggaaaaaaggaaaaccgcagacccggagtattgggacatgcttcatagttatccacttatcctgcaacctctaggcataaaatccaggcagcagagttcaatgcaatgcgacagcagagtagtaattgaggctatttcttctaatctcgtagtagtagatacctgccgtattgtactgtaaattagagcaaaaaataaacatccccagcgaaacccaaacacaaacacacagcgtgcgtggtagcagtaggagggggaacatgggagtgaggaggggagaggagacgattcgcgcggcggatgggacgaaccatgagttgcagacggtggagcagcgggcgaggtcgaagtggtcgtcgaggcgggagaagacggagcggagggtgtcgtcgttcagcgcctgcgccgtcgaccccgacccgccgccgccgccgccggggcccctgcggcgcttcaatcccgcgctcccgctccgtccccggctgctgctcgtctccatggccgaacccctctctctctctctctctctctctctctctcccgatctctctggaggcgccgccgtttgctcgttggtttcacggtggccggtggccggtggccggcggcgactattcggtccttccgccgattgtgtggtggataacggcgtgttgacccagcaaagtcccgagtcgatctggcccaatggcccattacactgacaactaactcggtacatttaggcccatcaaattttggatcgctccatggtagtaacccaactcggcccaacttaattttgaatatgtaccatgtcagctatcgaacataaccacccgaattttgtagggaaaagtgcactttacagattataattcgtagccctcaatcacaaaacctggtatagcgtgtcccctaacttttaaaataagtgacatatgaatctcttggcagttttagacgatggtttcattctaagtgacatccagatggtattttgactttgtcatcattaacgtggcatgtgcatagcatttataataattaataaaagaacagtgtgatccacatgtcaatggcatcaccccttattcctcatctgcctcctttgtctctctcgcgatcctcatctcttcttctttggcaacgtcggcatgggaaagggagcagcggtcacaagagagaggagaaggttgaggccattgcagtggcaagagaaagacagttgaaggtagagcagtggcgcatctgccacgacctatagcaatcactgcggtgtagcctctgtaacgtggccgcagggttctcctttccttcgccggtgcagcaaattaaacgacgagttggatgaggaggtgaagaacctccatgaattgatccgttgactcgctcattcctgccggttcccctcaacgctctcccatgttaatgcgccgagcaacgcactgactctggttttgggtacagctacaaatgtgtgaggatgatggggagttcctaaaggttgcatgccgcaagttggagtcgatggttatgcaactatttgccaattatggatggaggttcacaaatatatttcaataaatgtgttctccttattttggcttggtttcctctgtttttgtttggtgtgtcctatttagccgaactatgctcttttctggattgctacaatgtaataattggctgtagctctttttgagcaaaggctgggatgttaaattccattatctaaaaaaaatgttaatgcgccgagcaaaatgatatggggaagagaggatgtagaggaagaagggatgatatcaatgatatgtgggtcccattgatttttttttaatgatgctatgtagacaccacgtaggacgataccgtcttccaaaccgctgagaaacttgatttacactggttttaaaaattagaggatgttaaatacctgttttacggttaagagacctaatcacctaaagtggactttttctaattttgtaacgtcatgattggtgtcgatccaactcgggccaactgaatcttgatctgctgttcagtgagacatagtgatagtgagtagtgacggccaacacgtcagcggtggttgatgcgttacggcccgaccaannnnnnnnnnnnnnnnnnnngcagcggctgatagatcggtgaggccaacgccgctaccaagaaaagctggctcctgcactaacctaacaagttcaggtagagagaaaaacatttctctctatatttttgcagttaacttaaattggtgttgtaatgaatagtatgattatattgcttgtttatttatatggttgattcatgcgcggtttggaattttgtggtgctgactcttgcatgtaattcaaagaagagtagagtgcggtttggaatactgatcgccagtttgaccatgcagatgtcaccggtttggccaaaagaagatcagatggtctgaccgcccttcgccttgctgtcacctgccaccgccttcggtccaaccgctgtggtgccatcagtctgactaccggcatcctgccggtgtgagactgccaccataaaaacattaattgaagaccttttaaaagtagattgaactttattacttttatttgtgttaacaaaatataacaacattactcctcacgctacaaaatataacaacattactcctcacgctacaaaatataacaacattactcctcacactaaattcgactaaactcgaaattctaacttttctctaaacttaattttcacaaaatccataccggtaggcctcaaccctctcactatttatgtccgaggttggtagcctaaaatcacgaatctaacttgtacaagatgttttaatccactaggaaactttcccgtataaaaaacaaatttatttcatcattcgaattctaatctttccaaatttggactcctttcaaaattgacttttttttccatatgcgcacgatctcccatcaatatgtcgtatgaaatctccatcaataatttgcattgttctttatcctaagcataccgcatgatatctcgactgatcgggcgtcatcttatctcaacttgacttccaattcatcaccgacaacgctctcctaaggcatcaaggtacacctatatatatgaaccaaacaataaaccatatccgagcataagttctttcccaacttgctctacattagcacacaacagtactacacacgtatagaaatcatctagaagtcataaccacaagatagttatgagtatccaaatgaacaacccgaaactaaccccaattaggatccagccgatcagaccatccggttggcctgtcagacctcacgtactacgctggtctgaccggtctacccgtgtccggtctaactggctccacacagagagcaccactttgtcataattatcaaatatcaaaataaattacatgtcacgccaactgttcatcataaattaataatcaaaaacacactttgattttacaaagacgatgtgaagttctatatcaatacagcaggagaagaaattacaaggttataaccctaaaaggatataaccagaaaaaagataaatcgtatcaccacacgctagcagctaataacacatccccaataaaagcactgacatcaaatcggtcgccgttgtgcttcttatatcaatgattttattctcgatattatatcactaatatgtgagcttaattaattacagtggtgcaggtgcagatgagatattgtctaggtgccagcttgataatcctccccactccaactaggacggtaccactcccaaaccggcaaatattataaaatttataaccgaaaagagaagacagttgtagacggtagcgacggccaatggatactgcctcttgacggcattagtccggtgactgcgccacacaaacctccagaatatacgcatcgtcgttacaggttcaacccatgttccgacattgacaaccaaaacgatgaggcacacgtagataaccatgaacacgatggagactgccctcgaggttctcatcgtggcgcgaaaagccgcaaagaaggccaggatcaggctgacgagcgagacccagataaagtgcaacgccgccacgaagctcttccacgagccggcggagcgcgatgccttcccgtagacgagtaggatcacggcgaccaccgatgccgctacggcgacggtgtcgaggaccatgaaccatttgaatgagaacctgcccttgaggttcgccgtgccgtcgtctccgtagctgcctggcatgttgaatccggcggcaaaggcgacggtggcgatgagcacggccaccaccgcaaggctgtcagttgtcctctctatccctttacctatgtcgcggccgctccacggctttagatggtcattcctttgtggtcggccttgtgccccaaaagcaactaatatcaccacaaagcttacctgcattgcatgcacaccatgaatatataccattaagctgagggcccatgccatcatctctgatgtgtttgggtttcgtcaaaaaatagtggtcagttatgactccacctaatttctaacgagtggaggcctgtcagtacatgtggtggtcaacatctctgacaagcctcatatatgtaagtgttttttttctaatgaagatcaatcataccaaacttctaagtcaagatgtattgaaccatttaatgcttgcacatatttggttattgctcaccatgttgaacaaattggtcgatgtcgaagcgagatcaagcggcgagtgtccatcgtcgttcaagacatcgctttgcactttccccttatggagtaaggcattcacaatgtcaggcgagccggcaaccacggcgatgtggagcggcgtgttcccaaccccgtcctgcgcgtccagaaggccaccgacctgcttgtgtttcttgatagcgagggacacgatcgaggactgcttctccctgaccgcggtgtgcaggaaggtctctccatggccgtcacggagctcaacagcatcagggcagatcccaattagttgcttgacaacattggcatgtcccaacctagccgcgacatgaagagcggagaggccatccgagtccttcatgtacactgtgccagttggcacgatggctaggattgcatgtacgattttgcggttgccgtcggatgccgcgaaatggagtggggtgctgccattgcagtcgacctggctagccagttctggcttccattgcaataataagtgaaccatctctgccaaagacacaaatttatcaatcgagttgacaaacacattcttgttttgtgcttgagatctgccgaatcaacatgagccgatatcttacctaagcttcggaagacggcagcatgcagagcattctgggagctcggcccaacgggtgatgcgtcgctgcaggtagtaactattgctcttacggcaggcactgacctgctcatcactgccaagtacaacggtgacacaccggctttgtttagctcggtctgtgaattagtttgggtggaaacgatcgcactaatcctgtgcgtcgccttcgtgttaatatatatgtgatgggaacagcccccatcgtggcgatacagagttcggcgcagctgagaacaaccgaagccgagattgatgaaacgactgcatgcagtaacagaaaacagaaaacaaactctaacaaacatctgttatcgcatgtggaggaaaggctaacctgatccgcatggatagactaacctaatccaaactaaccttaacaactacatgcatgcaagctatcaggtcgtcatcacatgatccgaacctttcatgctaactaacaccctctctcaatccggacctaaccaggttcagattgcttttgaaattctccaggagtcttactgacagaggtttagtgaatccatctacaacttgatcattagtggaaacaaaatcaatttctagaagtttctgacttacccgttctctgacaaagtgatagtcaacttctatgtgtttcgttctggcatgaaacactggattagctgacaaatacttagctccaagattatcacaccatattttagcagcttttggacttttaatctctaactctgcaagtaaagtctgcacccacattatttctgcagtggcattggcaatagctttgtattctgactctgtgctagatctagacacagtggcttgttttctagcattccaggagaccagatttgaacccagaaatattgcaaatcctcctgttgatcttctgtcatctaaacagcctgcccagtctgcatcagagaagccactaactaaagtagatcctgacttatgaatttcaagtcctaaccgagtgcattgctttaagtacctaagaatccttttcacagcaatccaatgtacagttgtgggagcatgcaagaattggcaaactttattaacagagaaagctatgtcaggtctagtaagagtcaaatattgcaaagcaccaacaacactgcgatagtgacttgcatcttcaggccctaacaatgagccttcatgaagagagagtttctcacttactgaaagaggtgtattagcaggtttacaatctatcatgcccactttcttcaataaatcattggcatacttgtcttgattcagtacaatgccattctgaaccttgcttacctctattccgagaaaataatgcagctcaccaagatctttgagtgcaaattccccttttagattctgaagtaaagctgcagtggccttctctgaagagctggctacaatgatatcatcaacatataccagaacaaacatagttatatcacctttattcagaaagaacagagacgtatcagcttttgatcctttaaaaccaaggtccatcaactttttacttagtctagagaaccaggctctaggtgcctgttttaacccatatagagctttatcaagtttacacacatgatgtggcttagtaggatcctcaaaacctggtggctgtagcatataaacttcttcttctaggtacccatgcagaaaggcattttgaacatctagctgtctaagactccaacctttagacactgctaaagacaatattattctgatagtggcagctttaacaacagggctaaaggtatcttcataatcaataccatacctctgtttaaatccttttgctactaaccttgccttatacctatctagggtaccatcagctttccttttaattttatacacccacttacagccaataatatttctccctctctgaggaggaacaagatgccaagttttattcttaactaaagcatcatactctgaatccattgctagtttccaatttttatcctttaaggcttctaaatcatttgtaggttcacctgaagcagtaaaccaagaatgcttatatttaatagtaccatcagtatataccttttctttgcgaactccactttgcaacctggtgcgcggtcctgccggtgcctctgaacctgtgtcagtcacatctgcatgctgtaatgtattagtctcatctgtgacagcctgtgcatgttcctgcgctggtgaggactgctcctgctcctgcaccacctgcgactcctgctcctgcaccgcctgcgacactgagtcttctgctgtctcctctgctagcgatgatgctaccccccgtggcacagaaccaggtgtgggacccggatgacggcctgatgacgtggccgcaggggagtggtggacgacacggtctggttctggaccaaaactggcatccagaggaggcgtcgccggcggatcttctgcatcagcgggatgtactgcaccatctctatgtggctcattagcacgattagataaagcagcagaaacatcagcagataatggattagtcactggatgcatgcattgttcattcccaacagaccgtatgggtcctagcagttcaggagtgagaatatcaatctcagaacgaagacgggcactagcattggcatgaagttcagtgaagggaaaaatattctcatcaaagacaacatcgcgagaaatatagatgtgtcctgtagagacctcaagacactttaaccctttatgcatagtgctaaacccaagaaaaacacaacgcttagagcgaaattgtaatttgtggttattgtaggggcgaagattaggccaacaggcacaaccaaaaattctcaaggaggagtaatcgggtttttgtttgaacagtttttcaaggggactaatattatggataactctgctaggcacacggttaataagataagttgccgcctgaaaggcttcatcccaaaactttaatggcatggatgcatgagataggagagataaaccgatctcaactatatgacgatgttttctctcagccgacccattctgttggtgagtatgaggacaggaaacatgatgaacaatgccaatcttagaaaaaaaagagttaagggattgatattcgcctccccagtcagtttgcatggctagaatttttctatcaaattgacgttctaccatgacttgaaactcctgaaacttgtcaaacacttgagacttatgctgtatgagataaatccaagtaaatttactaaaatcatcaataaaactaacataatatttttttctcccaacagactctggagcaggtccccaaacatcagaaaagacaagttctaaggggtgtttggaaacactggaagaaataggaaaaggtaattgatgactctttgcttgttgacaagcattacaaactgactcactagacaaatctgaacaggggaggctaaacttattgactacttgtttaaccgtggtaatggaaggatgaccaagacgatgatgccaccggtccaaagatagtttgatggcactgtaggcttgcttcaaggaggagtgtggtagaggatatagcctgcgccatgatcttcccttaaggagagtttttcctggtgatttgatccttaagaaagaaataatcacgatgtaattcaagaaaggcagagttatcattaactaagcgatgtactgaaacaagatttttcttagcttgaggcacatataaaacatttctaaggtggatattacgactattgggattatgaacaatagcatgaccaatatgactaatatccatacctgcaccacttgctgtgtggatttgttcaccaccgttgtatttttccttcatagtgagcttgtccagctctcccgtgacatgatctgtagcaccagtgtcgatgtaccaatttgtgtcaactccataggagttaaccgctgcagctgcaacatgcttggcgtcaggaacgtaatcctcgtcgtacctataccaacaatctgctgccgtgtgcccccgtttgaaacacacttggcagattggtcttttatcaacgcctcctggtgtgcggcctcgaccacggccacctcctccgttgccgcgaccatggccgccgccgccgccgccgcgcgaacctccttggccaccattgctgttgccacgccccccgtggctgaagcctccacggttggcaacattgacggtgacctcctgtgcgccgcggtagatggcttggcgagcttcaaagttcaacacttgagagtacagatcactcacagagattggttcaacccgagcgcagacagccgacaccacctcgctgtagccctcgccaaggccggtgatgatatactgaatcagctcctcttcatcgatcgggcgacctccggcagtagccatctcatctcctaaggatttcatttttgcaaaatactcaggagttgacatgttacctttctttgtattggtgagagcaaaccgagtgttaatcgctcttgctcgtgtgtgggtggagtacatctgctcgatggcgctccacacttcagccgcggtgtcgcatgtagcgacctgcatcagcacctctcttgtcagcgacgagagaaggtaccccagaacttgctggtcggtggcttcccagtcttcatgggctgggttcggctccttcttggtggcgccatcttttgtgacagcgatctctgccggcggccgcttggttgcaccggtgagatgcccctgaagccgcgctcctctaactgcggcgcttacttgcaccttccagagcgcatgatttgccttcccaagcttctctgagattgggtggccttggaacggatttgtggcagccgtactggacgacgaggccatgagtattgatctcttagggaattgatcaacgctctgataccatgtgaattagtttgggtggaaacgatcgcactaatcctgtgcgtcgccttcgtgttaatatatatgtgatgggaacagcccccatcgtggcgatacagagttcggcgcagctgagaacaaccgaagccgagattgatgaaacgactgcatgcagtaacagaaaacagaaaacaaactctaacaaacatctgttatcgcatgtggaggaaaggctaacctgatccgcatggatagactaacctaatccaaactaacctcaacaactacatgcatgcaagctgtcaggtcgtcatcacatgatccgaacctttcatgctaactaacacggtcgccttcgcacgtgccacgacaagagcctccacggtggcgccatgcccgtgcctcgctgccatgtgtagggccgtgtccccggccgcgttctggcatcccaggatattctcctcgcagtcctgggccagatttacaaggatcgtcacggtgccggcgtgccctgccctcgccgcgcagtgcagaggtgtgtccatcgccgagttccggcgagagaggagactattgtccctgatgaacctatggtagagctcctggatcagctcgccatgccctttctccgctgcgacatgaagaatggtgttcctctccgccgtcacctcgagtacgttgcactgtctgtgctgaatgatgcctgaaatgggtacgaggagaattaaatgctgcttgtatgatgatatactagtcaaatgtctgtgagttgcaacagaaatcaactttttgaacaaaagaagatcattattgtgtggcggactagagaaggagagcccatttctttttttctagttctcacagggtcatcccccctggttttctaattttttgcatgctaggatgaccgaggatagaggatcggtttggggttggatttttggatgatggcatcgtgggcggagatggtttcgcaagataaaataggtttattttattggtactaagacggttttgaaacatcagatacttagttttattggtatgtctgtgagttctaggcaaactgttgttttcctgacagggggtggtgggctcaagtaacagagatagagatatcataggcttgcatttctttatatattttttgaaatgtttcagtattgtagctaacatttaagggcaaatgtagatgaaggacgtgcatggatttgtatttaaaaatcaaacaatggacaattttgatttatgatagtagcactccatctctctgtgcaacaacctccttgattggggctttgcatctcgaggaaacatcacgtttgtcccaaacaactttggatatacttcctctgtttcaaatactcatcacttagaccctctttgtttaggcttaagcttcagtttatagccagaaaagctaaagcccaaacaaagggcaggctttttcatctggcttttaaaaaagcctaagccaccctataactaaaagccgaaagcccatagaaaggtgctttttctggcttttgtgggttggagaatatccagtgccattaaatttgataacaaattacccaccatgcaatccatttataattacggaacgaatcgttttgtttgaattctatcctcgagcgagagcgaaccaaggagccatctctccgccgccggcgacgggcatcggtggccctcttcctcccctaggcccctgctgctcttcttcccaactgtcatcagattcttccctgacactagcgccatcttcttggcagccttctgtgatcaaggtaattaagacaagcccatattctcgatggataaattagcaggtgacaatgatggaatatcagtatgatgtgttttattgcgtgatttgcctacatgatttatttagaccattaatgtagttgttacacagcacgaagttaaattgctgaatatctttttttttctgaatacattgctgtgcatctttactgcctaaacatttttcatgtaataaagtcatgtagcattacataaatcttactataaatcattaaaatgtgtttatggctgaatgtaaattgtctagatggatctagttcctcgatccaaggcaaattgggacacatttagcaacagggccttttgtgagatctgtgccgaggaatgtgaggctgggaatagacctacgggttgtttgtcaactactggctacaaaaatctacagctgaagttctttcagaggacagggaaaaagcatgaccaaaaacaattaaagaaccactgggaaacactaaagaaggaatacaacttgtggatcgaactgaaggaaaaatcaactggattaggctgggatccaattaaaggaacatttactgctgatgatgcttggtgggcggaccacatagtggtatatactatttaaacactttacatgttccagttcatatttacatttaaacttgtgctaactttgttcttttttccctttttagaagcaccctaatcatacgcattttcgtaatggaccaccggctaatctacaagaaatggacgtcgtatgataaagcttttgtcactggtaacagttcagctatacccggatcttactgaatttgccaagttatcggatgaaaaggcaaacgaagattattcttgcatgtatggctcttcacaatttcattcgagacagtgttttgcgtgatgaactttttgggagatgtgatctcgatgaagagttcgatccaaacactgaacaagctagttcatctcaagaaaatggtatcaatggattagcggtggatgatgaagacatgaatgctttccgtgataggattgctaattcactaacggcaacaagggcatagattgataggttaatttatatatatgtgcttgtattattttacttcctcatttgttgtcgtggcatatatgtgatcttattattttactaatataatggtcacggtaattgtaacaatataagatgatgtttgtgacgttactagcagatcatacgtacgccagaaaaatacatttgacaatgtccttagcttgtaaacaagccaccaaaatctcaggggtgttttggaccattcaatagttagcaaatcagccatcccacacaaaagctagattgccaaacaacacagtggagacttttaagccaaggaagaataagctgcctaactggaaaaacctggcataagctgcttatctataagcctaagcccaaacaaaaggcccataatcctatttactttttaattttcacagcttcctccccttttcaaaaagtttatatatacttgaaagtaatatatatgcgtcgtaccataaatacaaacgtgcaacttttataaattaatcatttaagtgttatcagtggtcaaggttgaaatgttgatggtcaataatgaaaagaaaacgaggatggagagagtatgataaaattatccaataatatcaaactttataataatttaaaccaagtcaaaatatattttatatatggtgtatgaattgaacttatactaatcttcatattacaaattgtttccacacgacattgattttgttgtacaagtcaaagtctctggattttttttatcaaaccaaaacttaccagggcaacacggtcatttggtgctctggtatggactatacgactctatgagcaaggatgtttacacaccttatacgaagtgttgatacgtgttacaatagtgtcatgtcaagaaaggaacaggtctgtacaagacaagagaggactaatacaattcaaagtcaccttgatgcatatcacatcacattcttggactattgggatgtttttgaatggatgattgagttaatagactcatggagcgatgaattacatactactccctccggttctttaataattgacgctttggataaggttgagatcaaacttttataactttgaccatcaataactttaaaaatatttagtttaaagaaactagaataacatatatagatttatctttcaaagcactacaataaaagtaaacatgtatttatttattgtatatattataatagaaaaataaggtcaaagatatatttgtagaccgtgtcattgtccaaaacgtcaattaaaatgaaaccggagggagtatatttttttccgagtgcataatgatataaaaaaacattaaaaaatgtaagacgttattaaaacattataaagttgatgattcctaccaagaatttgagatggcaagtgtttatttccataaacactttataatgtttatggaaattattggtaggaatcatcaactttgaatgattataatgtttataatcggttctccgtaccgattggagaaaattaagatggcaagtgtttcctttgaatgaacagacaactgcagtgataagctgtgtgtggttactgttaaattaatcaattaccagcgacttgacgatgtgctgctgcaccatcgccgggccgttgctgcagaagcaacgccatgacctcctccgctcgcccgctccgtgcagcgcgatacagcgacgggcacatctccatgcgaggcgcctcatcaccattcgacgccgccggctgatccattgatggagtatgcatgccgtacgtacgtgtcaaattaagcttattagagataaagaggatataaagtatatgctagtagtaactagctgtaagaattagctagctgcagctgcatgcgtgaatatatagtgtgcagctgatgaagctgggggaaagggatcgagatatttaccgcctaatacgtacagactgaatttgaggctgtgaatggcaatgcataccctcatcctggactccacaactgcaacctagctagcttcctggttgctgctgctgtcaatattgcaaattaagtctcttgttctctaccgtacccgggtcgttactcatgcgtagtatactatggctgtgtttagatcaaagtttggatccaaacttcagtccttttctatcacatcaacctgtcatacacacacaacttttcagtcacatcatattcaatttcaaccaaaatccaaactttacgctgaactaaacacttttctttttcatttcaaaactcagcagaaacgcatgcgcttataaaacgtgtgcacaggtacgtactccctataaacgcatatcctttttatataagtatatatccgaagattagaccaacatattgactcacaaagttatcactagtaccttgttatcgagggaaattaagtcactcactcccttcgattctataattcttaacattttgagcaataacactcgatctctaaaatatacatttgattatatttttgtaatatatgcaataaataatttttttttacttttattatactacaaaacaaattgtcgacgtctgatgtcacgactacagtatttggacagtatggagatcgttggtgttaggatatacgtgagactgaggtaaaagagacggagacagagatttttatacaggttcgggcccctcgtaaggtaataaccctacatcctattggccgaagccggtcgttgatcttattcaccataatcacactagtacaatatttggggtagcctatctaactgttgtcgacatggcggtctataggtctgactcgtagtcgacaacagggtagccttcctcctcgaatccgtatccggcgagatcagagacaacgctagatccctacggccggcctctgaaggtaccagatagggtcgatccaggcatatctctgatgtcggtatccggcggcttgtcttggcgtatgttggcttgtatgttgttccgtagattgtggtgggtctcttccttcatctctctcctcctagggggtcttgtatttatacacataggtgtccccttgtccaagtagaactagggaaatcaatatggatacaaatccgagtagtccttgtcgtttccatgtagaactctgattgtatttccttattcggaactccctccatatctgaaggttgtttccgtataagatatggtatgtggtgggtcctgccgagatttagtcgactactattaggtatgtggtatccataaccctgacacaaatatatagatgttgacttaaatattcttaaaattatttatagtgaaaattataaaggtttaatctcaaccttaacttaaaacatcaagaattatgaaattggatagactattacttttaaaaattaatcaattataaatacatgtacttatataaacacataaaaaatacgggttaaaccagtacttatatgaactatactagtactaggctactagctaggaaatcaggagtacctgtacgtccagaattccagaaagggacgcacggtcattctctcacactgtcacgcgcatcggagaacatctatctcgtcaatttgactcgtagtatttgcgtccaaatttttttgtttgacttgtatgcgtttcctgcttctgttggctttcttcgaaaagccggatgtccggctgccgtcccaaatgaatttgcccctttggatcgtccgcgtgtcgctcaattaattagaatcgtcttcattcgtggggttcagaaaaaagaaaggacaatgcacagggtaaaaggtgcaaaatatactagaatttctttttacggattcgtgaaaactatcggcagtttttttcctctttaaaactttctaaggccctgtttatttcagtttgaaattattataatttagattattgagtcagattactataactaatctgtagtagaataagcggttagttatttctttcatagattattagagcctagattattgggtttgcaagtctaaatagggagtggggtggcatgatgggtaatttttcacccaataatctggaaaagctcacctaaatgagtttatcagattattattaactgggctccagattataataagctactttaataagttgtctgtttctttcagcttacttccaataatttagattataataatcccaagctgaaagaaacaggaccttaagtcatctaccatctgattgcatcgagattcatacaacgaaggacaaaaaaaatacttatgtttttctacacatgctcgagaaggacccaaaccagcggaagcaggctgcgctagccaaccggccaccactggtagagaaatcatctttggtcggtcgacccaaattcacaatagtcccggttccattaaaaaccaggatttttagtcccggttaataagaggaagatctttagtcccgctaaaaatcatctaaagttcatttttagtcccggttgattccatgtcaggccgtgtcaggaccctatgatctttagtcctggttagtaacaccaaccgggattaaaaacctatttttagtctcggttggtgttactgatcgggaataaaaatcaaaacacactatataatccatagtaccgatcctcttttcccgtccacacaacaaactcctccctctatctctttttttcctttctaacttcttgtctctttccttatctctaactcctctcctctccttccttttttccttcacccacagtgcaggcggccggcgcggaggcggcgacgcgggggacggcacggaggaggcctgcgcggcggcgcggggggccgtgcggcggctgcggtgggccgccggcgcggcggcgcggggggccgcgcggcggcgggcggcgctggctggccggcgcggaggggaggaggggaggcggcagtggccgccagccggattttttttctttttttttttttgagatgtgaatctgtgatgtatttttgtgtgagatgtgaatctgtgatgaattttttagaaccctgtgatgtaattttttttaagagtttgtgatgtatttagagatgatttgtttgaggatttgaggatttggagatgttctgtgatgtgatgatttggatatgggaggggatggtgtgaaatcaatattcaatattaaaagcggaaaataaaaagaaaaaatatctttagtcccggttggtgttagcaaccgggactacaccaaccgggactaaagatgctcctattaacaccaaccgggacgaaagattgatttttagtcccagttatttgaatcagtactaaagatagcgatctttagtcccggactcgtagtcccggttggaaaaccgggactacaggggggttacaaaccgggactaaaaagcatttctccaccagtgcacaaatcatttttttcaattatactagttgcatataagctatattatagtcataatgtagttacaatctaattacacttcatttgcagtatatttatatttataagttttcaatgaaaagactatcaactgttttaaagctactcctttttttaaaaaaaaaatactaggaagatagcccgcgcgttcgcttagacatgcgcattagtttttttgaaaatagttttacaaaacaaattgtgtcgacgtttgatgtcgcgactacagtatttggacagtatggggatcgttggtgctaggatatacgcgagactgaggtaaaagatggcggagacagagatttttatacaggttcgggcccctcggaaggtaataaccctacatcttgttggccggagccggtcgttgatctttattcaccataataacaccagtacagagcgtacgactaagtcttccgtcttgctgtaatcgagaatttggattgaagtcaagaaattttatctcggcgggtacaccatctcttcagtccgtattccttgtcgagatccagcaaccgttctcgagcgatcgagaaggcgtagagtctacgacggagccttgtcgacatttgttgtactcgccttagtcgatcttggtgtagaaccatagagacatggagtcttcaacaatgtcgaatagaattttccagtgttttgtatatgagcgttttctctcttaccgactccgatcagtcagtttgtagagtcatgcactctgcctagccccgagccttgtcttcggagaatcgttctcggatgataaggctcttggacctttgacctacctcatttgaacaagcactgatcctagcccccagccgtgaagttcgaaagctcaatttccgattacacggcttggttaatacgcacggcgagaactcttacacgaccagatcttacatggtgttttgtctctgaaggatccgacaaggccttatcggctctgggtgtccccagctgaagttcccttaggttcctcggaggccttgtcaagacggcgtaaagggacagtaggataggttgcaacgctaggtgtcttctgtggtgagggatctctgggtaaaacacttggcgatcttgtgtacctgatatcaaatttgttgaagtagaggtagtaggagaaatcgctacatcgctggtcgaggaccaggcagtagtcgtaactcgaccacttgaagtggaagtagtgggagagacactacatcgttggtcgagaactgggcagtagtcgtaactcgaccactagaagtggaagtagccagagaaacgctacatcgctggtcgaggaccagacagtagccgtaactcaaccacttgaagtggaaatagtgggagaaacgctacgtcgctggtcgaggacctggcagtagccgtaactcgaccacttaaagtggaaatagtgggaggaacgctacatcgctggtcgaggaccagacagtagccgtaactcgaccactgaaagtggaagtagtcggaggaacgctacatcgctggtcgaggaccaggtagtagccgtaactcgaccactgaaagtggaagtagtcggaggaacgctacatcgctggtcgaggaccaggcagtagccgtaactcgaccacttgaagcaaatgtacgagagatcactacgatcaactggttgagaaccggtgagtaggtgtccctcgatcatttggagtcgtggtacgaggaccgctacgctgccgtagtcgtaccttgaccatctgaagtaaaggtgcgagagattgctacgtactggtgcgagaaccagtgagcgagcagaattatgtctcgaacaccgatggaaggtgcggtgcgagaaccagtgagcgagcagaattatctctcgaacatcgatggaagttgcagtgcgagagattgctgcgtactagtgcgagaaccagtgagcgagcagaattatctctcgaacatcgatggaagttgcagtgcgagagaattctgcgtactggtgcgagaaccagtgagcgagcagaattatctctcgaacaccgatggaagtgctagagttggtttattgcaagtgtatctcatgtagccagcatgactcacgtacccaacttatagcatatccggatgtccgttcgcaatcatgtcgggtgatcaagccgacgacgttcgcgaggaattatctgttaacaaccttttctcgagtagtccagccatggccggttctatgagataggtcatcgatcttcgttggcaggttgggtgcgataactccgcatttgttgagaatgttctcgataatggagtgtactcgaccataacctactcgagtgctcaattgttcctgaaaaatattttctagaaggcaagatatatagcagagaatatcgaatatgtacttaaaaaaactgcatggatcttctaatattatcacgatacaacaagcagatgtaaatatcagggcattatgtaaaccgtaaacaagcatgatttatacagaagaaaacagagcgagcccccagcgttagaccgtagttggcctatcgtcggaagtactcgcacaacggatattgtataaaaagcatgctctaggtaaacataataaattatagatctgacaatgctgtatgatctgaataggtacgataaattgcagataaaatattgtgtaccttagtagatacatgccggatgtatctacgaaattagtagattaatttaaaaaaccaatctaccaattaccttgttgcgtactcgttcgacatcatacggtctgacatctttttggtacgccgcgaagcttgaggcttgaatgatctcgatagaccaagttgttgacgacgatggttccgatctcgtcgggagacatactccggtcgggttggatgttcccacagcgaagtcgtcgagtagcttgttgtcggagagtccatcttttgaacccatctcgtcgaaatcctagagcaccaaaatccccctacctggcgcgccactgtcgacgtttgatgtcgcgactacggtatttggacagtatggggatcgttggtgctaggatatacgcgagactgaggtaaaagatggtggagacagggatttttatataggttcgggcccctcggaaggtaataaccctacatcctgttggccggagccggtcgttgatctttattcaccataataacaccagtacaatgtgtggggtagcctatctaactgttgtcgacattgcggtctgaagatctgactcgtagtcgacaacagggtagccttcctcctcgagcttatgccaggtgagaccagaggtagcgctagatccctacggctggcctctgaaggtaccgggtagggtcgatccaggcgtatctctgatgtcgatatccggcagcttgtcttggcgtatgttggcttgtatgttgtggcttctggtgggtgtatggggggtcttgtatttatacccataggtgtccccttatccaagtagaactaggaaaaccaatatggatacaatccgagtagtccttgtcgtttccatgtataactctggttgtcttttcttatccggaactcctcctatatccgaaggttgcttccgtataggacatagtatgtggtgggtcctgccgagatttagtcaactactattaggtatgtggtatccataaccatgacaaattgaaattaaaataagatatttttctatttttaatggagcgttcattatatctctttcttgtgaacaaatctcgacaaacttggtaataaatgtatttttttattatcctgctagccccctctttaattgcttcatatatatacaattcattatgcatttgaatcaataaagataaaaaattcttttaaaaaatatttattgtattttgaatttagtgattgagtgattcttatttcgaatttgtattcaaatcaaattattgttttattcaaaattgtctttttaggaattataaattatacctaatctcgtatcgtgttgtatttggactcttctttgaatacttgttttattattccaaatttcaaatatttataacttatggttttatatggactcttgttattttatattgagagaattacctatatggcactgaaaattcgcttggtttcttatatgccaatagaaaacatcaatctccttatatgccatccaaaaagtttttccatccctcttgggccactgccgtgagctctgttggagaaatcatccattggctggtcaagtttttatccaagtacccaccctacccttcttcagcattttccagcaagcttccatgaaatgaattgcagcaagcaagcaacgatgggctgggcggttgactacaatgtaagtagttgaaaactaatctttttttttattctcgtacaggatagctcaaaattttgagatgaaaaagtattgataggatccatgtcgggcatacatattgttgccgaatcatacagaaaccaaaggtaaaatggatgcccatcaaggcagaaataaccggagaggaaacgaaagaacgcatgagagatttgaagggcaacattgtcttttattaccttaattagcagcaaaccaacagctagctcacgtagtggcacgaaggggataaaaagttgaactcagtgacatataagggacccaacaattttcagtgacatataagggactgaggcaatttatagtggcatatagagaattttctctttctacatggaatcttgttatattttttatagttttaattatttttttaaaattttgtatgtgattttaatcaaattgcttgttttatctttttgttctgaatttaattatgaactccttgtagtgatccgcctgtcaccatcagcctcgcagatcattgtcaacctcctcaccagtgagcctctcttgatgcattggaaatgatgtggtggggctctttctagtccttgtcgaagacgtggaacgcctccctgtgccgctcctctcagtacttgcccttcacctaatcatctagcgtgctatttagggccaggagggctgcaggaa

SEQ ID NO: 38839 - DNA, 16306 bp, Oryza sativa
cagaacagtcgcattatcttttatatagtaaatatgagcaatatggatcttggattatgtatttaattataaataacacaaaaaatcaaataaactaagaaaagtacatgtaacttgggagccatgatcacttagctattatttttttcatatatatgatatattatgtgtcaactagaaaatatgaaaagttagatagaaaataggagatgagagttggatcccagaggtgagttgcacggtggagggagtatgcatgtacatgcgtgctcacatatggtaggggtggaggtgggggtaccggatttattttttgtgacatgtagtagttataattattgggtccacgtacctatttaaaggaaaatcgatggtttgattttttttatcataatttctaggttttttttaaatttatttgagcaccacatggtgttttaggagtgtttgtagaacaccatgtgacagattgagagcatttgtagggagtttaatggacttttagtacataatagatagttaatatattgtgtagttaatatattgtattgtttatgtactgagctactggctagaaaatatggataagaaagtgagcaagagagataatatgagatcatttatgatggcatgatatattttatttttataatattttattactatttagttgtgatataaagaagtttatgtcaaatgatatatttcttatatatgtacatgccaaaatatggtaaatttagttcaaagtaaaatcaaatatattataagatattctaattatttagttattgtgttttatatataaaattttgctactataaatggaagaaagaagagaggggtgggggagacggacatacgtacgtgtgaggagaggagtgagaggtgtggacgtaggtgacacttttttttttaacatatatagatttaatgttgtaaaatgatgggtccaccatattaaatgaaaattaatggtaggatttttttccttttttttggaatttcttagatttctctaatttattagagcgccacgtggtggcttaggaacgtttgtagaagccatgtggcggtttaagagtgtttctaggaagtttaatgaacttttagtatataccagatagatatttacaaaatatattatgtaaatatacatagagggtaacaggtgcaaaatactacttccgtcctagaatataaggatttatagggttggttatggttattgagaaagtaggtagaattaattgtgagaatgttgtgattggatgagaagtggaagtaggtgaaaaaaaatgaatgttagtgacgaattttttatattttatgataaattctaaagactataagttgttatattttaaaacggagagaatataaagttctcctcggttccaataatccgagacaggtgaagctctaaccaacggcgcagcttaaatttcatccatgctctctatgtcaagacagtctctttgctatcccacaaggctcttcagaaatatctccgtggcattctttactatatggtcccatgacccagtgtcgaacataattctcaatgtcatctagtatgatagtgtataccccttgctggagataggttatgatagggtataccctctgctggagatgagtgttgagattgataggtaatatgtgcttcgtatgaaggcccgctcccttgacagccttgttgccatggttcgtacaaccacttgtttaggagcataatgccctggaataccttagctaccagcagtgcaatctttatatggttttacaggtgacaataaagaagatatgctataaaacctatgatcgtgcatgctaagctaaaaaacactccaagcatttaaagattgcatcatttcttaagtctatgacttgtgatgtgttgtccttgttaactaatgaagaaacattaaaaaactataccattgttgatgcagctcttcaataagtgtataaaatattagaagtgaaaaactcatatatttcaccatcaatggataattctaaattatgtccaacagcctggaatatgcgggatgtgcgaatgactttatgcagaagcagaagttttttcatcaacccttaaaagaacggtggtatgattactcgaatcagcatacttgggtaattataatttaacccttgattacttgtatttttttagttgctagttttttttactttaagttgattgattgtttgcttgaatagtttagataatctatttttataggaaataaaatttctcgaactgctattgcaaaaatttatgtcatttcaatccaatttgggttaagtttatgcttataaaacatgctttatttgttttttatagaacttgttctaacttatttaacttatttataaaacatgttctaacttaattactcctgacggtctggtctattctcgtagaaatatatctttatctcaattagtctagtttgttgctagaattttatattagtttgaattgatcagacagcgagacacatggataatcactaaatcttaattaattagggacaaatatgatctatgtgataatggatagaagcattgttgtgtatgtactgctggagtataatcgttcataggctcatgcttggagctagtgggcttgattagtgttgtcgaatgacaagttcgtccgtcgaaggactagattcactctttttttagaagtattacatccgtcctataaaagttgaatttatatggaattaaggacataataggaggatagacaaataactaccataaactcatttaatgaacaaagtacatgcatatattccatatataaacttgattagaaggaaggttgagacaacgggttagtgatgggaaggaaggaagaaagactaatggtcccatattagtagaaatacaatttttatgggacaaaagttcaatggtagaaattcaatttttatgggacgaaggcagtattaatgtttaaaatttttttggatccctcaatacatgccccttagggcctatttatagacttagtacaaactcatgtgccctagggttatcaagtgcatgggaatttacatggctacccttataataggaacatttatgagggtaattgtaggtaattcagctttgggcttcttcttgggccaccaagtgggcctccataggccagttggccccttcgggtcctgagccctttgttttgaggtgaaaggtccttgactcgtggcgaagatcttcggctttgtctagcgatttgccttaagccttcgtcttcgtgacgaccgaaactttgctgccatgcttcgccctagcaactgtgaattggttttagcagacttgatcgaatgccttcatgacatgtctccaacaattaggattggaacaaagaattggttatcaattggcatacttctatgtatttctgttgaaattcaattttcaagtgcttgtaagaatatatctcgtctcaattaatcagttaaagatcacatatattcatgttaaaaaggagtatttttatgaggacatattatttggatagattgtggagtacattttaaccttatgccaccctacttagagcaggtacaatagcagctataaacatattttaaagagataaataaaaagaaataatagtctatagctagctgcaatacggactccaaaacgtaatgtgtgtatgacaggtgggaccaggtattaatagtatagtaagcaactatttaatgaattggctattacattagctatagatgatttggagctagtagtgggctataccattaaacttgctcttattgtgggaactagttccaaagcgtggtgtgaagaaaaacaacagtgggcattcaatgtcctaccacatcagtttcttggcatattataatgatgatccttcagtccgtgtgctcttcttcgctgaagtgtgggagtcaagcttgagcattgaactgcatcttggattctgctaactgaaagcactgctacatagtacataggagtgccatgtaaaagagaatgacattttcagaagtgtacatatggagctcgcatgtggagtaacaaatgtaaacatcacaataaaggcttacttatcaattaaggagccttattgttccttcaatattccttaaaaaaatccaccttccaaaggagccttattgttctaccacatactatgtaaaactctagtactcctaataactgatataatccatcaattacaatttcagttcataatatttggtactgaaacaaaacttcaacagtaataaactatggtaattggcatcaaatcaacatcccaagcctaataacagatagtccattgttcacaatctcattctgcataaataaatagcatggatccaacatccgaaccatggtctagtttagttcttaactttttcttcaaacttccaactttttcatcacatcaaaactttcctacacacataaactttcaactttttcgtcacatcattccaatttcaatcaaacttccaattttagtgtgaactaaacacacccagaccaggaataaacaccctgaggtgtgggtgtactgacctaaatgaaggtccccagcccctacctaggtcccagccagctcaatcaatatcaacattagtgtggagtgataaggtttcaaggataagaatgagctgatataagaaggcgtgaaggattatttgccagaaaaatatgtccaaaaatatggttaattaccaagtaaattttctgttgcttgtccatcagaagagctcattgcatcattaataacataacaagaatagaacacgtaaaatataagaaaaatattgtataggtagtgctctaattacataggtgcaggggcaggtgagatatggttcgggttccagctgcttgataatcctccccgatccgaattggagtgattatgtaccactcccaaaccagcaaacattatataagttatatgtaagaagagaagccagttgtagatggaagcgacggcgaacggatactgcctcctgacggtgtgagcccggtgactgagccacaaaaacctccagaatgcacgcgccgtcgtcacaggtccaatccactgtgcgacaaagagagacaaaacgatgatgcccacgtagataacaatgtacacgatggattctgccgtcgaggttctcatcacggcacgggaggccgcgaagaaggccaggattaggctgacgagcgagacccagatgcagtgcaacgccgccacgaagctcttccacgacccggtggagcgcgacgccttcccgtagacgagcaggatcacggcgatcaccgatgatgctaccgcgatggggtcgaggaccacgaaccatctgaacaaggacatgccctcgaggcttgccgagccgtcgttcgtgtacccgcccggcatgttgaatccagctgcaaggcaacggtggcgatgagcacggccaccaccgcgaggctgtccgaagtcctctctatccccttccctatgttgtcatggccgctccatggctcagatggtcattcctttgtggtcggcattgtgccccgaaggcaactaatgccatcacgaaccttacctgcattgtgtgcacaccatggatatatatgtaagtgtttcttttatatgatgaagatcaataatcatatcatataaaacttctacatcaagatgcattgggacaatgcatgcgcatatttggttattgcttaccatattgaacaaactgggcgatgtggaagcgagatctagcggtgtgtgtccatcgtcgttcaagacatcggtttgcactttccccttctggagtagagcattcacgatgccaggcgcgccggcaaccacggcgatgtggagcggcgtgttcccatccccgtcctgcgcatccagaagaccaccgacctgcttgtgtttcttgatggcaagggacacgatcgaggagcgcttctccctgactgcggagtgcacgaaggtctcaccatggctgtcacgaagctcgacagcatcagggcggatcccaatcaactgcttgacaacatcggcatgccccaacttagctgcgacatgaagagcagagaggccatccgagtccttcatgtacactgtgccaggtggcgcagtggccatgattgcacgtatgattttgctgttgccatcggatgccgcgaaatggagcggggtgctaccattgcagtcgacttggctagccagttctggcttccattgcaataagaggtgaaccatctctgcaaaagtcataactttatcaatcaagttgatgaacgcattcttgttttgtgcttgaaagctatcgaatcaacaagctgatatctcacctaagctccgaaagacagcagcatgcagagcattctgcgagctcggcccaacggctgatgcgtcactgcaggtagtaactattgctcttacagcaggcaccgacctgctcatcaccgccaagtacaacggagacacgccgactttgttcagctctgtcgcctttgcgtgtgccgcgacaagagcctccacagtggcgccatgaccatgcctcgctgccagatgtagggccgtgtccccggccgtgttctggcaccccatgatattctccacacggtcctgggctagatgtactagggttgtcacggtgccggtgtgcccttcccttgctgcgcagtgcagaggcgtgttcagtgccgagtttcgacgagagaggaagttgttgtccttgatgaacctgtggtagagctccttgatcagctcgatgtgccctttctccgctgcgacatgaagaacggtgttcctctccgccgtcacctcgagtaggttgcattgttcatgctgaataatgcctgaaaaaggtgtttggagcattaaatgttgttttcatggtaactagctgggtcgcccatgtaattgcacggctagcacccatgttaaattatctattttctaatatatgatattacttaaaatttgttaaatagccatcacgttgtcttagaaccttaaaagattgaaccttatcatcccttaatttttaattttattgtttttaaagtcacatcagtctctacctcttactctaattttatcacccttctatcttgttttcccgatttaccatggcttctatttatccttcttgaaatctttaataattgggccttctagttttcagagtccattgtctcgtcaggttctgttattataatgtttagaagtgtcgtcaaacatcgctattgtactcctctatgacccatccgttgtctcccctacttattgttattgggattttaaaatttgaacataattatcattggggtttatttttttactttctagaagtcccgccaaccgccaccggctccggcactatactcctgtatggcccgcccattgttgccttccctatttattattattgagattaaaaaaatcgaaaatgattgtcattgcggtttatttttttactttatataagtcccaccaactatcgtgaccttgctacctaacggtctgtgtgtcgtcctcctcttaatcgtcattgggattctattcatggttttgcttatagtttttagatgtccattaaccaccaccatcttactcttttatgagtctattgcttctctcctttttattgttatttgtcatcattgacatctagataaactgctttttttcaaaatttcatatttttcattccaatattttttttacttataaagtgtattcctacatgaagtcctataattatttttctatttttttatttttttattttgaattttaattaatctcgtattcagttttatatgaactcttcttacaatattacttatttttaattccgaatttcagttatttctaaattgtattcctatgtatgcatttatttatatatttgtttgaatgtttcaatgttgtagctaactttagggcgaatgtacctaaaagaattgaatagatgaagattagacgtgcacgtatttgtatttgaaaatggggacaattttgatttacgatactaacattacatcaatttgtatggcctccttcatcggcgctttgcacctcaagcaaacatcatgtttgtcccaaataacttcggatatactccctctgtttaaaataatactcaccattgaatactatttaccttttttactttttcactttgaccgctcgttccttttgtaaaaactttgaatatactcaaaagtatgagacgtacattagcaaaatatatatgtgttatacaataaatacaaccatgcaacttttataaatatgagttatatttggtacgaattgaactaatactaatctttatagtacatattgttcccgtaggacattgattttgtatctttgataataaaaatatcattgtagccttattgtaggacaagtcaaaagtttatggatttttatcaaaccaaaacttaccagggccacaaggtcttttggtgctcttgtatgtaccactagcctagttcccgtaccgttgcaaccaaaaaaaaaagagtttcaagcttatctattactactaatttagtttaagtaatactaatattttcttatcaaacaaattggtgattttaaaatttgaaggagccaatagtaaaatatgggatgacttgttgaaaagtggtgtaatagtataaattgtggagcccagctgctagtaataaagggtggcgaggaaatggacatcactgctactaacaactttttaagtaatactccctccgtcccaagatgtagctatttttagcacagtatcttgtcctaaaatgaagctatttcttcacctacctcctcctctcaaccaatcacaaccattcttctttacctagtttctcttttcaactaatcacacacttccttcaatcattctcacatactttcttaatacccgtgccaacctcaaaaatgtctttattttgggacggaggaagtatagatgagcaggatgtggaaaaaatatgaagttgacgtgttacgtcttcttgtagggtcatgtgtacgtcaagaaagaaacatgtctgtatacaagcaaagaaaggaccaatacaattctaagtcacattgaatccttgacgcatatcacattcctattgtgacgtttgaaattaatgattgaatagactaaggacagttgcttttaggggtgaattacatgttataaaatatactccctacgtttcaaaatatttgacaccgttaacttttttagtacgtgtttgaccattcgtcttattcaaaaaatttaagtaattatttattcttttcatattatttgattcattgttaaatatactttcatgtacacaaatagttttacatatttcataattttttttaataagacgaacggtcaaacatgtgctaaaaagttaacggtgttaaatattttgaaacggagggagtagtttagaacgagttatatgtaagcaatgctgattaatgccaatgagtcgtagtgacattaaatcatatttttagaagcgtaacattaattaattaataatgcgaaaacaatattcactggccattagccgaaaaagaacgcatggtagttgtacctatcgacacagtgaatgatttggatatatccaagtatccaacatagctggaatgtgtgaccacgagtcaccgtgatctcatggccaaccgcgaacgaaataatacttgccttggtttgttatacatgttggaattaatgaatgggccttagcccacacgaagattaattctttggaaaatcacaaaagcccacctcatgggatggcatgcatgtggagtttagtaccaccttgcttattctaggagagggggacctccttaaaagggaggatgtcctcctagccacttgaagcatgtgtggtggagagaagaggggaaacacgtgctcgcctcgcctcgcctcgcctcgcctcgcctggcagggcaggcggcgcgcgtgcacgacgtacgcgcagtagagtccgaataagttacgcgcgacttatccggttcggttacgcgcagtagagatcgtgcgggcgccctgatcaagcgacccttctctatataaaccgacctgccgtcttcacgcaacacttgcgaaatcaatctagggtttgcctcctactctgtactgcgccgtcgctcgtagactactccatcccgctcgccggcgtgcaccggcgatcgggagagcaggtctccggaacctctgcctttgacgttctgcaccgggagaaggcggcaataaggtttttgggaagcgcttcgcgcgactgctccctgtttgttcgcgacggctcgccttcctcttcgctcgcgtgtttcgtgccttcgtagacacctgcgaaaagtttcaaccaagcaaccggtctttacgtcacctcggtacgtgttcaatatgttgcgcatatttgatctgttcatattatactatgtagtttacatgtatagatctaatgatgcgttcatgctagttttcatctgtaatgtcatgatttatttatggaatagattaaatcattatatgtctataatatcaacaatacatgactaattatatgttcaagttacaatttttcatgtgttgtattattgtataaggttaggttagctattacccagccaataacttagaaaaagttagacagctgataaataatacaattgtatatacacttatatctttgaaaaaagacatccggctgtgttcatttgaagcacattggaaagaaaagctcctcgattaccacaccttcctgaactgtaaataatgtgttttttaaaaagatttcataggaatggtttgaaaattatattatattattttttaaatttaaaataattaatacttaattaagagataatccattatatgccactgactttgtcgcacgtctacgatttgccactgactttgtcacgttctacaatatgccatcgacttttgcttaacttctacgatttaccatcaccgtccggttagccaccgttagtactgtacaaatttatcgaaatgaccaaaatacccctatgacaaaaacttccaaaatttggataaaattatcaaaatattatattataaacataagattgtaaacatccaaaatttgaccaaaaacttgaaatatgatatttcataatttttatccaaattttgaaaccttttctcccaggggtattttggtcattttgacaaatttgtatagtactaacggagactaaccggacggcgatggtaaattgtagaagttaagcaaaagtcgatggcatattgtagaacatgataaagtcagtggcaaatcgtagacgtgtgataaagtcagtggtaaataatggattctctccttgattaatcatacactggtgactcacctcgttgcgaggatcttctacaatcacctcctctcaaacacaacagacctgttatataactcaaactatgtaaagagtttcacattgattggagagaatcaattaagatggcatatgctgcagtaaaatactctcttcgcaaatgaaccagactgcagcaatactctgtctgtggtttactgttaattaatcaaattaccagcgacttgatgacgatgtcctgctgctgatccagcgccgtgccgttgttgcagaagcaacgccacgacctcctccgagcggccgctgcgtgcagcgcgatagagagacgggcacatctccatgcgaggcgtcgactcaccactcgccgccgccgcaggtggctgatctgcggacggcgagcctgaataacggtgctgcgcgagctggactacgacatggtgatccattgatggagtatatatctggctagctatagctactgcgcgaagaactagagaggaatatatgcgagtacgaactagctgtggactgtggcagagctaggagggagatgatacggcctaatctggactgaatttgaggcggtgaattgcccggcctctgcaacccttccttgttgctgctgctactgtcatggcaaagtctcctatactctcaacagcgtgaaacaaatttactgcggtcagtttcaaaccaaacaaaaggtcttatcttttcgcttaggcttttatttatcagtcaaaattaaattttttaaccttaaatttggagctgattttaaggttttttttatcaaaatttttttcatcatttgcttttacccatatgcatatagacgttgtgtctagattcattaacatctacaggaatgtgggcaacgctagaaagtctaacattataaaacgggggaactagatagctaagaatacgtatataaaagttttattcacaaattacctttcgtttgcaaatatgctaagtgaaacaatggctccaaaagtgtagcatgtactcactctgttaaaaaaaatccaattctaaatatgtatatggacaaacacttttagaattgggttgtttttgacaaaaaaaaaatgtaaagaagtccagatctgaagaacatcttctattcatctcacccggttctagagatcgaatccccttgccctagaaaaagggacgaacggtcatttttacacacataggagaacatcttttactcgtatcgtactagtacattttgctttagaaaaattttcaagagctttgcttgcttagcctgcaatcctaaaaacatcgatatgtgactacctgacaggatgagtgtgtctttttatttaaaactctctctgttattttatttgacgttctagctcaaatcggatcagtgtttacgttcgcggttttgatcctagtataaaaaaccggaccaccccggcggttgaaccggaatcaggcctctcaccggttcggtttagtaaaaagaccgattatgcatttgacccaataggaacgaaccgggctagtaagaaccggcggttcactataagttcagctaacgcttgggctagccttataaggcccatcatcctactccacggcccatttacattttaattatttcacccgtttcttaatttggtcaaacatgtctgaagggtcaaataaagaaaaacggagggagtacgaaggataatccggtttttactctaaagaggctgaaggaggaggcattggactgaagagccacgccgacggacggtggcggtttgtacatagcgagccgcgtgcgatcgagctcatcgcgattcgaccgtgtgaagtccggcacgccatccctggatctcggacgaacggctatatagcttggttcaaggctcggaaggctggctggcctggatcaggtcgactagcttgtcttagcagtatccctgtttgtgcttaatataacaatcaatcagctatggcttggctcggttaaaaaggagagagagagagaatgaatttcgaattatgttgaaaattttcaattattacctttatagtacaatttatacataccccttttacaatatttcaaatccaaattaaaactatacatcaagtaaaatatgtatgaacaagatggttggtggaggcgcctccaatctcattcctccagagtaaaatatatacaggatggttttattagctgtaaaaatttccctttgatacccaaaataaactctctacacaatcatccttcttatatcaatgagttttattctgaatatatcactcatatctcactgacatgtaagcttagtttcatgcatgtcccatatattctcacatattctcacataagtgcgggggcagtgagatgttatggattacctgataatcttctaccaaaaaataaggcatcattcccaaaacagaaagttcatgtttcatttcatgttcaagttcacgatgttattcatgtttcattcatctggaagtttttgtttacattattcaagtaccatgcgtagtcatgggagtgcaatttggatctttgttcatgatccttgagaagcgttgattacgcttgctcggcttaccggtaatgctaagaggatattcatacctgcccgggagtgaactactatattttgacttctttgttttagaataatgtaaatccaaattttcatattggtttcttattgcattaaacttgtctatgttttactagtttaatgttgtacttgctgagtaatctttactcactcttgtgtttaatttggtttttaggtacctaatgacttttgatcggcatagggcggggtacgcggttacctggggtgttacatcgacgacgcgagatgtgccagcaaccagatgcacatgctggttgcgaaattactacctgtttggaataacttaaaattgttaaactttgattctttataatatctcacttgtccttataacaattaaataaagagaaccagtctatgaaagtaaccaaaaaccaataataaaatctaatagtctcgtgattagacaatgtggaatgattttagaaagatgaggttctcttttaaaactccattgcaacacacgggcatttagctagtaatataagtagatttattatcttaccaataggggcatcatacaaagtttgaaactaaattagatgaaagttagacattaatttgtatagaaaatcacacaaggactacacatatttgaattctatttaaatggcgatattaatggctaatttggcagagctccatgtctagctccatcctggagctggagcctaaccaaaatggtcttatgtccacctaaaatgggagttgagcgagctaattaaaatgctctcacaaaatgagttagagagatggagcgggatttaggctgctccacaactctattccagacctagctcttaaaattaaatttaaaaattgaaagctctgccaataagggtggattcaatgtagatgccggggggactcaagtctcccctaccccactagatcaccattgaggtaagaagagaggggagtgggaagaagagaaagagaaggaagagtaaggtggcttaaggaggaagaatgagataaacccttctctattagaattatggatccgtccctgccggccaaacaggtacggatactccttcatacaatctcatccgggggtatctcaaggaaatcaaggttgtgccaagtaactttgggccattcagctgtatataaggcatccaagtctccaaaaatatcatcaaactttgtaatagtttatacaaaagattaatcataatgtatatttggtgcagatagtaagcttcatattaaaaataactcacacaggatttttatattgtagctatcatagtaataaaataatgtaggacaagtcaaagtctaattaaggattacagtggaacgaaaacttgcaagtgttgttgatctatgagcatgacgtttgcaggttgcaaccacgacattgctacatgttccaataggattactggaggccttgtcaagaaagatacagctctatatgaaaaccaagattttttttttgagaacttagtataaaaaaccaagataagaagtccaagatactcctatatacttctacattcaaaaccaccttgatgtatggcttgatgttacgtatatttcccaattcccaaaacaagccagctagcgctaacacctccatttactagaagatatatacggaccgctcaacatagatcggatataggaaaaaataatagtagagattaaacaaactaaaacagatccgccaatggagcatgttccatagtatagcacactactacctccaattcatctatagccaatttaataaccaattcatacaatagttgcttactatactattaatatatggtcccacctgttatacatacattgtgtcttagagtccgtgctacagctgcctacaaatctgtagcccactgctcttctctctcatcgtttatctcattaaaatatgtttatagctagctaatagcctgctattgtacctgctcttagaagtacacaataattttactcttgcctttagtccatctaaaaatagtaaatctaaaagtagctgtgttttagaataaatggagtataataagtttaggctattcgttgcgcaagtttatcaagagaaaaaaaattcaatgaagaagagtcggcagtaaactcgagatctgtgtgtgctgttaatattacttaccagcgagatgatgatgacgatctcctcctgcatcagcaccgtgccgtcgctgcaggagcagcgccatggcatcctccgctggccctccgtgtgcagcgagagatacagagacgggcacatcatctcgatccgtgcgacgctctgcagacgccgaagaaccagctgccggcggctgctgcggagggc

SEQ ID NO: 38840 - DNA, 19014 bp, Oryza sativa
tgttgaacactgttgaagtgtttgggcactgtttcgcactgtgcaacactgtttcgtactgtgcgtggggcgcttccgcacattggaaccgcgggattgcccatgaacagtgacaaaacagtgacaaacagtaaaaaaaacagtcctaaatagtgccacgcagtataaattcgctgtcatataataagcgcgtggcagaggacgggaacgagccgtcccgcgcaaccgtgacgcgcaatcggcgcggtcccgcgcattggcgacgcgcgaccggcgcggtcccgcacaacggagacgcgggaccgtctcgggacgcgtgggcgcgagagggaggcggtgccgcacttccgcgccgcgggagcgagacggtgccgcatggacgttctgcgcgaccgccagtcccgcggaatggaagagcggcactactcggtcccgcgtccccgccgtgcggcgaaggtatatttgtgcaaatatttttcatgcagatatataaacataaaatattaaaaaaagggtatattttcaatttttttcccggagggcaacgcgagagctggactacatgtcgactacgatccattcaataatatgtgtagctagctaggggataaattaattaaccgcctgatcaagactgaatttgatgctgtgaatggcctcaccaagtgttctatgctcctttgctcgatctatatgcatgtataactatataaagcggatctattatctaaaaaaaactataaatattaagctgatcaagtcgttatcaggtcgtactgcatacgcttgagccaggattaatgctatttttcctacaaggaatacgtggaaaaaattttggaaatatacgtgtttttgaccggaattgcaaaagtaggttgattaggggcagttttgcggaaatatactggcatcgcgctttgaatgtgcgagagcgcgatatcatcgcgcatggaatgcgcgaaagcggcggcgctatcgctaattgagagggagggagcgctaatgcatcggtctcacattcggaaagcgcgagagcgaagtggtctcgcacttttagcgtgggccggccggccgacgccgcctgacgcactcgggccaggaagcggtctcgcactttgagtgcgcaatagcgtgtgcagtatcgcggtcggctcgcgtgagaccgtagcgacgggggccgtctgacgcacgtgggtcccggagaggtctcgctctatgtgctagcgagagcgcggtcagtatcgcgctatacgcgagcgagagcgccaggggtatcgcggtcggctagcgcgataccgttgcggcgtggcccacccctaatcagctgctaatcccgtgggaggcgacagcgatggcttcggtctcgctctttgaaagcgcgagaccgcgagcgatatcgcacctcgcgggcgtgagagcggtgagctaattgcgcatatgtggccttctcgctttcgcgcatgccgcgtcaccggtctcgcgcgcgcaaagcgcgataccgcgtgcccacatttcccccgtcgcgtcactctcggtctcgcgctttcggattacgataccgaccttggtctcgcgcaacgaaaaagcgagagcgatggctccgcctgaggtagtttcgtggatttctccacgtggcgttctcgcgctacggaaaagcgataccgctgcagtttcgcctttcgcttccgcgataccgccaactcaacttcgctttcgctctttcacatcgcgatttcgccacgttatcgcacttttcagatgcgaacatcagtatcgctcttccaaacagcgataccgatagtatatttccgcaaaaccttcgttatccgatatatttttacaaaatcaatggacaaacagtatattttcaaaaaaatttcggaatacgtgtcctaaggttccagcatctaggaatcagccagtagtatatatatgcgtccagaaatatctgatcaatctgacttattcttaatataacaccaatccttcaatttttcctaccctcgccttaatatatggactagttcttgtccgccatgacgcctcgtcacactcgcaggtttgcattgcatataagtcgataaacacaggtaaccatcattggggcccaataggggatcgccacaaagatggtagttagtggtgccaaggggagttcggccgaaccacctccaccgtctctggccatcgcatttctcctgtatatgacttgtgggcccggcccctgaggtagttgacgatggtttggcccctcttaagtcggtttatactgtcatgtgggtcctccgatccttgtactcgcacataattggtcgaagaacattttcatggtatattgggtgtattttctccttaattaacctgcatatatatatatatatatatataccaaaactagtggaaatggttagtaataaactcctaccactaagttttgatagtatatttgatatcttttatgtatgagttgacggttaaagtttgcacttaatgaccgtcaacaccagcccacgaattttgtggtgtgggccagtactcgggttggttcattggagggtgaggcgcgatgctgctcggctggttgccgccaccaccaccgcctctgccgccgcgacatcggtgattgcgagaagaattgttcccacagccttgattctcgttggagccgcatttgttccctgcaccgaaataggtggcgtgggcggggttggagccgacgagcagcttggcgaaggtgctggcgaggaagacagtggactggtcggtgtgcctgttcgccttggagagttcctcaagtagaagttgagagcgcacgtcggcgaaagacaggaatgggcactgcatcgttattaaggtttgcatattatcaaacttggagctccaactgttgagggtggtgacgacgagatagcggttcgtgacagggtcgccaagggagtccgccatggccttcatcttgcggcagtagtcggtgatagataggtcaacttgatggaatgtgcgaaactcaacagagagattgagcgcacgtcgttcactgttgccaaggaattgcaacttgagcactcgctagatggagtgtgcggttgcggtgtgcgacataacctcctagaggagaccggcagagatggagccgtacagccaccagagaacaatgcaatccatctgaagccagtcggagtggtcggggtagtaagcgctgaagagaacgtggtatgccaaagcatatttgccaagagccacaatgaagagggagtgagggactccagagcgtcgtgttgtagaagccggatgcagatggccctacagcaagacgagccacggcgaagagggactccaggacaggcggcagagaggccgcaccggagggggccgaggagatcggtgggggaatcggcacggtggataccggaggagtcgtagtgtcagtagtcggtggtggatcaatcggcgctggggatgtggaggaggaaaagagcgaggcgaaggcattggtgatggcgtcgtggggggcttgagaagcgtgcttagcagcgacgttggcgatagtcgaagcggtgcctggatcgacgtcggtagaggcagaggtagtgaaggagtcgcgcaccgcgtcggcgatggctttgacaaccttctcaagagcggtgcttgcagattcggaggaaaagggcaacgacatggcgtcgtgcggcgctaaggagagcacgcgggggtttgggtttggagtggagcgaaagcggagatgaatctggtaccatgtgggaaggaataactcaacgcaattgtattgatcacggagtgtttacatatataagcccgtccatataaccactcaactaacttatagcaacagaatcggaaggataaggaacagggatttgaggagataagatacatgcaaacagtatagtctaacaatatatatcatatatgtacacacaaatacacaattgtcccagaaaagcctagacgttattatccattaagtcttatagatagatatagaccaacgatcagatgtagccatatatgcacgatgcagctatggacttgaactgaccagagcttaatcagctttttgaaagtgccaagaaggcaccaacgtatgccaagatgtttgtgacaacgaagacagaatagttacgcgagtaagtgccggcaaacggatactgccgagcgacacgcctgtgatgtctctcaggcaataaactgctgaacataaacttcacgaagctgatccacgacgccggcttagtcaagatcatgatgctcaagaccaagacatagatcccattgattatgacttcgtatatcacaatattgattgtcctccttctcatgacggcgaccagagccgcccagaaagccacgatcatgccgatcatcgaaacccacatgaagtgcagagctaaaatgaagctcttccatgaaccagatgctttcccatacacaataagtatcactgcgacaacggaagtcgtcatggcgacgctgtcgaagacgatgaagaatttgtaggcggtcttcgcctggaggaccgccttgccatcgtccccgtagcccccgggcacgttgaacgtggcggagaaggcgacggtggcgacgagcacggccacgacagcgaggctgttggacgtcttccttatccaatctgttgtgtcattgcctctccattgattcaggtggtcttgcctctgcgggcaggattgtgccccgtaggcagacagtgtcaccacaaggcttatctgcaccatttatatgtacatgatattactctcatcgagtaaataatatattaaactagtttagtttaccaacattgcatatatattggactagggttaaactaaatattcactttagaccaggtatcttctctgcttgttctcatatctctcttcttcctctcctttttcccggattcagtctcaaggagaagatcagaagactatgagagcaagtacaatagcagcatataagccagctataaacatattttaaagaggtaaaaaagaagagagaatagcagcgagctacatccctgtagccagctgtagcacgaactctaaaacgtaatgtgtaaatgaaaggtgggaccagatattacagtagtatagtaagcaactattatatgaattgactattaaattggagcacatagttggctatactattaaacttgctcttaggctatgttcggcaccccttttcccaacccatctccctcgttttccgcgcacacgcttttcaaactgctaaacgatgttttttttgcaaaaagtttctatacgaaagttacttttaaaaatcaaattaatctatttttaaaaaaaatagctaatatttaattaatcacgtgctaatgaatcgctctattttctccatgctcactgtacggctgccgaacacagcataatgaagaagaaactcttctgtcacggatgtgcgtgcctacaggtactccaaagtgcaaaacttggtaatagaacatggtttaaagtgaaaaaaaaaaggcaattccgttatccaatataagatattggtaataaaaattggtccaaactgtaatctactccatgcttatgagccaaatgttacataacgactagcaaaattgagttcaccacattaaagtactttttcaacatactccaaactagagaatgttcgaggaaaattttatgttaactacagaaaaatataaggatataaccatatattgtccacttgtagcaccaaattgctacagatacagagaaattaattaaaattaagaataaagaaagaaaggaaactagtgcaatatattgtataaactaatttctacactaaaaattaatattgaaatttggagttgaaaaactagtagacaataacaattgcaattcgtataagaaatcggcttgaatcataagaattaattttgaaatttaaatgataaaaaatagacaatattattgactctaatttcatattaatcaacttatatatgtatcataacaatttgtatcttaaactatggtaaaactccttattttgtaaaacttagtaattactactcaaacttagtaaaacttaataattaactctggtaagaaaacttgatttagaactataaattatatataaacaacagcaaaatgatttatgtgcaccgatgcatatttttcatgtatacaatttgaaatttaatcgttctaaagaaatatgcatatgaatatgtatttgaattgaaaacaaatatgcatataatatgtatttgaaatgaaattaacgaaaaaaacatatataatagagtgcttttctacaacaagtatataaaatcataattaatatcagccaataaataaaacatcctaaaaaattccaaaatggcatttaaatagatgggttataggagaagttaatttctaccaatataaataatagattttgcactaaagttggagtcttttatattgtacaagttttgtattggtgaccgagggcctgacaaccagctgacagcaaacgctaatattacatgcatgttaacattgatgctatcttaatggttcaaaaaagatatcttttatgtgaaagggcctgtaacatagttgttacatgagcctcagcagtagtaccttaggtcctgggttcgactctccatgcgagcgaatttttcatgatttaacaacttcgtgctttcggtgtaggcaacgtacccgtcaacagcgaagtgcctgtagtggtgacttcgttaatctcaaagattttccggcttgccggcccagtcttcgaaaatgcttatatgggtagggtttgcgtgcgtgtgttcttagagatgagtgtgcatgtaattctaaagaaaaatgattttttatagtaaatactcaatgtagttagagttgaccaggttacaaaaattttctggataaaatcatgacgagttgtagatagcaaattttttttgtttgcttaccatggagaggaagctagacgagttggcagcgagatcaaacggtgtgtacccatcgttgttcatgatgttgactcgtacgttgtctccggcggaaagtagtgcggctagtcccttggacgcggctgcagccaccgcgaggtggagcgccgtgttgccatccttgtcctgcgcgttcacgatgccgcaaagcatcgggttcttgacggcgagcgagatgaccggcgcgtgccctttctcggccgcggcgtggaggaacgtcctgccgcggccgtcgcggagctcggcggcgtcgggccaggcagatatcagctcctcgacgacatggtggtggcccatccgcgcggcgacatggatggccgagaggccgtccgagtccttcaggaacgccgtggacggcggcgcggcgcgcacgatcgcgcttacgatggagcggtcgccgtcggacgacgcgagatggagcgggctgctgcctttgacgtcgcattgtccagacagagctggcttccatttcaataccaggtcgaccatttctgcaaattaatgaacatgatgtgacatttttgctcatgcgcttgatagctagagtgggtgttaagcaaatgagatcatgacctgagatctggaagacggcagcgtgcagagcattctgcttgttcggcccaacgggcgatgcatcgctgcacgtggtaatgatcgctttcacggctgtaaccgacttactcatcaccgccaagtacagcggcgacacgccggcggcattcagctcggaggacagctccggcgccgccgccgagacaagggcctctaccgccgcgccatggccgttcctcgccgccaggtgaagggccgtatctccggcctcgttcttgcatcccaggatgctgtccagggccagcagctggacgatggccgtgacggccccggcgtgtccggctctcgccgcgcagtgcagcggcgtgtcctgcgacgagttccggcgagagaggaggctgctctccttgaacctgaggtacacctcccggatcagctcgtcgtgtccttgctccgcagccacgtgaaacacggtgttactctccgcgctcacctctgatatgttgcactggccatgccgctgtagaacacctgagtaatttttttacacggatattggattaagcttttagggtaaactggtcactaacggtaattaattcagagttcggccgaaaaatgactcaaactgtgttcggcccctccttgccgtcacacaaaacgaagcacttattattgcatgattaattaagtattaactgtttttaaaaaaatatagattaatatagtttttaagaaagggggaaatttcagcaaatactccatatatccaaatcgatcatccgcgttcttccttgtcggctaattaagtagtatacgtactaaattcttacttcatgatatgaatgcattatgcatataaatattttataacttttccatctatctaaataaagaggtttgttacggtccagcagatagtacctcgaggtactagtaccaccaggtaccaaatgaaatccaaccgttgaattagcagggcacgataggaaacgaattgaaaaggggcggagaaggcccgtgacacacatgcgcgtgcagatgccgccgcaatctcctcgtcctcacgcgccaacgggaaaaaaaatttggtggagaccgggtgtaaaccggctcccgtgcagccccgaccccgatgattgccgcgtggcaatcacagaatcggacgtctcgctatgcatggctccaggcgcagcgcaaacaggatggaggagccgactcgctcgatggctcccgggcccgtcggctcaccggctcaccggctcatatcacatcgatatctcttctcagcagcagccattgccaccgacacaacctctctcatccgtcgtccgcatggcggtgatagcgagtggccgatggcgaccgccctgactgaggacgaagacgacacagcgccgcctgggacgaggttgccctgtttgccggcggctagtgcagagatgtactccatcttcctgtgggcagtagctgctatctcttcccgatcacgggcttttttcttaccatggtgcaggattgatttgattagttattagtttgatttgggcctctgcattcaaactttaatatagttgttaactgctacatttcaatggatgcagtctgaatgtttgcagattctaattagatttgacaaagtacaatattgattttagtcctctaccatttcgatttgatacatactgaagattttggagacatgagcatttcatttcttcatggtcacttggtcagtgcatatatttccagggccggtcctaatattttaggggcctagggcgacacaaaaattagggccctatattgagttcgttttttttaattgtattaggtgccagaattgaagaaaacttcattttagagtagcataagaaaaacagatttgcataaaaaaatttaatcatagtatcttaaacttatcatattttatgaagattttccaatgtagattaatttgatggttagaattttaaatatgtatggcccgatggagtaatttttacaaatctagtatttatgggttcaaaatcaatatcagtgatcctttcaaaaaaatcaatatcagtgatcccttcattaaggagtagtagcactaaaattgttgataaatgataatcaccttggccatcagcctataggcttgcttgaccaatcaaatgactgctctgccttctatagctacgcgtatgggcctcaataaattaaggggcttgtgtttttacgctgttgttggattgcaaagcagacgatgcgatccactggaaatcaacgaattgtacgatggcaatagcaaacctacttacgtatacctggtcagggggcccctgacttggcggggcccagggcgcttgcactgctcgccctgccccagggccgggcctgtatatttcagtaaaagactgtcaagttcagttgaacaaattaacatatcatattctggccaatatgtgaacagcggataaagtaaatggcagacttttgtttaacaacaatgctttactaatattatctagtacctttctgtctctctgaacaaatttgctccaaattcacgctacatttcttgggtttcatctatataaactgagaatctgcatctatatacatgatactgatagtgccactaacattttctgatggcataatgtgcagttcaagaagatgagtgacaagaccgatgtgtacagcctccgtgtcatcatcctcaacctcaatctccttaccggtaattaagtttcttgccgaaacgaaaccatgcatggagttgccgcagtgggtgtcgtcaattgtgaatttgtgatgaagtggcgaacgagccggttgccctcgccatcaccgccgagaggacgacgtctgagagagggagcggtggcggatgagagacagtagatgagagaggcgccgctggcagccggcgcggcggcgactgcggacgaatgaggccggtaggagagggatctgagcccgcgagccggcgtgcccgggagccgagtcgagcgaggctcatcttatttgcgctgtgcctgaagccgcaacgagctaaacgtccgattctacgattgtccacgcggcaatcatcgggatcggggctgcacgggagctaatttacacccggtctccaccaattttttttcccgccaacgccaatatccttgccatcatgcgtgctaacttcctccatcatcgccgccaaatcctcgattccatacagccccctccagcgcgagcgcaaaatccgccgctgcctagcgcagaaggtcatcctggagttggcctcaacttcacccattgaattttgtttctacggctgagactaggtcatcgcacttcaaactatcctggttcataaatcggcaagatgtatggcaatatcgcatcgttgtggtggtcgacttgattgctccgccgacgttgctgctcacgctgggccgtgcgctgggaaagcttactgctgcagcttgtgcaagcacgaaggttttgcaatgcatgtgtggcaagatgactagatgtctagatggggctatgtaccgaacatcccggaaggagtgaggaagcgtcggctgtaagattgcagcttcatcttccttgcttcgtctcctgtagcgccggctgcgaagtcgcgatggcagtggttgccgtcggagatgacaggaggggcctccccatcacgatgcagggaggagagggcaaggtggctcctacggctctggcttctggccttccggcccgcctgcctgcccgaggcgagggcgccgtgcggaggcgagggaacggcgaccaggacggggccggaacggcggcggcggtggatcctatcgctccacagttttgactcgcacaattgctaatgcgaaaggacgaccttacccttccacctctctaccattatgcggtaccatccaagtacctggcggtaccggcagataacagccattggatctgatccaatcgatggctacgatttggtaccgccccaacctgctggactgtaaaaaaactcctaaataaaactatctgaggttattgttaaaaagaaaattagtacgtgtaacagtgctctttaagtatactaaatgtgtaaaagcaaactaagaggacatgaaactgcgtaattgctgtcaattacttaccattgacttgatcaagatgtccctgcgcaacaccaccatgccgtggctgaagaaggagcgccatgacctcctcggctcgccctttggaggcagcgagatacagagccgggcacatctccaagccacctgcagaatcacctctcgccgtcaccgccgcctccgagccatggtgctgcgaagaacagcgcgcgagctggatgtcctgcatctgacgatgatgatccatttggatcaaaatctagcacagtgaagagcctatagatgaatgaatatgattaagaagacaattaggtggtgtttggatccagggatttaactttagtccctatatttaaacactaatttatagtattaaatatagactacttataaaactaattacataaatgaaagctaattcacgagacaatttttttaagcctaattaatccataattagagaatgtttactgtagcatcacatagtctaatcatggattaattaggctcaatagattcgtctcgcgaattagtccaagattatggatgggttttattaatagtctacgtttaatatttataattaatttccaaacatccgatgtgatagggacttaaaagtttaatcccatctatacagggccttatacggccacctcgcctttgctgcttaaatttgcactgattagtctcgcacatacggccaatcatgtcatcgtcattctatcaccatatgcacgatacgggccatacggcgtgtgcgcgggaaaaattgactgttgaattgagattttctttcaaccattttagtgaaaaattacagctattgacttgagaaacgtccaagtgtcttctggctagcttcacaagatgatgggctagctggtataggttcgcagccttacctcttctatttatttgaatattcgtgttttttgctattgactttgcccagagggacattcaaaacaatgaatagtacatgaatgcgaccgatcaaggctggtagaggccgcaagaaattatgaaaaatccgatgcagtatttaaatatcctcgttttgaagtagatagagtgtataagattcatttagcacgatgacagaaagaaaaggaaaaaataaacagtgaagtgctttttgtttcttaaacttgtttttgttatcaagtagatctccatacactctaaatgttgattctggtaattttatcaagtgtatctttttgatccaaaattatgacgactcctccaaaatcctacatggctgccacctccttttctttttcttcttgtttttcctttcctttctcttttcttcttccttcgtctcatccgtccatccgcatcccgccaacaatgcctcccgtaccaccatcaccttcacctctctcccaccagccaagacgacttcgacccgttcctagcctacctgaccttgggcggcgccatcctatagacaaagcatgtcgcccctctccccgtagtccatcacccttatatcctcatcgcctgcctcccacttcccgttggcggtcacctttctccccatctgtcgggtcccaaaactaatgattcggaaaccgacatgtttaactgtatcaagccctggatcagtaggttgatacagcttcgacaatctggatcgtctttgcatacgtttagacatagctttgaaggagataatattacataaagtaatagggtatttacgagattgtggctaactattacagcagaagctttagaatgacctaactctgttgttttactatagacttaaaccatttaaattacctagacttgaagattaagttaaaagagaactaacttatgtgattgaactcctgacttcggcaagaacatcaaatggactctgaaaaaggtggttgaagcaagggtgagtacaagtaacgccccgattttcgttcgggtttaaaaataaattaataatacattttctagaaattaaataaaagttaaatcaatttatccaagtgaaatgttgggagaattaaaattttcccttaaaaatcattggccgggaatattttgtaatattctttgtgccctaatgtactctccggaattttccgtgaattttcggagctcgagaaatagttttaatagcacaaaggtcattgcatcaatttaaataaaaagaaaacaaaataaacttccccttcctccctttcgggctcggcccaaaatcctctctccttcccctcccgcggcccggcttgcctcccctttttggcgcaagtctgcttttcctccctcccggcctcccctctcactcaggccgacaggtgggacccatggaccccacctgtcatccccaacctccggccagctccaaccgccgcccacgccgcccactccctccgccgatcccgcacctcccctcgtcccaaccggcgtggacccgagaccccttccacctcgcgaccacatcccgccccactccccctctctccccgcgggaatcaacgccacgccgagccgccacacccccacgacgccgccccacttcccctcgaaatccgccgctccccggccctctcctcgcccccttgagctataaaatcaatccccgtggactcctcttcctttttccccgttttcccgagtcccccacgccctctaccgagctctccacgccgatccccttcgccgccgctcgccggcgatctccagccgcccgccaccgccgctcccgtcgctgccgcgctgcgccgccaccacctatagcatcacaccaccccaccgcaccccggcatccactccatctccctcctccaccgccggaaccaccttcccatcgcgaggccgagccactaccgccacacaccgccttcagccggccgctgccgctgcgttagtcgtcgccgcacctcgccgcttgcgccgtcggcaacgccgtgccaagctctaccccggcctccgctccgtttccccattccaccaccgcaaccacccttccaccgtgcatcccgagccacctccaccatacgccgcctccagccgtgtgccaccgtcgccttagccgccgccgcgtcgctccgtcttcacctctcgcctcgcagcgccgtgcagcacctcggtcaccgttgttcatcgccggaaacccaccggaacgtggtacctctcggtcgccggtgagccccaccattcctctcctctctggcgtggtattctcgccgctccggtcgcctatttccctccctaaccgctccaataatttccctaggtcttgccggccctcggccgcggctccgccatggtcgggcgtcgtcggaccgccgttcccgtcgcctcccgtgtcggccgccgccatcctttccgccgccggtcgcctccccatggtcgtcccgtcgccggcgctcctcggtgaggacccccttcatctcctttccctttcccctcttttcgtcgcctcccgtgcgtgccgtcgcgccggtggtcgtcgccggcgaccatcgggccgtgcgccgtcgctcccggccggccgaccggtgagctggctcccgctcgcccgtggccgcccgatcctccttcggggcgatctgggccgtccacgtggccttcccgtgccgcccgcgtcggtgcctctgtggcgccacgtcggcgccacctccgctagccgtccgtcgtggccgccacgtgtctgccacgtggtgcgcccgcggaccagcgcatgcgtggactcggtccacggtgcgcccgccacccgtgagtcaccgtcaggtggggcccgcttgccggcgccacctctcccccgtcggatgacgtcataattgatttaaattgcgcaataaatcggtaataattctagaaattcattaaaatggctcaaaaccttctaaaattcatatctaattcattcgaactccgaattgagccattcaacttgcaaaattcatctaaaattgagctctacatgtttgtttactttttatgtactgttttcttggtgtttattagagtttttcctcgttttgcgtgccagcgtgtagtttccgtcgtttcggaagtccgcggtcgcgaggaaaagagttcagaagatcaaagtgaagaagcaaggcaagtcacacattctccttgagcatgttgatcccaatttataaatgttttaccgtttacaaataaatatgcatgttttgctaattacatgggatcagggttttcctatctgctcgcttgcgccatgtttacttgatatctgttctttgtcaaccttgggtaataaattgactagcttgtgttacttatgtgacctagctagaactatatgcttagccatgcttaattaccactagctcagtcgatgggataattgcagtattagacattctagtatcttgttgagctgcgtgctcgagacatctggccatgttttatggtcgtaattatccaactaaaatgcgactgaatggtgggctgtggatgcatggttttgcgagtcgcacccatagcaattaaggaccggttcacgggaaaccctggaagacttacagcgcttgccacaagcgggaatgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtctcacacctaataaatcgacccaatgcactgtagtacaggtgggttggttgggcctgttcaacgtggtgtagcgttgatcagtggagatttaatattactttaattactcaacagttttactgttttgctcaataaaatgttttacaaccgcctttatgcaaatagccacaaaccgtccttgtgttcccccttgcacgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttggaactgtttattacttgtcgttttgtgtaccctggctggtcctggacagggatttaatacacaaaatagtctggaaatttgggctaaatttctgggcgtgacaaagtggtatcagagccaacttgactgtaggttgagccaaatggtcaaaccgtaaggacaagttttctgaaaaccctacttgcaaattgtctcctctcgcccttcggcatttctttgtgaaacggtttttcaaaattctcctcccaatctctccaattcttttagttgtcaaacctagaggaccagctgtcagcttcatgtctgttcggaagtcaagtcaattcgagcctcaagcttcgtgcaaggagcgagaagatcagttcagagtcgtcgttctgcgaagatcaagtggagttttcccgaagttgacctaaacccaatctttcccagaagagtagttccgttagctttctagatcgtgtgttgtttgcttgtgtgtaggggtatggtttgcatcattggtggggatgcgaccatactaggttgtttgcttaagcaacttgaacaataaaagtctactcacaacataacagtaggcaagtggtttagtaccttatctttagcaacccctctcttccacctttcttccgtcctggcagcggatggtcagtgtcagagataagatcaattaaagtcaccaatcaatggttcagttgaaagctacaaggtatcccagtgccagaagaaccctgctcgtgatcaacatttggtgtccaagattagatgatggatgtattgatgcgggagatgcaaagctcgatgcaaggtcaagtgtagcggaaagaactccagcagtagtgtgttgcagtcaagagtcagtgtgtccatgagctaaatgagagtcacttttatgtggaatttcctatcatcaactaagggttaagttccaaatcttgtcggggtgaaagtgcatcgccattgcttcaatttgatggaccgatgaagttttcagttttcaaagtcagggctctttgtaaatcagagaagtgttggctatatttgaaggacaacagttcaactgatcccagccacgcggaagtaagactactccctgtaaggggggtaggtctcggagaagagttttgcctcacttcgtcgctgttttagttgaaggttcaaccagtgccgcaatcagggtagcacttgaagaagcaagttgcaaggtatcagaagaattaagccgatccccgggcaaccgattgaattctaaggtacacccatgaggccagttcaaccgcttagcttagacaggtcaagcaggtttcctggatttacttgtcatttgagttgggaccagtccaagcggacatagggtaaatgatttacaaatgccagattcaattttcatcctcttatagccagcgtggtgaattctcaggttaccaaaattgccaacctcaacagttcagtccaagataagtaagtttcaggagtatccgcagttctggcctaggtcagttcaagcagaaccagtcggtccagttttggcaaagcaaaggaacagaaaggtcgaatccagccagtgcaatcgtgcaggtttgatcaaccagtcaatcaatcagttcgaagcagaatgtggcagttcaatgtgcagatcagtcagaccgcccaccagcaccggctttctttctagccatcccagaatctcgggacgagattcctgtaaggggggtagatttgtaacgccccgattttcgttcgggtttaaaaatcaattaataatacattttctagaaattaaataaaagttaaatcaatttatccaagtgaaatgttgggagaattaaaattttcccttaaaaatcattggccgggaatattttgtaatattctttgtgccctaatgtactctccggaattttccgtgaattttcggagctcgagaaatagttttaatagcacaaaggtcattgcatcaatttaaataaaaagaaaaca

SEQ ID NO: 38841 - DNA, 4740 bp, Oryza sativa
cctttatgcaaatagccacaaaccgtccttgtgttcccccttgcacgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttggaactgtttattacttgtcgttttgtgtaccctggctggtcctggacagggatttaatacacaaaatagtctggaaatttgggctaaatttctgggcgtgacatgtactcagcaagctattatatcaaataatgaatgcatgaaatagtatttaagtagatctaggtttactggcagaaagctaagaataaagatgaagaaagcctggtatgtctttatgcaacagtatttagtaaaatcttgagttaagtttctaaccaaataccatatgagtcctgatactcaattccgtgagcacggctattcgaatagtttcatgaatactctactgcagtaaatgtacgctttacccgcagtccacgacttgccaatattcattagcttagtcatgcccagtattaggttactaacaatagtggcacctgttccatgaactctagtccccatgcgctctgaacgtaacgttatcagcagcgagaggagttctggcgttcccggggtttttagagagaactggatgagagaccccacgtcatctcaaccaggtttccataaaatcacacacacagctcatgagcgaaaatcagtatatttacctgcgccttggtaaatatcataagatgccctactcagcataagattgcctcctgcgcgaggacttacaaaaggaaccactgtacagaggtaccacattgttaattaacctaataactaggtctgtccccattctagaagctgcggtcgtactcgttcgtttgacataagtatttggtggcaattatatcgatcgagacagtactagtcacccggaaatcaaccaaatcttacgtactgtcccaatctaagttcattgaattttatgcatattctaactaagcatggctaagcaaaagctagcatataactggttcgctatatgttcagattatgcattcaaaatcatgtatggctagtgcatagaatagaatatagaatataggacatttatgctcaaagggaaggaataataacttgccttgctccaatgcaaataaatccgagataggcaacctgattatccgatgctcgaaataccacaggttgccatccagaataaaatagactctatttaagaagaggaagaaccaaattcaataaaagccataaaatagcaagaaaacgatgaaaagcgagaaaggctaggtttggggtataactatctccttaatgggttattgagatagtattttatgcgtaggttctaatgggttggagactaggttggagaggggatcaagattaggctttggtggaatagtggctagggtttagttgttctcgagtcgatgctgaaatagcatagcatatcggctcgtatttcatgtttaaactatgggtagttggagggtaaatggctgatatggagtttggatggcaggctggctttggtttcatttgattaagccgatatcgaggtaggatgactatcggctgggatttgggtgtttgctagtcgtcattagaattgggtagtatgacgactaggtttggtgtctagccgatgtcaacagacaatataacggctagagggataggaagtttgtgtaggtttagcggggtggaagtgttactccgacaaccgtgagtggcggtggagcggctaggatcacacagagcttaaaagctaactgtgcggagtgcagatgaggtcgagggaatagtgaagctctgcacgttatacgcattgaggcgtaaggtgtcagaagcaacacttcgaccttaggtttgagttttgtcggactttacaaccaacggttcgacatcaggtcagaagaccgtgcgaacgtccccatggaaggcgtaaagttccaaacggtggttgtttagtggcgaagggtatttttgggtaaaaaggaaatatttgaaaggcaaatatagattcaaatggcattaaggaatttcaaatggtgaaatagcaaatttgatatcaaaatatagcttttgaatttagatgaatttaagtccaagtttcatcggaatcggatctacggtttaggagatatggacttctaaagattgggatttgaattaaataagaaaaatatgaaaggctactgttgatgggcccacctgtcagggagattcttttcttttctttttctcttcttcttcctcccgtatcctctctccttctgcttcttcttccagccgaacacagaggagagggagaggaggggcgccggtgctccggtggtcgagaggctgcgacgtcggcggaaaaatatgttcccgagcgacgcgcatccagggaaccagtcggccagcgaaggaaacaagcgaggaggccggaacggcgacggcaagagcttggctcggccaatttgggaggtggcggtggcggtttatctcaaggtagagggagaggggaaaggggaaaaaatggaatcacctcatcgaggccgagctaatggcgcaaggttttgggatgtagggctgtggaagaggagatcggccggtggcaatggtggtggccggtcatggtggagagagaagaaagagagagagataactcggatggatggaagaggagggggttttctctggctatttataggcaaggagaggcggtggagagaggcggttctggagacggtcgacggcttggccacggcgatgctggcgtgaaggaagaaaagacggcgcagattacttcgtgacgacggagggcgttggcggtggcgtgcgcgtgaggaccgaatatccatggcagaacccgcacggcatgcgcgcttgcgggaggaggaggggcggctcagctatgggccgacttgggccgcgcgagagagaagaagaattcggcccaaagttaaaaaggaggaagtctaattttcctagagattcaaataatagatttagaggaatttggatggctagattttgaaaaaggatttgaataatttgaatttgaagtaaaattgactgagagagagtttataaggaaattatattcgaatataatttccaaaagaaatatttctctagttggtttgagtgcaatattttggagagggagtttatttaatgcactcaaatagaaattcaaaatattcaacaccataaataatatggctctagatttgaatatttttgaggatgtggagggaatatggagggagtagagtaaataaaattttagcccaaaatatgtggtatgaaatttagagaattagatatgggctaaatgaggttttggatttgggacggagggataaagtctattctcttagcacaatagcaattactcacaatatttgtaataataatatttcttgtgccgaagagggaatgaaaccacatggattaaattggtggctagatcaaaaggaggaacttgaatatttggatcgagaatcaaaggatgggtttaagatcaaaggatgggctaacaattaattccaataaaattggaattgctttggtttaggttctagcacaatataggatggtttcttggaccataattcataatagtaaaaagggtttttcaaactaaatttaaataaaggaaattttaggcgaaagaaggttttagattaaaaccaaatcaaggaatatttcaagataaaattttaaatgaaaatcacaaaggcttttgaatatcaaagagggattttatgcaggttagcttcaggaggtctcgctaattatattgtcctaagtttaaagaggttattaagaacataagacccggcatgatgcaagattagaaaatagctaattttcggtatgttacaccatcggccgccgctcggaggcctagagagatggggaagagagaggacagggcggagatagaggaggaagatgagttgggcactgatttatgtagggcccacgtgtggatcccacactgacatagcctggttgaacacaatcaatttgccaccttagataaaaccgaacattatactgccctaaaaccggttttaggtatacctattatgtaattaaggggcgtgttgtatctagtatttgtggttcaagtatgagattcgaactggacatcaagatgagggacctagagtaattattccaaatcaatggcagtgaacccgatacagcccaccaaaatttcgtggtagcgatccagtgcagcccactgaatcaattaagcccgccaaatttcagcgatcaaattcggcccacccacccaactgaccagccaaaatttggaccgttacaatggtagcgacccaactcagcccatcaaatcttcgttcgctaccgttgcaagagaccaaattcggcccgtcacagtttgatttgccatgtcacaactctgaagagcgtcagagatttgccgagaaaatcgtactgttgatggcttgacgccaagaggtaaactcataagtcataacccatttttatcatgccatcttacattaacgaaagaaagaaaga

SEQ ID NO: 38842 - DNA, 1011 bp, Oryza sativa
tcctgcagcccaaataatggaaaatgtaacggtaggggcatggaagggatcaaactgaaatttcaggggcatagaagggatcaggtaaatttcaggggtatggaagggattgagtgagttttcaggggtacacaaggaatttactcttgtttttttctttttttaacgactcgcatgaaacgatgcgaagttctattgatagaggagaaaaaaattacaaaattacaatcctggagggtcgtaaccagggaaaagaaaaaaatataccaccacccacacaccgacagcgccaacacacaagaccgggagaagactaacaccggaccaggcgccgctaagcgtgaccgaccgccgctagaccaacaaaggaacacagacgagatcgcccaaaagaacactctcacaaccaacacaaagccaactcctagagcgtgcttgcaccaatcgatcgagaggcttcggccaggggatgccaaaacgacgtcttcaagaagagaagcgacggtaaaccgccgccgctgtccgtcggggctcaaaggagcttggactgggctttcgcccagcaaccacctctgagggatgagacagcacgacaacgccctcaagagggggaattaaccatcgttgtcacccactgctcaccacctgcgaatccatggctgacgcattgatgctcccaccacccctcaacctctgccaacatgtgggacccctgcaccggcgccccccgccggccagccttcgagcgccgaagaccgcgccacatccaccagcagctccttctcgtaccgaggtcgcctcctccaccgccggcagcgcctctcgcgccaagccggcttcctccaccggatgcacctctcgcgccaatccggcctccctccatcggccgcgcctcacgcgccaagccggtctccatctccgccgcccgcgcctctcgcgccgagccggcctccgctgccatcggtgtcacgccctgaagtacccctcccttgctctaaattcataaaataa

SEQ ID NO: 38843 - DNA, 20578 bp, Oryza sativa
aagacgttgctgtggtctcatcagtgcgagagcaaggcaagtcatgcaatacaattgatcatattgtacccaatttacaaatatcccgcatttctattaaatattgcattgttttacaatatcatgtgggatgggtcctattactcagccatatattgtttaccttatgccattgataacgtgggtattaaaatgactagatgttggtttaggagatgcttagccatgcttagttcaactagtgcacaaagagggatcacattaaagcatagacttgattattggcatagctttgatttagtgccatcgtaatggtgttggttaattaaaatacacgtcatggtgggctgtgggtgcatggtcttgctagtcgcacccatggcatttaaggaccggttcgcgggatgccctggaagaactgaccgtacttaccacaagccagcgtgggcaacggctgggcttgtagtgtagcttttctctagccgacgtacccaggcgagggtgggcgtgatggagttgggtcggccggggtgtccggttgatcggcttccggattcactgcggcacgaaaggggggctgcccgttgcctgttggggacgagggcgaaccctaaggtgttgtgcgatcggttagagggggttatgcgaagggtcctgtcacggcctctttccggtatgtcgtggtggcatgtcggcgcacgggaacgtgtcgtggggctatgtcttgtgggtacagttgtacacctctgatcagagtaaaactattcgaatagccgtgcccgcggttatgggcggtcgaccagattcaccgtgattagtttcaccctagttagcttttggaactggttagttcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtatgacttgctgagtacagtgggtagtactcagtcttgctctcttttcccccactccagagttgaagtccttctcagttgaagatgtctcgaagaggttggtttcgtcgctgccgtcaaggattgcctgtggaatggagtcaccgctgcaggagtcaagtcttcaggcttagctcgcttttatctttttccgctgcatttgtaatcttttctatttttgtaagacgtggatctgtatgtcaacaattgtcgtttgtgtaccctggctggtcctggacaggggtttaatgcacattcagcttagaaattctggttcgtgaatttctgggcgtgacaatcggctgcgccaagccggtctccgcccctcctccaaacgctgtcgcgccggccagatacagtcgtctcctactccctcggctagccgtccgaggccgccatgcatcctcccacctcagccacggtggtcaccaccgtgcctcctcccaccgcagccacggtcgtcaccttgcctccacattcacggccgccgcaagccggccgccatcgccgctgctgtctccagccgccgacaccgccaacgtggctgctgcctcgtcgccctccgccaccactgcctctgcagtcctccgctgccgccatcgcggccgtggaccaccgccgccgccgtcgccgccatcagggccgtggacctccgccgctgccgtcgcccccgggaggaccagaaccggcctcacccccgggccttcgccgccgttgccacatccgtcctcggtggcgcgcatccgtcacctcctttcggccgccgtcgccgcgaggctcgctgttcgctcggcccctggacgtggggaggccggatctgccgccgggggaggcggatccacctccagcgtgcccgaattcgccgcggtgacccccggcgccgcttcccgtgccgctgatcgccgctcgccattgctcggcccctggacacggagaggccagatctgctgccgagggagacagatccgccacgccgaccccccggtgccacctcccacgccgtggaccgccgctcccgagcagccctggtgtccccgccgctggcttcctcgaggaggggagagggccccgccgccgctgtccttgaggccggccggctttgccaacgcgccgctcgggcggcgcgaggcagaggagaggaggagggagggggcggcggaggaggatgaggtgccgcccatggacgggagcgacgcggacgaagaatttttggccaggagccgaactgatgtgctgatgattgttaagtggtaactatggcaatgcatgcgtttatccaaccatttgccatcaatgtagttcttactatcgaatattttgtggttgatctatgaaatcatcagtgtactcatgactgcaaagtgcaaaccacgtccaaacacctttgtacgctgttgtacatcaaacctctataatattcaaatccaaacgaaagctactcttgtttgtaactacacacaagatgattgtggaggtgcatccttgataatttctcctgagtatgcatgacagatggttagtttttgctgcaaaaaaatctctttgcttctatatattaattacttcctccgtaaaaaaacgaatctataattagatgtgccataacatagtacgataaatttggacagagatatgtgtccaaattaatagtgctaggaggttggttttttatgagacggtcataataaactactcctgcacaaatccttctattattaatgagtactcccaactaaaatatcactcatatctcattgatatatgagcttagtttcatatcacaatcatcaattgttcgacaatcttctcacatcgaaataatacaccacaaccagaacgacaaatgctgtgatatttataattataaccgagaagataagcaagctgtatagggagtcgccgaggaacggatatcgcctcttgatggcgtgagcatggcgaccacgccacacgaacctccaaaccgcgcgatacgtcgtcgctgcaggatcaatccacttctcgatccacaaaatcaaggcgttgaagcacacatagatgaccaagaacatggtgatcaagaccgtcctcgagctcgaggttgcgatgacgacggcatggatggcggagaagaaggccaggatcaggctgacgagcgagacccagatgcactgcagcgtcaccacgaagctcttccacgagacggcgaggtgcgccgccgccgccgtcttcccgtatacgagcaggatgacggcgaccactgacgtggtgatggcgaaggtgtcgaggaccatgaagtatttgaacgagatgttgtccctgaggttggccgtgccgtcgtccccgtacccgccgggcatgttgaacccgacggcgaagacggcggcggcaatgagaacagccaccaatgcgaggctgtcggatgtcttctcgataccactcgccatgtcatggccgctcgacggcttcagatggtcgttcctttgtggctgggcctgtgctccgaatgtgaccaatgtcacaacaaagcttaattacctacattacattcacaatgaaaatataggatgcaagtcacatatacagtgtaaaaaacctaatgtagtaataaaggcgtgaaaaataatctcagacatccattctgactatacggtaacagggttttcaattttgatattggccattttggttctcctaaaatttcagtatcttcagcacttcttggaccgatttttttttaaataaattaacataattaactgaatttgactaaattttgaccaaattcgtaaaaatttgagaaaaccgaaaatttttggccaagatagtcacttgcggggggtccgaaatttcaaaccaaaattgcaatcaatataagtttctaggtttatatatgtacactctagattactactacctccgtttcaggttataagactttctagtattgttcacattcatatatatgttaataaatgtagacatgcattgtccacattcatataatgaatctagacaactagattcattaacatatatatgaatatggacaatgctagaaagtcttataatctgaaacggaggaagtaacgagtaactaataacatagtaaatgggcatgcttggtttatggttgctcaccatattgaacaaactgtttgattctgaggcgagatcaagcggcgtgtgtccatcgtcattcaagacatcagtttgcacattcccctcccggagcagggcctccacaatgtcaggcgcgccggcgaccacggcgaggtggagcggcgtgttcccgccggcgtcctgcgcattcacgaggccacccatcattatggggttcttgatgtctagggacaccaccgacgagcgcctctccctggccgcggcgtgcaggaaggtctcgcagcggccgtcgcgcagctcggcggtgtctgggtagaaccctgtcagctcctcgacgatgccgccgtggcccagccgagccgcgacgtggagagcggagaggccatctgagtccttcatgtacgccgtgccaggtggcgccgtggccaggattgcacgtacgattttacggttgccgtcggacaccgtgaaatggagcggagtgctgccattgcagtcgacttggacggccaattctggcttccattgtagtagaaggtgaaccatctctgcgcaatttaatcaattgataagttaagttgggcaacacattctcgtgtttgcgctcaaaaccttagaaatcgacggttcaacgtgtaggatcgaatcacaagaactaagccaaccagaggggggtgaatggttggtatacccaaaaaccgaaaacttttagcggaaataaaagttaccctcgaaatcgatggagatcggtctgaccgagattgatctgccggtctgaccgagtggatgccgccggtctgaccgcccgtatgccgctggtctgaccgccggtatgtcaccggttggaccgccgaaactcggtgaaacacaaatcgaagaactcttaaagtggatgacaactttattacttctctctgtgtttacaaagtgcaccaacagcactccttacaaaaatttcgactaaactcgaaaccctaactcaaaactcaactcaattactctctaaagcgataccgggaagcctcacgctccccctctatttatacatgaggtaggcagcctaaagccacgaaccaaactcatactaggagtcctaaacaccttaggaaaccctctagtacaagaaagaaactttacataaccaatcataccaaatttggactccttccaaattcgactccgcatcccatacgcacacaataactctatcgtatgccatatggaatctccatcaaccacatgcatcaactctagcctaagtatcccgcatgatctctgaccaccacggacgtcgtcttatccccaagccgactcccggtccatcactgcaaatactctcccgagacatcgagtcacctacacatgaaacaaacaaagaaaccatatttcgagaccaagctatctccaacttgactcattagcagcaaacaatagtattacatacgcatagtatccatctagaagtcataatcatggaataaactcggatatccaaataaacaacctgaaaccgaaaccgacacagtgtcggccggtcagaccgcggactgcgccggtctgaccggcagcacaagcccggtctggccggtcccacataaaatcacagcagtacctgtatattcacctgtgaaatccaatcatctccaaaaccactttgtgaataaattccaaatatcaaaaccaataatctccaatgcccaattgttcatcacagaatatgaatcaaaaacacctttgattttacacaacggattgatagcatactcagggttcaaaatttcagttttgctattcctatcggggacattgataggaccgaaatttccaaaactgcagaaattttggtccaaaataattttatttttaacaaaatttggtcagatttgagttatttttgttaaattcaaaaatagaagaaaaagtgaaaaaaaatgggtgaaacaatttgtatctatcccctgaaattttgaaccgtgatcatacgtaagcttcggaagacggcggcatgtagaggattctgcgagcttggcccggcggatgaagcatcttcgaaggtgataatgattgctctgacagctgccaccgacagatacagaaggaaggagagggggagagaagatgtcaccgtcaccgccgctccccacagggaaaagagagagaagggaggaacaggcccggccctggggcagggcgagcagtgcaagcgccctgggccccgccaagtcaggggccccctgaccaggtatacgtaagtaggtttgctattgccatcgtacaattcgttgatttccagtggatcgcatcgtctgctttgcaatccaacaacagcgtaaaaacacaagccccttaatttattgaggcccatacgcgtagctatagaaggcagagcagtcatttgattggtcaagcaagcctataggctgatggccaaggtgattatcatttatcaacaattttagtgctactactccttaatgaagggatcactgatattgatttttttgaaaggatcactgatattgattttgaacccataaatactagatttgtaaaaattactccatcgggccatacatatttaaaattctaaccatcaaattaatctatattggaaaatcttcataaaatatgataagtttaagatactatgattaaatttttttatgcaaatatgtttttcttatgctactctaaaataaagttttcttcaattctggcacctaatacaattaaaaaaaacgaactcaatatagggccctaatttttgtgtcgccctaggcccctaaaatattaggaccggcccttgggaggaagaagaaggggaggataggaaaggataatatgtaggctccacatataagtggatctcataatattttttcgtgtgaatgataaatggctcccatatatttttttttatttatgcctgtaatacgaatagaattggatgatatgggcaacgacgtacgtgatatccacattgactctgtgagtttcattcgcttggtatccacatcacacggactctctttcgtagttcgctcacgagtcgtgactttgcaatgaatgttacgcgtgacgggaatcggatgcagacgaagtaccatagttttaacaaaaacatcttcaatttttaaatcgcaggcgagggcgacatagtcccaatcagacatacgacaagggcgcaaatcgtgtgtgcgagggtgttgcggtctcaatcgcggcggcgtgtaaaggcacatgtggaaaatggactcaggcttgggcccgatccctgcgtgcgacaaggggtgtgtgaaaaggtgaggtcccaattaattcgcgcgcgtctcggataagagggacactctggcgtaagaaaaaataaaaagatttgacagaacaggaaattaaaaacgattcaaacacggatgacgcaccaaaattctgacggaaacatcttcaatttttataatagtagagatagagataatgctacataagcaccatgtcgtcaacgaaaccgctctcaaaaatgtcaagagagttaaattacaccgattttaatacttgggggttaaaatatcgggtaatatggttcaagcatgtaaatcagataccactagttaagtgagtcaaagtgaatttattcctcttcataatgcttggtgtcctctctctggtcttctggagagagggcatgtctgattacggtgggctctcggaccttgaccagcgttcagccagactgtcatgcgtcgtcgctcacggagctccactgtgcatggtaggggtgagcgttcggtctaaccgaaaatttttttcgtctcggttttcagtctttaaaaagtgaagaccaaatttcaacacaaaaatattatgaccaacaaattcggtctcggtcttgatcccgaccgaaattcaacgacatttttatatatgcaaagaaataacggacattttcaacacaaataatcacaaaaaaaaatttgtaagcatgtatgagtaaaggctcttattagattgtatgcgtagaagaagtagggaagtgtaagttaaagtttaatgctattgaacttagtggattgtaggttgcatttatatatttatttttattaatttggtcttttcggtctatttgattaaccgaggagactacgaattgactgaacaaaattcggtctttcagtacctaagaccgaatttctcggtctcaatcttggtcttttcagttcggtctttttctgcccacccctagtgctcgagggcccggcttgagcaggatgtttgggtgacccatgtaacaatagatattataattttttcgtattttttaaactttttgattttaaaaataattcctcccaaaacttatttctaaatttttatagcttttgttttcagaagttatctgaatagatatcttgatagtttcactgttttccattttcatggatacttaccctcgtgtttttttttaaaaaaaaaagtcggaatcagtttttgttttcaaaaattatctgactgatactatttgtttcggaatggaggaaactatccgaactgattttataacttagttatcaggtacgggaatatatttttgagattatataaataaaggtgagtttctttgcaaattgtataaactgaaagcaacctgggagtgcctgagagaggacggagctccaccatcaatagggggagctgcgatgcatttcttgcttgcacagagaagctgcattcaggaacaaaaatacagcagcaggaagaagcggaatcccgcaaatctgtacacagctcgtgcgcgtggattttgaaggagtttatgcgcgtggatttcgtatgagctctggtcggctctgttctatttctttaactccatacttgcttgttgtttgttagcacgtttttcaaactgttaaatgatactccctccatattttaatgtatgacgccggggactttttaaccaacgtttgaccactcgtcttattcaaaaatttcatgcaaatataaaaatacttatgtcatgcttaaagaacatttgatgataaatcaagtcataataaaataaattataattacataaattttttgaataagacgaaaggtcaaacgtttgtcaaaaagtcaacagcgtcatacattaaaatacggaaggagtatatctttaaaaaaagattttatatagaagttgttttaaaaaaaacaaataaatctatttttaaaatttataatagttaatatttaattaattatatgctaataagctttttttgttttgcgtgtaaccaaaatttatctccatatgtggagatagaacagatgaatattggcatcacaagtcactgaattcaaatattcgagtggcataataaccaaaagcttaatttgaccatatgccatattcagatgagcgctataggatatgccatcatctagaatcaaaaagaataaaaagctcaggtttaattaattagtttggtaaaaaaaatactaacctctattttttattgataactttgactaaaaagttatttactttcctattttacccctacaagtaatttaatcgtatgtctatcttcataatctagaaacttttatctattacctccacccaaaaatatagcacaatataattaaaagggatatagcttagtactacgatcctacagttagagattgttgtggcatgggaagagtaaaaggccacgatttagctgacatgcgagacccatatacaatgtaacgccgccatgaagctcttccacaagccggcggagcgagacgccttatggtagacaagtaagatcacagtaaccattagtgctgttacaacaatgttgtcacagaacatgaagtatttgaatgaggatgcgtcttcgaggttcgtccgccattgttcggtacccactgggcacgttgagcatcatcattcgccattggcatcatcgcgccactgccaccatcgcacgtcgctgtgaagaacaacgtacgagctggatatcttgtatctgaggatgctttatttaatcaaaatctagtgcgtaaagagaggatataatctttggactgattatattgattgtataatgtagaagtaaactgaattagtttgagctccactttgcttgttgccttgatgctgctatatgggtatagctaggtgttgttgctgccgctcaagtggtcttagcaatacattagggatttatggtgtcataataattggctaattgtatttgatttctacttttattatgtgtaagctcaacgcctttctcctactccattttaacacaatttcgcagcagggtcacattaaaatttaaaagtgaccatggataaacaatggtgtcaattagaagtagacgattataacagacataactctaataatatatgatctactaattcaatatatttctaaaattattattcagttatccaccattcgtattgtttgctcaacgtttctaaaaacatattttctaaaaaaactttcctctatgaaccacttgttctaacatttttcttcatgtgaaaacaagatgagagcgcacatccaaaaaaaattatcaagtttttagtttatgcacgacaatatgatgtctatgaagttagagatatttttgggtccgtagaaaatgagctagtttcacttagtctttaagttccgagaaatgacgtgtttggctacaatgctagcatgatcctagcttgacttggcaagactaatcgtttggtatcgccataaaatcctagctcccagaagcgaactagcccaaatgggccagaaaaaggctagctcatcagggagagccaaatctgctcgcttccgacgacaaactaatcgcgcgaaaaattgatgatacacacaaaacgatttctcctaaacctaccaacaatcggcccatatcccatatctcatcgtactcttcctcaattcttgactaaactctcaggttagccaatagtaataaataaaacatgaagttgtttctcgaataatgaactataactcttttttagataattctttttgcacattatctctgttgtttaacgaaaacactcgtatatatagtcttacgttacttgcggaaaaattacaagccactaattttaactaaagagagcaaacgaaccaaatgcagagatacaagtaagcaatgagttgatttgcctttgccgagttaggctagttaggaaaagaaactaaaagtgcaccatagttactgctagagatgctacggcagggacgaaaattcaaaacaaaggcaaaaggcaaaaacagtttaaaactcgaactacggaaatagattccgaatttatccttgttttcctctttgagggaaagagttcattcagtacactgattcactcactcccgagtcccgacctccctcgcacgtgcttccctgcgtcgaccccgtcccgacccgtccccctcactcgccgccgccgccgccgccgccgacgccgacgccgaggacgacgacgacgatgccgcggaaggcctcgtcgacctcaggtacgcacctccaaccctcgccgaactccaattcccctaagcaagcgctaattccccgaaccctaactcccagattcgcgcctgaaatggcggaagtggaagcggaaccccaccgcgtccccgtcgccgtccaaccgctcgtcggccgccgccgccgcggcggaccactccgacgactccgactccgccgccgttaacgaggacgacgactccgcggtccccgaggacgccgacgacgaaaccctagccggggcggaggaccccgtgctcgacctccgcgaggcggaggtgctcccttcggcggagcccgtctcggcgttccccgtcgccacccgacgcgtcgtcaaccggccgcacccgtccgtcctcgccgtcatcgcggccgagcgatccgcgtgcgcgggtgagggttccgccgcggtggcggcggcgccggtgctggagaacatctcgtacgggcagcagcaggtgctctccggggtgctccctgaccacgcttcgctcgcgacggacactgacaagccgtctacctatgtgtgcacgccgccgaatcttatggaggggcatggcgtgaccaagcagttccagggtcgcctacatgtcgtgcccaagcactcaggtccgcctgctctttgcaaccaaaaacctgaatgtctgagctataatgcggcactaacttgtttgcgatttgtagattggttctccccagggatcgtgcacaggctggaaaggcaggtggtgccacagttcttttcagggaagtcgccgggcaacactccagagaagtacatgctattgaggaataaggttattgcaaaatatttagagaacccaagcaagaggcttgcttttgcagagtgccaggggcttgttgcgaacacagctgaattatatgatctcagtaggattgttaggttcttagacacttggggaatcatcaattaccttgcgtctgggtcggtgcaccggggtctaaggatggcaacctcccttctaagggaggagccaaccggggagttgcaactattgactgcgccactgaaatcaattgatggcctaattttgtttgatcgaccgaaatgtaacctccaagcagaggacatttcttcattggcatcaaattcggaggttgtggattttgatgctggacttgcagaattggatggaaagattagggagcgattgtcagagagttcttgcagttattgcttacagcctttgaccagcttgcactatcagtcactaaaggaggtgagcatctttgtaattttcgtttagatgttctctccccatttttcatgtgcaggaaacccttctatatcttagtgttgttgcttacattttgtttgacacctaaaagatgaataatacaaaaactgggaaacgatatcacagtaagctgagcagtagtctagcaagttatgacacacgcttttgctgagaattgacatactagattctgttgttgaaatttaatatctgtctgtctgtgtttgccaacccaatgaatacttgctctgtgttttgcatcataatcctgctcctcactgctctgtgtttgccaacccaacgaatactctacatatgttgcgtcatgctctgttctgctaaaacatggaaactgcatttttaatttgagaaaagaaaaacatttagaacacagaatcttacactcttactagtcagcctaagcaatttatggtctttccatacaagtgatcaacccaaacattatattgtgctgaaagcttctgaacagaattggttattaaatgatcagtgttcctgcatagaaaaaaatcacaatacaagatacagtcaacaacaatattaacttaaagaattaatagaaagtttatatggttgttcatgccacttttcagtgagtgataagagtaatgtggcaattgattggatggcaggccgtagtgatactgtgaactgtcataagaaaaaaccctgcaaaatttagttgaaataagaagacacatacaatctgtagtattcttttgaattaaaatacatataatttgtagtatcaaactgtattgaagtgagatgattcatgtaaacttgacaaatattgaattatttattggaagtacaacataaagggcaacataaagatcctaagatgcctatacaataacatgttagaatgcagctgggatagggataaaagttactaccaagagatttgggatgtacatctggacaagagcatttaggtggatgtttactgcagccacctccctgctgctggtcaatgggtgcctagaatgtacggattggagaaggatgcacacctgtgcaccatgcttatacttaccagctccttggttgccgtgcggtttactgctgcaaggaggccaacaatcaaattcaaaattaaggagagcagaaatgatgcagatgaaacaataatgttagacactcaaaatgtgttggataagaagggccacaaagcgtgcatccatgacagctactgtcctccattgaagtatcccttgatgcagcctgccaccacaaactccataacagctttgaaagttctgcttggaattttcagggtgaagatagcaaataagacaactgctccttcatatattagtagatattattgatggtatcatatatttgtggtgtagcaatgactagaaccctgtttgtagctgaacttaactttaagttatgggataggtgagtttcacactttcacttcaaattgcagtttgtgctattttgtcaactatgcataaattgattacagtagtactctattttctttgttgaaggaagataaactggtaggtctattttgcctgtgcaatattaatgcatcatgctggttcccactcttttctttgtgggggatgagaagcaaacaatgacaatcttcttgttggttgagcaggcagatatcgctctatgctctgattgcttccatgatgcgagatatattactgggcattcaagcttagattttcagaggattgatggggataacgatagatcagaaaatgatggggatagttggactgatcaagaaacgttattgctgttggagggcatagagaagtacaatgacaactggaataacattgcagagcatgttggaacaaagtcaaaagcacaatgtatttaccattttattcgtcttcctgttgaagatggtttgttagagaatattgaggtgccagatgcatctgtgccatttagagcagaaaccaatggatacccacatttagattgcaatggcagtacttcaggtatttttacatatttacactgatagttcctctgttatcagttctcgaaatttgttttctcacaaattttagattataataactagcatttttaacattgattaccatgtttttccataggaaatctacctcaaaaaattccacctgataaccagcttccgttcattaattcttctaatccggtgatgtcactggtaagcagttgttcactaaacctgtttagagaatgagtggacaatttttcggttttcaacagtgagttgtgtcatttagatttggatgacaagaatgcatggtactccctccgtttcatattataagtcgttttgactttagtcaaagtcaaactactttaagtttgactaagtttgtagattgatatagtataacatttacaacaccaaattagttttattaaatttataattgaatatattttcataatatatttgtgttgggttgaaaatatcactatttttttctataaacttggtcaaacttgaagcagtttgactttgaccaaagtcaagacgacttataaatctgaaacgcagggagtactattttttatgttagctcatagaatttgtgtttatctccacttctttaattctatttgacagtgacattttcttactgaagttatatttgcatagctctgcttggcactcctttggattataatccgaagctgattttgaatttgggactttgattttaggcttaattatgttcaataagcttggttgctgtaacaacagaaagtgttgaagttaaataagccaatgatgttacttccaaaaacaatttgtatttgaatgccaatttgatagttagtagtagctgcctttattcctttaatttggaggtggaggtctaagctgaactatcttggaactcgattttgaaaatcatagcttataattgttgattgattatccagacgtagcagttgattttctctaggctgaaagttaaatgcctgtacacattattttcagcagttgattaccagctcaaagcctcaaaacaccatatgcactatagagctgacaaaatagtaatggaagtgcactacgagtgattttagtattaaatgtaatcagttggaggtttagtaattaggatgttagagcaatgacatagtagaaagccccttataacccctcatttttattattcttttttgctcgtatcccttctaatcctcagactgatctgaggttcatttcaaccttagtgccttccaatttttgtgcctgctccagacttagcattcctttacaaaatgtatgctggcacatatacagcgagccactgaatgcttaagtttgagtaaagtgcatgggtgatccttaaacttgtaggggtgtgtcatttaagtccctaaactctaaaactacatatccaagtcccaaaacttgtcatagtgtatcatctaggttccaaatcgccatggtccttaaggatcctacgtggcgctgatgtggcatgccacacagacatgacgtgatatcattttgattgacaaatgggatccatttaaaaattttcctttttcttgttctcctattttttcctttcttctcctttctctgtgacccgagcagaagaaaggaaaaaaaaatgaatgagaagaaaacaaaaaagaaaaagaaaagaagaaaaaagagaggaaaaggacacatcatgttcatgtggtatgccacatcagcgccacgtaggattctagaggggctgtgttgaattgggacctagatgatacactttgacgagttttgggacttggatctacattttgagagtttggagatctagatgacacaaccctacaagtttaaggaccgcctatgcactttactctttaagttttatagagatctatacttataacttgattggcgcaggccacaagttctgaagtgaattcttattagttcaaatgcttcctcttgttctgcctgccttggtgttattaatcaagatggttttgtccgtcatattatctcaagtgtatgtgttatcttccttgctgaatttgacctgactatgacactgtttctagtatagagtgcttagtaacacgagaaataacatcagtattatcctgaattacttttcatattgttccctgattaattttaatttgaaattattgcaatcacacaaatcctgtgcttcactgcttcaacgtaaactagttctcatgatgtttgaaccaaacatatataggcttcttagccttctgtatatgtctggcattgtgtgtcttactgtttggagatactgtgcaggttgggtttttggcttctgctatgggaccaagagttgcagcatcatgtgcaagtgctgctttatcagttttgacagtagatgatgattccaggttagccatcttccctgaaatgttttattttagtagcatgattaaatcatttaacacttcagtcaggattttagaaaaaggttacataaattgaatactagatcttatctggtacaactacaagctaccagcaataaccatctttgagttctgtttgagtttattttatcaaacagcatatgagtactagataaatgaataagattagtccagaaatatcgcaccaatacttgtagctacagtactactgatacggctacccagatagtaaccaggtggttactactgatctttatccctcattgagattgcggaacttatccacctgatgttaaaattggacctttggtttgtttcatttggtcgttaggttggtttgcagtctcctttggacttattatggtagatgtaggttttgacttaccttttgctgaacactgaagggtgaattcagaaggcatttgctctgattctaggggccaaggtccgcatccgaattttcgtgatcataatggtggtaatgacttcatatttattctccactatgataatcagttttctgcgcaatctcatgtactcatgcaagatattagtgttaaggaaaccatcctatccttaaataggtgtatcttcatccatctctccagaaaaggtgaagcatgctgccatgtgtggtttgtcggcagcagctacgaaggctaaactttttgcagatcaagaggaacgtgaaatccaaagactaactgctactgtaataaaccatcaggttagtgtgaacgttgccatcttgtttacatttgggccttgtttttctcattattgctgtcaccagggtgtgaaaaaccgccggtaaccgcgcggttaccgcggttaccgcccgtaccgcgggggtacggttacccgtaccgcgcggtacggtttaataaaattcgtccaaattcaaaaatttaaaaaaaaaaagaaaaaaaatcaaaaaaaatagtgaaggtagtgcttgatttatagtgttttatggtgaagaaatttctcaaaaaagagtaatatttattcaaatttgagagcaaaacggagaataaatttgaaaattggaaaaagaaaaaaaatgggccggcccgttactgtgcaacccattacacatcgcgcggtaaccgcgccaaaccgcgtggttaccgcgtcaaaccgcgcggtaaccgcgccaaaccgcgcggtttgcccaaatttttgaattcaaatttcgatttgtaaatttgtcgcggttttgcgcggttaccgcggttaccgccggtaaccgccgtaccgccgggtggcggtaaccgggcccccggcggtttttgaaaccctggctgtcacatctgagggtgtgttcgccgttgcatggaaaacggagcagtccattagcgcgtgattaattaagtattagctattttttttcaaaaatggattaatttgatttttttaagcaactttcgtatagaaactttttgcaaaaaacacaccgtttagcagtttgaaaagcgtgcgcgtggaaaacgagggagagtggttggggaaaagggcatccgaacactgcctgaatgtctgagtgtgcaaactcctacttaagaaaaatgcactattgcatagccccactttatggcttattttgtacttggtcccttaaaatatgagttctagaaagagtttgaaaatggcagtgtaaagttggtgtctgtgtacacgatttcctttcctagtctaatttgatggtgaaaggtgtttctcatacattctgattaggttttggaaacttatataactcaattgcctataataccaggtaggcatgtctccaatgatagtgttgtggtgaatgataagtatagctggtgaggactgagtctataactggctgaactaattgtgtcgtcagtcttatgtataattgccagtaagtaggatcaataaaattcaaaactgtaattcatctaggaagcaagttaggaaactgtaattgatctatgtttgatctgccgttggtcatagtcactagctttttttaccaagttgcattgtcgtcattgataatatttgtttgcaacaacaattaacttgcagttaaaaaggttggaactgaagctgaagcagtttgccgaagtcgagaccttgcttttgaaagaatgcgagcaagtggagagaataaggcagaggattgcatctgaccgtgtccgaatcgtgtccacccgcttggcctcgcctggaaatagcctacctgggggtagtactagcaccatgtcatccaatccaatgagtatgagccccagaccgatgggcgtgccaggctcgatgcctcaatccagtatgccagcaccatttgccaataacatgcaggggcatggtcacccccagatggcattcttacaacagcagcagcggcagcagatgctgtcatttggacctcgtctgccgctgtcggccatccaaacccagccatccccacagacgtcaaacatcatgttcaacccaggcatgcccaattctgtaacccctaatcatcatcaactgttgaggtcgtcttctggaaacaattcaagtgtaggataggagaaagaaaaaagggagattcataagattccaaccagtgtagcttcctcagttgtagctttatatgattcataaacatctcattgttattcatttgtacaatatgttccattggtcgtataatttatgatcacttaggttctcattttatgtatttatgatcacttgggttctcattttatagcctcaaaagtgttgttacggatgtctcacgatatatcgtttgaatctggtgaaattgcaatatttgcgctttaaatatcacatagcaaacataaagccctctttggcacaactcgagatccaagatttaatggagctgggtatttctaggagttgggtatttatagctccataaatccatggatatagatctatgatcacgcggataatatttgattcaatcaatttgttcttattttaggtaaaatttaaaattttaaaccactataatttaacatataaacattaaatatactgtaaatctaatatttggagctatgccaaatagcatttagagctgtaggttggttagaactacagatttagcgttggtcgaaactacagattttgaaattttacgctaaatctgtagaatgctaacgttatcacaaagctatagatttagcgtgaaatttctcataaaactacagatt

SEQ ID NO: 38844 - DNA, 691 bp, Oryza sativa
tagtgacaaaagagagctgagaactaactgaatagtggcaaaagaaagagttccaaattcttgatggtctttttgttggatatttgcttgcaaattctatatgttttttttctgagaaatataaaatttcaagttaagaattatacatttagagatctattgaaacgtatgggtattttgctagtaaataccttttggtttcaatgggctacactcgcatgccacacacatccataaagaacatcgatctggttaaagagatttgctaaacacgacagggatttgtgatatctgatgttgactgccattacatgcaggtgtgcgttgggccatttaatttggaagactcagaaaacagcatggtttttaaattatgtgatttatagtcctgtaaaaatcttgtttatatgtacgttacgtgttgcttaatattggatttctttggtattaatttgtcattcatctacagaaattggagaggcggcgaagttaaaggcggctgctagaattagacgagtgttagtagtggagggatcaagtgaatcagattcatgccacgtactgtgcatccatccagagaaaattgctacaagattaatctgctatgcccctaaattttgtgtcatccgttacatgcaccaggacttttttcttattggtagttgattgttatttttctttaaataactac

SEQ ID NO: 38845 - DNA, 802 bp, Oryza sativa
tatgggatttacatatgttagttacaatttttaacaatttaatatcatgcatatgctaattatatacaattattagaatttttaaaagttttaaatcatgcatgtgggatttacatatgtttgttacaatttttaacaatttaatatcatgcatatgctaattatatataattattagaatttttaaaagttttaaatcaagcatgtgggatttacatatgttaattagaatttttaatgcattatttactatttagaaacacatatgcaacgaaattcaatattcagtgctattaactttagtcctgtttcttaaccctaaccaggtttaaaaaagaatttgaaaatagcgggaaaatatctttactcccggttgttgttacgaaccgggagtaaagatatctttactatctttactcccggttcttctcaccaaccgggagtaaagatccgggggtatatatattcccggtgcgccctcgtcttctccaccaacacttagacgtttttccatcgagatcgagcatcggcttctccttcgtcgccactgcctagcgctaccccgcgccgacgccgccgttgtctctcaccgtcgcctggtggtcctcgccacctccgccgcagacgccgtcgccgcgtctcttgggtgagagccctcgccctctctctctctttctcgatgtagctctctgtctctctctctttcgccgacggacaccgacgacgccgacgccgacgtatgccgccgggccgctacgttacgctgccgccgcgcccccatgccgccgggcccccatgccgc

SEQ ID NO: 38846 - DNA, 5551 bp, Oryza sativa
aggatatatgattatctaccgtacaaatacacgacacttagacttaacatatttgagtgttagagatagttagagatttaatataagattattagaggtttaatatacgaaacttaattagacttagcatatgtgagtgttagagatttaatataagattattagagatgtaatattcgaaacatatttgattgttagaaatttaatataagattattagagatgtaatattcgaaacttaaatagacttagcatatatgattatttgagttttaatacaagattagtagagtgttaatattacgcttagcaaatatttcttctatgaacagatggctgatcgtgatgaggaacagatactgtacgatacaatcgcatcgggaagcagctagtactggaacgaagaagaggggaacgaggatccaaaccagtacttgaacgaggaggggaacacggagagggatgcagaggggaacgaggaggggaacgtggagagggatgcggaggggaacgaggaggaggctagtggaagtcatccctccgctggacagaagagggcatgcggaaaacgaggtgccgcgaagaagatagagggtcggcacatcataactgaggtggacgcagatggccgacgtagtgccccggcacaagcagccaagaattttgtacgccacagcggttgggttgtgagggataacgtgcctgtcagcaaggtgtactggcgcagaacaagggcacgcaggggtgatgacagctttgtcccggaatcagagaaagagatgctgtggaccacaatgctcgagacgttcacgctccctgcaggtacagagaacatagtgaaatagtggactcttaagaaaatggcagaacagttccagaccttcaagggagatctgtaccagaaatacatcctgaaggggcagacaccgaacttcgacgtattcctgaagctatgggatcactgggacgagttcgttgcttacaagacaggtcaacaagggcaggcgatgatggaaagaaacaaagaaaatgccgctaagaagaagtaccatcaccacttggtgtcaggcggctatagcgtcgcgatgccgaagtgggaggagatggaggcaagcttgcttgagaagggtatcgaaccggccaccgctaaagggcctgatcgatcgaagttctggtactatgctcacggtggaatgctcaacccagttgatggctccttggtcttcagcgatcagatacgcgaggctgcgaatcgactaacggacgcagtggaagcctcttctcagggcatgttctgacccgacagagagaaggacgagctgtcactcgccctacagactcccgagcatctaggacgaacacgagggaaaggcgtgattccctggaagatgggattcaaggaggacatccacacgtacaagagtcggatgaggagcaagagagataccgaggcgaagattgcagatcttgagtacagggtatcgagctacgagctcagcatgcaagaggaggtggcccggaaggtggatgaacgcatggcagcacatcggtcacacgatccccagccgtacatacctcctccaatggtcagcccatcaggcaatcatagcagctgcgcctcaatggggcaggtagtatcacatagcatggacgccatgcaaacccaggacgaaaccacctgccccgttgatgagatcacgcaacggacaccatgtgagctgcatattcccttcaagaacttatcaatcaaggtatactcgatgtaatatatgatttttgactcgtacattccgcaagttgctacttaggttgattactaatagataacctctcatcacgtgaaggtggcgttgggaatggccatcccaacggacatttcagggacttaccactgcaggccgattccagcaggatactcgagggttaaagttgagctggtggaagccgtgtacgaggacctcgagttggactacccaggaggagacggtgagacgcatctacgagacacaagccacaccattatactatggcgcaagcggtacatcatcctccctgggcgacaagcggcgtctcgtgcaccatctcttctggctccgccgtctcctcctgcaccatctcctccggctcctccgccacctcctcctgcaccatctcctccggctcctccgcctcctcctgcaacaggctcctccgcctcctcctgcaccatctcctccggctcctccgccacctcctcctgcaccatctcctccgcctcctccgcctcctccaccgtgtccgcctacacctcccaagacaaggtctcgccaagctccacctcctgccagcacaagggcaacgaagaaggccaaagttgacaccaccaaaaacaaggagccaccgtacggttgcagtcaagaggagcttgacgcttatgtggcaggagaagtgaagaggcaactcaagtctcggagtcttgaaaagaagatacatattgacccgagcatgaagaatttcttcaagggaatgtccaccacaaacaaggaggccttaaagctatcagactatgaccgaacacttaggaaagcctattacaagaagtccaaaccagttcctcagcttggagaacaaccacaccaagtggtagagccgttggtgaccggcgaagactttggcataacggatttcatttcggacaccggtctaaccatcgctcagtaggttggaggcgcaccaatcccgaaggcggaagtggcatacaagtttgaactcagtaaaccgcttgtcaggcctgagcagctgcagtccctaccgacacaaatgtacaaattccatgcacggtacatggaaatgagcgccaatggtagagagatgttcggagcgaggatcagaaaccccgacttcttgcaaggagaagatgttctatggatccatttcaaggatgtcttcgatctgtaccatcgggacgccctcgacgtctctcttcttagcgcatggattttgtaagtatctttgagttcgatttgtttcattcaataattagctcctggcatatatgtaagcaataataatttcctttcattgttgtagaatggagattcaaagggcccgacagcgggggttttatgatactgggttcatcgtccctcggaaaatcaacaccgaaatgctcgacaagtacgagaaagacacagaggacaatctcgtccatctcctaacgcagcagcatttcaagacgttcatactattgccgtacaacacagagtgagtttttgttgtcgtttgaacaaatttcattcccatacatataacatgtatattctgatatttatctcatctcacgcatattctagattccactggtcctgttctttttcgacttggacgcatgcagagtcactgtgtacgactcaatgaataaaaaggagaaggtttttgacaaggtcttccaactgatagacaggtaatataatgccatctattccaaagtcgcgggactctgttgctattatgttgatctcgggtaatatttaattaatcatagcttgcaactgcacatgtagggcttgggatcggttccgtcaattggtccgcgggacttggaaagaaaaacttggacgaaggtttcattttctagtgagtacatgcatgatccaaaattatattgaattgaatctctagttacagttaatataaagagtatattaaatctctcatcgtttctcatgtagtgtgcaaagcaggacaagggaactaacttatgcggctactacgtatgcgagtatgcccactgcctatcaaaccaaatatacaccacacgagagctcgatgtacgtatacataaaccattcaaaatttcattgcgtatcgatttgttaagttgtttattaatttcatatattgatatgtcattatttttcgaatgatagcgtattcacatgagggaaaaactcccacacaaggattttatcatggctgttcaagaacaactgatggggttcatcaacgaagaagtccttaatcccgatgatgaattctactatgacggatcgataattcgtaacgtctgtccttcctcttctaacgtaacgcaagcgtcgaagtcgtagctatagctagcgagcaaatgaattgtactatacatgcatgtatatatatatatttatatatgtacgtatatttactttagtgtcaatatatattttggtaacatatatgtacacaaaatgttaagtgctttaaattataaatatgtgtgtaatatatgtatttatacatatatacataggcatatatatatatatatatgtatatatatacatgcataatatatatattacaatgcatatatatgtattgtaatatatatatatatatatatatatatatatatatatatatatatatatatatatatatatatataatcaaccatgtagcaaacagggccatgcaaataaaaaaaatggtacatagatctttagtccaccaaccgggactaaagatggatcagccggccacgtggctgaccgatctttagtcccggttatttcacccgggactaaagatcgctatctttagtcccggattcgtagtcccggttggacaagcgggactaaaggggggttacgaaccaggagtacaaacgatttctccactagtggtatctgcatattgatcagtgatttgagagagagatgagaagagtaataccattataatgtgagatcagtagtagttgagttgcacacagctcttgcgctaagatcccggtcttgaaataccttgggtactctcgttaacctttagttagtgttgttcacttgctaagatcccggccggccggacatcgcttaaatatacaatgcagaacgatttccagtgtccaattaattaatacgtgttatgttctccattacaatataatgttctgcttttttggacggattcgtcctcagccctttccaacaataatatctagttttataaaatgcatgcactctaacatataatcgttataacagaaaggtaatatacgtatcatacatacatatatacaagttttacatactcatggtcggcgcacagatgtcaaaaaaaatataaaaaagttctactgctactctcagtcaagaattgattgtattttacccgtaataagaaagaaaaaatgacaattctatgagtacaaattcattagaattttctattccccgctgctctttatgtgatgaattactacatctgtctacacatataaaggattccggggttcagatttaatccacaaatatatataagaaattctataatactagttccccccaactaatcacccctcatttaatttccacccaatataccccaaccatatatccttccatcccacatccttaatcctaatctctcaaaaattcctaggtccatatatgtatgtatatatatgtatatgtatgtatgtatgtatatatgtgtatatatgtatatatatgtatatatgtatatatatatacgtatatacatatacatgtatatatgtatatgtatatacatatacatgtatatatgtata

SEQ ID NO: 38847 - DNA, 4387 bp, Oryza sativa
tagctactccctccctgtccgccaccaattcaattcgtttgcctagataacgataatgactattaacgggtttattgaatcgaatacttttacccgtattttttttccctcagggtcaacaagattgtttctgttctgtagcagattcgaaaattgaatcaagaatcctgagtttgttgtagatagaattttgttcggagacagctaaccagagatatttcagggtggttttttcgctctttagtttgcttatccaaagcgagaaatcaggatgattatcccatcgagcagaacattatcgatctaaaatcgttctctgcgttttgagagttcttaacccatctcaactcagattagtagcctcgccggcggctgcgttgcagataacgttgaaagctctagcatggagaactccagttccaaggtttgttgccatattcatctgttattttgcagtgaatgcggcgccggccatggcgacgatgaacagcaccaacccgacattggtacggtatagcagtgtcaagctgcaggctgccggagtggagcgccccaatcttaccggagaggagcgccccaatgtgccgcgtgcacgccgagcgccccaacgccggcgccgtcaaagctcgcggtagccatggatggattttttttcctaatctttgagtctttttttgatcgtatctcttaatagtttgttttgtttatgtttttgcatttgcagcacctttgcagtcctgcagcaggtgcgaatgtttcaggtggtggtggctctagttctgttttcactagagcccttcatgctgctcaagcaagaaagatgcatcagcggaagcagctacctggttctgcagtatcaaattccaaaaaaacaagtggcatcaagggtaaaaaggtagtacaagaaaaaatttacaccaggtgcactcctgctattctctcagatctgttctcaagttttggtgatcagcaaaaagagctagtgaaacagatggggtttgatgggttgctttccatgaggctgactaaactgaacaagcaattcggagcatggattctgtgcaagctagacccatcatcaggtaatctgtttacgggatctagacatgaaatttgtttgacatgtgaggatgtcagcctacttttgggaatcccttgtggacggaaggagattttgcctgcaataaaaaacgaggtaaaagatgttaaggcttatatgtatgaaatcttcgagaaagattcctttgatggacttaccattgtaacaattcagaggatattggagaaaaaatttaacaggacgatgactgttcacgaacaaattgtattcaagactgcttttataatcttcgttgtaaccaaattcttggctcctcaatctgttaacaatcacatatctataaggtatatgaaggctttggttgatgtagaaaatattcacaagtacaactgggcggaatttgttttgcatgacatcaaagatgcagcagcagcattgcaacacaaaatacgccatcggaaaagcattggttacatcaatggctgcattatactacctcaggtgaaattatcctattattcgttcgaattatttgccttttactttctaatatactcgcaacatctttcacatgctataatttatactgctcagcttttttatttggacaatctggatttcgggacggacactcccgagcaggaaaacattccacggattggcatgtacaatgactccatgatagcggaattcattgagaaggatgtaattctcaagaaccggaatcctttccccgcgtatggaaagatgaaggtaaaatcaactctcctgccggtagtatattcttgttgaaatttctcttctgcagaaacttcagactattgacatttttattgggtttcagctgcgaaacaaacatgatgaaaaatacaatattggccatcatacgggtgcaatagaggtgcaatctcatgtagtttgtcaatctattcaatatgaaaaaaatccatttttctataagaattgttgatatatctgtacacaggctatccatgtggatcatacctacgatgccaggtctgacatcgagcccccaagctttaatctaggaataacacaagatatcgaagaagtaaacatggtggcatgtaccccaggtcatgacatatccaatgtggctgaagactctgacaaagaacaagaactcaactttttagcacgtaccccagatcagccaatctcaaagtcagtagatgcctctgacaaatccggagaaggtaatgcagtgcacaaaactccctcttcgcatagaggtaatgatacccacaagcctgtatcagtttttcattttcattcataaccaaccacatgcacataatatgactcactcttactgttttgactcataataggttaccaacaaacaaaacttagtagtttctctccgtactctatgttgaaagagacgagtggggcgtgaggagtacgcatgtacaaagctcccacctaaatccaagaggagaattattggcggtccttctgatatcctattcgatcggccaaagaggtcgattaaaccaagccatttggtgaaatcaccatttctgagcaagcaacactctttcgtcaggcatgaccagaaggcacttgatgatttatgcacatatgcaatttcaatcgctgatgcagaagctcttaagtaagccacctatctgaaacacttgatgatttatacacatatacaacttcaatagcttatgcagaagctctaatgtaagccacctacctgaaatgttcctttctttcaccactaattgtaaagatatcacatttaacaggaaaatctgggttcacatctcccaacctgtccctatgtcattaagcctacatgacatacaataggctattcggctggacactcaaatgcaagaagaaacattcaatgttgcagttcaagtattagtagcggatgcgatacagagatttggaggaactgattttgtaggctggagacatttcttaaatcaagattttgcagtaagtgcttccaattactctagatcgactatttcaatttttaaatatggtgtgttttaacataatatggcgctgtagatgtttgcaacagctggtgatgaccagtggaacccagaggaccatctcccctcattcaaagatgactccctgataccatatgtcgtacctagttgccacctggtttgataattaacagcatcttgaaaaattcagtacatcaagtgcaaatgttcaggccactaacttttgcaatgtcaatattaatttgcagatatttattccactacttcaaccactgcactattctctatacgcatttgatatggagaaaaaaaatatgcattcttgacccactgagagacgcctcgaaaagataagaggatacagcagaaagacacttaaaaacaaaatttcacatttcatctgctctgaaggagtgcatgaagcttgcatttccagattggggcgaggatataccaaactgggtttctaagttcccttcggtcatcccagctttaaacaacaagttccagttcatgctcccaatttgatccaaattaatttttccattctactcatttatggtcattacaataataacaattttggtaggctggattgtgcctttcacgtgctctactacatgcgaaactgggatggaactcgccttgtgaaccccccaaaatccgtgagttttctgtacacactaggttcaacttaagtttcattgaagtagcttcctttataataaataattttctatattaacaacaggatcaacgagatcttcgaaaggaatttctgtccaacttattgtcattcagaaacaacgaagctattctgccggacttcgtcgttcactgcctgaagttatctaacaagatctgagcagttatgcaagcatgccaaaataaacattacattcagttacatcattattatctaaaatttgttagttcccaataatatttgtcttgttcttattcaacatttttcaaggcttcatgttctctgctattctcttcccaaatagatgaatttgtcatttaccttccaactatcataaatttagattttcccaacatcaaatccatgatgttcacctatggcaaattaaatactagaaactaattacatcttctgttgccgtacattacgtgatcagctctcctccgaacttagagagcagatcatgccatgatccaaatcagtgcatgcccagcgaaaaagagacatgttctgctgggcgaacatgtctataacagtcatgttttgctcggcgaaaaaaagacatgctcccagagcagaacagtatgccaattgatttatgctaccacgaggatacatccc

SEQ ID NO: 38848 - DNA, 7109 bp, Oryza sativa
atgttgtacctattagtctgatatgtagtatcaaaagtgattgcatccccaaaatgttcaaaacttaatctggacagtgaatgacaccaaaatatatttttaatccttgagcaccatcaatctgtatggtgtaaaagaaattcttactacggcattgcatttccctaaaaaaattcagtgtcttctgcacatgattgctacactcatcccttctgatggcatacgccattcttgtcacagccctccttgtaaagggggttaaggacggcccgccgagcatacctgaaagtaatccatacatagctgtaggtgtcatcccattatctaccatttcctttatgttcctctttgtcccttcatcaatgaaattatgagacctgaagtgcttagtatgctgcaggtcccgtttcatttcatggttatgctcactaatgaatgcagaaactctccacttttgactttcagaagaacgatttaacctgaccatagccttgcagcctatcctggtcggcggaccagtgacagaattatctctacctgcataaattacaggaacaccttactacgtaaaacctatcgaatgatgatcctacgcatcacactgtagaaacttgccaatcctacgagaatacgaaaccatggttttcaaaaaaaaaaagaacacactaaagatttttacctcacgaatgcagcagaactcttgcatggacttcacgccttcatctttgtatctgttcttggatctccttataccaaaaccagtgaacctagcgtacagattgtagaacgcatagccattagagtcctcattgaaggtctgcccaatttccggcaacagaatggctgggtcagagagtgaaataggcagcagatcactatcttcctccccctcaaccacgatcctaggatcaaaaaacgagaaatcaggaaacaatgcagaaaggggaattgtacactacaatcacactgacataaaaaaatacctttccaacggaactacgtccatgggttgtccactatgatcctcgccacctttctccggccagccttcttcctccatacctatctccgtgaatattgtttctgtccagcacggactctggtagctaccccttttggcaaacagaatttgctctagggtgtccttttttttcagctggttggatatatactgacaaataattacggtttattttccaccagctgctcaacaacctccccgaaaatcaaggctcctacgtgcgaagcatgttattggactctggaaagtcagccactagcaacattaacgaattctgatgaaaccataccgccacaaaaatagcatctataacaaatattccgaatacgcaacgctacactcacagaaaccaattcgaaatctctgctccattcttgtacaatattctgctcgaagaacttcatcttggtgaaggattgcattcacgatgacaacagggagtttgcagtacacacaacttaaatagataaatgaaaggataacatctcaattttatttcacttcccaaatagcagaagatacagatttctcaactcagatactactcgcttttttctcatagaatataccatacaaaactagagacagttcgtacgactaatctacggccgtgcagaaagcaagcccttattacaattttcctgatcatcacactattggctacatattttccttggacacatgttcgcaactattactgttgccccgggttgtttcgttgcttctgaaattcacgtcgcaagccacgcgaatatcacggagtgagcaccaagcacatctcttcctaggattcctcatggaaagaggatgacatccatccaaatgaatgacatatttctggagggagtggttcatcacttcactccgggcagcagtatccatgcaacgcacaaaaccattcctgatgaccaaataacgcaataaccagtcagagccaaacaaacaaacaagagaaaaattttcaacagaacataacctaaaactaaacttctatgtgtacctatctgcggcaggcttctgctgcttgtcaccattagctgtaatggttccattttcttccttcgccagattgtgctgcttgctactactcactggcgacgacgcgcctacggccaccaccgacttctgctgctcgacatcacgcgccgacgagcctccgcctacttgcgccgcggaaggcgacgcaacagacctcgccgacgacattctgccctttccaccggaggggttctgctccaccaaaaacctgcagaacaaaatcttcttcctcacaaatccgaaatataattctgctcctcattttctgtcctacatcaccgtcaacttaaatagagtatcaacagcaacctccacactaactactctcctggtcgcacggccatgcatgcgtgcgggtcaacaatccatgcatgcagaacattcaaaatgactcgccatgcagaacaccacgcggtgatacgaattttcaaagaaaaaaagaatattcaagtttctgcatcggtggatcagtggatcttttctcaccaaccgttagtgagttaaagcccgaaaccctgatatgagttgggcaggtgtccgatggttacaataggagtacctactacagggagtagtatataggcttcctatgtatatatatatatatatatatatatatatatatatatatatatatatatatgtatgtatgtatatatatgtatgtatgtatgtatatgtatgtatgtatagatataaatatgtatgtatatatatatatatgtatatataaatatatatatgtatatatatatgtatatatatatatatgtatatatatatgtatatatatatatatatatatatatatatatatatatatgtatatataaatatatatatgtatatatatatatatctatgtatatatgtatatgtatatgtatatgtatatgtatatgtatatgtatatgtatatgtatatgtatatgtatatgtatatatgtatatatatatatgtatatatgtatatatatatatgtgtatatgtatgtcggagaatgaactcctccaccagggaaccgtgaggcccccctttgtgtgttcggccgggggcagcgggtgagattcgagggcttggtgagcggagctgtgtgatcttgagggggttagccccccccccccaagacgatgagacaaaagaggtttatacaggttcgggctgctgagaagcgtaataccctactcctgtgcatgattgattgaatgtagaacacaagtgcttggggttgcgagacccaagcgccagttcgccccgaagtcccccctccaccactaggcctggacctccttttatacctcaaggggttaccacatgggcccaacaacctaacctaactccggtggagaagtattataatctttgcattaaatgcatgtcttgtctcttgacttgggaagccaagcacacgtcgtcttgatgatggggcctgtcaaatcttgccgcctgacatggggggtgcccctgtcagtcaccatttaatgggtgaagacttctaggctcctattacaccgagaaacgggagccttgcttttaccagagcgggaggactgactctggctgggataagaggatgagaacctctcaccatcactatttgatgggacatgtcaggctgcacgccgcctgacacacgagcagcgcacaggcgcactagccagtcccattggtcattcgaccggtcacagaccggttgagtgcactgcacgccacattaaatgcagcgtggcgcgactactcgggatgccataaatgcgggtaggtgggcacttggaggcggacacctaacctaccgtacgtggtgacctaaagaaggggtcgggggagcccgacccctagtcacgagaaggggccgccgccgcccgacctcgggcccgattccccctcgagggggagccacgtggcgcctggggcagccttctccctctagtctcggccagggagtggccgccgccctacctcgggcccgacccctctcgggggagggccacgtggcattggagggcagcctcctacatctagtctctgggaaggagtggccgccgtcctacctcgggcctgactcccctcggcggaggaccacgtggcatcggggggcagcctccaccgactagtctttggggaaggaggggccaccaccccacctcgggcctaactcccctcgggggaggggcacgtggcatcggggggcagcctcctccctctaaacatgatagccccgggcccatatcaccgacagtagcccccggcgttagccctgaccaaaaccttccccaggtggtcagggtgacgccactttcctagtctgatgataggtgggcccgatctcttattctttctttgctggtactaggacccatgcgcctttttcgccccaacctaagggcgactcgctagcccataccttaggctgtgaaattattttatgtatatattcagcaaacgttgttagattctctcgggcccgtgaccttacgccgcgtacctcacttgcccctgccatttgttaacctttgttcatgttctacttcatctattcaaacaattattttcgcgagtgtgaggactgaactttccatagccagcaatcttcacccgtgatcaagctaagctgggcgccatagccagccggcggggccaaagccagccgctgtggaagagctagcataggagggcccgggtgtcgacggtacccagagcttgacgcaaggctaggatagagctaggaatcgtagcccccgtactttaagcaaagaatcgtttgaatggatgaagcgaatacaaactttttgttaccaagggaggcaagccggtgcgcgacacataggtaccgcggagaccgcgaggaagagataggcgagagataaatataagcaataataattttatgcaaacgattatcttcgcgcgagtgtgaggactgaactttctatagccagcaattttcgcctgcgatcaagcgaagctgagcgttgtaaccagccgatggggccaaagccagccgctacggaagagctagcacagggggccccgggcgtcgacggtacccagagctcgacacagggctaggatagagctaggaatcgtagcatccacacttacagcaaagaattgcttgtatgaatgaagcaaacacaaacctttagctcgaagagggccccccaccatgggttccgaaccatcttgggaagcctgtgaccacttagcaaacgaggttaggttcccacgagcctgtgtccccacactacacattctgtttgctctttcctttcggtggcctccttccaatctcttttccttctacatgcacgattactttcgcatgagtgtgagagccgaaaactctagagccagcaatccccgtccacagttgagccaggccgggtaccgtagccagccggcgggaccaaagccagccgctacggaagagccaacacactgggtcccgggcgtcgacggcacccggggctcaacttaaggctaggataaggctagaaaacttagcccccacacttagtgaagaatcgttcatgtagatgggggagaggttgggctcttaccaccgagggagcaaacaaatgcgcaacacgcgggcgtcgcagggccatgagaatagaatggggggaaagaaatataagatttcaagctaatgaattgaaaaattgaaaatacttgaagcttgaaaggacgatcagttgagccgggccgggcatcgtagccagccgacgggaccaaagtcagccgctacagaagagctagcacagggggtcccgggcttcgacggcacccggagctcaaaactgcaagagtcctcccaggagtgaaccgaggcagcagcaggttcatgggccaaccccgcgcttggcccctaagggccatgggaatgacgttcgccatgacccggtcgccaccacccgccacctctatgatcgccgtgcagatctggagggactcggaggggtcggcgccatcgtcgtacttctcggtgaggcagggctggagctttgggggccctcggacattctgaagactcgccacaaagaccaggtagccaagattacctggtggggatgtggggggccttgccccctgcctggggtggcacgacactcctgaggatgttgcgccttccccagtagcggcggcgcgacactcaccacaccggcgctcgaaagaacctcaaaaatcacgaacgcgccccctacctggcgcgccagatatcggagaatgaattcctcaaccagggaaccgtgaggcccccctttgtgagttcggccgggggcagcgggtgagattcgagggcttggtgagcagagctgtgtgatcttgagggggttagccccccccccaagacgatgagacaaaaaaggtttatacaggttcgagccgctgagaagcgtaataccctactcctgtgcatgattgattgaatgtagaacacaagtgcttggggttgggagacccaagcgccagttcgccccgaagtctcccctccaccactaggcctggacctccttttataccttaaggggttaccatatgggcccaacaacctaacctagctctggtggagaagtattgtaatctttgcattaaatgcatgtcttgtctcttgacttgggaagccaagcaaacgtcgtcttgatgatggggcctgtcaaatcttgccgcctgacacggggggtgcccctgtcagtcaccatttaatgggtgaagacttctgggctcctattataccgggaaacgggagccttgcttttactagagcgggaggcctgactccggctgagataagaggatgagaacctctcaccatcactatttgatgggacatgtcaggctgcacgccgcctgacacacgagcagcgcacaggcgcactagccagtcccatcggtcattcgaccggtcacagaacggttgagtgcactgcacgccgcattaaatacggcgtggcgcgatcgctcgggatgccataaatgcggtaggtgggcacctggaggcggacgcctaacccaccgtacgtggtgacctagagagggggtcggggg

SEQ ID NO: 38849 - DNA, 3414 bp, Oryza sativa
gatcatacgtctataatgcattgtatgtcctagaatagggcccttttggcgttccttcgtagatctacggatttcacccctacacacgaaattccactctcctctgtctcactcaagtgaattggtttcgagagcattccgccactttttggtgactttcactttcaacccgattcacccccaagacgatgttggcgcagaagcaataaaagtatgatctcgttgtcgctttcatcaacccggaacgatagtgtaggcgagcccggatgtagagatggatgatgtgtaaccaaagaagcagtgcccaaaatgcctctagaaagatcagacagaagtaagacgagctgtaattgtacgtacatgtaaaggagcttagtatggagttgcctggattagatcctcgttggtccttgaagaagaaggcggaagacttaaacccttcatttcctaatttttggttcggctctcctaaagaattgacttcctagagccacatgtttcgtcgtggtgctgatcgcgtggtttgcctcttcgtccaattttagaatactttttgattttttagtcccttatcaacatttcatcaatatctccatcttccttgtcaagttccctaaccccctttatagcttcacgctgtttgaatagttccaattaatggaatcaaagtcattacacgagtgagtttagcaagtggaatatctgactttgaaggagctgctgcgaggtgtatggtttgagtacaattaattcatttttttatgtatatgtatatatatgtatatatgtatatatatatatgtgtgtgtgtgtatatatatatagacatatatatatatatatagaagaagatcagagtcaatactagaaaaatcatttttctagacgatgacatttttttctaggcaggtagggctctcagagctaaatgaccacttgcgaaaattacaaccgtggggtgaaatcgttatccgcctgcaaaaatctattttcgcaggcgaaccacttaagcgatccgcctgcaaaaattccatttatttttgcaagtggacctcttaagtggtccgcctgcgaaaattggcgtggcatataaatagatgcgacatcaataatattttttctaagtcctatcctctcttctcccccagctctcctctctccctcagccctcagctctcctctccctaagctccctcagcgaccgtgggcgttctggggggcggcgacggcaaggcgcggggccggtgggcaacgcgagcgcgaggtcagcgatggcgaggcatgggtgggcgacggcgatgcaccggggctacggcatccaccctcggcgcggctccccttccctcccttctagatgtggcaaagagggaggggagggcggtggtggctgcggttccactacctcccagatccggccggagggaagggggagggcggcggcggcggttcccctccctccccaggtctggccagaagaaggggggagggcggcggcggttccccttcctcccaggtccggctggagggagggggagggcggtggcgagcggctccacttcctctccctctccctcccaaaaccctaacctagatcggccggaggtgggtaggggcttgggtgggattaggcccataagtttgtatacccaagcactatatatatttcactaattatccttgccaactcttatctaacttgtggctaaggattacatagtcagataaattgtgacatgtgacaccttagttgtaaaagtttggtaaattaaaacaagctttcgaacagcccattcttcaacaaaaatatttcgtagaggcatttaattattagccctgcagaatatcgaaaactacaatttcaatacaatggaaagtacatttgtagtttgctttgttttatatttttacattaatcttgatgtattgttattattttaaaaagaaaatcataatctcataacagtttacaacaagtaaaccttgtttttccacttctaggttagaacattattcgcttcaccataagaaaagaaacatacaagtgtgagttgtttgtattgattcggtgttaaataaatgattgatagataagaaaaatattagccacttgacaagtagactcccccttagaatatttaattaactagatatgttaaatattattttatatttaactgtccaagctcgaataattcgtagtaccataaagctatccctcattatggtagcaacgcaagagtgctgaggtcaccttgatgacgtttaagaaaaacagagagatcacccagcttgatgacgcagcgaaattatcctgtttctatattgaaatctaacaagaatcagaaaataaaaaaatattggagcggttaccatatgatcagcaatttgtcgagttggaatagcatttacctaaaccactaataaagcatatacatatgggttgtagaaattcaaagatatgttttaactctctctttttttatgtgggcatatatgccaaagatgatatgttggcaagagacattattgaaacctaattattaatgacctgtttaggacttcagttagcttccccaatgtttttttttttttttgaaatgcacatggcattctcttcatctggaagctagactggaacattttgagctgtgccttttggtttcaacatatgggcaacattcccatgccacacatccataaagaacatcaatctggttaaagagatttgataaacaagacagggatttgggatatttggtagtactagcattgtacgcagtggcgttttgggccaattggaagactaaaaaatacagtgcatggttttaaagtcatgcgtatgtgatttataatcatgtaaaaatattgtttatatgtgttgtttactattggattattttggttttaatttgtctttctacagaaattggagaggcagggaagttaaagacatgctgttggaagacaagtggcaggctgacagcagaagtttcaaagaatcggagaatattaaggacggcgggatgggcgctcgctcgctgcgtccacgtcggattttgctacagtagctacagtgcgcgcggggtggaaattatgcgaaaaagccctccgatttttcgtaataatgtataggtccctagcgtcctgtgtttgaagaggaataatcgcggacaggggcttttttgtgatatgtgaaagaagaggggcttttccgcaaaacagcatccactaacgcataccccccacagccctagctgccgcctctccctctcccaccacccctcccgcgccgccgccgcctgcgcctaccctcgcgccgccgccgccgcctcccactccccctcaccccgtccacgtcgccgagcgccaccgccgcctccactcccgccgcctgcgcctaccctcgcgccggcg

SEQ ID NO: 38850 - DNA, 2932 bp, Oryza sativa
tggcgacgacgacgacggtcgatggggtcatttcctccccacagaggtgggggtccaagctggctgcggcaaatttagtttgttcacgctgttcagaaacggtggttgcgtttcatgtgtacgggctgcgttgattggtgcatgtgaaggcacgtgtctttgagtgtgtccgtggcagcttgggcggtgcatccgtggtaaagaaggaaggggacggcatggcattttctggatgcactcgcatttcctcttcgtcgttggccgcgccattccgtgcgatttttgctccgatatcagcggctccattgttttgcccccctgatttggtattgaatcgatgctctttctatctcagtgccaaatctgtatgcctggtgtgatttcttcctccttatacattttctccctggtaatggatggccagttaattggtgttggatgtttgcttgctgttcttcctcgcttgtctctgcatatcatagcatggtacaaatcgttcagggtgcctgctcacaccactcaagatgctctgattgggccattgtggtgtatgccagtcgagtctcgtcgctgcgggagggtcccaccagtgcggccagtgtcaggtgcactcaccaccactcgtcgttcgagggcgggacagagaactcgagcatgcctagtcaatggcagccggtcatcggggctgcgaggtgattggtggcgtctgtgcgtgttctggcgagtagtcggtcccacggctttagccaatcatgctccactgttgttcgggccccacgtagtcgtggtccatgccaattgcagttggccgttgtagcaggctccgccgatgtgccctttttccggcgcagtgttactgctcggtgtgttacgtcggagagctcgaggatggcctccgtcagagcactgatgtgttacgtcgtatgctgtggctgaccgatggccctgtcatctgtggggtcctattgacagcctctgagtatgttgttttttatgttacatatttttttgttttgtttaccagtataagtagctcattgcctgccaatcttctctttcccttctgctttttcgccatttcctttgcattgccttttggtgcccgttcgctgttcttcttgtcgtctgttctagcccattctccgctgttgtgctttcttcgttcgatcatgaaccctggggggtgaacgcgtgggctggtgggttttctgtatctagcctagctgccttcctttgtgtctgtgccgtgtgtttcctttttatcctgtgattaggcttggtgcatctcaggtagccatgtactggcctgtttgttgcacgagacttactgtcacagagtttttaggttttaggcgattttccccgtgttcatatttcccttttcacagtggatcattgcttatctctgttgttcttcttttagtaaatacttctttcagtaaatagatggtggctattacatagatgaagcacacggtcgttagttaatgacaaatatcattgctttttttttcctggttctgattcattattggatcatgtttcgccactcagagtgtgtcccgtggtgttttcttttcgtgcagaaccatgtggttcatttgcatttttgagtctttccttaagtgcatctctgtacgtttacatgtttttttttgtcccttcacatcgattttttttggcgcaggtgcttattgtcgcggtcaggtccgtgcgatacgttcgttgctgttgtgctgctgttccctttaccatcagctcctgttcaggtgagctttgtttctttgctatttctttggggcagacatcctttttgttttgtagtttatttgtgccttgtggtttggtgtatgttctttcttttatctgatatccagcttaaattacattcttattccctgcaggttgcggaccgcatctcctgtgcccgtacatgtcggctaaggtataacaattggcctttgttgcttcagctatctatacattattcgagctgcgctgttccttgtgggttatatgttctatatgtgtgcacgacatttctgtttttctatgcgtttagttcctatatggaagggggtcgtgtggttaggcctgctcgttgacgggatcgccgattgctagagcgtagcagcgcttctcttagatgtatggtttgttgcggtttgttttttttagatgctttagattttatatcttttcctgggtggaaagattaaatcgtctgttgcttgtttagcatcttcctctaattcagctgccagcgaatatgtttgggagactgttgctccaccccatcagggtatgtgatttactgatctgtgtgcgactgttgttgtggcttgtttatatttatgtagtcgttgctcatatatttttctcgctttagtagacgatggatttttccctatctaccctgcatggtattcttcaaaaagacggcaaatgtgttcaaaaaaattggccatgaaacgattggaggctacaggtttttccattggatctttggttttctgcatatgttcttgctgacatggcttacatggatgttatatctccttccctataggcaaaaaaccttgccgtattgctcctgtctcttgcaacaagtttgacagtgattatgccaagtttttaagaggttgctttcatctctgattcgtttccattcccttgtttgcaatgccagcacgcttggtttaaacataaatttctttttttgaatgcttgcatagagacttcaaaggataggtgcgattatggccctcctgagtatcgctgccgtatgtgcgctgctcagttctggtaccaggaacagtgcaagaaagattctgctattaccaagcgccgtgtctgttacaacctttgttgcaaaggcgggaaaatttttgtccctccatttgcgcagccaccagaacctttgaattcactt

SEQ ID NO: 38851 - DNA, 687 bp, Oryza sativa
tactgttgccactatcgtcgagaccagttcaacccatatttatgttgcggtcgtttgtcctcccaaagtcaagttgatggttttgtgtgttttgaggagggtagattgacatttatagatgaacaccagggcgattttagatgcgaacacgttcaaggcattgcagatgcagtcgccaaaggttgtttagacggtaatagtgttggtaagcgacgaattctccctgcaagtttcactggcgggagaagatatatgtaccaaaattatcaggatgcggctgctatttgtcgtgtgtatggtgcccctgatgtgtttaccacttttacttgtaatccgaaatggcctgagattgaagaagcattgcgcattgagccagggcagcgttcgacagattgttctgacattgtttgtagagtttttaaaatgaaacttgatgagatgtttctgatattatggctggtgttccatttggtcgtgtgcgtgctggttagtgctctttttttgcccttaacttagctgtgctctttatggtctattgttttattgatttttatttggttgttttgcctatgatatgtttgtagttctttatagcgtggaatttcagaagaggggccttccccacgtgcatatactggtgtagcgtgatgcaccaagcactgacgccacaccatttgttgtggatac

SEQ ID NO: 38852 - DNA, 605 bp, Oryza sativa
aaaataatacggcatcatatttagtgacatatgccgaggtgtcgaaactcttgtagtcgtcgtggttggtgaagtagcaaagcttgcgaagtagaagcaataaagtttgccggtgccgaagataataaagatgaagtcgctccaccatggtgacaaagttgcatagctgtaatgaagtgaacacgagtcggcggtaacagaagcaaaccggtggtgaagacgcgcagttgtgaagataaaagcaccagtcggcggcggcataaccagtcggcgacggaagacgatgatgtccatcagtagtggtagctattagcggtgacggtgatgtagccagccgtgaagaagatagcatcagttggcgtcataacaggccagccgtgcaggcggtgacaccagtcggcggcggacgaggcggccggtcggtgaagacgtagacgcccaacaacggcggcataataggccagccgtgcaggcggaaacaccagtcggcggcggacgaggcggccggtcggtgaagacgtagacgcccaacaacggcggcataataggccaacgtgcaggcggaaacaccagtcggcagcgaacgaggcggccgctcggtgaaa

SEQ ID NO: 38853 - DNA, 384 bp, Oryza sativa
tggcggcataataggccagccgtgcaggcgaggacaccagttggcggcgacgaaggcaagccggttggtgaagacgtagacgcccaacaacggcggcataataggccagccgtgcaggcgaggacaccagtcggcggcgacggaggcaggccggtcggtgaagacgtaggcgcccaacaatggcggcataataggccagccgtgcaggcgaggacaccagttggcggcgacgaaggcaagccggtcggtgaagacgtagacgcccaacaacggcggcataataggccagccgtgcaggcgaggacaccagtcggcggcgacggaggcaggccggtcgggaagacgtaggcgcccaacaatggcggcataataggccagccgtgc

SEQ ID NO: 38854 - DNA, 633 bp, Oryza sativa
aaagaaacatgctcatagacaactacagaacattatttactacaggcagattagttgcttacttgttatcttttatatgggatgtaatgcgctccaaaatgatctgcatatggcctaccatcttttgctaccactgaccattgcacgcagcctaccagttatatcttttgctatgcataggcatatcatgtaatattactgatcatgatggctatctgctatatttctcagttcttctcgcactgatgaccaagctgctgataagcaacatgctgtgcctcatgaggttgatgtttctcagattgcagctgcctctgctgaaccaaatactcaggttaagcataaatacaccactttccagctaattcagtggtcgaatttttttagtgacactggcaacctaattattcccgttctataggtcaaagatatcctgccaactgaagccaaaaagaaaaggtataaaactacatattccagctgagaacgaataagaaaatccctatttttgtactagcggtggaagcatgtcacattcattgttaaatagactgcaccatttcgctttcgctgctctctcatttttggttcttctagattaaccaggtgttcctctctgctttagtgttgatc

SEQ ID NO: 38855 - DNA, 161 bp, Oryza sativa
ccgtgggatgtccaacaattatagcttggcatgaaccccgactcaaacaagtggaaatgaatagtcctggatgcagaatactccttctgattcttacacttattgcatggacaacaaataaaacccttctgcttgttagcttcggccactctcaaaaaata

SEQ ID NO: 38856 - DNA, 629 bp, Oryza sativa
cgcacagtcttattgaagaatttggaatgaaaagaagagtaatgcttccgagggtcttggcttatacctttgcttctcttctctagggatctatacttggatatgcaactttaggtagtcagacagtcaccctcgtatcggctggatatatatagatcagtggtcgtaactggttatgcttaaggaactgtaacaacaacaaaaggttcttcgtttttcaactggctctaatgcaaatttaaaaaataaagaagagttccgtcaggcgtactgaatctcaagacgttcctcaaaccaatcatatactttattgagataggtaactaacccgaaccccagaagtcatgggtgataattggtctgatgctcgggcgaaaccaattccccaggtgtgacgggcggtgtgtgatcatacgtctataatgcattgtatgtcctaaaatagggcccttttggcgttccttcgtagatctacggatttcacccctacacaccaaattccactctcctctgtctcactcaagtgaattggtttcgaaagcattccgccactttttggtgactttcactttacacccgatttacccccaagacgatgttcgcgcaaaaaccataaaagtattgatctc

SEQ ID NO: 38857 - DNA, 6423 bp, Oryza sativa
  unsure (1)..(6423): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggctttgttttgttagtgttcagtgtatgcctgttgaataaagatccaagattaccttacattcctaatctggctatgcagatgctcaggattattgttccacttcagattaatcaagaatggttatccaatacatgtagaattagtttcacatctgtaggaaatgcagttccagggttttgttcttcagcagtcagttcggaacctctgaagtgaaatcctgttacttcagtggtccaagtctacagatagctcaattgaatgattcaaaaaatggctagacatttcaattttgaaacttggattcagagtttcaggttacctgaaacatacatactgtacatcccaagtccaaagcatgatcctgcgcggagtgcgggcggacaataattgaaagaattaacagctgaaattttcaacacataactaaattttgacagcaaattcgaaaagtcataactgattatgagggcctttcatgacaactcttttgccccagactcaagcctccatccctattgaccactggttggtgtaacatgtaccagtaaatattaagacctactccaggattcaacagagcaattatttttgagactctgacaattatgaaaactcagttgaaccatactgtataccctagtgaaaaaagttaccatgactggcctgctgctgttcattttcgtcagttaccctcatattgggcaatggtcataggctgggtttagtcagcgcaaagtttggattttggtttatattggagatgatgtgactgaaaagttgggtgtgtatgacaggttgatgcgatggaaaatgactgaagtttggatccaaactttggatataaacacagccataaactaatttccaagttaaccttacccatgaaacttggattatgagtttgaggttacctgaaacataaacttggactcagagtttcaagttagcaccagtcttgattctgggcaaaaaagatgtcatgacttattcttaatgaaaaatcgtgtggacggtcacccccccccacccaaccccaatcgagctcacgactaatgaaaaataaatttatcatgacctgctgctgtttattttcactagttaattaaccctcttacgttatactaagtgctactcgttttcaatttgataattcaattcaatagagagcaatcgacaatatataggtggaagaaaagaggaaaacaatgtcaagtaagtaactaccctttcaattcaaaaaaattagattacggttttcttagacatttttttaataccaaaagacatatgggcaatggccaaaaatatacaagataatcagtatcgagatactattagattttagaaaatacatatttttatataaaatatataatatgttgtataaattaaagcatataatattgattttgataaatttaattggtttttaatgtaaacttgagcatatttattcatattattttcaatccacctatttttaaataatattttgtaggatcgtagggatagtagaattaggatactacctaagatttcgtaggaacgtgcgaaaacaattagtaagattgagatactatgaaaattaggataatagatgagataatatcattttgatttggtggatcgtagtgtctagtatactggtatacgtatcgggatactgacaaccttggaaatagaccatggacttgaaggtcatgataagtgcctcaacggctcaaccaaggaggtagctgcagaagaaatccttttctaatgtatcattgtgtcaatacgtgcagcaatatactactataacataagcctgaaaattttaaaagtcccctgaatcagttcctggaacttgtacttcgtctaacttcatgaaattttctgagccaatacaaaatcaagaaaatcccagtcaactgtaggataattcatgaaaaatcccacaaattcgatgtatgatcctaaatgacctttctcaacccctaaagttcaccaatgaggtgacaagctatactaggtcttttaccctttcataactaatatgaaactattcaacaattgaaaacttaaaacccaatttaataattcagaacaatctcaaatgtaacattccagtttttctcttgtttagttgctgaattaggttctatttgttggacctctaaatgttcactcttttttcggagaagccagctccccgaggaagattacacagggtcctaataatttgatttatacgtgtaatcaccattagcgcctttgaatatatgcccacaagtaaataaaatttaaaacgaccttttcaaagcatccaataggtacatgctgttagtggtttaggtaaatattcttctaacttgagtaactgtttttatacggggactagttaacctatggataaccacgggtaatctcatattacgtgatttgcatatatctgaaacagctctaaatttaaattattaatgaaacaacatacacaaaaccattcaaataattttgttgttgcttctatttagtaaatttactaattcaaaatttgtatttacaaagttgtacatattgtggagttgaactttatatgttttcttattatataatactaaaatttagaataaataaaaaaaaagcaacatggtttgaaatcgcacttatagtttttctggatttactaagtactccctccattttatattataagtcgcattgactattttctagttaaacttttttaagtttggtcaagtttatagaaaaatatagcaatattttaatcagaaaacaaacatattatcaaaatatattcaatgttatatttaataaaactaatttagtgtcgtagaaattgctaaatgttgcaataaacttggttaaacctaaaaaaacgtttgcctagaaaaaatcgaagctagagtataaaatttgaaactagcaagtaatcttggagtctcgatgatttcataatttattaattcttgcaattaaacttaataattaacatcgtatgactaacatggacctttaattaggaaatgcatcttcgcacttggtgcgtactattaattttatttttcctcataaaatttttctcaatccaatattgatataaatgcaaagttttaatcttcttttgaatctcaattaaattttttactgaatcaataattatgtaattataaattattaaatattaagtgactttcaattttaatatgtatcgatttttttcgcgaacgcgtaaaaggattgcacgtcaatattagcaggaaaagagtttttgttacacaacggaatcagccagattggcttaataaaaaacctgaagctaggaactactacgatggttaaaacgaaactccaaacaacaggagggggcagagccacactacactcccaagaaatccccaaaaacagcaatgccagctaaagaccacagctggccctccgagcggatggactccaaaatcactgggaccgaagcgagcgcagagtcaaaaaccctggagtttcattccttccacagctgccaagagattaggagtaccaagtagtcaaagccgatacggaggtgctcaggtaaatgggccctggaggatgaccaccaatcctggagccagctgccacgagggggagagagggcaacccagccaggaggggacatcacacggagccagacctaccgagcgaacatgcaattaatgaggatgtggttcaccctctcaagctcctaagcgcaaaaggggtaagcagagtggctatcgataccacgcttctggagaagatcggtagtccagcagcgctgctgaaatgcaaaccataggaagaacttgcatttagcagggcccttcgcgtgctagagcaggtcggcacaggcaaaagagtgctagccaaggaagaacgcctggtacgccaatcgcactgagtagcactggtcacccgtccaacaccagacgaggcgatcctcaacacccggcgagagctgggtaggaagcaccgcgtcccaaactaacaggaactgagagatgaccgggacagtgagggcaccgcgtatatcaccaacccaggagttgttcgctaacccagtagcaaccgtgcgcgatccccggaaacgtggaggcacgacatggaggaggtcaggagctatagaagctagcgaccgaccatcaatccatcgtcagtccagaagagcgtggactgaccatctcccaaggtagtgaaggtagatgctgcgaacatgtcggagacgctccgctcaacagaggccttcagatcagaccagttggggtgtcctgagcgctgaagccagagccagcgaactctcaaggcaaagccagctatcctgaggtccggaatgcccataccactgagatacctaggatggcaaaccttcgtccaggacactcggcattgtcccccattggccgagtccgtacctgtccacaagaaggggtgacgcttcttgtcaatggctttgataacccagcctggcaagccgatcgccatagaaagatgtaccagaatagaagagacaaccgattggaccagaaccgagcgacccgccagagtggtgagacgacccttcgagggggggggagccgatgggaggctttatccacaagtggttgcagggccgcttttggcagcttgcgaactgatagtggaatgccgaggtaggtgcagggaaactcagagatcgagcaaggaaaagaggactgaaccagctctaggtcaagaaccgagcagtggatcggagtaatcaagcatttggtgaagttggtctgaagcccggaagcggcactgaagatagagaggatgccttggatgaactcaaggtcctaccgaacgggggaaaggaagagaactagatcatcggcgtagagggatgcacgatgtcgaatagcacaatcattgaggggaagaaaactactcgagtcagaggctttgcggagcatcgcattgagcacatccatgactagaatgaaaagcatgggggaaagaggatctccttggcgaagacctctccgatacctggcaccccattgaccagcacccgggaagaggaggcactgagaatgagggagacccaatcacgccaacgttgactgaagccaagctgggctagcacctcaagcaagaaaggccagctgaccatgtcaaaggccttcgcgatatccaccttgagaagaagtcggggaacgcatttggcgtggagcgcccttgccgcaagctggacatagcggaagttgtcatgaagggagcggcccttgatgaaagcactctggttaggccaccgacgccgtcgcacctcctgccgacggccccacctccacaccggctgtcttcgccgagccgcaccttcagatttggcgcgggccacctctgtccgactgcctcccgctgccgagggactcggctgcgcaggttgccttcctcccgccgctgcacgccgcctcctgccgccgaggggagcgggccacctccctcccaccgtagcgccacctcacgccaccgagtgtcgccgcacgtcccctcccaccatggcgccgcccgggataaggagagagagaagaaagagaagaggagaagatggagccgagtggaggagaagaggagaagaaagagacaaggagagagagatgtagccgagtggatggataagaacgacgacttgcggtcttgtgcggactcggctcggctcggtttttgtggggcccaccaatgatcactagtacagatccttctatctgtagggagctctaacaggcctagaaatagcgcccggtcctaaggaagttcttttgtggcgggccacaactgtaggaccgtttgcgagtccattccatatctcaaacgggcctcaagttgtggcccgtcacaaatgaccatcatctgtgacgtgcaccaacttgaggcccgtttgagataacaactaggcccgtcatagatgactcatcagtgacgggctatatacttaatctctatcgggcattaactaaaacccgtcaccgatgactattttttcatttttcatatgaaatgtttatatttgtaagttgattatagcaaaataattttacgggtagtaaatgatttcaaatggaaaaaatgtcaacaacaaagttgtataacttatcaatatttacaacttttagtttggtcattttttaatataacatttttttgaacaatttgaatttgaatttaaaaatatgacaacttcaaaaaacattttcaaatactaaatgatttcaattga

SEQ ID NO: 38858 - DNA, 1600 bp, Oryza sativa
tagtgcatgtctcataatctattatacgtatatttgtcatttctatagatagatcactctacataaatatatcaagtctgattgatctcggttaattcattatatttggtgatcaattattatttgatatatttatctagattaacctgtttatataagtttttattggagtaatagccagtacattatctattctacctctaaatattggattatcagctatttcctaatactgtcaaaaggtgattgttaaaaacaaaagaggtattgtagtcgatagtacatatttagggttttgtttcacttgctcatcataaagccacatcccatttggtttaactgcatcggctaggtcctgacgatacgttatcagttctatcggccgatcggctatcgttcatctaattacgttttgttgcaggatcaaaccagctcgtatgctcttgacactcgaggcaagcctttgaccagcactggagtgaagcaaaatctcccagggcaccatgtttcgcatcaacacttacgtcagagtttttttttttatattaattgatctctaagcctaataaaatgtaaaaaaaaagacctatgggggtaaggccacctatttataagggctatggccaattttaatatatcatagccccgaccttgacacctacacaatcgaatcattttatacctttaccttttcaccatattttctaatttaccttagttccatccaacttggaacatttccatcgtaaaccacccgtctttgttgtgagagtgtgatatccttcgtagctttgtcccgtaaaccttcgattcacccacgagatgggtcattatttccgtattgatctaaatcagcttttagactggtttaatctctaaattggctctcctagccaattttgatcttttgtgaactcatctgggttgagaggttttcaagttggaacgttcggtgactcaattaaaactataaatctttagccgagtctatgttggtaaaaaaacgtcaatgcaaatcaaccatagagactagttccattgtttcacattataggacgtcttgggtttttaatagatttatgtatagatccatatatgtgcttcatatttatatctatattcatatgaatattagtgaatctagaaaagggatgagaaaggctaaaacgtcttaataatatggaatggaattctgattaccgtgtctattgatattgctcatccattccataacagagttggttagaaagacaggctgatagagttctctgagtctcaaacggcatgtcctatacagagtagttttttctttaaaagtaaactactgctagcttctgccaacagttaacaagtgtttctctagctagttaaatttctgttgctacgatgaaccgacaacagtatactccactgtcactttcagagttggacaaagtcattaataaagttggtagaattaaatgggagagtattgtgattggagaaaaagtggggataggtaggaaaattaaatggtacatgattatgtttggttgggaagagaacgttggtgaagaacttgttttattttaggaaaaaatttgaaggctagaagttatta

SEQ ID NO: 38859 - DNA, 11521 bp, Oryza sativa
aggataggcggccacatactcttgcagatgttcctatgcttcaggaatagactcgtccctcgtctgttggaaactagaaattcgtccacgatgggcattggttttgcctatcgggaagaacttcaagaggaatgtcgtagagcacttgtcccagatgttgacagcagcacgattggcgtaaaaccactgcttcgctctcccgaggagggagaatggaaacagcctcagcctgacggcttcttgactgacgcccttgatggtgtacgtgctacagatctccaggaactgctgcagatgagtgttggcatcctcgttaggcttgccatagaacgggctagcatgcgccatcgtgataaggctggacttcaggtcgaaatccacgtctccaatgttgatctgcggcccaatggccacattttcagcagagggagcaacgaactcgcggaaggtcttgtcagccatagtcttgaaggtcggtggcgctggtatggctggtttgtctgttggtagagttttctgcggaacaacgactcgcggcctgacactccggaagaaatcttctggattttctttgaagttttccggcaagttgaaaccggtcatgcactaccctgttttcaaaacagaagtgaaaacaaccaaggttagcctacaaaggaaaatgattatacataggtaaatataaagtattagttcaagtaatctttattatgaatcttccccggcaacggcgccagaaatgcttgttggtatttcttgacgacattactagaaatataattcccagcaatggcgcataaatacttctattatattacggttacagagttcatccacaagcgcacggatatatcattgtagcatttcacccgagagtattccaagggtatcgtatttattttatcccgtgggaagatcatgtagagagaacttggctaataatttatatgttaagataacccaagggtagagtgacacacaagcagtagctactcattctcatattaaattatctaaactaagtggaaaaaaaaagagaaagataatctattcctatacttctagtatacatagtatacatacattctagttatccaatatagtagctaataccctctatccgatgccctctccaatgccctcctggtacttcgagaagccaccccttactgccgagttccttatgacagtccgtcatgaccatacaacctgggctaaatacggaggagtaccctccccagggaattaacttaggattatatacatgcgcggaggaatacccgtactgagctgtcaccatcaacggcccacctctgatccgcagcatataaccccaaataatgatatcccgtaatctagacaccacgtctaaactaccagatactactctaatatcatcgtcatgatatagagtaattgaataagcaaacaatatacccgcaccaaagcatctcccagataagctagcagcatatttagtataacaagaacataatgtaaagtaggcattcatatactcggaaagtatttcaataccataaatttatatagaagagtattctaaataaagtacaaagcttacaaaaaaggaaaggaaagctactagagccataaccgaactcttccgaagactttcgaactcctgatttctactctattcctattccactagcttgatactactagactaaacttgagagaatatgagatagctcttgcttgaggtgtgtgagtgaagtgagaaggtgaggggtttatatagcctccgaatgactgttgtgacggttggaatggtcggaaataccctccaaccgtcattgggggctattccacactgtccagccgcaaccctgcatccaaaggcgctagcgggggtttggccgaacctcctggttcggcagaaccaggggccggcccaaccaacccatgttttggctggcggcctcctctgttgatcctcttcgtagacttgtgaattttggcccaattcatcgtgtcaattctaagttcttggcccattcatgcataagtctgattatcgacatcgtccgattgatttatcatctttgctgatgtcgattctcctccacttcgttgctattctctgcaaaaggttagtatacctattactagtggaatattattattctaacatatatatgcattgcaagcattactagttctcctctattttggtaatattgacggttgaaactgatcgataacgatcgtcaacaccatcacagggtaactagtcacttgtgacgggccaaaaagggaacccgtcgaaggtgaggtaaagtcagctgtgacaggtcaaatatttgtatgcccgtcaaagatgattaaaaaatatcgccatcataacctcctcctggctccgaacccacgcccggtcttatccttttttcttccgcctcccttcttcttccgctctcccttcttcttccgccaccacccgcgctctcccttcttcttccgcccctccctctttctcccttcttccgagcgcaggcgtccaagccgtcgggcggccagatgccgccgggcgccgaccagatgtggccgggcgtcggcgtcccatgcgtcagggtggcgagatccagcggccgaggaaggacgagatccagcggccgccgcaaccacctcgtcaggcagttcaccaagctgaggcccggtgggaacgtcggtgagataggggatgccagatccggcctctccaacaccggatccagcccctccaagggctagccacctcctccatcaccggatccagctcctccaagggcgagttaggggatgctagatctaggtcgggggaaaccggatccgactcctcctccatcaccgagaagcgacctccaagggctagccgcctccttcatccccgagcggcggctgccgcagagtccacctcctcctgtgagcaccggtcctcaccacctcctccatcttcgagcatgtgtttgtatgtgttttgtattcttgtgatttgattttagatcttgcaagttatcggtgccaagtttttaatcggcatgtgttcttgttgaagccgcatgatgtgttgccactggagattaatcgcaggggtggatgactgatgtgttgccactgatttgtttgttgaagccgcatgatgtgtcttgtttttcttgaaggtggtgcattggaagtgtttagagtttcattgtctttggtgattttgctagaaaattggaatctgaacattgtagttctcaagtagtttgcagttgcactagtttgtttttatgttcattgtaacatcaaccttgtaagttcttggatcagaaatgtagtctaaaatattctggattatttagcgtggatctacaaatcattgttgcagcgaggtttttttttggttgatttttcataccaatgacgggttgactgcttttaactcatttgaggtggcataatctgtgacgggttctaattataactcgtcaaaaatatctctcaccactaatggtttgctaattgtaacccgtaacaggtgtctctcaccactgacagaccttcaaccgtcacaggtgaggttaaatcatcagtgaccaataatctgtgacaaagggaaaaacccgtcaaaggtgagggtttggacccgtcacagatgacttggtccgatgtagtgaatgttgtggttgtgattttcacccagttttttctaattaactgtgcattgtaaggtttggtttcattttctccttaaaatggaacaccttcttctttatataaaacatcggcaactaaaatggaacaccttcttctttatataaaacatcggcaacggtctgatcattcgaaaaaaaaagcacacgcgcagcaggtgatgcaagattttggacgtatgttatatatggctcgcggatgtgtacgtggtttgtacgcacatgtctcatattttagtttttacccaatgttcttattttaatattagccaaagtctgcaaattttattttcgcaaaaagatatggatgtttcatatcataatttaaaatggcgggtggatataaatttagttcttgccttcgtcacctatgacctatttcggcccataaactgcggatacaaaaactcccatgcatatcccgatcggaaaatattcctaattaacaaattaagctccgtcgcaatcgatacctatatccagcatatgcgtatttcaattatcaagctgggcgacgacccattcaatgtggtttccaagctgggacctgacaaaacagctctgtatggaattactttactttttcctttttcacgcgtgctaaatcagtcgtatgattaggtatgtacaatggtgtctaataacgggctctttttattatcatgtaagtaaatttggtgatatgaaagaaagagatagaaggacgtggaagaaagagatagaaggaagaagaaatatcgtttactacaaatgacatcatctcaaagtcgactctttatatttattaatgaaaactttgttacatgagggtggtaaaaaggaaagaaatataacaaaaaaaatatttagtaaattaatggttcagaaatcttattgtctttacattataggagaatagtctctagtgatattaattaatatagacagctcatattagactctatctttatacatgcccttaattaagcagtacctttgttctaaaataaatttgtttttttatccgtcctacacatatcaataaaaaaactaaaatgctcttttatctaatcccaatgcaattgttattgattttatctattttcaatgtatttatcctttactctcacaaacgatgatgattgcttaaaaaagaaacttatttgggacaaatagaatatgaaaaatgatgttactctaggacgggggtattaattattacaaaatttaaaaatgtgtttgtttgactttttaaaagaatttctacataaacagtttttaaaaaaacatactatttagcaatttgaaaaatgtgcgagagaaccgtaaaagtgaaattaatgagctttcaaatgcatcctaagaatgctttgcatttaaattgcaaaataaagaatactctagttggaatgttcgcagcaacaaacgcgacaaattgcaacatcgcaatgcaattgttatctattgattttatcaacatgactaaagtagtttctaaagttctattagaaaaaaaaatctaaacccaaggtcgtcagcagaagtgcaacagtacgaatttctatcatcaaattaggtgacctctgtccatcagtaaagttctaaccggaaggccagagcagcacggcaaatggccgtcagacacatgctcgatctcatgcatgtacgctagctcttgtttagaataggctttgttagtaagaagactttgttttttttttgataaagaataagaagagggctgaccctgttaattagttgttgctacttagattatgtgtcacaacaataaatcttgcatgcataacccaattgaaaaagattacagttatatgtcataaccgataactatatatccttcatctaagtgtatttcaatcgtcccctccaaaaataagtttacttcaatcctcagcgtggccgatctatcaccaaattgggtgacctctgtccattagaaaagttctaaccggaaagtcttagcagcccggcgaattgcgcttggacacgtgctcacatacacgtatactcttgttttgacttaggctatatcaataagaacactttgtctttttgaaagaataagaagactgttgactccattcattaattagttgctgctacttcgattacgtatcatggattatatataaaacacgaaaaaaataaatcttatatgcataacccaattgaaaaatatcagttatgtcataatcgataaaaaaaaagtaatcgatacctatatgtatatattcttcgtctaagtttattgcaatcgtcaacgtgaccgacctaccactaagttgggcgacctctgtccatcggtaaagttctaaacggaaggtcgtcgggcacgtgctctgatacgcgttcgcttcccaaccactctcatttttcacacgcacgcttttcaaactgctaaatggtgcgtctttagcaaaaagtttctatacgaaagttacttaaaaaatcagattaatctatttttaaaaaaaattagctaatacttaattaatgacgtactaatggattgctccgtttaccgtaccggatgtatcggttaggagcctggggtgccgaactgagccagctatgttaataagagggcaaaatttaccacggacatctaaaatttatgtaattggctaggagatatcacaaaatcatgtcgctactaatggacactttaaaatctgtgtaatttcactactagaaaaacgatttttatggcgttaccccataattttcgccggcggccatatgcaaaaacataatgaggggtgcaggactactgaccaccagcgaaaaccaaattttggctggcggccacgctaagtggttcgccataaaaactactctatttttcgaggcggacctcttaattgtctgcctgcgaaaaatggattttcgctgacggccagttaggagagcagacagcaaagatttgcactttttcgctggcggtccacttaaacggccgccagtgaaaatattgtcacagttaaaaacccatcggccaccgccacccagcacttctcatccacccaactcagcctcttctcatcctcctctttagatccaccctcctccctcaccctggtgacagctccctccctcctccctcctccctccccaccggcggcgtgtctcgcgtaggcggcggcggcagagagaagcgcgggcggtggagatccagcgctgggagggacagcggcggcggagagaagcgcgggcctaagagtgttggtgatatgccctagagataataatagagatgattgtattacatactatgtttacatatttatcagatattgttccttgaaatagataactcattattggttaatgaatatgtgattctttcatgagactttttatgttgtatgttactatttctagagtatccctgatcaaatattatatatggaacaaatatgtttaaatgatcagcgcatgtattatataattgatgatcatgtctcatggatcatggtatataccaaattaataatgtgaacacatgttggggaatatgttattgtatagacccaacatgagacactgcaagagccatatgtattgtgtcatcagtgatctcattaagtgttggtgttgaattgttagacctaagattatcatggttcccaacatgtgtagtaccttacttagggactgctaaacactacgctgtaattgggtagttataaaagtagttttgaggtatgctatgaaacatgtagtgggatataaataatcaagatgtgatttgctcctcctatggagagatatctatggacccctcgatgttatagattatggaagtgcatgaccatgccaaaggtgattgaggagtctatcacaagttatataatctatcacagattcgagtgaatgatagagctaatagaggatggcacatatctagccttgattttaatcgttatcgtgaggcaaaggggttcatacatgtatacactagaggttcagccgatataatctttatgtatgcccggtgggtcaatacgttctgctagggaccgctgttgacacgtggaccgaaaaggaattttcgggttacagcctagtgtgcataaacctatagggtcgcatgcttaatgggccggaataagggggattggaaggagatctaatatgagcttaattcagatagggatccgaataggaatcctacaggccttggaggcccgagtcatggatcctatatatttgtgaggggcgtgactggcggaggcattgcatcacatgagaaaccctagacgccacacctctccctgagcaaaaccttatccgcttgcgggtcctagcacatctgcacgtggcgttttgtccctgtacgtgtggataccgatagaggcgctgctgctttgcggtgttgatcggcttgggcgtacggcgaggagaacgcacgaggaagagaaggttgagccggtgcgatcgactacttcctctacatcgacgcgcgctacatcacgagggttcctttgccttcttagcacttttttccgctacgcagtgcgtccagtggtagcgatctatgatctaatacttgcacggttcctggtttacgtagtagaaaatttttgatttatgctatcgtagcctacgcgtatcccaacaaagggatctggcgtcgggaggggcggcggcggcggagagaagcgcgggcggcgacggtggcggagagaagcgcgggcgcgggcggcggcgtcttcctccccactgcgatggcgcaagtgacgacgagcatcctccctgtcatcgtcctcttcatgactcgacgtggctgccatcctcgacggcaagctgagtgcccaagtccgtctggccagctgcggccaaggcgggtggttagagtggatggattgttttggtatttggtgaatttgtgatttgtgaagggatgtttctgaatgaatctgttgaatgtattatgatatttgtaatgaatttatgttgtgtgaatggattagggtggttgaggattttggatttgcattggggtattttgaatttatgtaagggagtttggaccgggtgggggattttcgctggcagttctgtttggatctggtggaggatttttgctagtagttctctttacggatctgccaacaaaaatatattttcgcaagctcgcggctggcttaagacagctagctgccagcgaagatcttgatcttcactggcctttgcttttgtggtggcgccaaatgccgcttgcaaaggcccaaaatggccgccgtaaaagatgatttttgtagtattgtttgctgtagaacatccaagacaatgtcttattattttcaggtaaaaagatgagagagaaattttagaaagacaaaattgcgttcaaccctatctaaccccactagcatcacacttttgcccccccccccaacacccctaacctagcggcaagtaggcctgagccgactttgacgaccactggtgagccccaaggcagcggcttatgagcttggtggcggcgtcggcggcttcaatgattgtcggcgagctcggcaatagcggcttcaacagtggcggtggcggcggcggcagcaccttcaacgatggctgatggcagcagcagcgacttcaatgacggttggtgtgcagcgctgggaagcgcgcggcggcggcaactttgatgatggtcacgagctcgacagcattggcttcaatggcggcggtgacagtggtggcagtggcggtggcttcaacgatggttggcaagccctgtggcaacgtcttcgacggtggcgcgcttggcaagcggcgctgggaagcaggtgtcggcagtagggatcagatagaactgagggcaattttttttttgaaatttaccactctttttgtcaaaaatgataaaatattgtattgggtgtcctacggcaaattaaatgaattttgtggtgtccatcggcagcggcacgattttacagtatctcccacccaattacataatttttaggtgtcctagggcaaattttgcctaataattaagaagactttgtttttttagaaagaataagattattgctgactgctgttgctacttcaattaagtacaaaggcttatatataaaacacgaagaaaaataaatcttacatgcataatccaagtgaaaatgattacaattatatcattatcgaaagctatatatatgtcaacggtatccgtagagtatatgggttgttggcactaggatgttatacgcaaaatcatatcaagaagacaaaggataaggatttatactaattccgacccttgagataaataataatcatacacgatccagtttatatacattgccgagaaaaataccacacaagttatgatggagaaatctgtagactacttagcataccgactagaacctaccgagtacatctcgatgagtagaacatggtgactagtaggggcaggctcacctcaatttaagagtattcatatgtatatacctaagatttttgtcaaaaagaaaagatatttatactatgtatttcttatgtgtattgtcaaaataaaaaggaggccacaatcagccccaaaagcaaacaattcaatgttattgggctgactccctccttcctcttttggcccattcactaattcacggcccaattagagattcccttggtcaattttgcccacggaaattcccccactcccccaacacccacaggcggccatacacatgtatatatgccagtacgtgcacggctcatgcatgaatcaatatttaattaactggcttaattagcacattggcattgctagctaaattggttcctgaaaatagccattaatacatgtaatatatatggttatatttaagtatgtacaaaataacgtcaaacaccaaaatttttcacaaactttctataatatatccagccagtccaaggaaccctctcagcttttcgacagtattgggcaccttccaatttacaacttcttcaatcttggactgatcagtagcaacccccttaccactgataatgtgtcccaagtaagatagttgtgagttgtgactgaccaaaggagcacttactgagtttcactttccattggtgcttgtttaacaggagcaacagttccttgagatgagttaaatgagactgcatatcctgactgtaaaccaatatatcatcaaagaagaccaaggcaaattaccttagtataggtgcaagagtctcattcatggccccttgaaatgtagctggagcaccagtcaacctaaatgacattaccctgtaatcatagtggccagtatgagtttggaaagcagttttatgctcttccccttcctgcaacctaatctggtgatactctgcccttagatctaatttggaaaagacctgagcaccagataacttatccaaaagttcatcaatgactggcatgggaaattacctttaacagttatggcattaagttgtctatagtcaatacaaaccctccatgtaccatctttcttttttcaccaaaagtgcaggagaagagtatgcactgctgctaggtctaatcaccccagaagccaacatctctttcacctgtctctcaatttcgtccttctatgttggattgtgcctataaggtttgatgtacataggtttggagttgggcaacaaaggaattctgggaggtaaaccagtagtttcaggaaaaatatccttaaattcagttaaaagaggcccgaattgcagggggacctcaacaagtttatctggtgttagttgttgcagttggaagacctgcataactgaaccaatagtcagcatttcctgaaatttgtccactgaaatgggagcacagtttt

SEQ ID NO: 38860 - DNA, 16330 bp, Oryza sativa
gcggttggggctcggctccaaccggctagagaaggaagacgaccggcaggtgggccccacctgtcggcgcccgaaggagagagggagggagggaggacttcggggaggggaaaggggaacgggccggcccaaagaaaagaggccgagcgcgggagggagtgggccgacggcccaagaagaggaaaaaggaggaaaaaggaaaaagaaaaagaagaaaggattttcctgggattaaaaattgcacttgctcatttttaattggttaaaaattatttccaaggctctgaaaattccactaaaaatcttgttaatgcattggagcatggggaactcaagaaaaattccaccacgccgaattcaattattaattgcatttattaattagggaattagctctaggttatttaagataatttcttcggacgatttatttagccaatttttaaagcaaggagagggggaaacttccgggcgtgacaaacctaccccccttaaacggaatctcgaccccgagattcggaagagctggcgaagaggtgcgggtgggtggccttcaactcatcttctctttcccaagtggcctcttcctctgagtggtggctccactgaaccttgcagaatcttatactttgtttctggtccttctctcgctggttttgaggacacgagtcggcttctccacatacgtcagatcttcctgaatttcgatgtgatccggacttgcctgttcctcaggaactctcaaacatttcttcaactgagagacgtggaacacgttgtggatgccaagcatgttggagggaagctcgagctggtaagcaacttcacctctacgttccaagatcctgtatggtcccacaaagcgtggtgccaactttcctttggtttggaagcgatgtactcccctgagcggagtgacacggagatacacataatcccctgtttcgaaagcgagctcccttcggcggttgtctgcatagcttttctgccgagactgtgcgattctcaatctttccctaacagctctgactttctcttctgcctcatttaaaacttctgtaccaaacaattggcgttcccctgtctgatcccagaagagcggagtacgacaccttcgtccatacagtgcttcaaacggtgccatctgcagactagcctggtaactgttgttgtacgagaactaagcatacggcaagcttttgtcccatgctccaccaaagtcaagcgcacatgctctcaacatatcctctagcatttgattgactcgctcagtctggccatctgtttgtggatggtaagcagtgctgaaattcaaccgggttcccaatccttcttgtaatttctgccagaactttgaagtgaattggcttcctcgatcagacacgatcttcttaggtacaccatgtaaacacataattcttgccagatagagttatgctaatttcttccctgagtaggtagtgtgcaccggaatgaagtgagccactttggtgagtcggtcaacgactacccaaatagaatcatgccccgatgacgtcctgggcaaaccggtgatgaaatccattccgatttcttcccacttccattctggaatctgaagtggctgtagcaaacctgctggcctttggtgttctgcctttactcgttgacagacgtcatagagtgctacgaactcagctatttcccttctcatgctgacccaccagaacttttctttgaggtcttggtacattttggtactgccgggatgaatggaatattgagtttgatgagcctcgattagtatcaggtcttttaattccttgttttcgggtacacacaatctttctcccatccagattgttccttgttcgtcctcaacaaaacctcgggcttttccaaccctcatgttctttttgagctctgctatttcaggatcacttgcttgagctatgcgaacctgctccaccagtgtgggctgtgcctctagggcaaccacgaatccgtgctcaactataccaaggttcagatgttccagaccgcgttgaacctcacaacatagttgctctacccatgcaacattgcagtagctcttcctgctcaaggcatctgcaaccacattagccttgccgggatgataatgtattcccatatcataatccttgatcagctccaaccatcttcgctgtctgagatttaaatcaggttgagtaaagatgtactttagacttttgtgatctgtatatacctcacaacggttaccgatgagatagtgccgccaaatctttaaagcatgaacaactgcggccaattccagatcatgcgtcgggtagttgccttcatgaggacgcaactgccgtgaagcataagaaaccactttgccatcctgcatcaacacacatcctagcccctggcgagatgcatcacaatagatctggaaacctttcgtctgatcaggcaggattaagactggtgcagacaccaaccgtcgtttgagttcttcaaaactcctattgcattcagcagaccagataaacttttcttccttcttcaatagctgtgtcattggcttagcaattttagagaagttctcaatgaaccggcggtaatagcccgcaagtcctaagaaactccgaacatgagtgactgtccttggtggggtccatttggaactgactccacatttgctggatccacagctactccttgagcattcacgatgtgaccgagaaactgaacttccttaagccagaagtcgcacttgctgaacttggcatatagttggtgctcttttaacttttcaagtaccagccgaagatgctgctcatgctcttcctcggacttggagtaaatcagtatatcatcgatgaaaaccacgacaaacttgtccagaaattccataaacaccttgttcatcaaattcatgaagaaggcaggtgcattagtgagtccgaaagacataactgtgcattcgaacaacccgtaccgagtgatgaatgctgtctttggaatatcctcttcgcggatcctcaactggtgataacctgatcgcaggtctatcttagagaacaccgtagctcctttcaactgatcaaacagatcatcaattcttggcaacggatacttgttcttaatagtgacctcattgagtgcgcggtagtcaacgcacatcctcttggttttgtctttcttctccacaaagataaccggagcaccccaaggcgacgtgctcgggcggatgtatcccttctgtaactgttcatcgacttgcttcttgacttccgccaactcgctggctcccattctgtaaggcctcttgtggatcggtgcagttccaggtaccaagtcaatccggaactcgatatccctttttggtggcattgttgtcagatcgtccggaaaaacctccggatactctctgactatgggaatatcctccagcttcttagtggttttctccactgctacctcttgttcttcaccagcagcctggtttaaactaatccctagcttccgcggcacttgagactggaaagttaccacctctccttttgcattggtcaacttgatggtgcggctggcgcaatcaatcactcctctgtgccttgtcaaccaatccattccaagtatgacgtctaggtccttggattcgagaagaatgaggttggctggaaaaatcatcccttgaatttcaactgtcacagatgggcagtagtgagttgtggtcatgccacctccaggagtatgcactcgcattggtatcttaagcttcactaaagataacccatgtgcaccagcaaaacgcttggaaatgaaggaatgggttgcaccagaatcaaacaatatttttgccggtgtcgagtcgacaggaaatgtgcccaatataacctctggtgctgactgcgcctcctctgctgacgcatgattgacacgggcctgaacaaacttgggtccagcacgtcttggcttcgggcaccttccgaccgtgtgtccgggctcgttacaattgaagcagagttcgggcttttctccaaacttcttgggctgttctggctgagctggcagagctggctgagctggaatcattaatggacttggagtaggcttgagcctgtgctgctcactgttgttgtgactgccactatggtgggtcttgttgaagctacccgggtggtagggacggtactgccggataatcatggtggaaggtccaccctgatgtcccatcgtgaaacgaggcttctgactcttcccctggggagtcctgaactgagctgccttcctcttacggtttatttcgttatagtgctcctcctgacggatagccttatccaccagcttctcaaagtcctcataatctctagagatcaactggttagtcaattcatcatcaagaccagacagaaacttctcctgcctctcggcatcggtacgcacgtcctcaggggcgtagcgcgcgaggcggttgagctcatgcaaatactctataactgttctggttccttgttgcagggaacggaactctctcttcttttgtgccacaattccctcgggaacctgtgctttattgaaactatgacaaaactctgtccaagtaacctctgccccagctggacgggtcaccatgtagttgtcccaccaaatagaagcgggaccttgtagctggtgtatagcaaaagcaaccttctcctgctcgttgcattgcaaaagattcagcttcttctcaatggcatgaagccagtcgtgggcctcgattgggttggtggtgcttgagaaaatgggcggcttgacacgaagaaattctaacaatttggactgaggaggtggaggaccaaactgcaggttctgttgctgctgctgtgcttgctgctgcacctgttgcaacacctgatggtactgttgctgcatctgttgcatcatcattgtcatcatctgagtctgattgttcaacacctgagcaattgttgggttctcgggcggtggggacagactgtagtcagatgcaccattggcacgtgctccattgatcggctcttcgctgccactgacgttgttggagtcgcgtgaaccattccttatctccatctgaaggggataggtagaaatatgagaaaatgaagaaaaacagggggctcagaaactaatcttgtttatgaatttaagtgcaattatcttaatcttgattaaaacactgaaaaagaggcacgcaactcctaattgaggcagtcataccactgacacatgatatcgaccgctgactaacccacaagcaacaaacctaaacacgaaaactagcaagcaaacagactaagaaggcgataaagctaagggcggcgactctgaagctcgggcggcgcttgcaaacgagggataggactgacatctaaagtagacaagggataggaaccaattcatgctcaaatccaaattaaacaaagcaaaagaagacccaaataaataaccgagcatgatgatttttatgcatagaacatttttcatgaactcaaaataaagacactaatgcaactaggcaataaattaatgcatagactagttgcatggaaaatgatgcgcataacattgcccccatcgaacatagacacgacctaatgcataacccccaataaattcccgactgactgtcgaataaactccaactaaaatttttctaaagccctagactgagctaatttttttttttaaaaaaaaatccgatccgaatgaacgaccaagatttttcccgcaaaccaaagaggcaaaactccaaattttcccaaaacaaattccaagtgcaaaagggcatatgcatatgaaaaggggttcagagggctcttagggtttccagttggcttgtcctacggtcaaggtcggctctgataccaacttgtcacgcccagaaattctcggaccagaatttctaagctgaatgtgcattaaacccctgtccaggaccagccagggtacacaaacgacaattgttgacatacagatccacgtcttacaaaaatagaaaagattacaaatgcagcggaaaagataaaagcgagctaaaccaggaagcttgacttcagcagcgagcgactccactccacaggcaatccttgacggcagcgacgaaaccaactttgacaaaacagctccaactaggaagatcttcagctctggtgtgggggagaagagagcaagactgagtactacccactgtactcagcaagtcataccggaagaggaggtatgatgcaggatataaccaaaggaggctagaggttcttttgcataaagctagcatttaaaagcagtagttgaaagcggtaaaacagttgtagtaattaatcaatattaaccaaacactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccgcacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaattgccatgggtgcgaccagcaaaaccatgcacccacagcccaccattcagtgtattttaattaacgacacccatgcggtggcaccaatccaaagctatgccaataaacaaagtctatgctttaatgtgatccccttttgtgcactagttgaactaagcatggctaagcatctcctgaaccaacatctagtcattttaatacccaagttatcaatggcgtaagggaaacaacatatagctgagtaataggaccaatcccacatgatattgtaaaacaatgcaatatttaatagaaatgcgggacatttgtaaattgggtacaatatgatcaattgcaatgtatgacttgccttgctctcgcactgatgagacctcagcaacgtcttcgagaaactgcggatcgacgaaacggccgaaacctacgcgacaaacaaagcacacaagcaaaacatgctataagactactgaaacaggaaacaaaaccatttttaatggattctttgcatttttcttgatttactgagacttgaatggacttaaacggggctcggatgaattacttatgaattttagaagataaactgtgtttttactaataaagaaaagtccttaatccatttattgcgcaataaagcccagggctgacgtcagcggaagggagggcgggcgccgacaggcgagccccacttgtcagcggttcaagagagaggaagggggcggctggcaagcgggccccactggcagcggctaaaagggaggggtggtccaccggctggtgggccccaccgggcagcggcacagggcgggagaggggcgtggctgttggcttggcacggctcaagccggccggccagccatggggcggcggcggcggcacgcgcggtccccggcggtgaccggcggcgcggaagacggcggcggccagtgcgaaggcggcggcggcggccgaagacgacggcgcacgcgcggaggacggcggcgctcatgggagagagaggaaaggaaggaggagaggggattcctcaccggcgagcacgacggccggcgcgaaggaagaaagcggcggcgacgaccggcgatgccgaggtgcggacgggcgcggcagcacgctaggagagagcatagaggggttagggaagggaaggcgaccatggcggcttgaattgccggccggagacggaggggagagagggtctcaccggcgcgcgaggagaaaatggctccggcggtgattcgcggcaatgaagcggcggccgaggtgcgggcgggctcggtgagcgcgacggcggcgatggtgcggcttggcggcggctctagcggcggcggctcgcggccgaaggcggcggcaagcggcggagctcgggtgtgatggcgcgggcgcggtagacggcacgggagagcgcggcgagtgcgaaaaacgagagaggaagacgcggggagcgatttataggtgcgggagggggcggacgtggccggggaggtggccgattttgccggcgatgtgggggagtggggaggaagagagagagagagggggattcaaatcccccaccacttgcgggcgcgcgcgcgcgggagatgtgtggggggggggaagagcggcgacgtgggcgcgaggtgcgggcgcggagagggacggagaaggcgggcggcgtggggaggtggggcgccggcggttggggctcggctccaaccggctagaggaggaagacgaccggcaggtgggccccacctgtcggcgcccgaaggagagagggagggagggaggacttcggggaggggaaaggggaacgggccggcccaaaggaaaagaggccgagcgcgggagggagtgggccgacggcccaagaagaggaaaaaggaggaaaaaggaaaaagaaaaagaagaaaggattttcctgggattaaaaattgcacttgctcatttttaattggttaaaaattatttccaaggctctgaaaattccactaaaaatcttgttaatgcattggagcatggggaactcaagaaaaattccaccacgccgaattcaattattaattgcatttattaattagggaattagctctaggttatttaagataatttcttcggacgatttatttagccaatttttaaagcaaggagagggggaaacttccgggcgtgacaaatatgaagttgaacagagttggcacatttgtgttccttactccaacgctccccacaagtaaaacacagcaccttggatcttctatatgatctcagagcggctagcctgtcatctctagccctggtattgtcagaccctctcctgtcctctgatggaggtgatgcattgcccttaacaacagaattagaatggctttgaggagagagagacttcaaagagttcttgactaaaataggcttatcagactttttatgactgacagacttggaaccttccaagatttcgtcctgcaagaaggccaatgagcaagctgaatccagatcctgtggtttctgcatcagaactgctgacctgatttcctgtttcaactctccacaaacttggtcacaaaataattgagaggcagtgaattattgtaggccaacagttggtgcataatgctgtcaaatttttcgacatagtcagacaaagtagtatcttgcacaataagaatccactgtctaataagaattttctagtcatcttgagcaaatctgatacacacttgttcaacaaaaactggccagctaacccccgacagtttggatctcatagattgaagccagaaagctgtgttaccaacaaaattcaaaccagctatcctgacccaattcttagcatgtactccatagatctcaaagtattcttcacagttacacttccacatttgaggattaaacaccataaaactttcgacaagacatcggtggaacgctactacccaaacccatcacaccaacaaaaatttgctacatctgacggagctgctccaccttgccttgcaaatccttcaccgaaccttccagagcatccaccctcttcttcacagctgggaaacgagattctaccgccgccttgagagccatgagctcagccctgctcttctcctctgaccgctccctcttcttctcactttcctcgcgcttcttctccacctcctccattttcttgaggaggtccagcttcccatcttggtccatgatcttcacgccctgcttggtgacgtagcgaggtttcttgtaggtacccgtggttgaaatctcgttctggatctcgctaacccagtcgagggagccgaagcttttgcggaatcagtcgccgaggcaacaattcccacctcttccgggaaaaattttgcagcaaaatccaggaagcgagagaatggcaaggctctgataccagattgttagaaccctaacccaactcctcaataacagtaagaacaagcaagaaacaagatagtttcaccaaatccaacaggattggtgccgccgccgccttcgcctccagttcttacttcatcgatacgaaagaaagacagggtgctttgttcttattacagttcaactctctctcactctagacttactagtgggctcggttggtactcatttggtacaatccggcccacacacacgcgtattacacttacggactcttgctcctctcccagcataggtctgttcttcctccctcgagttgtcagcatcctgtagctctcccggcaacgtcaggttcctgacaccctcacacctcttgtcccctcccatcctctatccctctcatcttgtcgcccacggttgtactatcatgtgaaataaagtaataactgtatagggtgaacaaatattattgtattagtaacagttcaagttaagcacacaaaattattgtatccaagaaacagtactctcatgtgaaaggacagcaagtagttcaacaggacttagattcctctagaaaattaactagccactttctccatatttgtttcatttatatatcccacatgatgaatgataaataaatgtaatacatccatgcatgcaggccagtaccaccatggcctgtcttaacaaaatttattattagcgcgaaaggactggttacaagagcttcagtagcacctgaggtccttggttcgactcctcataggagcgaatttttcaggatttaattgcattgtgctttctgtggttggcggcgtacccgtcgacagcgaggcgcctgtggtgacttcgtcaatctcaaggatttgccagcacagtcttcgaaatgctcataggggtagggtttgtgtgcgtgtgtgcgttcatatgggtgagtgcacgtgcgttatgagtgtctatgttgtactgtgtaattctcaaaaaaatattgttagcatattatcaaaatttaaacaaaatatatctttatcatgatttaataattgctacttgaacattctatcaacttggtctgcacatttgtttaagctttggaaagaacagtaactaaatatatctggctccatcctaaatgctactcggcaatttttcacatgcccttgaagcagcttccgaacgcactcctcgcccgttagctttgatgcatgacgccgcttcttttcgcttcctccactacctcccctacaactcaacaaatgtggtggagggaaaataaatagcatcatatcattgtcctccccttccctcctctttctagtgagttatggatatgagagtagtactataggtagcacacaaattatttacaattttgcacttagcacaacaacaaaagatctagagagataagcacaaaagaaaatcactaaactctgagaattaatcttaagcagatccaagttatctctactactttaaaaaaaaaaagagaagattccttcatccgtcaaaaataaaaaaaatagcgaaaaataaaaaaaagatccgactcctattcctctggtccaactcctattcctctcagaaaaaaaaagtccgtccgtcaaaaaaataagcgaaaaaataaaaaaaaaaggtccgactcctattcctatcagaaacaaaaaaaaatccggctctatctgattcccccttaaaaaggaaaaataaaaggcaccactcctctctgtttaagtccgagatcgagatcccaggcactctcctttcgtttcaatctataccatgatatcccatacatcttggtgaaaaaaattaatatgccggattaaagatctgtttgcaaaaataaaacctataggtcgagagcattccattttatatgattttaatttttggatttgtacttttgcattcgagtcctggtaatttttatatttacatttaagtccctataattttgaaaaaaaatagaaagggcgaaacaaagtccgatttctaataagtatatatctcttctctatctctaatctaatctaactatataaaaatagaaaatgcacgagaaaataaaaactgcttaaaaaaatgcgtgagaaaaaagcgcaaaaaacacactaaaaaggttttacatcttccataaaaaaaagtgcgagaaaaattatttccatcgctggaaaaaaaatttaaaaaaaacatgtgaggaaaaaactgtaaaaaaacacgccatttctaaaaaaaatggtttgaaaaaaccgcgcaaggaaaaagaacaccatctattaaaaaacaaatcgctctggcaaaactgtcagataaaacactaaattaatggacgcttgagtcggatagaatccatcgattttttgccatctactacacggcttttatttcgtcacatattctcctgtattggaaaaaagcaaaaaataacatttgaaacaaaacaagaaaaaaacgcgcgagaaaattattgttagaaaaaacatgcaaaaaacacacgagaaaataaaagcaaaaaaaagggagaaaaatatggttttcatcgtcagtaaaaaaagcaaaataaaaaaaatgctaggaaaaaactattagaaagaaatgcgccatttctgaaaaatagtttgagaaaatcgcgcaagaaaagaaataccgtttataaaaaaacaagccactcatcaaaatacaaacatatattattattagaattttttcacccgttgcaacgcacggacatttttgctagtgaagcatatttaaagattgatgggaaagtgagaggaataataagaatttttttcttaaacctaccagtctattctaagttgttgctgacaaataactaaactttgcagtttatctatccatattaactaaatcccgacttggtgataaaaagaaaggactaattgagcaaactgacaatcaatccttaccttgagagaacatcctctacaaccttccctacaagacaagaaatctaacaggaagatcaattgcagaaacttcactgactgactgtttcacaaacaaaaaactaagcaaaaggtaagcctgttagttcttggtttctcataaagccatcttgtgctttgtttaatctacaactagttactactgccattggtcaactagtttatgagatgatctccaacctataaattctccaactaattattcaacagactagcattctcagccatgcgttggaacaagaagcataccgaggattaacctccaagaaccaaggtaggaggaaatctagctaggtggcagatggggtagaaagaagaacaaatcaagaaaccagtgaaagaaagaagctgtgtccgtgtcctcatgcttctccatgccgcaacggcggagcttcaacggcgccttggcgagggagtgtgatgtggcggcttccccaaggccccaccatgcctgccaccaccgtgcgccgtcgccgccacgcagcagtgccgcgtggccgagaaaccctaaccctagaacaggaggggagaagggaaggggaggaactcaccggaggagacagctgccggaggagaaagcgtgtcgtcgccgtcgcttccgggtcatgccacgctccgcgtgctgcccccgcggcagcgcctctcgctgtgccgcctcctctcaagtatttttttcctcacctacaaactagatgattttttcctgggcctgataataggggaaccccgtggtgggccgggttaaaatcagcgactgggcttaaccgagcgcaaattttctcatgggccgggattgtttcctcgccgggttaatccatggggattgagccgcaatcccacccgaccccgccaagaactaaccgcatactatgtcttatacggaaacaaccttcggatataggaggagttccgtataaggaaggatgaatagagttctacatagaaatgacaaggactactcggattgtatccatattggtttccctaattctacttggacaaggagatatctatgggtataaatacaaggccccctaggaggagaggaagagacccacaatcaacatacacggaacaatagaagctacaatatacaagccaacatgcgccaagacaagtcgccggacatagacttcagggataagcatggctagtcccctacggtgtctccggatactgtcaggagagacgaaagcgctatctctgatctcgccgggcacggattcgaggaggaagactaccctgttgttgactacgagtcagaccttcagaccgccatgtcgacaacagttagataggctaccccaaatattgtactgatgtgattatgatgaataagagcaacaaccggcttcagtcaataggatgtagggttattacctgacaattcaggggcccgaacctgtataaaaatcatcgtctctatctcttttacttcacattacaagaaaaatgctttgtagagacatttttctagtactgtagaggcacttatcaaatgcgtttacaacaatgtagaggcattttaaaaaatgtctagttagtgtcttatggtgaattgtctctacaaacaagagatattttataaaatgtctataagatggtagagacattttctagagacattaaattgtaccgcaaacatataaaaccagtccaaaaaagagaataaaatagtttccttgcttttgacaagtctttaactcatgatctcttggttaaatcattttaatcttcagtacactaaccaactcaactccatgacattacttatatatgcttgttcctttagttacttatatttagtcctttagtatacattatcattctaaaaagtctctacatagtttaaaatgtctcaacaaaatgcctttacatattagacgcattttatagtgccaaaagaatccctctacgagataaaatctaacaaactgatctaaaaatgtctctagagtaaaagttttctaggcaatttttgaaagtgcctctataaagtgtctctacactataaaacttctgattttaaaagcaatttgcaaaacgcctctacaaaagtgcctctatacgaggtttttgctgtagtgttagtctcgcatatatcctagtaccaacaatccctatactatgcaaataccggaatcgcgacatcaaacgtcgatagtggcgcgccatgtcaacaacagaggtgtagcgacattaatatcttgtagcttgtcatatgtagacccccgtttttataacaggaattaatcgtgtaaacagtaccatttcctggatcaagtagtctggtacacacgaattcatagctgaaatacctagtgcacatacacgagtgtctggtatgaattattacatcataagcccgcagacatagttttaaatcatcggaccgggcggtccggaattcattccaaaaacagaagtaagtaagacagcggagtcaaggcagcggcacgccattgccacaggcaacgaccgtaactaagacctactgagcgccatcgtcttcatcaccctcctggtagtaagcatagggatcctccgaagcttcatctccgacctctgattaagtttatatattgcaagggtgagtaccaaccgtactcagcaagccaccacagcaacaatgcacatgataggggtattcaaagtgtggctatagttcttttgcgcaaagcaagttttgtaattcttttcacgagccctaagacctagcacaaactgatcaaattttagtaccagtgttcatatttaaacaatgacggttctgtccaccatccattatgatcccaaggatggattctcgccattgagtcgtcatggttttctgagaacgtccacctgcccacctctcaggaagtggctccatcagcatagaaatcattatgcaatatcccatcccatacaagttaagaatttagagtctagccaagtataatacatgtcccggtgctcaataaccacgagcacggctattcgaatagatttggtttactcacactgcagtggatacactttacccgcactccgcgactgcttaacacatgagcctcgtcccaacacatgagacacgtcacggcaaaccttttcgataacctcgcattggcagtacctgctccatgaacttaaatcctcatgcactctaggcg

SEQ ID NO: 38861 - DNA, 1237 bp, Oryza sativa
tcgcccgaagcatcagaccaattatcacccatgacttctggggttcgggttagttacctatctcaataaagtatatgattggtttgaggaacgtcttgagattcagtacgcctgacggaactcttctttattttttaaatttgcattagagccagttgaaaaacgaagaacctttttttgttgttacagttccttaagcataaccagttacgaccactgatctatatatatccagccgatacgagggtgactgtctgactacctaaagttgcatatccaagtatagatccctagagaagagaagcaaaggtataagccaagaccctaggaagcattactcttcttttcattccaaattcttcaataagactgtgcgaacaagcgatgaatctatcatatccgagaatactatagatattgaacgaaggcgttcattttctgtctcagaaaacataatccagtgtcaagtccagtcaaattgaaaatctttttttcatgaaaaaattttaaacttgacgtagaacattgtataaaaaacgagacctattcctttatggtagagatagatttatgatagagataaatttttttatagtattttattagtaaaaatggttccttcttctctttctttctttggttaagcgaaaacaatctcgagaaaattccttacttttccatttctttggaaagctcctactaagattagaaattccccaataaagctagcgatagccttgtttcggattttctagcgatgactagccctttgacggctcctatccctagacaccggcccccggtaccaatactagagatttgcccccgagctagccctcctattaatagggttgctttgttcacgcgcaccacgactcattcaaaagagagagtaaaaggaaggatttcccagaattcgtaccaactcggcatttcacgagttaccacacgagaaaatcctatctttcaagctttctctaactaacttcgccaattgtccttcgctccagatggtcaatgtctttagactagccatcagcccgattcaaacctgcagtcttcaggtcatgagcatgatgagttgaccaattcctccggctgttctgttcttttctttccttttgggttggcggagagagtaagaagttctttcattcctatcccgtgtctatatatatatatatatatatatatatatatatatatatatatatatatatatatatatatatatata

SEQ ID NO: 38862 - DNA, 779 bp, Oryza sativa
aaattttgagatttttcagacaaaagttttcatatttgagttgaaattttctaaatttgtgaaggaatttctagattttgaattaaaagtcttcttttgaattcgagacaaaagttttaggattcttgtggtcatgtgatactggggaatgggaagctctcgcttaggtggagacatgcgcactgcaatgggctctcgttcacctgcaacgctcttgcaccaaagctctaaactctaatcggggtgcgcaacttaccgttgtcgcacgtattcgctagctagcatctgttgttagtacgttaaccatatttttaataccttttcatttgtatcttatcttacatcgttagattacaagtgatcacaatggctctcctacattcaatcaccctacaaagtctcagtcagtctctctctctctctctctctctctatatatatatatatatatatatatatatatatatatatatatatatatatatatatatatatgataacttttctctaaatattttagtgcgtatctattttataacgttatatattgttcgagaagtagaggagaatccacccaaaaaagcaacacactaccatgagagcataagactgttcttttgggaagttgggaacttattctctatgcatggaaaacgtagcggtgaattaacacatgattaattaagtattagctaaaataactcgaaaatgaattgtttaatatgatatgattctttaaagctactttcctatagaaatttacaataaaacataacatt

SEQ ID NO: 38863 - DNA, 7196 bp, Oryza sativa
ggagaccttgcgaccgtgtactgcttgtatttcgatatatcagtcacacggtccatcttgggaaaaacgtcctcgatcttcatctcctttttttccctatcttcctatccaaactagtgtgtaccccttgacaatttttctcaatctcattcatgccctatgtggagattatgggtaccccatacccacacggcatggttatccgactagttataggggataacttatatatataaaatatgtaacagatcatgacttgggtattacgtttccctgtatattatggaacagcctaaagtcctggtttgataagattgtaaagtagatttaggaaaccgataccgtattggttaaggtttctatcttgtaaccctgccccccaacctatataaggagggcagggagccccctctaggggcatgagacaacctgatcgtcagatcaatacacactcggcggattcaaatccccaaacaggagtagggtattacctctcattgagagggcctgaacctgtctaaatcctttgtctccgcatccatccacttttaggtctcgtgcgctacccccttttattattgccgaattcatgtttcgacagttggcgcgccaggtaggggctgcgtcgaattacccatcgaaaagtgtgatggaatcaactacagaagaaacggcgagattaatctcgatggctcaaatcttcagtcgggttcggtgttttgatctaactgttattagattaatttctaattgtgatttgctcttctggtgttttccttgctttctatgggctggtcggctgaggttaaaacggagctgttgacggcgatcgccaggagcagcgccgacggatgcgttgcggccaccacgccaccacgggcacatgggagcagccgcctatagcttgctcggagaaatttcacgcatgcatgagttgatttagcagattaacatacatgcacgatctacctaatcatgcatgcatatacttctaattaatcttctagtgtgtactaactagattagattagattaattttctaatctcagtttgatctgtgattccttattttgcatgcgccatggtcacctgagtctgattcccatcacgtaaagcctccaagttggatttgatccggactcggaccgtgatctgtacgcacggatggcagcctgcaatctgtctggtgacgtgcatgtgtggatgtgtgtactgttcatgctacaggagatcaatcggccaatcaaaaaatatatgcatgcttcatatatgcagacttacgtacacaagattaattttcttgatgctaattagagattgcttttctctttacatgtactgctggagccaccgtcaccgcccggtttgccttcgccgccgccgactggtgtctccgtctacacggctggcatatcaagccaccgttgttgggcgtctacgtcttcaccgaccggcttgccttcgtcgccgccaactggtgtcctcgcctgcacggctggcctattatgccgctattgttgggcgcctacgtcttcaccgaccggcctgcctccgtcgccgccgactggtgtcctcgcctgcacggctggcctattatgccgccgttgttgggtgtctacgtcttcaccaccggctcgcctttgtcgccgccgactggtgtcctcgcctgcacggctggcctattatgccgccgttgttaggcgtctacgtcttcaccgaccggccgcctcgtccgctgctgactggtgtccttgcctgcacggttggcctattatgccgccgctgttgggcgactacgacttcaccggcagcctgcctccgtcgccgccgaccggtgtcctcgcctatatacggttggtcacaccaccgttcataggcgtccatgtcttcaccgaccggctggccttcgccgactggtgtttccgcctgcacggctggcctattatgccgccgttgttgggcgtctacgacttcaccaccggcctgcctccgtcgccgccgactggtgtcctcgcctatacggtcggttggtcacaccaccgttgatgggcatcgtcatctacaccgccggcctgcctccgtcgccgccgactgatgtcctcgcctatacggtcggttggtcacaccaccgttgatgggcatcgtcatctacaccgccggcctgcctccgtcgccgccgactggcgtccccgcctatacggtcggttggtcacaccaccgttcatgggcgtccacgtcttcaccgaccggctggccttcgccgactggtgtttccgcctgcacggctggcctattatgccgccgttgttggatgtctacatcttcaccgttggctcaccttcattgccgtcgactggtgtttccgcttacacggttggcctattgtgccgccattagtgggcatcttcactttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattacttgcgacataatctgagtacaaaagtacctatcgagttatggagttctatcttcctatgctttccgtttggtttgccaatggatggttgcctttgggctgattcctagcacccgggggctcgttggatggaccgagtaacgcaaggtgctaagtattattcggaataaatcaaaagcatagagatgagataaatttattttctgctcttaataatggcaaaagtacccgagtagtaaattctgatccgtgaaactttgttccattaatgacgaactcatgtcactcatatgcatgtttgggaagtgcctaggccgactcccgatgcttggggactatgactagtcgggcagagtgtttaaacgtaaggagtcatctgctcggggaaatcacaattgacaagaggagaaatacatatttataaacattttaaaatgcttgaatttttctcgagtattatatttacatcaggtactactcatcctatctgtttgttctgtaggatccagatccagatatgcataaaagggattcatggctttaagcttatctcctacgctttaggaatggatcaatcagaacatcaccaccggctcgccttcgtcgccgccgactggtgtcctcgcctgcacggctggcctattatgccgccgttgttgggtgtctacgtcttcaccaccggctcgccttcgtcgccgccgactggtgtcctcgcctgcacggctggcctattatgccgccattgttgggcgcctacgtcttcaccgaccggcctgcctccgtcgccgccgactggtgtcctcgcctgcacggctggcctattatgccgccgttgttgggcgtctacgtcttcaccgaccggcttgccttcgtcgccgccaactggtgtcctcgcctgcacggctggcctattatgccgccattgttgggcgcctacgtcttcaccgaccggcctgcctccgtcgccgccgactggtgtcctcgcctgcacggctggcctattatgccgccgttgttgggcgtctacgtcttcaccaaccggcttgccttcgtcgccgccaactggtgtcctcgcctgcacggctggcctgttatgacgccaactgatgctatcttcttcacggctggctacatcaccgtcaccgctaatagctaccactactgatggacatcatcgtcttccgtcgccgactggttatgccgccgccgactggtgcttttatcttcacaactgcgcgtcttcaccaccggtttgcttctgttaccgccgactcgtgttcacttcattacagctatgcaactttgtcaccatggtggagcgacttcatctttattatcttcggcaccggcaaactttattgcttctacttcgcaagctttgctacttcaccaaccacgacgactacaagagtttcgacacctcggcatatgtcactaaatatgatgccgtattattttattacaacaagtggtgttccaatcttcaatatttctactcggacatcctcaacacatatcttcactcaagttatgactattcgatgacaagaagctacagttctcgactctatgttcagttgtttcccaactgatcaaagagtcgggggctacacaaatacaaggctcaaaatttgacaaattttatgtcaagctgaagaaatcaattaatcagccaacgagtcaactccaggagtcattatcttcatctttgcttcggagcagacattctacttcaacaacttcaaatatttcggttagacgagttgggcaacaacatcaactctcctccaagtgaagcatctacaacagctgactggtttcttcgcctccacggctgtgcaacttcatcacttttgattggtatcactatcttcactaccaccaatatttttgccacctctgttgggcaatattatctctatattggtcgtcttgtctctatgccaactgcgtcagctaccatcaatgaacaattgtgactacgtgctcaggggcttactagctcaaatacaagtattatatcttcaatttggacttgctccggatacatgcaacatgaattcatgatcatgggtctattttctatgctcaaagactggactatttattattccccgtaagggttatcaactgaatacttgtgccagtcggaattcaattgttatatctattttggagtatcccataaaggataatcactcagatcagaagctattcatatgagctacacttggtctatatcacccgaaaagatttattactcgggagcatgttacatgcgtcatcctttaaagggtgtcgaaggcatattttttggcctaggcctaatatatctgcagcccatattttcaggtgtggcctgtcacgttcttttagggacttaggcactttttgcttaggccaaagtgcgcgtgatcaattgcccaataccttaaaatccttttatatcgcagttactcaactttttaggagttggtataatgcatcttaaaaggtgtcaaacagtaaagctttatatagctgccccgctgacttttttatatagtcatggtgttgtttgggtttttaagcaattgattggatacaatatcattgctttttgccacgtaagtgtgcatttttattgaccaatattatggcttaggctgattatatattgtggtcattttccaggcggttggtaaatcctttatgagtttatttactcagattttatacctcatatgccatatatttccaggtgtggtggaaccatgtgtcttctagggacttaagcacatctgttaaagcagtgtgcgcatggcgtatgcccaatactatggaaatttctttattcacaacatacaagcttctttatagctattttgctatgtgaattttcaatgatgtagccaactttaggttacactcatcatattttacaaagcagtcggtatatcacttggatcatattattcagggattcataccacatatgctacatattaagtcgcttggttgactacaattatcgaaaccactcggtgcatctagtcgatgcacctgactttattttttcagccctccacagtcttctgatttggaaaaagtactcgggagatcatggcgaagatgattgaagcactcggctttggagtaatctagttcgagagaagattatctttccgactgtgaaggtctcaggggctactgtggagattatgggtaccccatacccacacggcatggttatccgactagttataggggataacttatatatataaaatatgtaacagatcatgacttgggtattacgtttccctgtatattatggaacagcctaaagtcctagtttgataagattgtaaagtagatttagaaaaccgataccgtattggttaaggtttctatcttgtaaccctgccccccaacctatataaggagggcagggagccccctctaggggcatgagacaacctgatcgtcagatcaatacacactcggcggattcaaatccccaaacaggagtagggtattacctctcattgagagggcctgaacctgtctaaatcctttgtctccgcatccatccattttaggtctcgtgcgctacccccttttattattgccgaattcatgtttcgacaccctaaaatttgccttatctcctttgagtttttcccgatccattagttaaaccttgagttgaccattagatttttttgaaataactatatcaccccttctcatactcacatgctacatgactcattaatatctatgtgaaaaattataatttataatcaaatcaaatcgaacagaaatatgcaacatttaaaatacaaaacttaatttgaataaattattatttttactaaatccatacgagaatttaagctagaaattcagaacaaaaattatttattacttgggtttaaattttggtcaaaatgctgtacggatttcatcaaagttcatttgaaatttatttaaaattttaatttcattattaaatttgtggtcaattaattctatcccttcatttttacaattgaatcttactcctgttgagagttgtcttttttatcactaggctagcagacaattaactgattaagtatgacgggggcaatatagtcctttgaaaaaattaacggtcaactaacataatcaaaaggagaactcaggtgcatataatacattagataaaaattcatggacatataaggatcgggcaaattctcaagagcacgtagagaattttctccatggatgctagctagtgacaatcttacatgaatctgattctctggagccctctgttacctttaactagaggttggggcgcgcccttggcgcaccgcctgtacgcacgtgtgccgcccaataagctgatagccagggaagaacggttaaaaagtgttggtgggggaaaagtaatgaaagcagacggcaatagataaatagattgcagcgctaacacacatatgtctgatatttgtaaggtgctgcagtacctatgataataatcttaaggtgcaacactaattaac

SEQ ID NO: 38864 - DNA, 1144 bp, Oryza sativa
acgaacgcgaatgaacgtgactgaaatgtgaacgaacgtgagtgttagtgaacgaacacgaatgaacgtgaacgaacgcgaacgaacgcttaacgaacgcgaacgaacgtgaacgaacgcgaacgaaacgttaaagaaacgtgaacgaacgcgaacgaaacgtgaacgaacgtgaacaaacgtgactgaaacgtgaacgaacgtgagtgttagtgaacgaacgcgaacgaacgcgaatgaaacgcgaacgaacgtgattgaaacgttaacgaacattaatgcacttgaactaaaagtgtgagaacgaacgcgagcgaaacgtgtacgaacgagataattaaactattgttgaacttagcatatatatatgattatatatacttgaaaacatgaaatacatttttttgcatgttgcagagaagacgtcgtcgtcgtcgtccctcaagccgaagtggtagctagccctcgaaggaattcgcgcaggcaagtgatgtaaagatgtgattgttagagatataatataagattgttagatttctaatataagattattagattattagagttaccatatgtgagtgttagaaattattagattattagacttagcatatttgagtgttagagatagttagagatttaatataagattattagaggtttaatatacgaaacttaattagacttagcatatgtgagtgttagagatttaatataagattattagagatgtaatattcgaaacatatttgattgttagagatttaatataagattattagagatgtaatattcgaaacttaattagacttagcatatatgattatctaccgtacaaatacacgacacttagacttagcatatttgagtgttagagatagttagagatttaatataagattattagaggtttaatatacgaaacttaattagacttagcatatgtgagtgttagagatttaatataagattactagagatgtaatattcgaaatatatttgattgttagagatttaatataagattattagagatgtaaaattcgaaacttaattagacttagcatatatgattatctaccgtacaaatacacgacacttagacttaacatatttgagtgttagagatagttagagatttaat

SEQ ID NO: 38865 - DNA, 705 bp, Oryza sativa
aatataaatatggtatacaattatttcatggatcaaacaataaaaactaaacacatcagagaagaggtgaatggcagcaacaccaaaaaccaaaagtttttgcggaattaaaagttaccttccaatcgttggagatcggtctaactggctagccctggtctgaccatgcccttgcagccggtctgagcagtattgatcggccagtctgaccgcctatcgaaccgcctgcgcctgtcgctgccgcaggtctaactgccctatacccatcggtctgaccattggtaagccatcggtctggttgccgtatacttgccggtgtgattctcgaaaccgagcaaacacaaattaaataactcgtggaaatagattaacctttactgattatattagcgtttacaaagtgcgaactacaacacttctttcaaaaatttcaacctttactgattatattagcgtttacaaagtgcgaactacaacacttctttcaaaaatttcaactaaactcgaaaccctaactttttctctcagctcaactcgtacaaatcgataccaggagggcttagcccccctctctacttacactcgaggtagatagcctaaagccacgaatccaacttgtgcaagaagtcctaatccactaggaaacattcccgtataagaaacaaacttatctctttccaacttaaactctaatcttctcaaatt

SEQ ID NO: 38866 - DNA, 859 bp, Oryza sativa
tggacttcaccgatctcaacaaggcgtgcccaaacgattacttttctcttcctcgaatagaccaattggtggattcaacaaccagctgtgagttgctaagttttcttgacgcttactccgggtcttctataattgtggcatagtgatggttggattgcagatgttcagccgatcggaccaatgggcccctagtctgtgtctaattaaggtagttctcatgtcttattgtgaacaatgaaatttggcaagatatattcggatttggacatggatattaaagcgggcttgaaagagatttgatcttgccagaaactaactgcgcatcggctggacatcatatcggcaggaaacagagttggacaccaactcagccaatatgggaagtagctgatacacctcgacttgggctcggttggagcctcgattgagataactggcattgccatataaagataaagctgatttaaggcaattttttctattacattaggatattaatgtcggtttgaattagagaaatggtaagagtccgccgtgtggacttgtttgttgtttttatctttatgaaagtttgagtcgtgtccataatggacgagttttgtactctgtgtataaatataaaccccgaatcattgtaataaacgacgacaataaaatcagtacaattttctgcacatcgccacactttttattgtaataaatgacgacaataaaatcagtacaggttcttgcttcaagtcgggacatcagctacgatctctcgacaagaggtaacctgtctcaatggtttgcatcatcggggcttttacattgctttaaatgtattaatattgttcgtgtgacgtttgttatcatatat

SEQ ID NO: 38867 - DNA, 612 bp, Oryza sativa
ccgtttataaaaaaaaatcacatcaagtatacttttaattttatttttttagtatatattttgtagttctagaaatttattgcacactatactcactttactaaactatgtccatgttagtttttcttatcaaggcatttatcattaatttatatcaagtctatatatagtaccgtctttttttaagaaaaaatacaaagatttttttcttaacttcatacccacattttaaaaatctttcatccaccaccgtattacactagtgatctaaactagttgacatctctttatcacgttacacataagagtatcatctaggtattatgtaagaaatatatatagcttagaatcaataaacaaccaagacatcaacatgcacacaggatcaaaggccaaacataaataaaacatttgatttcatacaacaacaatgctgaccacttacatcaatattgatgcatgcatggagatgaaggtgagctaccatgcatgacatagacgtatggcacacatttttgctgctagctagcggccggggtcatatccagcttattacaaatatgtatagttatactcacatacatcactcatatctgtaggtataaaacaggg

SEQ ID NO: 38868 - DNA, 1914 bp, Oryza sativa
acgatttttcttttgcctgggagaaccacgtggcgcttcggctcgtcaggccctttgccattctttcctttgctagacatgtccttcacataaaaaacttgcgttacatcattggcaaggacaaaaggttcgtccgagtatccaaccttgttaaggtcaaccgttgtcatcccactgtcattaatcgttacgcctccaccagtcaacctaacccattggcaccggaacagagggaccttgagaggtccatagtcaagttcctatatctcctcgatggctccgtaatatgtgccagttgtaccatcgtgtcccatggcattgatacgaatagcactgttctggttcgtgctcttcatgtcttgggctcttgtgtagaatgtgtacccattgatctcatatccctggaatatcgcgatcgactcagatgaaccccttgccaggaaggccagttactggttaatcgtctcgttacccatgagatgttgttgcagccatgcggggaaagtatcaatgtgatgccgtgtaatccatgcatcggacttaccgatgtttctgggcgaactagagccaagtgctcctcgatgtaaggagccaccaatgaagattgttgtaaaaccgtgaaatgggctttatgaaataaattgttgtctaccgtcattattgctttccttccgagagtcccctttccccgtagtctcccttcgtggcgtgattcaggtaccccgattggcgaaggtcttcaataaattctacgcccatgttccataccccttggcgatgcttgcctctggaagagcacggttacgaatatacttcttcagaacgcccatgtacctctcgaaaggaaacatgttgtgtaggaacacaggcccgagaataccgatctctttcactaggtgacaaatcagatgcgtcattatattgaaaaatgaaggtggaaatatcaactcaaagctgacaagacattgcaccacatcattctgaagggcttctaacctatccggatcgatgaccttctgcgaaattgcgttcatgaaagaacatagctttgttattgttacccggacattgtctgggaggatactccttattataactggtagcagctgtgtcatcaacacgtgatagtcatgagactttaggtttgtgaacttcttctccttcgtgcttattattcgctttatattcgtggagtatccagacggtaccttgatgctctccaagcattgaaacatactttccttctctgccttgctaagagtgtagctggctggactcaagtaatggctgcctttctcctgtggttccgggtgaaggtcgccgcgttgtttcatatgcttcagatcattacgtgcttccagtgtatctttcaactttccatatacacctaggaagccaagaaggtttacgaaaaggttcttagtgaggtgcatcacgtcgattgcgtggcggacgtccaagaattcccactagggtaactcccaaaatatggagttttttttccacatcgccgcgtgaccatcttcactctctataggctggctgccaggctcctttccaaacactactttaagatctttaaccatagcaaacactgttttcccgctgcgtacggtggtccgccgtatgttcaaagtgcttgcctttcttccgtaccgggtggtttgctgcaaggaatcgacgatgacccatgtacacaaccttcctacagtggttaagatacgtactttctgtttcatccatacagtgagtgcaagccttgtaccccttgttggactgtccggataggttgctaagtgcaggccaatcgttgatggttacgaacagtagcgcttgtaggttaaacttctcctgtttgtcctcgtcccacacggggacaccttccttcttccacaacagtttaagggggggtcc

SEQ ID NO: 38869 - DNA, 709 bp, Oryza sativa
ttacaatattgagcgggttttgtgagcactgcatcaagatgattctttgttagaagatgcaacagtttattcagtaatgaaatgaatttgtacagaaacttacatccatgatcgctgtttgaatctttgggttctggaatgcaacagcaacttctgggtttgccattattttcgatactacctcctctggagtcatgccaacttgcgctgagcaaacacaaaatagattgatgtcatatatgctcatttgaatttgaataactttttacaaaatgcgatggaacaattttgcaatagatgaattgttgcaaacaatagaaaactagttcagcacaatggaatcacaatccagtttaattatctccacccacctaccaagtatgcaaggacataataatgggagcaggtgcgaaaaactctgctaggcgtatctagcaccagaaagtgacaaagggggtaaaagaacatatgctccatatgacttcactatagcccaaaaagaaagaaaggaagacagaaaagaaataaaaaacaggttcgcattaggggggaatagcacatatcatcgaattgctcactgggatagggtactaaagcatagcatggaagctaaacagaattccagtgttccaatcaggaactactaggtaaatgtggaaatgtttaattcactcaccaaactgctgcctgacttctggactgctaaggt

SEQ ID NO: 38870 - DNA, 11430 bp, Oryza sativa
cataggccctgaattgcctacatacataatcagtttaggacatttatcaacagcagataactaaaaatccttaaacagaaacacaaataaaaaaactaaatgtgaataataaaaatgtgctaatgataatagtacttactagattcagttgtcccgctagcagaaccttcattcatctaaagcagttccatttgttggagcctatgaagatcattgaaaatgattagttgaattgtacttggagcctattacaaagcttcttcatgcaacttactttttgctcagtatcctccatagtttcactctgtttactctcactttttacatccactgtctccagtgaagattgaagttccttttgctgcaactcttcaggagaaacgtcaacaaaggctgcaaacattttgttacaataacatgagatatgcatgacaaaagtatgaagaaaacataagattagacactaatcacaagctccatcccctattcactgatagttggagaagaattctcagagataaacggccaataccaaatttcttctttggctgttcagccacatcagcctcttccaaagttccagttgcttccactttagtagctgaaacatcgacagttgcagattgaggagaggtatctttccttggttgtgagtatgggtaactgctaggagctgcaggagctgcctgtggtggcatggcaaatgggaaaggcgagtttgagccaaaagtgtttggcggtgcctgggtcatcattgacttgaatgcttgttgcattgcatatttctgcatcagaattagcaatgtgtcaaaactggcaagcaagggagagttatacgattttaagttccaacaagacattatacagatcaaacctacaaagagaacattgtattaattaaatcagtgcaacaatggatacatcacgatatactttcgagaaaagaagtggtgcaacaatgttaactctctagtaattaaaagaactagtggaagtgatgatgctgtatcatcctcactttggatcttttatgggtgaatttatgtatacatgtgtgttacttataggttttttttgtaaaatattgcactattttacatgccaatattttgaagctgggtgaggtgatatgatcatattttacatgcagaatttacattagaggacttcctttagtcttttatatataaaaaaatttgatcttagtgagtactccctccggctccataattcttgatgttttggacaatgacacggtcttcaaaatatatctttgactatgtttttctattataatatataataaatatatatatttttacttttattattgtactttataagacaaatctaaatatgctgttctagtacctttaaactaaatatttttaaagttattggtagtcaaagttataaaaatttgacctcaaccttgtccaaaacgtcaagaattatggaatcggagggagtacaccaaattgttttgacatccatcacaatgcatggatattatgctattttatcaatattgaaaagaactagaaattatgtgataagaaaatgaattgtctaacaaaactacaatactccctctgtactcgtaaaggaagtcgttctggacagcgacacggtctccaaaacacaactttgacttcttgtttctataaaaatatttattgaaaagtgatatatgtatacttttatgaaagtatttttcaagacaaatctattcatataatttttacattttcaaactcaacaacttgagagttattcatgatttatattcccaaggtttgacttaaacattgtcctaacatcttcctttacgagtacggagggagtacactgcaacagtaccacctttgctagaacatatgccatgcattgcttcaaactattaagaactagaaaggaaggcatggctcacatgtgggtatgtaggttcatcacaaaaaaagctcactaaaatacctctcttgcttatgtactagtatgcagaggtgaccatgggtcattctcaagatcaagtatgcaattgatagggtacataccatttgaagatgtagaaacagaggaaagttgtgaactcacctttaccatcgaagagacctgatataacagccaacaccaagtattaaaatacaactctaagaacatttaatcacaaaaaagcattacaggtaattgtattcacaccatagaaaatgctgcggacaatgctacaccaactccaatccagaaaacaggcgaaccgctgcacaaaggatttacatgtcatcatgcagtgtaagttgagaaaattgtagccagacaaaagaagggaaactggcgcacatgtatgacgatgggggtggcatgggaggtagggaacccgttccagttgacatattctcactgttggtcgaagacgacatgcttgcaaatccatttgtctttaatccctcgaaacctgttgttacaactaaacaatcagaataatggagatcctccggcagcataagattaaaatgggggaaatcctaagctgattgggattgtctattcgtcggctattactacaaacaaggacagatatgctgaccattttgtactcatcatttgccacactaccaatactggataaggtggccattactaactcaccaactgccaccatactacgaaaataaagacagtattccatcacggatgcatgacttaaggtcactaaattcgcaaggataacacactcaattccactaacgaagcccatggcacagcgatggatccagctgatacacagagtataataaaattcctgacaatcccacaaaaaaaaacactatagcacggacacttgaagcgagcgcatacgagagctttcagcgcgcacctacccaaagagcgcatccggctcgcatctaacgaacaaacctaaaacggaagcacacccacacagaagcacaccacccccctcaccgttcccggacccgcgggccgcggcggcggcggcggcgacgacgacgagcttggacctcccagctcccctccgcccggacgccgcagccgtcgccgggagagtctgcgaggaggggcggcggcggcgggccgcggagaggggaggcaggcggggagaagcggagcaggaggaggcgaggaccaggctctccatgccgcctgctgcgcgcgcggggggagggaaaaccctagcttagctctactgctgctgctactacaactaccaccccctcgcccctccccactcgcgctagggttttgggtgggtgggtgcgcgcgtgagtcgacgagagacctcgggctcgtgttgtgtaggctacgttcccccttttacccctgcggtgagtgataggaagctgaaacggaggggagtcatcgccttccgctgcgtggggctagtatccatcgctatcgggacattcagagtttcagactgtcagcggctcatttcaggcactaattgcagacagcaacatttaaccactgatgaaaaaaaataatactactactaattaagatgcgatgtttcaaaattcgaatatctcaaaatgcaattcgggccagttcaaaaaatgaaaagggaaatccagtaaagtcgaataaacaacttttatgccttgttattaactgacaaagttcaatgttttggttctgaatttgagagaagagagaaaattaaagtaatcccgttcaccatggaatggagtgtaactagtagtagtaatttgtgccattgcagaaatcatatcgcgttcaatcactcaagttacaaaagtacaacggtatacatgaatgagaacatatgcatacaaccttcagttcactgtgctaagttatttcccatcttacagcagaacaaatgttcagaaaagccgaacgagatattctaacgttgaagggttgcctgcacatatattttgatcaagcaaggtagagcatcatgcagatcaaaccaaggggattatctcctggaaatgctagaagggtgaaaccatccatcattttacagtcttcccgaaacctcaaacaagaatatgatgaccttagcctataagaaaaaactcggtgagtatctctgcctcgtacttcatatctgctgcgctttggctttcttccgcgccagagctctttctctggcagcagcaagtgcatcagcatttctcttatagtgttcatccgtgatctgtgctggttgagtattctgtggattctgggtctgaggagctggttgggtattttctggtgtctgggtctgaggagcatccaaggaaacatctgcatttttctcggtagatctagcagcagctgaatcccttgattgagttgtagcaggttcttccacacttctactttcattggccgtctctgctccttcaccggagtcccttttgtgcttaggagagcgatcggatacttcagcaccaaccttgctagttttagcatcttgaactttctcgtctaacttttcaggtttagcatgttttgtattgtcatgtgtctgtgcaccgaaagcaacattcttactaagaccaaagtaaaaatcactcaagtctttcttcttagtaacctgtacaaaaatagacgaaggaaacgtaatcagttacagtgagccaaaagaattttttgttgtgaaccattagaagtaattttatcttagcaaatactccctctatcccataatataaggcgcggtcaaagttggcacggtcttcaaaacgaatgtttagcttataatttctcatataccataaggtttgtagtaacaaaattataaccatatgaatgtaaatttaaatctcgatctaatggtataatttttaacaaataaaattcattttatattatactaagtgttggtcaaatgtttgaaatgttgaaacttcaaatgcatgcgcgccttatattatgagatggagggagtatctgatttggagataaacaaaactattgcattaatttggtgatcaacaaacatatttcagattcccgaaaggttgcttgtgtaagcagcaaccagaagatagtgtttttcgtaaccagcaaaaagcaaagtgaagacagtcctttaaaaagaatgctaaaaacatataaaaaaaggtaggtttacaattttgcatagcaatataacataaaaataagtgaaaaggtcctctcttttctctctcgtactcttctagcaagacagatggggcatgcagcacactagtgtgaatttgaagattgtgaactcaaactaaagagtttgactataaacattacaacaattcaattaatatcaagtttaatgcataattttgttatgaccaacctcacaagagacaacacaagaagcattggtagaaataaattatggagataaacatgcacataatcaagagtcatgaaaaaaaattgagaaaagcttacatcttccttttcttcttgaagctgccgccgcttctcttcctccagccatttccgctcctcctcaagtttcttcctgtaggcagatgtaacaaatttgtctttgtcaccatataggtggtcttccttactcctctctttttgaagcttcctctcataaataatgtcctgctctcgtttacgttgttcggctttctccttaagtgccgcaatgtattttgactgagagaagcatagcattcaaacgatgagtagccatttacatactctctgtgctagtgcacatttgggagaaccaaacaattccttgtaaaaatagcaaatcacaaacttgcactaccgacaatcaaccatgaaggtagatttcagttagccctgaagtatgctccaatatacatctagcaaacataccagctggcagctgctaatccccaaaaatgaaactccctatgctcaagcaacaactactgctttttttttatcaaacagcacaaaatctctaagcttcagcaacaaaagtaaaacccgactgcctcacatccatcattaaatcagtaccacgaggggaaataatacaaccccttcactaaaaattaataatgtatactctttggaacatcccggtgaccataaacaaagcaccaagagaattaagtaatcaaatcagagggagacttacctcgcgaactaccctgtcctgcatcttggggagggcggccttctgcttcatgtcgtcataaacctcgtcgtaggcgaacaccgagggatcctcttccatcgccttcttctgctgctcttccaccttcagcacgcaacgcaaaccccaaacaagggtaataagtaagtcaatctactcgtgacccgcacggcccagccggcgacggtggaggggttggggggaggggattcgagctagttaccttctgctgggatcgcttcttgtacgactgccggaggatgtcggcctccacgtcatcgtcgccatcgtcggcgaaggccgccagggggcgggccggcggcggcggcggcgcccgcgacgacgaggacgccgccggcttcgtgcggagctgcagcccgtacctctgcatcgcggcggcggcgtccaggtggtgcgcggattcgacgcggagcaaaccctagtctcgggcaaggggaggaggcctcctgacgcggagaaatccctaggattcggcaagggggaggagacccgtgatgaggcgggcagcgagcgaaggaagcaggggcgacgagccggcgaccgacggcgacggcggtgagggtcgccggcggcgacctcgtccagcgactcgcgaggaagaggagcgaagggcccgagactccgagaggagttaacggcgaaatccagatgggtattttaggttggatccactgatactaaaatccagcgcgacccatacagcccacctccgcgaattgggctgcgataccagatttcgaggcccaatacatgagatacaaactggccccgtacgttttcgtgagattaaaatcccgaaaactatagcttaatgagcacactaatattgagatctttctttcctagctattgtcatatcgaatgcaatgaaaattttactgaactgcgagatagtaacaatttaaacacttgatagtgttgaatatatttggtttccaagcttaaacaaatttcggttgtgtttttaagagtagaagctttcaaaattaataattttcaacaggttagcattggcaatggtatgtagtttgaacactgctccctccgtttcacgatataagttattctagcatttctagcatttcttatattcatatagatgttatatatatctagattctttaacatctatataaatgtagaaaatgctagaatgacttacattgtgcaatgaaggtagtaccaaattttggtagtgttaaaagtagcaaaaactgaacaggccatagctccacaagaacaactgctcttttcctagcaggagaaaaatacattcagaaagaagagattaaggcacccaacgaattgttaacaatcacatttcatagaagcacgacaacttgctcaagattaaaacagcaagcacctttgatgctgtacatcatatcatcattcttaacaatacccccataattatctggtgaaacattaacaggaagacgcacaccatcaacatccacatgtcaaaacaataccacatcccgttactcagggggggcaggggcacaaaaccaaaatgagatgccactttgcactctagggtaacttctgttggtgaccacggtcgcagccgcctaaacagtggattctcataatctatcaactaattcacttttatttagcaaaccaggcagtctgataacttttttttatctcttttgtagatacatggcaccgctaacctgcgaacagaagtcagaaccagacctcttctttctctagagatatgtacacccatctctgattagttgaggtcgtgtatattctccaggggtctcagaaatatgtgaccactgtcacgagggtaatgatgccaacctaaatccttccattgctccagaatagcaaccttgggcccaaatcaagtctcacccaaagcaatcaagagctacctaaagtgggttatgttaattcactattgctgtgaatcaaatcatataagctcccttttcagctaaagctgagatttcgattgacaaatctgagattgcacttcatggaagcatatgatcgggggcattttgttaacagtacttcacaggatcaagctgcaaaatccagaactccacaacttgcaatatttgttttgatgagtatctgcaaaagagcaaataaattagcgtgtatttggtgacacacttctagtaattctttttcttgtggtgcatgtgttttgataaccaaagaccaaaacaaaatttctggaccacaaatagtttaccatcattggacaagatcacgtcgccgagcttgatttttgaacccacacttgcctctacatataacattcatatattataagaaatctagtgaataaaaatcatttcacgcaaaacataggcccttgaaatgtcaaaggcagaataaaaaactatattctgatcacacctcatgagcaccatattggcagaggctctctttgaaggctttccatcagatgtgcttgcagaaatttccatctccttcagaccacgtggaggaccacggcggttagcatgtctatgtcctgaattgaagattgacagtattaaccatagtacagaaaatgatctggagaacagtttgcatcatttttcatggtcataattgcaacaactaaatatacaaaccattttccacagggcctccgcgaataccaccatgaccccttgggtctatttttctctctccatggcctgctttgcatcatcaagtcacataattaataatagggtgaataaccaacatgatccttgaactttcacttaaggatcaatttagtccttgacatttcatattggccaaaataagtccccaaactttatagtgtgatttaatataatccttggacccataaaaatgccacgtgtacatgccacatcacatgtgcatgcaaattcaacatttaaaatgtccattctacccttatacattctccataggaaataaataaaaagaattaagaaaaagatgttgcattggtaactaaagaatgtgtcatttttcttttgttttaagattgctttcttcatgttttccttttttttttcttttttctatagaaaatgtaagggtaaaatggatatttaattgttgactgtacatgcatgaatgatgtggcatgtccatgtggcgttttaagccacatgataatctttagggatttgtttggacaacgtaaaacatcaaggactaatttgacccatgagcaaaagtttaaggactgaattggctattcaccctcaataatacaataactcaagaactcaaatgaacagtactaaaatcgcttcaaaaggaatcttaccatctgcttgctgacagaaattttcaccagaatgttgctgcattggtgagaactcagatgacgaggaatgcgtcccacctgatgcagatttgtcatagcgacgaggggcccatacaccacgatcaggcctatctctatttctagcatgtctttcagtcttttcactgatgagcccagaaccatggagatgactatgtttgtcatccaaatggtttttctcagcattttcaactacctgatctttaacaacggaacgtgggtttggaatccgtggtgggcgcttctcagctgtaattatgtgaccttcctgatcatgttgagacgtaaccacatgccgtccttccttgtttgaaagtatagtcttaataattctgccactgccctcaagccgcggatcttgcctagaactagattgtgcagcatttttcataggggtccctgactgctgctgagatgtgacatcagatgtctggaaaaaacatatcaaatgacagtcagtacagttaccaacaaaatggtcaaactattcgtggagcttatatacttacattagaatcgacccttgctcttcctttcaaaagcacaattttctcttttttgttttccgcgacatgagcagaaccagaaatcccgccacttgtagcatctacgagacaattgaacgaaacagcaatattaacaactaaaaaggaactttcatcaagacatatgggcagaaagtgcaaaaatagcatacatcaacaatttacaaattggaaggatagaggctaacagaagacgacaagaataatactatacacttcttggaaaggtaactgactaatagaactccatgcaaagacaaaatgatggaagttcaaaatgaaatccattttctataggataggacattgacgtagtgtagcaaaagtagatgtcacccaacaaggtacgccattgccataattggatggcaggtagccatacaaatgtccacaggcctatctcaacacaatagctattatgccaaataagtaaacaagcccaaactaaacttgtctatgttgatggtgcttttagcattgcagtggttttagtttttgttttggaatagtcataaaaacaactaagatttaacctatttacttaaattgtacaggtttcatatagctagatttcaccatgcaacacagcataataagatcaacttgatcttgcctcagttctcacagaattgaatcaatcagtgtcatcaccctattacctaactcagctcaaactatacattagttgatacaaccttttatcagcatatataggcatggatatgttatagcagagaacagatacttagtaataatcaataaaataaaaggacatgttgatatgaatggttacaacaaagttatagtgattatctatttcttgaatcagtaccacctgaagttccagcagtacctttttccctctgcgcatgctcgtctctctttggcactaagatataagttggcttctccttagcattctctcgtagaacatattgctgaagatcacatgaaaaaaagacaaaaacagtagcttgtcataacctcatggcatagtttttgtgcggaatgaactgggtactttttataacaatgcagcatgaaacccaaaataaccaaactgagacacagtgcactgttcaaaggttgaaaaagaatagatgaaaactcacaacaatagcccagaaataaaatatactccctgcatttcatattataagttgtttaactttttccttagtcaaacttctttagaaaaatataatgatatttttaacacaaaacaaacatattatcaaaatatattcaatgctagatttaatgaatctaatttgatattttagatgttaaatttttctataaacttggtcaaacttaacaaagtttgactagaaaaaagtcaaaacgacttataagatgaaacagagggagtataaaacatataagagcatacaatacacaaacagtagcacaaacagaaatgcacactggggacagga

SEQ ID NO: 38871 - DNA, 1079 bp, Oryza sativa
ccccgcgcgccgccgaacgggtcgttcgtaatcgcagcaatggcgcgccagccaatccgtccggactttttatttattttttgttgttgttgtgacaaaatcctcaaatgcggctaccgagcaccggcacaaacggtgagaaaagaggcgacttcacttcaaaagagtagcctgagtaggctgcactggagaggtgaaacaattttttctttttagaaagtatatataacctccagccactgcagcaactaagaatacacgtggtcataattatgatattactacatccgtccccaaaatagagttttaggcttaacgtgagtattaacaaagtgggtaaagttaaatggtaaaaatattgtgatcggttgaaaatagagagttggtggagaatatgaatggtggaatattatgattggttgagaaaaaaatgtaggtggagaaattattatattttcggacggatggagtaacgtttaaaatctgataggttgtgccatgcattttccattctaccactacaccaataatgcttccgcatgaaaccgaatatagagggaggaaacaaacaatcttttgttttttaagtggggagaaagtgattctgttagtcaattggattgctttattatcactagggccagttgttctcatatgttgttttcgtaaattctaagacgtcactgtaattttcaagacccattagctctagctctacaggtgtttgtttttttctcttagcaaatgagggtgcaaggtttgtttgcagttcagctgttccattcaggaaacccaccaactctcagagataagcactctctgatctcccctttgttgctttttaaatgtgattctgttaatgattattggtacgaaaaaaagggtagtacatcgcaagattgatgtcccactgcttttttttttgtcacgttcgcaatcgaagacttgaagttgtacagtctgccgctttacgacttcgaaaaatatgtaaagttgttttcatgttcaaagtaaaataaacatctgggtctggtcagtgctgcatcggcctcagtatttacataaattgggctgcagga

SEQ ID NO: 38872 - DNA, 4199 bp, Oryza sativa
  unsure (1)..(4199): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccggatagtccgacatgcattgttggacagtctggctcaacgtttgtttggctgtcactgtgtaagttcaagtgccttaatttggttttggtgattaatgacaaatctagttatatgagattaacatttttatgagcttttgtttgactagtctcatttggatatgaaagtaaaaaatgattagaggtatgtattaaacttcacatattctaacttggtctctcttgtggatccaaaatatagtgtgagctccctcattgatcttgattgattatgtgcgtatgtgttcctttatatccatatgtatgcacatcttgagggggaggttattctatattttgtttattataagatttctatcttgatttgaaatcatctttcatctcatctctctatattgtttatatcggattattatctatcacaaaagagagaaaagattgaaagatcttggattaaacaatttgtgtaattgttgctttagtgatagatgataaaccgatgtttatgggattaacctctcttttacataagttttcaacaaagttatttcccgataatgagatgtggtagatatgcattctttggtgatggaccttaatcatgacaaggatgaaattcatggagataaagcaatatgtatcacttcttatctcctactttttgataggttcatatatatgatttccatgttattgttatataagtgtgagactaatgtttacttgagtcttatcttatttagtctcctttacattgagaacatggagatcataaaggtatgtgttttttgctttatctttatcattgctacatgccttctccatgtgtataggataaaccccattggttcttcataacttatgcatacacttgcctctcttgtatatttatttgtatgcatatatttagggggagcaaatcctatacatttattgtgcatgttttagatccacgttgttcacctattatttatattggatctttgcatttgagcttgcatacgagtatatgacacttgcgatgttaatgaatactcaacaaacatatccatatctttcatatgcaaccggttggtcaccaagtggaggatgacaaccgatttgttggtactaatgttcttctttgagatgtgcaaaggaataggtctaattgtgatgaagctaatggatgacaccatgggttgatggtcaccaagccaagggcatcgccatgtcaacaagaatgaaatcaagcttgtgatgagaagaaagtcttgacaaatgatggtaaataccttggtataaacatggttgaatcaaatggtcataagtattgatctcgactcaagcttgaccccaagatggatggcgcaaggcaaaggtactaagaatgttttcttagtcttttcccggtcttggtgtttggtgtagaccagatttgctagataggtgccgtactatcaagaggggtctataaagcgagcttgtggatgatcttgtgccatgttagttcatatgcatgtaggtgcatttggtgggcttgtctagccaagtgtgatgagttttctcaagtcctaaaccaagagagaagtgggcatgtccaataggagtgagtgacatcttatgggtatgtccggtggatatcctttggagtttgagccctttatccttgacttaagttgtatttcttggatggttttttcatgggttggatggccctttgaataagctttccatagagtccaagaacgccaaattccgagacccgagtcaagagatatcgtcgttttactaacggtcggttaagctgaaaagtgacctgcggtctgaccgtgggccttaggccggtctggccgggcctattagccggtctgaccggtgtgataaggccggtatgaccggccgcactggtctgttgcactggtctggtttttggtgacgatacagagccgctagaaccacaaccggtcagaccgagccgatggcggtctgaccgagccgtggacaatctgaccgcctactacactgcggtcagaccggccaggttgagtgggctcaatggttgccctgtaacggctagttttctagtcgttacaaagtagtccggtctgaccggccactctatggcgatctgaccggcagagcacaaagttggggatttcaacttcaacggctagttttggtggttgggggtatatatactcactccccagcagcaagggcaaggttttggcactccattgcattatcttgaacccttgcaagagctctcacacccttgtgcacttagtttatctagtgaggtgttagagagtgagttaagccaatccaagtgcattgcttcattgttatagctagtgtggcacttgatcatcctcggcaagtatcctagacttgttactcttggaggttgccgcctcctagacggcttgtggaggtgttgcccggtgacctctccgaggagattgtggaggaggcccggcaccgtttgtgagtggtttggagttcaccaccttcagagtgaaggaagaactaccccgagttatcaaggcttggatagtcctttccgtgggccggctcccgccttgcccaccccttgacgaagggggcgtgcggtggcttcgtggttgagcggtggagttgggctcgcctcaacggggattaggaaactggcgagtttctgaatctcggtgaaaaattccttgtctcttgtctcatttatttgtcgcatttacatttgtgttatttacattcatagagacatatttgagcccatatcacttaggtttgcaaaacttaacttagttgcttagttaaccttgcacctcaccttgcctagcaacttaggttagttttgtttaagtgccattaagttttaaaaccgcctattcacccccctctagtcggtctccttgatcctacacactgggcaatggtattgaactaaccagatggtctagtgtcggtaccggacaatgggcaatggacagtccaagtgataccagattgtttggctctttatagcccaatggctatttggttagttaccgtttgaaaggtgtaaagagcctgactgtccgttgcgacaccagactatccaacccaatatattttctagaaacatgttcgaacggtagcaaatggctagttagtgcaatagagcaacctaatggagagtcccttgagcttatttgggatcaaatccttgtaagtttaatgctcatagtggcttagtgtgcgcccaccgagagttccgttcttagtgtttcaagtgaagggtgcatcttattgttcttgacatctttgtatgcctagctagcctcagaggcgaaccctgtgacgcctcaagatgcttgtggaagacccgatgtgattgtgaagggtttggggttgaaccatcaagaagagagcgccgttgaaagggagcaacactcctgtgtgtgctccaatgaggatcaatgaagattgtgtttgattccttctctctcttcactctcttgcatttagatttctagcttgaactagatttgtgtgtggtcagctgtaggttgcagtccattctttgaaacctgggcacttaggctaagtttatgttagagtttctaattttggccaatttgtttagaactaaattggagctcgccattccctgtcttcgaaaaggagcggcaaggtgacaatttgagagagctttatcccccctggcaccaactatatcaaatattatgaccaaatgcagcagtatttgtcttcttttgtaaagtgcctagaaaacatagacatatattcatccaagagcatatttttagaaacagtctaataatttaaagagtaaagtgcattggcggtccttaaacttgtagaattgtgtcatataggtccctaaactctcaaaatgcatat

SEQ ID NO: 38873 - DNA, 3333 bp, Oryza sativa
ctgaaaatgcgatactcctataaggatgaccaaagtacactgcctagtcttcatctggcaaattggtacacactgcacactataaacctgcagttctactctaactgaagacctatttacagagttacactactactacggtactaccacaaaaaaaaaagaagggggagggggatctgtacacagccaaaccagctgaccaaggccgtatgccccgtatccacattcacatattacaacgacaatttataggcttgccatcaagttgatttcagccggtccaatctgaacttcgcctgaaaaatgagcagatgctatataaattcaccgacagaaagcccttaatctttgcaagatgaattcagaatcagtgcaaggcgctactgctaaccatcatggcatggatatcgtcaaggaagggcttaagcaactttgcgagctttcgaatctcctccttcagagcagcacaatcttggcatttgccaacgagcaggttgatgaacatcttcctgtcaggaatgagtttcattgcgatctgttcaccacgtttatcaaattgtgtcagccaagtgcaatggaaccaaggattgatcattttcgacaaaatcgatgccccaagattcagtaaaccctgaccttgtaggctgctgaagagatccacccatgccatggctttagagtgaccatgtatgcagattctacaagctgtgcaaaacacttctgatcagaatcctcctccaatctctgtaatagtgcaatagtgaaatccatggatctggtgacgttagaaaaggtaaatacaaatgagaagaggcatattaagcagcctacgtattgcatatctcataatgacatgctatgaaagatcgaaattttcaagcgtaagtgcatatataagagaagaacggaagctcattacatgggctgtcttgttttacctagtaagccaaagaatagctctcgcgcagctatcaaccttccttgcagtgccctcatctacctccttctccagtatctcctctagattatagtatttggatgggtccaacaagtacaactcctgcagcctctgcaataggcagtaacagatcagaaaacaaaaggttgcacctggattttttttcttcaaaattcacagaaatgttcaaaagatatacactgaagtcagccagagtcacccattagtaaatagttggcaccaattatttgcaacctactagcataataacgttcacattttcatgccaagacaaatcaactctccacttggccatcactatcatgaccctgtcaatatgctctttccaagcctagaaaaactttaccttcaccctctcctgataatcttgatcttgaaaatattaaggtaaaacaaaacaagaaaaaaaacctcatcctctcgtagaggaaaataaaaaaggaacaaaacaacaagagagggacaccgaagtttgcgtctgaaaatgccccacggatgaacggacggatgtgaccagagcagttgaaggcctgtgtgaggcacacgcaaaagcaaatcttgaggagaaaatgatctgatcggatcagatatttacaacttttgcatcgagaggaaagccctaatcctatctcctttgttttatctcttgtcctgccttccaaattccaatcagtcgccgtctcctagtccaagaatcgagagcgccggaaagagaccgtaaataatactatgatgcaaagactttgcatgccgagataaggttcctggtgtttgtggtgctggaacttgcaagtgattcctctgcagttgaagctgcagttataagctcacgcaaggagggctcgtggtgtgctcgaatcaatatgtgtttggctgaagggacacgatgggtcaggatagagcgaacccatatttcagaatgtttggtttgatgaaagtcaggtcaagtcaacaccattggagtcatgacctgataattctatgctagtagtacacaccttgaacaactcggagcaggggcggatccagcatgggggcggcggggtctcgagtcctcacgaagaccccacattttaccatacgtagataggagtggggactataactttatctataactttatctagtttgcttagaccccaccgctatttaaccgccaccgacttggaggagtaagaagagattatcggctgtcgaatcgtgctttgagattagtgcgaatatccagaaggtggggggcctcaagaggcagctctcaactttggcaaagcaaagcagtgactgtgagcccagtgacagtgtcaaaaggaaaattaattagaggttagcctagctatctacgtggcttaattaaaacgaccggttgctttcggtggctactggctagccgtgtggccggcacgggacaggggaagcagccacaggattacgcttccctacatgggaccgcgccaacagctctaatctataaaattagtagtagatgtgaattcttggggtatgattatttggattcacaacttgcaaccttttttgtttcggtttcttgctctcaagtcgagcagcaggtaggggtgtgattgagactctgtgcctaccaaccatacaagaaggcatttttagttagctaggattttcatctgatcagggaactaatgctttttttgagagagagggaactaatgcttgactagtaaaacctttcttctactaactctgtcttaaaatatagcaaattagacataacatgtaacacgaatctgtacaagctccttattcgtcgtagaattttgaatctgtacaagctccttattcgtcgcataatttttcacgatctcgcagatatatgtatttttttatcatgatttacgctaagaaatggtaatgatgaaaaactgtaacatggcgaaaatatttttagggacaaatatgtaatgacaataaaattaaatactagttctaaatatttgtaatcagtagccaaactctaagatcatgcagattactagtaggtcattaggtacagaaggaatgatttttttctttttgtacctcgatgtttcgttggacgtcgagcctcagcacagccatggtcggaccgatcttatctgcaaacgcccatgtaggagtatcaccagagaacagtaagaacaagcaaaagcaacaacgacaaagcacgcaggtcaccatgtgttcaaatgaagaaacgggatgcgatacagattactggcaggtgatggcagatagaggagtaaaccatgcaatggcatgtaaaaaaggaaaaaaaatggaagaattggagaaggaaggatgaattatttttgaaatttgaaccaagaacaaggttgaaagag

SEQ ID NO: 38874 - DNA, 2622 bp, Oryza sativa
  unsure (1)..(2622): unsure at all n locations
gtatctccgaccacccgcgnttngccgcctcctcctcttcctcctctcgatctctcccgtcctcctcctcctccttcggctcgtctccttcgcccgcgtccttcgctcctacggccttcgccgccgcgtctcctcctccttcgctttcgccgcatggcccgtcgtccatggcgctcgccgtcgccgccgccgcttcgctctcatctctccccgtctccgtctccaccaccatggattgatacctcagaaagtcttcggtcttcgtcggagtcaccaatcacatggcgattgcgagcacgcaattattgtcgttgtgatccttcgctgtgtgtgttcttgtcctgtgtcagggagagtgtgaagtcaaaatgctcaaacaccgtgccgcttctgtaggcatagaagagagatttatgaatatatactaagggcagaaaagaataaaaaaaaagcttcagcggagcttaagattctaagaaagaatttaaaaaaactggtttttcctgcttttggcttttatctttttttttattctacaactacatcttctcataatctaaatcaaaagttgtttagaaaacttctgattctaaaaaaaagctgtaccaactaaaatcttctccaaacatgcccttggattggttgggcacgttgcacgttagttaacccgcctttgttcgctctggggaacgagaaaaggcactgacaagtggtaaaaatttacgagtactagcagtacaatggtccacggttatcgaactggtgattgagtggtgaacatggtaattaaccaagctttgccgtcagcgtgcgttaaaacaaacaacggcacgtccagctcactgaatttctatcgagaaccaatccgcatgtgcataatatttcatctactgagtatatatgtactttgaaaagatatttactaccctcttactaacaaggatgtcaaacatttaattcaattatagtgggggtaataataaaaatcaacatccaatcacattgtaccacgtcagttttgtaggatgtttgggaacaaaattttgtatctgtatcatttttctcccaatattcaccatgcaatattcaccgcgtaaccgtatggttaccacagtaactgtgcttcccacacggatgcgattccttcaccggtcaaattattttaagtttaaccatggttaccaagcttacctcgggaaagggtaaccacatgccacatattgatgcccactgcgcaaagtttttcatgagatttatgtttatatacatattttaaatcatgtctcgagtcaaaactaaaaccaaagtgggtgtatttcttctacagtagtcctgcacttccaacttgtttgcatgttacagtttgatatgcaaaacttctgcaagactagtttatgattgtgatattaatcagtatatggagcagtttttattatcctgatattgatagccctcattattactctaaagaaatatagggagagggcgtcacgtcctcttatcatactcgacgcatgaaagggatcacgccaaggagaagacaccagaagacaatatccctggccgtcacacaccagttcagtcagcaatgacgaaataaatggccatgtcactcctatcttttaagttccaatcggccgccaaaacaggtacatgccccaattctcacagcagtttctgccccccacaaaaaagaagtgatcagctgctacaccatcttgaccagatgccagatgcagtcccagatcctcagaaaccatcggtacaccaccaaacagcttctgcagtccaccacaggtaaacaaccaaggtgcaaatgtaaaatgttacgatcgccagacatgagaagctcgcactaagtaaatggcaaattggccctggctgcatgtgattgccactttgcctgacgaccttggaagagagatactccttggacatatgcaaaacaatcctgatctttaagtagccttgatactgattctgatttcggtctggtggtccgaaagaaagtatagataatttcataaattgtcccccaaaaaaagtgtcatggactcatggtgtcaagattccccaacatgatgccgttggaaaccaaagataaactatccaatggaatccacaaagctgtgggatcagctaattccagacagggcaacagcaaaactgatgctcgtttggtgttcacagtttgtgctttaaccacttagctcatgcagcagcaatacagcagcgtgatttccagtaaacagatcactcagctcgttgacatttggttctccctaatcgcttgtagtggggtactgattaaatccgacctggctctactttaccaaaaggaattccaaaatatcctccaacaggcaacagtagcaaaacattgattaaagaagtgcaaaagaatgaatgatgcgacaaacaaattgaatcatatgcagacggcaaactcaaaattaaaacatctttatgaaggctagtacacaaccactcgtgcaatcccctttttaaagagagaaagaactgagtcaagtttaagcaacctctgaaacatcacacgatgataatctcttctgttacatagaacttttttaggcttttcattgtctatgacatcttagcaag

SEQ ID NO: 38875 - DNA, 753 bp, Oryza sativa
tggacaagaatacgtgattcagtcggtgacaggttcttggcggctcgttttgcgtgttggagatggagatttggagtggatgtccctttttacagacctagattagctatgataatgaggtagcagtcagcagtgaactcaacttgcctgctttgcaggagtattcgtcttcctccttttgaaacttgaaaagtgaaaaaactataatttctgaggaattctcgtgttccacagttaggcaattcataaatgtcatgtatgctagtatacacccttaaacagtgtactcaccccgtttcataacttttgacgttttagataagactgagaatcaataaattttaaactatttagattgaaaacactataacacgatgtatatattaatcttacaacttattttttatatgttataatagaaaaatcatagtcgaagataattttttaagaccgtgtcattttctaaaatattaagaattatagaaccgtatggtacatttatgtttaccaagcagtgataaggtatttatgtattttacaactttgatctctgaatatttgcgtgtaggagatggggatttgtggtggacgtccctttttactgacctatattagctatgataattacgtatagtaagcagtaaactcaacttgtctgctttatagtaatgttcgttgtcctccctttgaaacttgaaaactgaaaaccatgaaatttctgcgaaattcttgtgctctagttaggcactcatc

SEQ ID NO: 38876 - DNA, 600 bp, Oryza sativa
catacacagagcgcatacaacccttagaaatgtccaaatcaaatttacctaagaccttaattccttatggatgttctgtccattcaaaacagctggagcaatcatatgatgttttaaggttgcaaaattttgtttgccaactgatcatgtgggtaatatagcatgtacctatgaaatgctagcatagactagtactctttccatgcaaagaggtatagcattgttgaaaatgtcctctaaaatgtgctaattttgttcaccatatggtcatgccatttgatatatactgttgaatgttttaatatgagataacttccgttgtctttgattaaacatcagctgccattgtggtcagttctattccttagttccattagtgtttcttgacatattaaccacacaacaatgacatattatctattatatgagtatagtgtttcagaaaattatattagtttgtggacttggtctgcaatgcaggctgatgtttgatgaaatgatctatgatatgttatcctccaattattctttgaagtttggttgtgataaaatgaatctttatttcatgtcatgaattcctatcaagtgaagttcaatttt

SEQ ID NO: 38877 - DNA, 1188 bp, Oryza sativa
taaataatggatgcattcaaaatgaattcagaattcttcagaattcgacaccagagaggcaatgcatggtcgtatgggatccgcgttggttggtgaggtgcttcactgcctaaaaaataaatttataaggaaaacaaaatggagagaagtttgatcatcgatgaggacttggagtgagttcaatggctgtttggtacgactccactatatatgcacacatatcagtactgttccctgactttgttcttcagttaattgcgtatgggagaaacctctcaacagcaacaactactgcacaccaacttgtactagaattgcgccttgttagcaatatgatagtacactgaattttttttttgtcgaaatcacaatgatttaatgattttaagttgtttggtaagagttcatgactagtgattgattaggtttacggccatagagtcaacgcatcagaatacatgggcgatgacaaacagctacagttgttctattccaaatactgcgtacaaatttcatgcgaaatatctttcaataagtaatgatgtggagtatttcttaaaaaatagtagaatatacattttatacaagggcatatgtatatatagtgtatacatgttcttttttttttgcatcttctttaaaaaaaaagaatttatttgatatgtacttgcaactaccccaatgttacatcttgctaatcttgtcaatttatttgatatatagctgcaactactctaatattgtaatactgcatttactagtcttatagatttatttgatatatgcttgcaactgatatataatactatattttgcttagggtttagggcgactattgcaagaaaattgtcgaggaagacttcaatatatgtatattaagaccagaaaagaacaaaaaaggggggagaaaacccaaaaatatttcaaatcaaaacaatgtcagaagaccatttacactaaaattttgattcttttctataaaatactaatgaatgttctgtgactaatgctaagcaataacaataaaacaaacaaaaaatcctcaaaagaaaactctcctccccgttgttcttgcgcaagggaggccaaccatgcaaatgggggcattccattccacgacatgccacgtcacgtcgccgtggacccatcggtgcacgaccgcgacagcgcgggctcgccgccggcgcc

SEQ ID NO: 38878 - DNA, 3627 bp, Oryza sativa
tcctgcacccccttgggcgagccgctgccctcgtacttctggattgccttgcacccggacagcagctccagcagcacgacgccgaagctgtacacgtcgctcttgtccgtcaggtgctgcagcctgtagtactccgggtccatgtaccccaccgtccccgccgtcacgcaccgctcctcgtcgtctccgtcgccggcattgcctccgtcgccggcggcggcattgtcaccgtccagggtgttgaggagggagaggccgaagtcggagaccttggcggtccagcaggagtcgaggaggatgttggaggacttgatgtcgcggtggatgatgggcgggacggcgtaggtgtgcatgtactcgatgccgcgggcggcgccgagcgcgaggcggaggcgggacggccaggaggcgagcggcggggagagcggcgccgccgccgacgccgcacgcctgtggaggtggtcgtggagggtgccgttgggcatgaactcgtagacgaggatgcgctcgccgccgtcggcgcagaagccgaggaggcggaccaggttcttgtggttgacgcgggagaggagcgcgagctcggagacgaatgccgcctcgtggtcgacgcgccgcgccgcggcggcggaggaggaggaagggccccccgtgtcgcggcgctcggcgcgcttgatggcgacctcgcggccgtcggggagggacgcgcggtacaccgcgccgaagctgccggagccgatgcgcttcgccggcgagaagcagtcggtggcggcgcggagcgccaccagcgggaactgctcgaccgtcgtgttcgggcccttggagagcagcgcgctgagccgccgctccacgcgcggcgccgtgcccgtcggctcggcgtggatgcgcccggagaccggcgagctgctgccacggtgccggcgcaggtagtaaaccgccgcgagcgcggcgaggagcgccacgagcgccgatccagctccggcgctgatcaacgctatcgccagattgctcgggcgacgcttccccttcgattgagagctcgacgacgacgacgagttggacgtcggggacagcgccatcggaggaggggtgtagccgcaggggtaacaaacggacacgtctccgccgcctcccccgccgctgccggcgcagagctgcgcggagcccgaccagacgccgcacgagcacgacttcgacggcgcgcacggacccgggagcaccttgtcgaacaccttcctcaccccgcccgcgacgcctgcgccccagcactgcagcgagtagtcggacatgagcaccccgcacaccaccttccccttcgcctccagcgcgacgaactgctgccccgccagcgccggcggcggcgacgcctccccctcgggccagcacgagaccgtccagttcccccacagcacgcacgtgaccgcgtcgcccaccgccaccgtcgacaccgcgcggctgatcctcggcggcgacgcggccgccaccgccgccgcctccccccagcaacccaccaccccgccatcatccacgccgcacgcgtgcctctcgccggcggcgagcagcatgaacctcctccccgcgggctccctccccaccacctcccctccaccatagcacctcacctccccgctccccaccaccaacccgcacacgaacccgccacccaccgccaccgccgagaaccccaccctcgccggcgcgccctccccccacgggcacctccagcactgcatcctctccccgacgagcccgcacacggactccccgccgccggacaccgccgagagcacccgccccctgtacacccgcttcgacccatccccggcctcgttcagatcccaccaccgcatcgacattggcggcgacgacgtcggcgcagccgagcacaggtacccgtccccggcgaccaccgccgagtacggcgagcacgtcccgtccccgccatacgcgtacacgtgcggcgccgccgccgacctgttcgacacgctggcgcacgagatcctgtaccccgccgccgcgccccccgccgccggcacgagcccgcacgcgagatgctgcttggaggggttggagctggagttggagacggcggcgatggcgatggtggggagggggaaggaggaggaggcgaggaggaggggcggcgagaggaggagggctaggaggaggaggaggaggtgaggtggagacattgggttggaggagaggaggaggaggaggagtttgtggagacgaccattgttggcgcgagttggggaggaggaggaagaagatggagaaggggaaatgggggagggagggaaagggtggaggtttaaaggttggtgtctatgtttttctttctcctcttcatcactttttgttagatttttttttattttttttgttgttgtttgagaaaaagtaatgggaaagatttgggtgttttttgtttttcttctttttggctaacttggttgttgggtagtatggaaatatgaatgcactattggtatttctctctctctctcttgttgagtgattttttttttgagaactttgttgagtgatttgatgtgtgtcaatagcttgtcaagaggaaataggtggcttgttaattagttatggtgttgcattttggaggaccacgttgtgattagtaatgggattctttcttttttttcttttgtgcatatgaattttaagcaagctgtagtacatttcatcagaatcctctcttttgacatatagccactatcctttctgttgtgatgatagtacaatggtggttgtgacttagtgacaagtatcttccaatggggtcgcaatctatgttcgaagaaaaattctaggtccgccaccataatcggagatcttaatatgaactttttgttaagttcattttttttatgcacgatcttcacaaggtcatataagcagatgatcatttcttctgttgtatgattacaaaagggaaggatgaaattacttactgatattttccttctaatgtgtgaaagcaaaggtaatttctcatatggcattttgtgcaactcccacaatgtggccaggcctttcaaagtccagcgaagttggagaaaattattgaatcatcattgtgctcatctcactcagcagagaaaatggccaagaaactgtacttgttttcttttcttttttttcaggaagtgagatcatgggagaatactaggagcggtttccggatctagaaacacctcccctaatactttcattactcatcagaaaaatctattgtttccggatctagaaacacctcccctaacactttcattactcatcagaaaaatctatcttattgatagtggttattgtttaagtatcagatttggacgcaatcatcagagatcatcacatataaggtttcttctaggtcttctttgccttgccacaagcaagagtcccagctaagatccagattctccatccatggcatgtgtgctctgcagattgctgagacagccagctagtgactgaagagaaaaaacatttgattacaagtcaagatcatttctttaccctgcaagatggcaattaacaagccccaacactgcaattaaatacagtttaagtagctgtaatacttttctctctgtgggctcctgattccat

SEQ ID NO: 38879 - DNA, 19644 bp, Oryza sativa
tttgcgttgtgcttagctttgttgaccggggatttttgctgccctgacctcgcagctcgaatcgacaaaagcagaagagaatcatctcacctaccaagcgtttttattcctcctatcattctccattagggataacttgggcagctttagcattcgacgtggacagaaatctcaaaatgcacaagctaaaatatcgttttttttatggagtatagtttgttatggtggattgcttattgtgacgttcttttttatatttgaataggaattgacaagtgctattagcaatagttttattaatagtgtaaggatgcttaaacattttggacttgctctgaaattttgggacctaggcggctaatagagctgatgactataacttctaaccaccctgcccctgttgcttcacacggtaaacaactgcttttaaaaaacaattatttttctcaaagattaaccaaacatctctttttaaaaaaacaaactcttgtattggactattggagccggctcatctatttcagctgttcaatttccaatatggaaattacaggttttccttttgcgagggtgaaaattaatcaaattacaggttggagaactatctttccaagaagatagcaaccatgactaaactgaaacattgcatcctgcaactccaagagagtactgaaaatcttgatgttctatcgtggaacgtcgaaactgtttatttgtttttgacgttgggtttgacaataatgacatgtttacagtgaagtcgaagctcctatgtaacttgggtggcaagttcgcaatggtaacacatgccttgtgtagtcgaggctgttgtgtcacttctacgataagctcggtgacaatacctcacgttgggtttaggtcgtggtagtttaggttagattagttgttgtggttgtgattttcgctcaggttttcctaattaacagtgcactataaggtttattcgtatttactctttaaaatgtgtcacattgttttttatataaaacatcggcaacgaactgacgttttttttgggaaaaaaggaagaagagagaagagcagcgcaaagtctaattgggctttgtcggttgggcctagttatggagattgaaagataggctagaagtaaaattcagagtagcttttagcgattcattcattgggccaaattttgagtttgggcccaactattccttctatttcctgacagaataagtcgacttgtcgtccctcaactttaacgtcttgacctcccttatcctcgataccagaaatcttcgcccctaaactatacaaaaccgtgcgtaacttatgtcccatgacagtatagacccgtttttcctgtttttgctttcatgatagatgaccgggccatttggcaatctgagaggagatggcggaggcgccagtggaggagatcgagggccggagctcgcagagaacgacaaccagtgccgcggcccccgtcgaacatgctgttcctggcgacatagcagtctcgtcgtccatccagcaaaaagtattttctatacctagatgcctaggtgtatgcatgtaattcaaacagttataaaaaatttcataaaatttgataatatagtccatgataatataagacaatatgtaaacatgtaagtgtaaattcgatcgatatataaagaaacaaaaataacaaattttatctgcattgtacgggtactattcattatctgattttattatttttatttctctagttgtagatcgaatttagtcttgcatgtttgtatataaacttatatcatcacaaacaatgttactaatttttttctataactatttgagtcgtatgcaaatgataggtgtcatggtacttttggtacttatgtgttgaaaatcctttgtccgtccgtccatccagccccagctgtaccgctgctcgtggttcatgctcgctgcggtcgccacagcaagacgacggccagcgcgaagagctcaccctgcacatccgacacgcgcgccatcgggtggaggctttttacttggtgccgtaacagaaatccgcggcggcgccgcgttcgtggttcctcgccggaatcatggtttacccgcttgttgagaggagagctctcgtggttcactatggttcgtggcgtggtaattgttggatcggtcgtcgaggctaacggccaacctgtctgatgattctcgcctgtctcgtttagccttcttgttccatcctaaattgtgatgttttcttttgcatggctagcttgtttgatcctttggggattttatggattagtacgattcttcttttggttcttgcgtcccaggagggatgatggacgagtaggaggcgagcaaggggagtacgtgacacggcttcgccggaagagaaggtggcggcggcgaccaggaacggcggcgtgctcggtggggccgcggcgctgttcgtcgtcctccgcgagctccggccctcgatctcctccatcgcccgtgacccgcgcgaaaaatttgataatttgacactttttttcgttgcccaattatttaaattggcacttgtgaggatgataagtgggaccatctgagtgaatgaaagtggatcatgatgtcaaataatcaaaactcatttaaaggagtggtaaattatcaaatcgctcgacgtgcgcatacccatccagacatcgaggtctcctcctcttctaagaccgacaagtgggcccaatcatatgccagttaagaataaacataaaaagatgaggcctatatataatgccatgtacctaagttgtattttttttatagtttaagggtgaagatttcagatataaatcaaactcagcctaaagtttagggatggcaagtgaacttacagcatcatcgtttggcttatctgcggaataagccaaacgacatatttgcaaacgaaaaaaaaaattatgaataaaacttttatatacgtgtttttagcgatctaaaatcaaagatcgaaaaaaactttaatggaagaacctcaaaattaactccaaatttaaagttaaaaattaaaattttagctgataagtgtaagcacaagtaaaaagataatgccattattcctttgctgaccggaggaaatgaaggcccaggcctcaagtgggccccaaataggccgtgcgtggtgctgtacgtgcggccacgtgggcaactgcgtctccgagcccaattcacgtgtcaccttcgtctatttattttctcacgtgataactaatagggaaataaaattgaaaatatacttttgtttcctttcaatttacaaaaatatacttacaaaaatatatttgcgaaaatatacctcatcctaggttagcgggagcggtacggtaagcacggtcgcgcctgccggtcccgcacggcggttgcgcggaagcgatgcagcccgcggcacgagtatgcgggagcggcggggatgcgggagcacctcgggagcggcacggtcccacggaacgggcgtgcgggagcggctcggttccacatttttttacggtatcagtactgttctgcactgttcaaacagcggtgccgccgatccaacgtggaaccggctcatgaacagtgtcaaaacagtgtgcatgtgcagcttggctgcccgctcacgcgcggccggcctgcgtgaccgcggtgccgcttggccggtccgcggtaccgagcgtccgtgctgcgggaccaccggtccccgtggaatggtagtgcgggaccgcctcgatcccgcgtaaccacatcggggaataggtatatttgtgcaaattttcgctatataggtatataaacacaaaataataaaaaaatattttttcaattttctttcaactaatatacgcagtaattaattaaaaataaaccaaggaaagttggaaggtataattgggtgatgcacctcacacttgcaccgaataacatcacttcagctaaccaagcaatgtttccttttcagtacccattttacaaactcacatttacaccaaattttttgactagtggcggtcggtcacgcttagcggcggtcgatctggtgctagccttctcctgggcttgtgtgttggtgatgtcggtgtgtgggtggtgatatattttttcctttttcctgattacgaccctccaaggttgtaatcttgtaattttttcctactctatcaatagaacttcgcaccgtctcgtgcgagtcgtttaaaaaaattggcttgtttcttttcaccctctcttcagatttatagatctagttgtattgtcccgcaaaaaaaatagatctagttgtatttaagctaactctattttaccaataataaatcttcatggtttgtgtcgatgtttggcaataataaaagggtagcttaagaaattaacctaaaagaagatggatgaaaggagacaaaggtttagacatgtttcacactttcccgatgagaggtaacaccctaattccgtttagtgaattggccatcttcaatctttctcccctgtccaatgcgcgatattatttgaacttcactagctacaattgtgtggatgaaggtagtaggagtacatgaaacattacatgaactcacatcaaatgctatttgtaatgttcagaccttagtgttccagctagtcagtcacggactcacacattatgactatgagtttcaactataccgaacgttttgagatatatacttcctccgtaaaagaataagtcgatttttctacctcatcaaagtaatctcaaaagaattgatttctagccccatacctaacattggcagatcggctcatgaatcgagatatattaaataggctttatctcttcaatagccttacctaccttaccttacgtgagaacactacgagtatttattattagacaaaagttgaacatccaacgcaaaaagtgacacttccgatggactccacaatttttgtgtaattggctgtggacactcgagacaatatcttatcactctcgagagaaaagatgagagaaatttcaaaagaatataaatgctctggccttagtcctatgtaagcctgataaggtgtggtaaatcacactcgtcgcccacgctccacaccctcgatccccttccaatctaaccctaggtggtggcggtggtggcttcgacgacggctggcacgaacggcggctaaatactactttcgccattctaaaataataataatttagtaggggatgtgactccacatagtataacaaatctgaacagttctttgtctagattcgttgtactggtatgggagatttttttttctagagggagggagtattcattaatcatcaagtcctctggggacggtgggtgcagaaatactcttaaaaccgaggtacccaggagcaaaataaaacacctccacgagacgggagagattctccaaggaaacaggcccatttctggccacatcaaaaaaccgctataaatttcgcctgagccacgcgtcgctccctctcctcttctccgttgctgccgcctgcgtttctccgatttctcccccctccgtcctcctctcgccgtcgctgcctcgcctccggcccgcgccaccggagcccggcgaggccgccgggcgcgcgccgctcgctccgcccccgctggaacctccgactccgcagctactcccccggcgagcgtcgccttttttgcggcgcgccgtcggccgtagcgttccacccgggcccggacttctgggtgaggccgcctcgggaataatgatttgctctctttcgccgtcgtgttgggctgtggggtgggtgacgcaggatcgcgggtttgagttgtgcggttttgttcgtgcccgagggtggtacggactacggaggtgtcaggttggcggttgggtgcggcgggggtggtgttgtgttgtgttgtgtttgggggttgggttagggtttggagccgctcgatttggggggaattggggttttggggattcggcgtggggaatgggagagcttcggtgcactgaatgggggttttgcggggagcttgggttgatgatttgaaggtggggggcattgggtggtgaactggtggtttacccctaggtgttctcaatccttcaatcggacgtggattggagctgaggaatgactacttcatgctgcattcttgtctgctaaaagtggctactctgtttctaccataaatttgtgcttgtcgaccgaaccgaaggatggaaatgataagtgtgttttgtggctgtgcattcgggggcttgttagttcttgcggtatagggatatcaacacgttgctgctggattaacgaaacatgaagggtgtattgttgacttagtgttagtgcagctacaccaagtaaaagaactagttgctcattggatttatgagtgttgcggtgctgcattttagtttatatttgtgtggttacatcagataaatgttaactcatcgctgtttaattttgttgtgaagattagcatccacgtgaagcgttctaagtcggattgacacaaacgacaaaagaaaattgtattgactttttttaaccatttggtgctaaatgtgataaactatcatatcccatgcagtattgaactaatgttatgaaaaatttgacactatatgatatgccatatcttcttataagatatttatgctttatctgtgatttggctgttgctaatttagagcttcccatgaagaagtgaatagtttaaaaacttatggaggtgtcttttgttgaattacagggatgcaatgcctctcttaaaaaggagaccgttcttcttactggatccgccaaaggacttgaatccagaggacaaggtgttccaagttcggtataccaaggagatattccgagattaccagtatcctctttcatgccttaatggctgcttattgagttgtcctttatatgaagaataatttccattctaatctgatattatgtacttgtattagattatgttgaagtaatatggttatgtccttgactatttattagggaatacctgaatagggtaaacctttatcgtgaaagagtttggacatgtaaggtgtctggaaaatcaaatttaacatatgaggaagcgctggtctcagagcatcatgctgcagagaaggctcaacagttgccaagagagttaatagcgcctgttctacatatgattcaatacagtatgaccaccaagcttttcctaaacctgttacagttcttggcagcgttattatgattgcacatttccagaaaatgcaatggttttttatttctttatggtgcacactgttggtctgtgtccaaattgattagtattctgtctatgcattttctcatttttcctgtgctatatgaagtttgactgagctaatactgtttgaaagatatattaggtccgtagttttccccttggggtgtagtgtaacacgcagaaggctttctgtgtgacaaatctctcttttttataattttgatgagatgtcgtcctgtaattgtgcgcccatgtggaggttgtttgcctagtcctcaacttcactatagtttgcaaaagggacaatctgtgacttattgatctactgtatatttagtatctgtactatattattggtgttttgagtggtatcactgatgtgtatcattagtgttcttatatagttttttgaattctcttctgtgaaggcaagttaattattccctttacaatattttggattatttgatgattttgatagagtggaatttctactacatttgcttcaggcactcttagcttgactgaccttgtcaacaaaatatacagtattctccaagaagacttttttgaaggattagaactaaatggtagaaaagatggttctgtgtctgcttgcaagatcttaaaggttattattggctctggtaacaccaagatgtatgaggtgggttggattggtcaggacaatgcagagactaacacttcagttcttcaagccgatgatctagtaattcgcaagaaggcacgcgctagtcgtagcatgctgaaaatatatattagggagtcaacatcacagaattccccatggattatacatgcaaatcttgcaaagaaatatggaatacccactgagcccccaaaagacttattggtaaccatcttccctcattttatttactgtgttccttattatcttaaacctaaaaaaccatggcttgtagaatggtcaagggttgccaaaactgaggagaggactcgagaatggaaccacagatgatgtcagaaaaaaattgaagaaaggtgacttaacagataaccatgtcatcctctcagttcatttgatgttccatacaactacatttttgcccagcttcttattgttcactttttgcatgactatgcaggtgagccaattgatgatcttttattaaggcctacagcagatgatcccagtctgtcaaaaagacgtccactgtctacagatttcagagtgcctgtagattctgttggggatctacttatggtttgggacttctgcatgacttacgggaggattttatgcttgtctccattttccctctcggacctggagaatgcaatctgccacaaagaaagcaaccttgttcttcttgtggaattacatgctgcactcttccatttgctcattaaagatggaggcgggtattttatgtttctccagaacaagagaaggaaattaaaggtgactttgccttatccatcatttaagcatgcatatttttttgtcctttcttgttaacttgcactatgcgtaggtaacattggtcacctgggctgagtatctatgtgatttcttggaaatgacaagtaaagaagaattctccagtagtttatcaactgtaagaagggggcattatggacttgttcacactgccgtgaagcttaaaattctgcgggaactggtagatgaagccataacaacttctgctgtaagacagaatatagatgaaaagattgaccagcaacaagctattgcagcatcaaaaagagagcttgctagaaataaaaaggaagagcataagctggccatggaaggggtgacagaaaaggaaatgagtcagacagatgctgcagaaaatgtcaacgggaatgtaaatggtcaggttgtggaaaaagaaggaaaggagaagaaaaacatttatgccaacaagatgggagaggggaaagtacatcctgtgagaacctatacccttcttcatgtgaacttgcatatgcacgttcattcttacatatgcaaatgcatgtctctgctgaagctatccatgacagcaggtgcaagtcttgttgctaatctttgctttttctgcatagcagatgttagaatttcaatggttactctcattgagaagaggatggcactcgagatggggcaattttctggttttcttcattcactaaacacaaaagccatgtcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaagcaggaaaaaaaggcaccacaagaccaagaccaaccagccaagacttattcctacattctccccctaagtcttgtgcgccgtcttgtgggagagttgagccatcccgatccgggagcaaagctcaaggaacttgatcctcccaaggggtttggtgagcaaatccgcaagctggtccttggtgttgatgtagctcgccttgatgctcccttcctccaagtagcttcggatgaaatggtacctcactcggatgtgcttgctccgttcgtgaaaaacggggttttttgccagggccagagcggacttgctatccaccctgagctccaccgctccagtatctctgccgaggagatcactaagcagtcgagcaagccagagcgcctgggtcgaagcggcggatgctgccatgtactcggcctcgcagctggacagggccaccacctgctgcttgattgactgccagctaacgaggcactcgtcgaggaaaaagagaatcccgctcgtgctcttgctggtgtcgatgtcgccggcgtggtcgctgtcgctgtacccgacgaagtgtgccttgccaggacacctcgggtagtagagaccgtggtcgagagtccccgcaacgtagcggatgatcctcttcacagcctgctggtgctccgtcgtcggtcgctgcatgaaccgactgacgtagccgacggagaaggccaagtccggccgtgtgtgggtgaggtagcgaaggctccccacaagacgtcggtactgtgtagcatccacctcctccgctgtgctgtcgcggctcagcttcagtctctcctccatcggagtgagagctgggttgcaatcggtgagcccagccagctcaacgacgcgcttggcgtaggcggtctgtcgaagcgtgatcccggagttgtcctggtgcacttcgatccccaggtagaaggagagaggccccagatcactcatctggaaggtggccttcatctcctccttgaacgccgcgacctctgcatccttggtgccggtgatcactaagtcgtcgacgtagacacccaccagcaaggcatttcctccattgccccgccggtagatggccgcctcgtgcgggctttgctcgaagcccatccccttgagcgtggaatccaacttggcattccacgccctcggtgcctgccgcaagccgtagagggccttgtgcaggcgtagcaccttgccctccttgccggggatcacaaatcccggcggctggtgcacgtagacctcctccttcaagtcgccgtttagaaacgccgacttgacgtccatgtgatggacgccccagccttcctgagcagccagcgcaagaaggagtcgcacggactccatccgtgccacgggagcgaaggcatcgtcgtagtcgatcccctcctgctgcacgaaaccgcgtgccaccaagcgagccttgtgcttgacgatggctccggcttcatccctcttcagcttgaacacccacttaagggtgatcgcgcggtgaccacgagggaggtcagcaagctcccaggtgcggttctcctgaaccgcgtccatctccgactgcatcgcggcacgccatgccgcgtgtttctcggcctctgcaaaagaccgaggctcaccgtcgtcgcacgcaaggtgcaactgcgcctccaggttgcgaggcaccagtcccggcaccggctggtcgccgagaagatcctccatcgtacggtaccgtagctgctcgccgtcatggtacgcgtcgatgcgctccccgtcgtgggagagcggagtaacgaactccaccgggctgcgctcaacacgagctggcgtcggagtagacgtgcccggaggagtggctgttggtgctggagcgtgtggggacaccggctggggtggtgtcgacgaagagctcgtcgtagtcgaagtcgtggcccgagggtgtgttggtgttggagtcggtggaggctcggggactggggtagacacgctcggtgaagaagagctgcctactcccccagctccctcgaagtggacgtactcgatggtgaagtcgtcgtacgtcggagtcgaaccatcatccaccgccttgtcccatacccaccctcgcccttcgtcgaacacaacatcgcgcgtaatgcgcacacgctgtgtctccgggtcgaggatgcggtaggccttcgagccctccgcgtagccgatgaacacccctggggtgctcctgtcgtcgagcttgccgatgtggccaagctccttggcgaacgcgaggcagccgaagacccgcaggtgggagaccgccggcttgcgcccatgccaagcctcgtacggtgtcctgccatcgagggccttggtaggcgagcggttgaggatgtaggcggccgtcaccaccgcctccccccagaagatggccggcatccccctctgcttgaggagggcccgagccatccccacaaccgtctggttgcgccgctcgacgacgccgttctgctgtgggctgtacggcgcggtgtagtggcgctgaatgccctcatcagcgcagtacgacgcgaattcagctgccgtgaattcgccgccgttgtcggtgcgcagcacgcgcagcttgcggccgcactccgcctctgcagcagcctgcgcatgcctgatggcgtccgcagcctctcccttgctgccgaggaccatcacccacatgtagcgggagaggtcgtcgacgagcagcaggaaataacgtcgtcctcctggtgtggccggtgtcactgggccacacaagtccccgtgcacgagcccgagccgctccttggctcggaagctcgtctgctggggaaaggggagccgccgctgctttgtcaccacgcagacgtcgcagagctgctccacgtggtcaaggcacggcatgcctcgcaccatctccttggcactgagctgcttcagggcctcgaagtggaggtgcccgaagcgctcgtgccactgccacgcctcgtcgtcccgacgagcggcgaggcaaactggatgtgcgacctgcgcgctgaggatgtagagtcgattagtgcctctggttaccttggcaagaaggcgacgacggcgatcccaaatcctcatgagtccgtcctcgaccaacacgcgtgagccgttctcatccagctgtcccacgctgatgatagaattcctcaacgcggggatgtagtagactccggtgagcagcctgtgctcaccggacttggcggtgaaggtgacggagccaacacccttgatctccacgccggaggcgtccccgaacttgacggtgcctcggacgctggagtcgaactcggtgaagaactcccgtcggccggtcatgtgatgggtggcgccggtgtcgaggtaccacccatcagccttgtcgttgctggagccgtcacagagggagacgagtaccttcggctcatcaaggtggaggaaagccgctgcggccggtgccgctggaggtagctcgatgcttgcgtgagctaggagcagagccggctcttcctcctccacccgtgcgacgtgggcctggccgcgtcgtggctgtcgacagtctttggcccaatggccaagcttgccacagttgcggcaggtgtcgtctcgtgccggcttgtggttgccggtggcaacgccctgggcgcctctgcgggcgccaccctcggcacgtcttcgcgcccaccgtagctggacacctccccgcgccttgcgcggcttatggccgcctgtcggggaagatgactcccccttcctcctgtcaccctgagaggcctcccactgctcccgagtgagatggagcttcccgccgatggtgatgggccccgagagaggccgtggctcatcaccatcgacgaccttgaggcgacctaacgcctcctcgatcgacatcgtggagaggtccagcagagattcaatcgagcgagcgatctgcctgtacttctcagggacgcagcggaagagcttctcgacagctctctcctcgtcgtaggtgtcgtcgccgtactgcaccattttctgcaagagagtgttgagacggagagcaaagtcatcaacatcctcacctggcttgaaggccaggttctcccactccttgcggagtgcctgcagtgtggacttgcgggcgcggtcgctgccgatgcgtgccgcagcgatggcgtcccaggcctccttggcagtccgcttctgggaaagcgagaactgcatctcgggcggaactgcagcgatgagggcatccagtgcccgccgatcctcgtcgtagtcgacgtcaccgtaccggactgcctcccacatgtgccgcacctggagcctcaccctcatcaccgcggcccactcgatgtagttggttttggtgagggtaggccacccaccgccgggaccaaaatccctgaccaccgtctggacgccgtggtgaccatggcgccggtcaggggagagggagccgtgccgcctgcgagggccgcgtgcgggctccgggctgccgccggcacgcccgcgcccgtctgggttcccgtcggcgggcgcacgatcccttgggccgccgccgccgccgtggaggtgggctgctgcccaccgctctgctcgctcccgtgcccttcctcttgccagctcctcaagctccctgtcagcggtgatgtcgccggcgatggagccgttgatgctgctgcgcaaggtctcaacctctacctccgccgcacgtgccgcatcttccgccgcctccgcctccgcctccgccctggctgctgccaactccgctgccgccagtctggccgccctcgctgctgctgcagcggtctgagccgttgctcgcctgcgctcttctgctgcggcgagctcggcgtcctgctgacgccgagtgctcgaggcgaccgaacgccgagaccgagcgtcggacatggcgcacctccggggggctgctgtgtggagagggggaagggaaaggggaaggaggggcaaccggtgctgctgctgctgctgctggctgagagctcaaccgagcttgggaaggggtggaacaagagatgtttatggttactctcattgagaagaggatggcactcgagatggggcaattttctggttttcttcattcactaaacacaaaagccatgtcctcccaaagaggattggatacatatttatagctgcttgtagcagccatgcagccatgctagtctaagagggtgctgtcagcatcccaacaaactgtcctagagcagagcatcccaacaaactgtcctagagcatctcaacaaactgctgtcctaactgtcctagagcatccaaactgaaagtagagatgctgtcctagaaagctgaaaagcaggaaaaaaaggcaccacaagaccaagaccaaccagccaagacttattcctacagcagaggcaccttggaacagaaatggagaaacaatctgtacaaagcaattcccttggaaaagacaggtactacaacagatattggttttttaggcatgaaggacgactttttgtcgaaagtgcagattccaaagaatggggttactacagcactaaggaagaggtgatcactttgcaaactttgggaatccctatgttttattttctggctaacagttctgtttcaatttgtaatccacagcttgatgcgcttattggatcgttaaatgttaaaggcataagggagagagcactgaaacggcagcttgataagttctataatacgataaggtactcaattttcattcaaagaaaaaaatataagataattcactcattgctgtagttgggtactttttacatgtttgatggttgcttctgttaatttttggaagtgacagattagctggaaagaagttaatcatcccatgtcaattttttgaaggcctacatctaatttttttaaaaaacaaaatgttatttaatgtagataatggtccagaatggtctttactggtggaacattcagttcaaggcctaaataacacaccgtagcctccatttttcactgaatggatgcgctatacttgctagacatgatcgaagctcctaaaaatagatcttgaaagattaatcattgagtgtaggttttttgagacctgtttgccttacagttgcagtctttatttgtacaagtaaaatgttctttgtgtgtttctcaaacatgaaggaaaccttaagcatgggcaccatatgctctcatgttacttttcagcctgtgggcattggacacttatggtaaactctttgctctgtttgtttagcaattgacctttgtgttggccgatgtagcaatgctctggaaaaaagaacgaaggacgtcacccagaaaatgctactccaagaggctgcactgcggcgatcctctcgtgtacaggcccaaccaagggataacccttcgatgttattcctcaagtatgtcaacaaatggaaggaaaactgagctcttactggttgatatgatacttgataggttgacatcttctttttcttttttactccctaccctttgaacccttgtagcggtttgttttgggtccttgatagctgttgatacaccaaaagaggaaacctgtcatttagacatagtcggcttaggcgagctgcttgaaggaaagatcgcattcgagtggactcatgctgctataagctgatgatcccatatccattttggaggattgggtaactgagagttgttaagcagtagaaatcctctgtatagtgaagagagtgcagaggtccatccgttgtatggaactatggatatgattgttccgccttgtcgagttccatgaatctataccattacctgtttattatcaactgttctgttttgttgtctcgttattatgttttgttttaatgagaaaattaggctctaatcttcatattctgttttatcgtgagaagttggttttgttcttgcatttgtactttttttaagggtccacgggagatattggaggaacaggtatctactaaatcctaatgtagtatatttctgtaagagttaatcacatctatatgatcttagaaaaaaaataagaggatttctggtgaatgccaaccaaatttcaaccaccccactgcacaaccgatcgaaatttttacatcacaatatttaaatttaaatattcacattatttcagttcccagagcaaatacattacaccagatttaacttacacccaggtgcaattgagcacatctaaccaccgactaaattctggagtgagggtcatccatattagccctgcacccagaatcgacacactgaaatttaattagcctaccaatcaacacctatgtaaattcatgtacaaaatgcccaatatttcctacccatataaatttacattccataatccgtattgtaatatacattaacaaaactacacaaaccctattctgctaatcacaaggcaagcgccttgtaccattgtccatggaccttctctgatatgactgccatatttatcagcatctccccggccttgacaaccctgtcggcgagcttcgccgcggcgaggcgtcgcagcggcgcttcggccagcttcttgcccttgacgccgccgccgccgaggacgacgccgcggaacgcgcagtagaccgtacgggacaccttgccgaagacgacgtcgccggcctggaggctcttgaggagcatcttggtcgcgagctccgccgtggcctgagcctgcttctccggcagagagagagagccgaccgtcgccagagagctcgccatcgcctccacgatctcctccgtcgaagcgtcggggttgctgtcgaggagcttcacgagagcgtcgtagagctccgagatggcgttctgcagctccggagcagcgaccttcgacaccagaacttgatgcaggacgagaatgctggaacagacagacatggtagattgatttcagttatcacatgcatcaagtataaaaatcagttgttctgaatcgacagatttagttcaaaagttcaaggtggagaatatttatttacctcgtcgcgatcacaatcaccttctgaaactgatcttgcacagccctcaacctcggcagattaatttggaaggtctcaggggttgactgcatgttcaggccctccacattgctgataagttgcaacaagccaacccttgtcagcttgtcgatcttctcacccttgcattctgggagaccagaaccgctagctgcggacgaagaagcctgagccattggagcaccgtgaccagctcgaagtgccggaacaacaacgcgttgagcctgacaagacgggttaaaattcagtgtcagtcagagaaaaacttaagactgctgcctatgctaatacaaccgtaaaaattgttgtgatcgtagagagacttacatgatctgctggcaaagcttggagagactccaaatgtgagctccactcttgttccacgatgctcttcgttgccgaaacccactgcttagttatagggagagacgctgatgcattagcaggaggtccatagcgatccgcgaaagccttctgcaggtactccactccggcagagccttttatgattggttgcatgagctggatgcgagccttgctaacttcagattgcagttgctgttaaatcacagaaaaaatgttaggaaaacacggcgcaaagtaagtgcaatctatgtcaggactaagtcaaggtgttaacattgaacaaacctttatttcttcgagagtgaaacgcaggcccttgatgacagcaatgacaaaggagctgatgccattgtcattaacttcggaacttgcagccaactcgttcaataatttctcatgactcctcttcatgtcatcttcctttgcaggggcagatagtttcctgatcatatccagggagtagtgcataatctgccccagatatcgcgtgtcctgggagcctgactcgagcacctttcatccaaaaaaaaaataacaacattaattcaaaatatactgggtttaacaaaagcaaattaatactaactattttattttgtcaagaccaccgattccttacctgtgacaaaatttcgaggtcaatgttctcgaggatttcctccttcaactccttggaagccaactcatgtaatgaatccctgacttccttcacgaggttaattagttgggtataatctggtttgtcccctttcatcgaatcagtaaccagatcccaaaacgctttctccatcgtcgatttcactttggcctgaaactccttctccgcggaactgacgttatcagagttgccaccaaaagaaacatcgtcctcgtgaagcatctcattgagcatttgctcattgtccgtcggctgtttcatcagagatgaactgcttggcgatgaagcagctccaggcaaagattgggcagtgaagctcgatccagacgaaccaatgctcaaaggagtagatacgtttgcaactgatgcagctaatgggtttccgttctccttcgcctcaaagaactttgaccttgtgtccgaaagagcagagttcatccgctcgatgcctgcatcgccactcagttgatgaaccttctctcgtaacagcttctgatcatcagcaacctgtttctgaatcgccttcatatcatgagagaggccattatgtgactgcccatctgaacttagcttgcacgtctgcatcatcgacagctcaagcttgcacgcagcccggacaagatcgtcctccagcgatttcgcatccttcagtttccacaccacaaagcagtagaggtaagcgcaccatgctctatcgaaatcggccagctgagcactgaacattttctgaccggcagcagcatcagtcgattgcttctcaagcacagtcttaaccaatagctcaaactccttgacaaagcttcctgctgaatccataagtagcttctccttctccccttgtccactcaacactgcacccggatgagccaggatcatgtaggagcagaggactaccctcagcgagtatcgagacgcgctagcagcagcagcaggtggtggtgtcttcttcttctttggagatccaaggtgtttcaggaggtgatcgatgtttatgaccggcgatgaaagaag

SEQ ID NO: 38880 - DNA, 13577 bp, Oryza sativa
aactcgcttccttcgctgctttactgttcctctcctctcctcgacttcttcttggtttttctctctctccctcgagagagaagaagttgggtttgttgtgttacgctttcctctgtcgtttgaggtggcaatatatacacagcgggtgtggggggagtattcggaaacggattgggaatcccaaggcggatcggacggcgaggaggggggtccgagacggagatggaggacgcggggaggccctatttttccgggtttttttttcttttctcggtttcctctcggtattttttttctcttttttcggttttttaatacgtgtgtacgtacgcttttttttgggttttttctctccttttttactattttttaatatgtgcatctacaaagattgtataggtacgtagtatctcacacatttacatagtttgtagtttttttattggtttttaatacatatgtaaagtttgtatatgtacgtttacaaagtttatatacgtgtatatattttttattcactaaaaatgtatacatataaaaaattaaatatatctatattttttatatacagtgtatgtactccctcttctcattggatatccattagttgattatgaatagttagattaaaagagaaaaataaattactgttcccttctttttttttttaatttctgcgtgcatgcactccggccgttacatacgcaggttcaaattttttgatatggttgaggaagcacgttactagtatatgtatttttttttctcggcacacaagtacaaactttttgttttatactccctccgtcctaaaatatagctatttctagcacagtatcttgtcccaaaataaagctatttcttcacctacctcctcctctcaaccaatcgcaaccattcttcttcacctactttctcttttcaaccaatcacacacttcctctaattattctcacctactttcttaatacccatgccaacctaaaaaatggcttcattttgggacggaggaagtagtatgtacactattgcctcacaaattttgacaatttgactctttgcaaaaactaattatacaaatgaaccgtggtcaaaacttattttaaaaacgacccttttgttcaaacacctcagcgtcaaatagcatggcgctgaatgcaggttggcacgccgactcatactcccatccacgatggcacgacattcagcgccagttgacgtggcgctgagttgtctaagttcagcgtcatgagatttggcgttgaacaaaagggtaattttgaaataagttttggctacggttcatttgtataattattttttgcaaagggtcaaattgtcaaaatttgtgctactgcctagtagtttatatacttgtttgctttccatatagtattgtacggtgcctagtagtatatccaagaatgaacaatatcagcacttttatactactttgtaaatagtagtagcgatagatatagagaacttttaaagtatagctagaaaggtagcccgcacgaatgcatgggcatatgtcgtacgttaagtttaagatacttataaaagtgaaatattaaccggagaacacctcccatgatttctctataaattgttttcatggcattaattgcttttataagtttataacctattagctttatgttaatcatatttaagtaatatctataagcaattatttataatattcttcattatttgaaaagaaggtagacttattttcttcagaaaacatgtcagtaaaagtaagttggttttctttttttagttgcgtatatattatcatagtttactaaaggatgaattgggtgggacatgaagctccagtaaatatatgggtttatatagtctaaaatgattaatgtagtttgagagatgatccatctgaacattcatttcatatagagtgagtgagaggctccacgcaatctaacatgaatacgataacgacgaaatataattacgcagtaatatttttaaaatatgatgtaccatgaatacacacttgtttttttatatatataagatagatctaatggttagaaataatggtttcacggatttaaaaagcataggagtattccatatatgtagcttttggttgttttaattatgtagttggtgacttacgaacactccggagggcatttaattgattttgattgtgtacaatgatttagtataacacgatacatattttcaattaattttcgtgtttatttagtgttcatgcaaacggtagggtctaccttcaaatgatatattttaacttttatatagcaaaatatagctaatgaatgtttaattataaataaaataatagttatgactatttttatattatgttagttagaaaaatatagaagaggcgataattgcattggagaggagaggatgcgagaggcagagtgggaggagagtggcattacgaaagacaggatgatgggaggagattagatgtttttaaaatagatcgaatgtgcactataatttagagttatctatttttataaatacatttaatattagatctaatttaaatactttgggtgttgtattttctaattaaactacttaaattattctaattttagtgcattttgttaatcaaaaggtttaaaaatatatttgatataataataaggtctagtttgaatttaaataatatataaaaaaaggagggtggacaccggccttggaacacgaaggaggaggcgtacgtctgtttctacaaaagtgtataggacggtgatttagttttataggacggtgatttagttttatttttttaaaaaaatattattataaattgtgatttccatctaactaaaatagcatgaaaatcatgaaaataggagagagaatgaacagaggggaaggcgtacacagatggagttcacgtaaatggaaatgtacttaagcgggacgggaggggatcgatgctattttcttttttaaaaaaaatagatctaatgacgtataatattaggtccactatataactttaaatctaatagctaaaaatctaaatagtgggtccaccggttaattagaatgccacatgacggtttaggagtgtttttacgagtacacgtggtggtttaggagtatttgtaggaagatatggtgttttttatgtacggacatatgcatgttttctttttttttccaaataataatctcatgtacatgcatatatacatacatatattttctccggatgaatagtatagatttatttttctctctcacaaatacacatgagattagaagagagggattaattactttaatatgatttgatctaatctattctacacctgtacatgtgtaaatcaattgttgtatatttatacgtgactacatatacaagggaaagtgatgttacgtgtgggaggaaggaggtggaggtggaaagattttttttttagataaatctgacggcttgaaataatgggtccaccgattttaatgaaaacagatggacagatgttttgtttttttcttagaatttctaggaatttctattatttattagaatgtcatgtggcgacttatgagcgtttataggatgacatgtggcggtttgaaagcgtttttagggagtttaatggacttttagtatataatagatagatagatagatagatagaagatagatatactaacagtatatactacaagtataaccgatctaacggtatagattgatttgatatttcattgaattagattgtactataaaattttaaagggtaaattcgactttgcatgttatcccgtggacgtattttcttaccgctcgacaaaagaaaattgtcgttcggccctccccactccttcttcttcactacgggcgacgagcgaatccacgcgcgccgtgccaccactgccggcgaccgcaaccacaccgcgccgccgccaacgggaatcgattcgctctcctctcctcctcttcttgccttcccatccaccaaaaaacccaaggcatgcgctatctagaggaggagcagccacggcggacgcgacggcgctcaaggaggaagatcagcagcatgcatgcagagggtcgtgtactcaatggcagattttgtcttccaccccgcggcgacaacggcctcgtatgatcgtatctgattgctgattcgactctcgtatgactacggccaagtagcacaacgccacaaccaggctgggtacttaatgaggtttctccctctcgagacggaagaatttaagggcgtcatcgtttcgctttttttctaatacgccaaaacggcttattagggaataaaaatgaatttgtaaataaaatttttatatatgtgttcttggtgacttaaaagccaatgctgaaaaaaaaaactacgttgaaaatatctcaaaatcgttctcaaaattaagtttgaaaatttaaaatttggttttttttggtttatctaggccatccgatgggagcctaagtgaaaaggcatcatgaccggatggcggatgctcatgccggaacagttcagctatttgctcttttggcttgtgttcccaaaagtgaaaaaaaaacacacttgttttcttcatttgcttcaggactgcatatttgaagatacttctgaaccttctttttgatatgcatgatttctgaacttggtgaatgtgatacctaagaagcaaagatgataaactgaattttcagtacaataaaaccaaacaattccatggtactgaaagcagtactataaaatcttcagcacttcacaagcaaatactagcaatattacaagataagcacattcgaattgttataagtgtactgccttttcttgtaagggaagatatgaaaattgtgccatctttaattatattctaaacatccttcatgtgctcaactgcatgaacaattacacaagtttcaagagaacatatggaaacacatggagtaaggccgaatgacagccaagagaatgagtcgcactgctgcctagcgcaccaccgtcgctcgcgagcacaggaatgacgccggggacgaatcacaccgccgcctagcgtgccgtcgtctttcgcgagcgcacgaactgaatcttatttattggattggattaattctaaacgtagaaagctcttttccactttctgtcaaattcctaacatacccttctatataatgtaagtatatactcatagtataatatactgtaaaagttatatttctgtaagaagttaatcacacctatacgatcttaagaacaaaaaaggaggatttctggtgaatgccaaccaaatttcaatcaccccactgcacaaccgatcgaaatatttacatcacaatatttaaattaaaatattcacattatttcagttccaagagcaaatagattacatcagatttaacttacacccaggtgcaattcagcacatctaaccactggctaaattctggggtgagggtcatccatattagccctgcacccagaattaatttttgacactgaaatcagcctaccaattaacacctatataaatttatgtacaatgcccaatatttcctacctcaccccggtaggacaagaatttacagtccgtaatccgtaatgtatattcacaaaacaacacaaaccctattctgctcttcacaaggcaagcgccttgtaccattgtccatggaccttctctgatatgactgccatctttatcagcacctccccggccttgacaaccctgtcggcgagcttcgccgcgccgaggcgtcgcagcggcgcttcggctagcttcttgcccttggcgccgccaccgaggacgacgccgcggaaggcaaagtagaccgcccgggacaccttaccgaagacgatgtcgccggcctggaggctcttgagaagcatcttggttgctagctctgtcgtgtcctgaatctgttcctccggcagagagccgaccgaggccagagagcgcgtcatcgcctccacgatctccttcgttgatgcgtcagcgttgttgtcgaggagcttcacgagagcgtcgtagagctctgagatggtattctgtagctccggaggagcgatcttcaacatcagaacttgatgcaggacaagcatgctggaacagacagacatggtaaattgatttcagttatcgtagaaatcaattgttctgaatgaccggtttagttcaaagtattgggggttgggggggggatgatatttatttacctcgtcgcgatcactatcaccttctgaaactgatcttgcacagccctcaacctcagcagattaatttggaaggtctcaggggttgactgcatgttcaggccctccacattgctgataagttgcaacaagccaacccttgtcagcttgtcgatcttctcacccttgcattctgggagaccagaactgctagctgcagacgaagaagcctgcggcgctggagcaccgtgaccagctcgaagtaccggaacaacgtgctgagcctgtcaataagggataaattcgtgtcagtcagagaaaaacttagactgctgcctaagctaatacaactgtaaattgttttgatcgtagaaacctacatgatctgctggcaaagcttggagagactccaaatgtgagctccactcttgttccacgatgctcttcgttgccgaaacccactgcttagttatagggagagacactgatgcattagcaggaggtccatagcgatccgtgaaagccttctgcaggtattccactccggcagagcctttaataattggttgcatgagctggatgcgagccttgctaacttcagtttgcagttgctgttaatcacagaaaaatgttaggaaaacacggcgcaatgtaagtgcaatctatgtcaggactaattcaaggtgttaacaaggaacaaacctttatttcttcgagagtgaaacgcaggcccttgatgacagcaatgacaaaggagctgataccattgtcattaacttcggaacttgcagccaactcgtttaacaatttctcatgactcctcttcatgtcatcttcctttgcaggggcagatagtttcctgaccatatccagggagtactgcaaaatctgccccagatatcgcgtgtcctgggagcctgactgaagcacctttcatccataaaaaataacaacaacattaattcaaaatataccgggtttaacaaaagcaaattaatactaactattttattttgtcaagaccaccgagtccttacctgagacaaaatttcgaggtcaatgttctcaagaatttcctccttcaactcatttgaggccaactcatgtaacgaattcctgacttcctttacgaggttaattaattggctataatctggtttgtcccctctcatcgaatcagtaacaagatcccaaaaggctttctccatcgttgctttcactttggcctgaaagtccttctccgcggaactgacgttatcagagttgcgagcaaaagaaacatcgtcctcatgaagcatctcattgaccatttgctcattgtccgtcggcggtttcattggagatgtactgcttgacgatgaagcagctccaggcaaagattgggcagtgaaacttgatccttccacagtaggcttggaagtagggtttggaacctgtccagatgaattaatgctcaaaggagtagatacatttgcaacagatgttgctaatggatttccgttttccttcgcctcaaagaactttgaccttgtatccgaaagagcagagttcatccgctcgatgcctgcatcgccactcaggtgctgaatcttctctcttaacagcttctggtcatcagtaacctgtttctgaattgccttcatatcatgagaaaggtcatgtgactgcccatctgaacttaacttgcatgtttgcatcattgacagctcaagcttgcatgcagccctgacaagatcttgttccaatgatttggcatccttcagtttccacacaacaaagtggtaaaggtaagcgcaccatgctttatcaaaagcagccaactgagtcctgaactttttctgactggcagcatcagtcgattgcatcgaggcacctcctggtctatcaagtactgtcttaaccaatagctcaaactccttaacaaagttttctgctgactccataagtagattctccttctccccttgtccacttaatacagcacctggatgagccagtatcatataagagcagaggactacccgcagtgagtatctagaaagcttgcttgtctcggaacccttcgctggctttttcgcagctaccctagatctgctagcaggtgccttcctctttggagatccaaggcgtttcagaaggtgatcaatgttctcggctgatgatgaaccagttggctgagaaagaagcaaacgtttctcgaaccggtcaagcactgccttggtggtctggagagtcgttggagattccatcaacatagctaaattttcaaatggcatagatttgacagacatctcattaattcccaaggcgtcataagcttgaaccagtgcatatgttgtcttgttagatttcaaaaatcttttccagcatctgaagtacaacaaaatggaaaaaacattgccaattagttaaaactttcacatgtgcaaatgcaagaaaataatattccaaaaatcaactgtgtgacaccataccttgccagctttgttgaaagaaattctgcatgcttgatgtaatcagcatgggcagaactacggggacttacccgctgcttcaagtactcagctctctgcctttttgcctgttccattaagttaacttaactgtaagaaatagaatagaagggctaaaacaacaatatcagagtataatatgagagaacaaacataccttctgaagcttgctttctagctgttcttgcaactgtctcctctctgattctctcttgctgcatacagtcttggcagctcgttggatgtgcaaaatcctagcctgggctttcctcttctcagcttccagcaatgccagtcgcttcttttcagcagcattgcgcttttgtaagatcaaagacttgactcgctccgtgtatttcctctcagatgtctgtttccgcacaagggaccgcgccgttctctccttcattgccgcccgcttctgcatatgtgcatgcaaaagacgcatgcgatttgcctctgcttgacgaacacgagactcgactcgagtcccgagttcttccctttctttctcgatccgcatttccacgatgttcttcgccgcttgtcggagttcatccaacttggctagcctgttctgtgcctttgccaagaggctcaacctgcaagatacaaataattagtatcagactctcagagctcctctaattgcataagaccgcaaataactaatatcaggcactgttttttttcattaccttttctgctcggcggcctgaagcttcgcttcgaggcgctgaccttgatcttcctcttgtgatgaccatgatgggctccgcggcttcttcctcgctttgcaggacacccattcatggaattgctgcaaagtgcaaacaacatatgaccataagctatgttgatcaatcatttatcaataaatacagtaccaacatcttaataacaaatcaatcaaatatactagacccaaatacgagtcatacgatacggtcccaaaaagaagaagaaaaaaacttcaagtgaactgaacctaccaaatcacatcaaccaaaaaaagtttcacccctattacttactggtcaccaaattttcagtactacaagtgcgacgaaagttacttctaacttctaagcgaatccaagtgtggtcggtggtacacaaactattcataccaaactaccataatcttttcaccgacgggacaccatgtgctgaattgtttgctcatgaccctttttctacaacaaatattatcttcctaatttgaatataaaaaaaagaaattattttacaggcaacctgtcgtaactcgatgcagacaactaaatatgttactgatatccactgattactctttagcaaaccgcaggtagaaaccaaaagataattatatactgcattaaattattagtgcagtgtatatccaacaaacagataaaaacgggaccttttatatggggaaagtacgctttaatccagagccgcaaaatcatgcggctgagagaaaatcgaatggaaaagaaatcgaattcgaggcacacgtgaacccaacttcatctcacgactacctaccaagaacagaatcccccaaagaatgttacttcaactccccaccaggaatcccaaccaccaaaaacaaaaaagaacctcactgcacagaaatccttccacgtaatcccaactttgcgtctccactaatcagccaaaataagtttccaattaaagtagaacataagtgattaagaaagaactggtcgtgagtacccccccccccaaaaaaaaaaaaactgaaaattaaggactaatcctagtctaaaaatagcagcgaaattcatcaaaaccaccactctgaactgttcatcagcatgtaaagggcactatggtttaatcagtagtaaaacatttcttacgaaactcgaaaccgaaacaaagcaactcaaattaaatcaaaaggctccaaaagcttcgaattcacagttcactctcgtccccccacaatccaccgcgaaggacgaaatgaaagaaaagaaaaacaaaaacaaaaaaagcgacggaaagggaacccggacagggacacctacctgcctccggagctccgcctccttcagcttcgcctcgatctcctccgcgctcgtcggcgccccgcctccgacgcggctcccctccagcaaccgccgcctgatcctcggcggcatcctccccgccgccgacgactccaccgccggtatctccatcgccaccggctcccgcaccaccatcctcctcctcctcctcccccgatcaaaccaccaaaccaacccggcggaatcaaactctactacgggcgaatcccgcaaagcagactcgccttccttcctcgcgctgctttactcttcctctcttctcctcgacttcttcttggtttttcttttttttttttcctctctcgagaagaagttagtttgttctgttacgctttcccgccgttcgcgtgaggcgtcaatatataacggcgggtggagggagtattgggaagcggtttgcgaatctcgaggcggatcggacggcaaggcggggatggaggggtgtttcggtaatttgagtagggggtgtgtcactgacggcgttaggccttagggcgggggtgggggggttcgagacggttcggggcggtggggccccgcgcggttttctcgtttgtggatcgggttttggattggacggaattgcccctgtagtgtaggcggcttcgctttggtgtccgaatccggttttgcaaaggttaggctgcttttgcctgtggccaatgagttgatcactttgttatcctcgtggtggataataatggaggtctacgaggctatggaaaaaaacgtgcatagagaagatgtttttttttattttttctatgtgactaatatagaggtctggctaacacgtatgcgccaccgtggcatatacagagcgggttagacagcattttgatctccatgacactcattagacaaagtttggagacttgcatattacattttaagaatttagcgatctagatgacacacttatacaagtttagatataggcacctgtgtactttgctcattttctaattgtaatttaatcttgatttgaattttgatatttgagaaaaatttacgtgcatctttacttttttcctattaatcataggaaaatactagtaaaaaataatggaacaaagttaggaaaatactagtaaaaaataatggaacaaagttattgatgaaggattatttttacacttaaaatcaaatttaaaatttgagaattagctacataatacacttgtcagttgtggctgactcactgttggcccgacgttgcttcgactttgaccattgataatttttttaaatggttaaattgtgttagataaaagtgcaatggataaaggcggtatatatcggtttgatatagcgaccgataaaaaataccctcctctaaaaaaaagtgcaatggatagtacttcgtactccaacatttgccttgcagtgcatctgcctgagctgctgctgggacgggcacgtcagcgaggctcacgcctggcgtcggaaaccggaagcggataacgtccacgtgtgcctcctccacgtagcctgctggtcagtgacacgtggggccagatctacgatggccccacgggtcagtgaggaggtgcggtatattctcaggtgattgcgtttgctgctgctgctagttggggacacgcgtttccccactatgcaggaggggccaggggaaacgtggcacgaggagaacgcttactttctctcgtctaattacgcaactgccctcacgatcatttctggatttctggccagcttccctcactctgcacgtgtcacttcttttgtctttaggtggtgtttggttggagggactaaggccctgtttagatgagactaaaacttttaagtccttatcacatcaaatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcgtgaattagcttttatttatgtaattagttttgtaagtagtctatatttaatactctaaattagtgtctaaagacagggactaaagttaagtccctggaagtaaacaccacctaaagtggagctaaactttagtccctctcacaaaaatataagtccctaccatagggacttataattctgtgagagagactaaatttagtctctagttcccaaacacccccttaaaatagcaaaatttgctacaggacacataaaaaaaatatgtaattagctgagagacacagcaaaaacgtgacactgcctatctaattggcctaggacaccagacgtattattttatcatttttaggatgaaagaggggagagaaatttctaaatgactggaatgccccctttactcctccttcctttcttctcgctgcagccgacatgtgggcctgcgcacagtgtcatcgtcctcctctcgccaacgctcaacgccggccgtgtccccgccctcgatgccgccgtcgccttcgcctgtcgacgcgcctacacccagaccacctcccccctcgccccacccgcaccttccctcctccgcgacaccctcacccacacccgcgcttaccccaccggattccgcagcggggacatcaagcgatgtccagatcgtccaattcagcggcaatatcaaattctgacggcgcatcgcccccctcgtcatgtccaagaaatccatcaggctcggcagcaagaggcaacccgtcttcccctatctcgttgtcggagaggcggggctgcagga

SEQ ID NO: 38881 - DNA, 18049 bp, Oryza sativa
tccatggtagtgtcacgtttttgcggtgtccctcagccaattacacgttttttgcgtgtcctgtagcaaaatttgccttttagaatatagcggcctggtttagttaccaattttttcttcaaacttttaactttttcatcacatcaaaacttttctacacacacaaactttcaactttttcgtcacatcatttcaatttcaatcaaacgtctaattttagcgtgaactaaacaaatccttagtattgtgttagacatattccagtcaggaatgatattatatgttactttgccatgaacataatcttatttctatcagcagaaatggatcaaccacatttcttgtttctaattacagtgacatggttaaaacatataatcattttgctcataacaagccgtttattagtaattaaaattaactttacaaatataatgtttatatatgtgttttcagtaatttagaagtaaatacttgaataaactacagcgaaaagaacttccaaatcaacttaaaataaagttgtaaaatttaaaattatacttatatttacaaaccgaaggctagatgatggggttgaatacttctacctaagttagaacaagtttataattgcagtagtgcaatagcatgggttaaatatataatgctggattttagtgaggtttgcgagtatgtaagtgtggtgtccgcgtacatatgtcttccatattggaaaaaaaataaagaaaagtcaaaacaggtgttagtacaatgtcattcatctgtcctaaaaaagtccatgttcaatatcttggatgggcttacattctttcctatccaatccaaggaacactgtaggaagtgcacaaaagttgacttcgattttcgagtttgacatttctacgacctgcaaaatgcaggtagcgagacaatatatttattgtataaaagagtagaccgggttttcatgatacacatggatatataatgcgaaggataaacaaagtttgattaattagcttactgctgtacagtcctaaaatatcagtataaattgtgaacctgttttggtctccttaacaattttgtactactaattaatgcacatttctctctgaccaattattcatatgaagccaaacactcaatgcgacggtgccggaccaagtccttgcagggggtaaggtttcacaggtgaccctagcaaaatcaagtactgaaagcgattgtgggtttggtagctcgtcgtggcctcgtgctacgcgtttggtaattggcagggcacggatggctgagataagctaacgccaccaaacttgtctacacatataactacctagttttgagtctaaatacctaatacacataaatcataacatgtatatattttgcctggaaaggtaaactactcctgccatgatattaccaacttctgcagatatattacaacagtagttggagttgtattttaaagaatacggtatgctttttatccaatacaacatgtttccctaaaccggtgtgatagctgtttggcgaagtcgagtttcacaaatttatagtctcttttggaaaaagaaaaggaaattaattcgtaggacctataaaagcttgaacttgttttataaaaattatgtaaaatttctgctgtatagattaaactaaacctagggaacaaattaaaggaaaagtgaagacaactctacgtaaaatgcaccttgctagctaagagacggtcaatgttgacgcttaattagcttaagctacttcttgatcaaatgcttgcacgcatgagcaaccgtttaatttgcacttaatctgctgggatgcgctaactaattggtacaccagtttggtagctagagcacgcactatacgtaattaggctaaaatatatatagtcaagtctctcttgttataacgcttttattgctgagattgatgcaccgactgaacttgaacgaacagtcgcaggaaccacactaccggctaatgctccgatgatcgagcatcattagtcaaccacgtacacggcctacttaaatgtagacaatgaaatggcagggaaaaataattttggtgtccttgcaaattgctacagcgaaatataaagcgttctcaatgcatcgagacatatatacatattcatgcatgcggcacataatttaatttgggggccgttgaaacagagcattcttacacaagaattttgctggaatgttatgacaagcattttgttttttaatccctccatactcgtaaaaaaagtcgttttggacagcgacacgatctccaaaacacaattttgacttcttgtttctataaaaatatttattgaaaaataatatatgtatacttttatgaaagtatttttcaagacaaatctattcatataatttttacattttcaaactcaacaaattgagagttattcataatttatatttccaaggtttgacttaaacattgtcctaaacgactttctttacgagtacagagggattagtacatattaagctcagtgaacatttttttttcgtgtgcaagattaatgcttgggctctttattttcagcttccctatcggattactgccgttgattatactcctcgcttctaaaaacgtgagttctcaaaagaaaaaaaaaacttttattgtgttgtactatttagaccgcttattctaagctggtagtatttgttcaactattttgaaatatttaatatctctaacttaagtagataattaacttgtggttgcaataatctggttcaaaccgcagagttatttactacccaaatcgatgtgtaatctcctgggagttttacctggttccttgtccgaggagactgcaaggtataagaacgtgccctaaaataaaaggcctttcagagggatctccggccggttgcatcagatacttggccccatgggacgggacaggggagatccctgggattaggtgccaagccgcggccgaatgacttgcaagtacagcgtctgttcaagcaaagcatttcctcgttctttagatgggctattttgggtgtgtttagttttttgggtgtaaagtttttagagtgtacggatatatatttgaagtattaaatatatactaattacagattctacctgtaaactgcgagacgaatttattaagactaattaatccatcattagtaaatatttactgtagcatcacattgttaaatcattgcgtaattaggctcaaaagactcgtctcgcaatttacatgtaaactgtgcaattgttttttttcacatttaatactccatacatgtatcaaatatttgatgtgacgtttttggtcaaaattttttgatctaaacaacgcctttatgttgtgtcccgtggttactatgcaactttgtcgagaacttttatggttctttaaagtatctcctaaaaatagtaaaacaactagtactattactatctccgttattacaaaataaattaatctaacacgagatatggcatattctattactacctccgtcccaaaaaaattgtatttctaactccaaggctttgtcccacaaaaattatatttgtagccatgtggggcccagcaaattgattgatctagataagattcctaatgcaagcagcaaatttttggtgccaaatccatttggcgctaaagcatgtaatttggactgctaatgcttgtaattaagtatgctgattatatgggttaattctctcgaatttccttttaatcattttgtatatatggaatgtgtgcatgcagtgggttcattaaataaggccattgtggtcattttccaatcatactgttttgtcctaaattaggtagaaatgtaatttttatgggacggagggagtactatgaatttggacaggtgatatatgtcttaccgttcatagtactagtatatgctacatttcgtactatattaacttattttagggcagagaaaatataacttatcatatctagcgagcgacaactcatgatgatactcactccctctgttacaaaataaaccaacctcctatgagatatgacgcatcatatacgatgaatatggacatgcttatgttcagattggttctttcaagatatgtcacatcttataccactgtaatagagtgtctaaattttgtattatgatgattccggacacgcttacgataatagatcaggctgcaacaaagcagatgcagcaccaataataggaagttaccacggcaacggaacaaacatttgcccggtgtccggtgatgacaacgacgacgatgattgatcgatggtttctgaatccgtgtgcacgcacgcgtccacgtacgcaccccgcatcatatagcccacaccgtacaggtccacagcacacaagtgacacaagaagtccacgtcgctgtagccgccgtggctacctcgccaaagcccgttgcgacggaacagacagctacggctaactaacgtacccccccccccccccccctcttttcgtctcgatcgaccggcaccgcaggaggaccaaccgaaaaactgctgcaccctccgttttatattatattaaatgtatttttattggtcaatttgatcaagattataaaaaaacttagcaacatatttattaaatctaatattaaatatatatttcgatattatgtttattttgtactaaaaatattattatatttttctatatatttatttaaatttaaagaagtttgaaaaaaaattataatataaagcgaatggagtacaccgatagattcaatatggagtatacagtttgcggactttataatcacgttttagagtcatgacgacgcacatgggcgatggatcggttggccacggccagatactgatcagattccaacggataacgcacacgcacacgcacacgcacatatcagagccgagctgccgtgtggccgatgccttctcctcctccttttcttgggtcatcgatcacctgcccattcgacgtgtacatgtatgaaagggaggattgaatgattaatggtcacttaattaattaacagtggtgcgactatgtaagctgatagcataacatacactgtatcaaagctgtcacgctgatatatcacatattccatccgtccaaaataaattaatttaaaatatagtagaatattatctttctatgcaacaaaacctgaacagtattttagggcctattcattttgatgaaaaaaaacttattaaattttagcatcaattttggtaactatactaaaattttagcaggatttcttatatagttaccaaaatttgacagcaaactaaatgtagccaatttttagcaactttaccaaaatttggtaatgttgaaaatgtcatcaaagtgaaacccttatattggtttattttgagataaaggaatagtatgcctgatggctggctggtaacgggcaatggatggacccaagcaaaatgagaggctgtttctttcgtgaagaggaaacgaaagaaccttattcttttttactctttccttgtcatgggttcgtgcgttcttcctgggccggggcccttgcgtgcggggcgagacctcttcgcttccacgcttccgtcccctgggaaggcaagggcgcgcggacagccgcgtttgacgccgcacacggcacatctgcaatggggattgggaaggcagcctcacgtttgcgacgacgacgacgcatactgcaacacaagttgtgggaaactagtaaactgctagcgtatgatttggccggggaactcgttgaccaatgaccatatctactccctccctccgtccttaaaaaaagataaaccctagtttccacgtccaatatttgaccgtccgttttatttgaaaaaattataaaaaaattaaaaagacaagtcacacattaaatattaatcatgttttatcatctaacaacaataaaaatacaaattataaaaaaatttcatataaaacggaccatcaaagttgaacacgaaaacccagggtttgcctttttttgggacggagggagtatctgtttatctgataataaagcaacgtgtgcagtacaaaagaagcatatgggcaagttccagtagattcgcttactgcacaagtatctgtcgttctcaggttgaaactgaaactctgatgtaagagtcatacaaacaacagtaaccgatgttatttctgcaccgagatatctcctcctcttcttctttagttctgattaatttcttcttgtactaaaacagctgctaggcaaagtcagtgtcaaattgtcaattgtcaagaacctgcacatattgtcaagcagattttaaccagagattccatgtggtccatattgtcatggatcgataagcgcaatatccaaatctctccgcaccactctttttagtttatcagtgggcagcaaacggcaacaacagcagatagtgctgaatcgatcgatgatagatagcctgatagacaggctaatgattctggggctgggagtggagcagagcagagttgggagacacaatccgagcaaaaacgagtgacgatccgtcctacatctacattcggatgcacgcgcgcgatactattatgcgaacagaccagaagattaaaagtggtctttgtcatcacgaagggcacacacatctggtccatggattgtgggagagaacgttctagctaggcccagcacgcatcattgattagtgcagattaatcatattgtctcgcattgttcaatgcactgtgtgtttttcctgtatctagcataaaaacacgatgacttttgccatcgttgatagtataaaatatctttgggcaatttgacatcaagagcactgtggacgagtctgatgtacgctgtagcctgtacgcatggcattttggtcctcaacttttggcctcggaacgtcagggcagtacctttgggttagcttaatccaaccctagctagctagctactctatccgtccttaaaaaggaaagataatttagatagagattttacatcctccagacaacgaatctatatgtaagattgttcagattcgttagtataggtgatgtcaaattctcacttatatccaaatttattattttagatggtgtcaaattgctatataaatttgtattatttttttttgggaatgaaaggaaggagtagtacagattgacagattctaggccgttttttctcagcattttctgacgatggaccatcgatcggtctcaccgttcgcctgtgcggtgtgtttgtccgagtgcgtgtcgcggtcgcggggatcggcgccggatgctgcgcgcccgacccatcaatggggtcggacccccacctcgcgtcttcagtgcagtggcgagagaagggaaggcgagggaccatgatggcggccgctgccggagtctggccgggtgcgaggtgtggtcaccggggcgaatgccgtaatgggctaagcctggacagtacgtgtccttgtcgatcaatgtgtcgccgtcgcacggggggctaagcgagcgtgttggtgccgcgtgtcgaggtagattttgcatgtgttggggattcatcgatccaacggccctcgcgcgcgcagttcatgcatagggccggcttttcttttttccttcttcagatgatggctgaaccagttgttcatgcataggtttgatttgtgtgatgcgagtatgcaacgtgaaggattatattgcgcacatctacactcactaaagactaaatcacctggtttcacaaacaaagtcatataacttaacttaagctcaccaaatagatgatgatggcagaacacacgcaattagagaaatgagaaaagaacatgtaagattaatgtaaagtactcggagataagactaaagacttggcagatgggcctaattttcaaattaatacaactcatatcagtaatacagggaagaaataaattcactttgaggacagcgtgagtcgcacatgtcagcagccaactttcttccttctttctctccctttcctctctcttcctcatctctttcctcaccctcctccttcgttatctctaaaacacacatcgacagtcgacctcctattcgagcttttctctgacccctgtggggtcgccatcttctccgatatgcttcgtcgcccccgcatttctatgtcttttttggttcttgatatgtgcgatttcgttgattcttgcccactactgttggttgctgcagcggtggcaacgagcggcagtcaaacaccatgcattcccgacctccttcgcatcccttcgatccctcgtcgaacactgacatagggaggaagagagagggccattaaatagatccagttgctcagaggacaccgccgctaaggctgcaaccatcgtcgaccccatcaagcttgctagcgatctccctcaccgtgctcaccgttgacctcttgtacatgcctcctcaaggaatcccaccgctcgccttttgccacaacccaccttctttgtgtcaaccaccgtccatctctacaccacccgccttccaacaacctagcctggtaagagatagggaagagggggagagaggaggaaggagtggcagctgacatatgtaaggtccatgctgactcagctaggttgattgtaatcaactggtcacattggccaaaaccgggcactatactgctctaaggtctctgatacaccagttttataagctgagggacatgttatatctggtattgcggtttgagaatgtaattcgaacttgacgtcaagatgaaggatcttaagtgaacttattcctacagggaatcacccagcccaaaaaattgggccatctggcccacggaggtaacctgcttcccaatttcccaaatctccgcgtcgcctccacgcgaggggctcgcgcgcgcgccttccccatttccccttcccgccacgccgagttaccgccattgggactccgactccgacttggagtcgacatgggagctccttgccctacatagcggcgtgggcctctcgatccccgcatccattccacctccgcctccgcctccgcctccgcctccgcctccgcttcttcttctcctcctccgacgtagcctgcggcctcgtgctgatggcgacggtgtcctcctcctcctcctacgcgtcctgctccgcctccgccgacgacgctttctactcgacgtgcttctgcggcccgatggtggtggcgcctccgcctccgcctccgccgcgcaccgccgcgtcgccggagtacaccccgtctaccccgtggcgccgggccgcgtcgccggattacaccccgtcgactccgtggcgcagggccgcgtcgccggaccacgccccgtccccgccgtggagcccttcgcgccgcgccgcttcgcctgactactcgccgtcgactcctccgcgtcgcgccgcttcgccggactactcgccatcgacgcctccgcgccgcgccgcgtcgccggattacaccccgtcgactccgtggcgccgggccgcgtcgccggactacgccccgtccacgccgtggagccctccgcgtcgcgcctcgtcgcggactactcgccatcgacgcctccgcgctgcgccgcgtcgccggactacaccccatcgacgcctcctcgccgggccgcgtcgccagactactcgccgtcttcgccccctcgccgagctgcctcaccggagtacaccccgttgagccctccgcgccgggccgcatcgccggactacaaccccagcacgccgcccccgtcgcctgtgccgtccgatgcggggtctcgcacttctccgccgtggcgccgccaccatccgtacctgaggagcggctccagcgccgcctgctcgtcgcgcgcggcgcgggtcgccggcggccggcatcaccatgtcttcctgtacggatactaggcgtcctgtaatagggcagattcatagtttgggttcttgatgtgagtgtgactaatgtatggcacaaaattatcttgtgcttcatctagtctttgataaatcgatctttgtattatatcattgatgtaaattgatccaattcaataaatatctgataatttgttgattttcctatcaattaatctgtgtctgtgattgatgattctttgtttgatcctctgatatataaactgaaatttctgttcgtctttgatgttgatctcaaattgtacaacatgtctgtgactagtgtaattgatatgtcccttgaaagaacttcttctttaagttgtgctgcctgtagtattgaatcatcgatcagttccagagtagaatatcaggctagtttcagataatagaatttcagactagtttaagataatagaatgtcctgactactgtaattgatatattatttgaaagaacttctgtagttgctgtgcctgtattcttgtagtgcagtttcagagtagaatctcaggctagtttcagataatagaatttcagactagtttcagagatcagaatttcagactagtttctgtctttcagaggatatattcagactagttttagagaagataacataatttcagactttgctacagacccactgttctttgtgacataaaaaacaacagcctgacaatctgaatatctgacagagtacattgtttccataaagggcgaatttagagctaacctccatatattggcagtaaaactgaactgaaatccttctcaaacagaattacggcaagtctgcaacttaatcccttccatccaaatgaacccttggagagttcagcaatgaatcgttgaacttcacagttaagaacaagtagcacctaacagcatggaaatcccttcttacgcctaataccctcgccaatcgactccttcatcgacagcatgatttccaagttccaaccttcaaacgaaaagcagtttgataatctgtctgttgctcaagctgtatattgagcattcccatccgttcgacaacacgaaagctctgacattgctcagattgcttcctccatgcgaacaagacaatggtcatagtcatagattcagcttcgttttcttcagaaatagaaattcaggttcagcttcatatttcaggggcccttgactacatgaggcccaacacaaatggtagcctggtaggaatggtcaagatgacaacagggaatcccagatgtccaccccaaaaccaaaacattcactctctccgttcaggttcgtaccagaatgcagtaatttaggatgggtatatccaggttcctaccagaatgtaactatcaaaggatttattaagaaatttcataggattgaaatcctataggaaaatatcctatttgggcctttgattcaaatgattggagttttcgaaatcctatataatttctatggaatgactcattgcatgtaggttttggagaaaatttaacaagaggtccaacctcttggaaaaattcttttgagtctttttctttcatccgattcttgcgtttttcctgtggcccaattaaacgatcattcatgtgttttacaatcctctattttacacttcacatttctgctcgaatattgtgtttttctattcatctattttttttcattcctacgatttaaaagggccctgaatagaggacaataccctaacttccatccatgtattgattgagtttggtcttaaattttataaatcgtcatgaaagtttgtaatttttctttaaatgtaagaggtcacgaaactggagtacgggggtcattgtcttttgccttgggccaaatttgctacaggacactcaaagtgagacacccaaaaaatatgtatttgcttgtggacactgcaaaaatatggtaattagttgctgaacacccacctcattattttattattttcggtggtaatggagaaagaaacattggttaaagacaagtttgcccatggcccacttgtcaatctctctttctctatttctatgttcatcttcttcggttcttcctcctgcgtgcgtgctgctggcctgctaccttcgcaggccaccgcgtcccggtggatgtgctgccccccgacgggaagctcctcgcctcgtttcgcacgtcgcttgggtcgttcctcgccgcccaccgctcgccgctgccgcgggaggaatgtggccggcgtgatgagggacctcacgggcctcctcgggcaccattacctgacctgcaccgtggtcgggaacagtggcgtgctcctcggctccggccgtggcccgttgacgcgcacaacctcgtcattcacctcgacaacgcacgcgtggcggagcagcacccgcgggagaagaaaagagaggagaagaaagacacgcggcatgtggccgctcaagctagtgagctttgttccctcccgaccgctcgactcgatggctgcttcctgcgaccccatatcggctccactcgtcgcgccgcatgacgagagtggagcctcccttcacaaagccggcgacgaagcaaagatggtgacgcggtgcgcggcttcctcgatgatgccgatgacgtgctgttcgggcagctcgccgcagagcacgcaacgaggaggcggcgtgcttggacgcgacgacgtgggcgggccacggtgaggtgatgaggtcgacaaggcgggcggcgtgggagcgcgacgcgaagaagtcgagcccgccaccgccgccgcgcaccgcgccgacgcggagggcgtcgccggcggcgccgccccgtcgtggccgagccgtcccggctcgggccggccgccgtcgctctctgctccacgaagaagaagaagaagaagaagaaggggaaaagaaaagaagtgagaggaagaacactgtataggggtatttttgtaattacacaactctttctctctcaattttgattggaaataataaaataatgggaggagggtccagcagctaattaccactttttttacattgtccacgagcaaatacacgatcttcggatgtctcacagcaaagaccgtaatatttcgatgtactgtagcaaattttgccaatgccttgggcctctgcaactggatccagtcactgggacgctaccacttggtcctaccgccgtggcgctgccggtcgggatctgcatcgcttgcatccgtcgggacatcctcatcaagctccagcccccaccaagcttgatcccgagaggcaacaccgttgtttcatttactagccgtctctcggaccaaccgcgccgcctcgagcttgaactcctcgttgctcagagctcgcgcattcaccagtagcggctgccgcatgggggaggacggagaatgacaaaaacaaaggtaggtgagaggcagaggagagataggaaaaggagaagaagatgctcacaagtcacaagtgcagcccactgatttttattatttttgactgactggattgctcgtatgatccaaaccgctttggattgactagggattttctttgtccggtttaaaaaattcggggtataaattgtttgatttttttagttaaggataaaataattttagaggtaattcagatctcttcttaataaaataatatttttaaagatatatctcagagaccgtgtcatcgtcaaaaacattagaattatagaatcggagggagtatgtagtatcaaattctatacgaggtttttgaaaatgcatctaggcccctaatgattttgatgattgattacaatgcgattagagaggactaacatttttattcaagcaaatgtgaaggttgttaaatcctcaacgtgttgtaatacaatgcatatcctgtgaatgcgacatcacgatgcaatgcggcaatgatcaaatgttatattgtatctttttcctcgcattgtgtcgcaggaaagtcgtactattaagggggatgatgcatagacatataaggagtgatgtgtgtgctcaaaatcaatttctcttttggagcgttctggaaattttcggaagttccgaaaagaatttggaagttccgaaaatacacaggaccgtttgagagctctctggaaattttcggaagtttcgaaaatgattttcggaagttccgaaaatacacagaagcgttttagaaattttcggaagttccgaaaagtgcgttgactttgattatttctcagatctagaattttcggaagttccgaaaattgtttcggaagttccgaaaattacttttattacactccaacgggcagatttgtgctgtgggtataaatacccacctcccctcactttgtgagggctgctggtttcattctaattatttgtgcccttggcttgctctctctctagttcatttgagccttacttcctcgattcatctctccacccgtgtttgattccgatttagtgtgtgtgtgagagtgtggattcgagtttatgtgggtgcttcttgtggtctttgtgaagatttgtgagcacttgcataatctccgggagttctttgcatcatcttttactcttgaaggttgaggactcctagacggctaggtgtcactcccgagtcaccgatctacttgtggttggccgggagaagtttgtgaaggccggatctcgcctccgcaagggaagagatacctcttagtggaaggagtgcttagtgcaacctcttgaggaaagggttagctaagacccggctcttagtgagctcctcaacggagagtagaatcccccaaggatttgaactccgggaacaagtttgcaagcttcaccttggtgatatcttttcatccctctcctctaattttgcttgcttgtgccgctattggtctagttgttgtatgtgcctttcttttcatgtggtagtcttctagatctagatacttctgtttgtgtgcgctcctctgtgcattttcggaagtttcgaaaatcctttcggaagttccgaaaattcccacccaagttccaaaaattactgcttccgcttttcttaagtttttaaattggcctattcaccccccctctagacctaattgaccttttcagtttttacattttgatactatagggagcagtttccttcaactagttgtactactacttattttgagatgtagagaggactatgggtgtgtatagttctttttgtgtaaagtttttgaagtatacataaacacatttgaagtattaaacgtaaactaataacaaaataaattatagattccacctgtaaactgcgagacgaatttattaagcctaattaatccatcattagcaaatgtttactgtagcatcacattgtcaaaaacatgacgtaattatgctcaaaagattcgtatcgtaatttacatggaaactgtacaattgttttttttcacatttaatgttccatacatgtatcaaacatttgatgtaacgttttttaccaaaatttttggatctaaacaaagcctatattaacttattttgggctgaattttttacaatttgaccctttgcaaaaactatttttacaaataaattgttgccaaaacttatttaaatcacctgacgctgaacttagacaactcagcgccatatcaactgacgctgaatgcaatggcaccgcggatgggagactaagtcagcgtgccaacgcatattcagcgccacgctttggcgctgaggtgtctaagttcagtgcctgaacaaaagggttatttttgaaataagctttagcggcggttcatttgtgaaaatagtttttgcaaagattcaaattgtgaaaatttttgtattttgggagtatagactagtagtggacgtttataaacaaaatcctccgctaaatcaccctcaaaacctagatccctgtcttgtcacggacaacccccccgccgcagagcccacctcctccctcccctctctctctctctctcctaccctaccaccatggcgtccgccgagacccccaaccccgacgccgaaatccccaacaccgacgccgccgccgccgccgacccagctgccgccgccccagctgccgccgccaccgaccccgccgccgctggatcgccgtcgcccccgctcccgccacgcaaacgccgcctctcccctacgccctcccccacccgccgctcctcccgctcccgctcccgctccccgcgccgcggccgcagccgcagccgctcccggagcaggagccgcgggcggagcgccagcccgcggtaccccgatgggaagcggaggcggcacaacgacctcaacgtcgaggtgtgccgcgacttcctccgcgacaggtgcgcccgcgccgacatcgagtgcaagtacgcgcacccgcaccccaccgtcgccgtcgacaggtaccgcccccccaccgttcccggagatctcgcctcccgctcccccccccttcctgcggcgcccgtgtctgattttggggggttttgtatgtgcagggacagcaaggtgacggcgtgcgcggactcgctgcggaacaactgcttccggggaaggacctgccgctactaccacccgccccctcatatccaggagtatgcgatgatgccccgttgctgtttgttccgtttgcattgcgtgcttttgtcgacgagggttggtagcgtgtatggtcttatgttctagagatgcacaagctgctgcaagtccatttattgatgcaagtcgattaatactcgattagtgcttccaagcatacagtcttccgtttctagttcaattcctgaaatattaacagcatcatggctacatgagatcatgctctactgtgctatctggaggattaaattagctgcctgacattgtttttttacttgtgcttctgatggaaatttcttggaacaatgttttatgagccactttctgtattaaaattccattatcgtgtttttatgttctcacagtttttatatttcatgggcatgtgtacccatgattccctcggtgtgttgtataggtgttctcacacattttatgtgttcagagtttggctgtttgggagaaaaacttgttttttctactttattctctctgggtaaattgatattattttgtttttttgaacattatgtttactctcacattcaggggcgaagccaagatttgagattaggggggggtgtgggggtgaggataagccatgagaccaaataactaatattgatagcaaaggaggtcaaatagtcaccgtcaataacaatcaatgcgtaaactagtcctttaaaaaaaaacttgaattttagatctttaataatatcattgaaagattgaaactagcctttattgctaaattctttcaatgtaaactattgaataatctcacaaataagtatcatctattttactttgaaaaagatgagaaatcacaaactaattttgtatatcatgtttcttgctaatgtttttggacttgctaactaactaaactgataatactttcaagttacacaaataaactagatgaatacttatcttaattaaccttaatatagagtaaaaacaggggggttgtggtggtggtggtctttggatagcggggtgttggcaccctccagcacccccctagctgcgccactgctcacattacgtagctctttatttgacacacacacacacgtgtatgtgctgggtgctatatgggagaagctttagatttctaggttaaaggagacactggagtggaatgatgcagaatgctgaaatgggaatgcactgtattttatgctagtttgcgattgaaaagaaaacttatatttgaatgttgatggcttgttttgtgacctatgattatctctttggaggcagggtagcatatttttgtaaatgaaatgcaggcattggatgcaaccagctgatcccaactttcttttgtttcttttacgtaggtcattattgagatcaattggtgtggaagacccaaaggtgaagatggtaagtttctcctgtttaacctttcatctgttcatcaatcatgcatcggtttgtcatttctctaagtagttaatggttttttactatctattgtaaagctaattggaaaggttgtttatctgcttcaaacaagaaaaaaaaggtagctaattggctgatgtcgcatggtatgtccataaggaacaagtaatcttttttgaaagctagaacacatagaagggctgtaaaccatctatcacctg

SEQ ID NO: 38882 - DNA, 1188 bp, Oryza sativa
tgcgtgggaggtgtgatcgtaaatcatgtagatactctcatgttatggcccatccaatgccacccccaatgagggatattcccatgcaataccctgatatggtaagttgttgtaccgaacatagtcttacagaattacgctgttgcttgttgaaaataatttcttatggagtatttgtacttgccttatttaatactccctctgtcccaaattatagggcgtcctctttttaaggaaaatcaaactcggtaacttttgtctaataatcatactaaccatatatatgctaaatattatgcatgttatattgctagattcatattttaaagtactttcatatgatgctaatttcatatttgttgggaacataacatggaataagttaatggtcaaagtatgtcattgaagatcgtgtaaaaaaagtaggcattataattttggacggagggagtatattttttggaagcaagacagttagtgttcctttaactcacatagacttgccattatttgttcagaattcagatgcaataagaaatgaattgttaaatagataattgcttgtcttttgatcgtaaagagtgttctactgttttgttttctgttttcataatttgattatagtaatatagtcttaaaattttattcactgccttcaaggtttacatgccaccaccagcaccccttggagtacctatgatgatgcctcccccttcagcccctgcagccttttctggtaaatagtgcatgatagaccatttactactgatgttcagttttaatgaatttagcaaaaaggtacattagttttccctattactgttcagccttttctggtaaatgaagttttgagtgtctaccctattctgttgctattttggcaagcttttgatcgttgctcttctgcaggtaataactacggagtggaagtttgcagggactacttgaagaacatgtgtaatagagaatcctgcagatttgcacacccggatttgaataatgaggtttttataattttcttcttctggcatgaaccatttgttttacaggctactaattagcaagttctttccaacattttctaataggtgatgaatacccaagttgaagttgccgtgattttaagcgaggagaatgcaatcgacctgcctgtcgcttttaccatccacctgcaagctcaaattctat

SEQ ID NO: 38883 - DNA, 19170 bp, Oryza sativa
  unsure (1)..(19170): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgattggtccaatggttttctattctcataaatgagtcctgatagatccgaggagttcttgagctatcaggctggatgaaatcaaactagggtttacttactagagaggaaacaagaagggatatggtaggggatctcaccagatatagggccttcgcggcgaagtgcagcggcagaggttcgtagacgtcgccggctcgccggaggggaagcacaagcgcccccctttctcactgtcacagtggcacagtcccacttctccgagggtaaagaggaggacaatttgggccgaaaccgtaccgggctcaattctatggcccaactgataattgcaccctaaatttttattttcattttgttggaatacaggattagagatgagtgtgaccttgaccccgggtacacttccacagtgaactactccctccattccaaatttttttacatatagtttttttagtttattcctaaatgatctatatatttgtgttcatttattaggtctattcgttatttgtgcattggagaggagtaaatgaacattgatgcatgcatccatgcacacatgtatttataacccacatgcaatattttgatttgctattggctaggaaatagtggggatggtgcatgcattgagtttgttgctagagtaaatatagtatgagagagttattagcttttcttgatcttggtgtacctatgaaatatgtaaatcaatttggaatggagggagtaacgctttacaaaatacagcacaacatgctgattagtctctccctcactctctctctctctctctctctctctgaaagatcacaaacatactgatcacttagctttcttcattatgtctatatgtatgagtttcaattgaaggatggttgaatcgaaaataacacaaaactaaataattcatgctttgtgcggttgtgcctagcaaaaataagcgcacgcccatgaaagagattccaaacaggagctgatcatcagaaagcaacagcacgcgttacttgctgagatcatgatgaatgatgatccagaactagttgacagaaatgtgcagcatgcaggagtacgaatcaaagaaccgataccatagggcatacactgaacagcatcatcgagaaacgagacagaagcacacgctcgcccttacaggataacagtacatgaattcgtctgaaactagaacattctgaaaagaaatggcaagttcatttagaaagcggaaaacggtaatgctactcagaatcggacccaaattgagttcctacgttcttaatggttattgtattcatcaaatggcttccagcaatgtctagcaaagtattgaccagttggcaaacatcatccgtatcctcgtacaagatttcagtacgcttcaactttcgacatcgaatcttcaacaggtccttagacttgctcgacttggtctttcttttccctatatcggaacttttggaggccttcgcagcgcacaatgatttgtataagctatcaaactcaatcaagtgagaataaaaataaatgaaggcaaatttaccttgcagcaccgcatagtgagcttctccaaattaggagacttcttaagaaggtgccacaatatcccgaaattgtcacctagatcacacttttccagcaacaaggttcttaggtttttgaatgtagggaattcaaatggtccctcatttggcatcacctaaaagatagaaaaatagaactcaataaacaagtacttgaaaccaacctgtttcattgtaaaatgaaagagaggaaacttataattttggttttaactgtatggcccaacaaagttactagcatagactttagagtgcagagtaatttcgttattagtgttgctctttttttgagcgaacatcgtgagtttgtaactcagctcgccttgctcacaagtgttacagaacaaaataacaagaacaaatgacttatttggaatatcacagcaaaaataaaactttgagatatcacagcacaaagaaaacttaattaccatctcaaagttttgtaaccataatcacgatgcacattctctaagaccaaaaagactaatcaggaccagggccagtgctccttgctggctttcatcggacaatagaaaaaactaacatacggtaagaaacacacactatagataacaatataattatccgatcttaacaagtacagctttatttagtactggatcagttgtaagaaaggtaaaatcaagcatcaagctagacatgcatcgaaatacaagctataagtaataatcaccacaaaagatcagatgtggatctttggtctaagataataagagttgcaagataaatacatatatcattatccaggatagaaaggcataccatcatattgaagcccaccagcacaagatttgtgacattaagtagattgctaagaagcgtgcattgcttgctgcggttatttttgtgagaactgtaattgttgagatgtattgatgctttcacgaggtaccgcatttggtctgaaatctggaagtttgcaaagctgagttctaggagcagagaagcaagattaggagcttctatagtcagcggaccaagagggcttggacttcccgccggtgatagaattggttcttagggtgaaccttaccaaaatttggcaatgcctaaaatttagataaattggtaacattgttaaaattttgataggattgataccaaaattctatacacactaccaatatttgaacaggcccatagatttttgttagaatgtggggttttttttgttcatgcctgattgatgatttgcagggttggcttattctgcatccatggcgaccgcgaggaagaggagctgtccagacaccatctccaccggcgaccgaccggctgagcgcgctgccggacgccctcctccacaccatcctctcctcactcaagggccgacagatggttcagacgagcgtgctctccaagaggtggaggcatctttggcgctccgtgccatgcctcgacatcgaccagagagagttcgcggccgccagtgagaattgggcaatctcccgaagtgaccttgaaaagtttgaggattttgcagataatgtgctggcctatcgctgtggatcgcccgcgaaattggacacattccgacttcgcatatgtgacagatatcattctctccgttcttcagatactgatagatggattcggcgcggcctcaagtgctccccgagagagtttcacttgcattttgattacagatatgactcctatttgcttgagatgcataagttgggttccaattatggctgcctcaccaagttgcaccttactaatgtttcattgcatgaatgcttcatggagcacatcactactgtttgcacccttctggaagttctagagctcaacagatgtagtctctatctccaagaaattacacatcccaagctgaagaatttggttctgcatgggcctgcagtgtatgatgaagacgaacttccagttggtgcaaatgcaaaatgttataaggagctaattatcagggctccttgtcttacttatctgaatttagtgcttccagttgacatgcgtcaaatttctttaaaggatgccgtctcttgtcagagcatcaatccgtttcagtgttgtctttccgtgcaaatgcaactttcttaacgtgttgtttaatgtgacaagtctagaattgtcgggtttccgtgaaatggtgagtcctctgtttctaatacatgtctcctgtaagcacttatgttagttgagcatctaaatgttttctcgctaactttccactcaatagatcatgtggcaaaaggatatggggtgttgagaaattctgagctgaaatagatgcacaaatgtctcaattgatctttagctagatgcctaccttgcttaatctttgtatcctatgggctatgtgcttttcatttcttgtaagcaatgcaactgcattcatcagaggctacaggctaacgagtatgtttgaatgctgctcccttcttcaccccttgtataaaaaaacatcgctcctagttccttcagttttttcttaggaggaattttagtaagcaatgctaatgctaaaattattgtgctctctttatttatgcttgctactaagttaatgcaactgcaacgaaacatgtatgcttctctttttctaaaaatttattggcaaccaactgttgcttagtttattaactgtaatattatcctaatttcaggtgcggctggagttcaatcaagtcgaattccatgcattcaaaaacctgaggaccttgttgctggatagatgccgtccgagttacaacaatgagttattgcgtcaccttctccagaactctcctaatcttgagaagctcactgtgcattgctgcaaggtatttctttgtatagtccttcagttcacagtaactcttgctgaattgtgtttgctgattaactcatatgaaaccttttgtctagcagttctcaaaaggttccctggagtggaggaaatcatcccagcataagaaccaggtgaactgtaggaagctgaagtctactgaaatcatatacaaggacattgatgatgttcgtgagcttgtcgatcttttgctggacgtctcagggcacctaccgaagaacactatagcgctcaccaaaatatgaaggaattatcagcctgaagccctgaacctgactagtcctcccactatctggtttccatcgataccttctatttgcagatgtactgtttattgcaaatctaatgctaaggtcctattcctgaatctaatctagatggtggtaggactcctaagcctcctgcatgtcttgtttgtgcatcgtggtgaactgtttagtagcgtttaattgcaggctcaaggagaccaacaaaagccatggaaggttttgaggtattatatattcatgggttgtaaaagctactactgactataacaaaataagtttgtaatgcctaagcaatttagccattatcatgagtgctgccagactttggtatagcctgtcaatttgacagtattcttaccaaaccttctgggaaaaaaaagaaaaaaaaagcatgaattgcaaaggtgctccaaaattctggtagcatatttctctcctatctacaggatatggtatgccaggtccatcaaagcccatggatatgtcttgttgagttgtgacttggtgcttttgccctccgagccgctgctccatgaaattcgattcaattgttagcaaaacgtagctctttcgaatgaaatttttggcaagtgaaatgccttgatttcactcaacgcgaagcttcggttcggagcatggccacatgtcctgaggccattcatagtttgtcctgcgattttaccgaatttcgcatgccagctagacgaagaaccacattagccacatacttcacaatgtaagttatataaagtgggtctgtcggtgatatagacccgggggtgccaagcttagaggggagaggccacccccagcgtccacgtggcgctccctcccgagggggtcgggcccgtggatgagtggcagccatccctttcgagcccccgacccctcctcgtggccaccatgggtatggggttaggtgggcgccccccagcgtccacctaaccgcatttaatgtgggcggagcaggcatagcacgccacatttaatagcagtttgcgatcggtctgtgaccggccgaatgacagacgggacggcgacaatctactcacgccctgaccatgtgttaggcagcgtgaggcaggtatgccccatcccatcatgatgatccaatccggagtcggcttgaccgctccggacgtgcccgagattgtgttcctggagcatgcccccaaaagtcctcatccattaaatagtgaatgacaagggcgccccccgtgtcagccgacatgatttgatgggccccacgcagcagccgacgtgcgaatagcttccgggttaaggcacaagacatgcatttaatatagagaatattttttctcttccctaggtagctttcgcagcacatgtggtaacctcttggagtataaaaggaggtcaatgcctagcgaggagggggatccatgggtcgaaggttggggctaactctagcttgtacaccggagattcagagactttgaaagctcggaaaaatcatcatacacaggaatagggtattacgcttcttgacggctcgaacctgtataacccccttttgtttcatcttcaccgaggggcccgaccccctctagaacacactacacttccttccatccaactcctcagttttcacccgatgccccccgccgaactatcagaggggggcctcacagtcccccactcgaggagttcactctccggcaaggtcccactagtatcatctttttcacttttttttatctctctttctctctcccctactttccccatcgcatctcctcctttccccatcgcacagaagctgccgtgggcgagggcggcattgggcggcaccaaaactggggcgacgatggcggcggcgggcggccagatccacccctcctttcctcccccgaagcagcggcggcgtcggcttcgcgggagcggcggatgggcggccagatccaccctcctcggtcgaggccgcccctctcctctcgttgcccggcggccaccgtcgagcggctgctgcacgggtggttgacaacggcgagcggcagcttgtatcggtttaaatttgtccgtaacgaccgtcaacaggcgtcttcattgatacggtttaaattattcttggtcttggtgaccaaatattataagataaccaaattgggatgaaggaaatatttttataatatatttgttttatgttgaaaatattactatgtttttctataaatttgatcaaacttaaaagagtttgaataggagaaaattcaaagtgagttataatatgaaatgaagatagaagtactttacgatatgcttttcctactatacatcatggctgtgttattttggagagattggaaaccctttccctccgtacgtaaaacagagcgatgaattaatgcatgattaatcaaatattagcttaaaattattgaaaaataaattaatattgacggagcgtggggctcctcaccgggagaccgcgcaggcccccctttgccggttcggccgggggccctgggtgagattctaagctcctagtctgtgtgtggaaggttcgcgagaatggaaacacacaagacacgggcgatgtatacaggttcgggccgctgagaagcgtaataccctactcctgtgttctggtggatctgtgtatgaagaagctacaaaagagctggagaaccagagagctcttactctctccctctctgatcgttctggatccgaaaaaatcccctttctaagtgggcaaggtcctccttttatacctcaaggggataccacatgcaccatctctctcttttttttgtggggacttatcctatcttttcataaacaaacggagacttgtatggttgccgtccgaatgaccttctgatgggacggcccatacctacctccacttccgccggaagcaggcgcgacgtgggaacatggctgtctgctgacgacatgaccagtgtcagaccggtcacaaatcggtcattcttgtccaccacgcgtcagtttatcaatctgcatgttcgcccctcttcatacaacgtcatgcttgtaatggttaggatgaagcctggtatatatctgaccgggaccaacgtgccatctccaggagctaacacgctggctccggctagggacgagtgcttggaggctctcatcctgacgggatggggcgaggcgtgcgtcagaccgcctgtcgccacctaacccacgatctgatcggtctgtgactggtcacagaccggataaacgagtgcgctgcactgcgttacatgcggcgtgacgcgctcgtccaaaccgcaataaatgtggttaggtgagccccgctatgctcacctaccccatatacgcggcgcaaaacccacaaggggtcggggcgcctcggccctcggggccgagacgggagcggtctgacccctcggggagacaaagagaagggcggccgtatcaccctcgggcccgaccccccccccccccgagggggttaggccacgtgggtgatcgtgtctgtctcaagtctctaagtcatgatactcccggtcccatgtcaccgacagtagcccccggcgttacgccagggcgatcgccctcctcgagggaagcggtcgggcgtgacgccacttcctaaggcctggtgacaggtggggccggtctaaaaatcgggacaagccggttcgtttttcctggagatatggtgatggcgcttcggtcggcgagcgtaattaacgcgcgcacgagatgttccatctcgactgccacagccgcttatccacctcatgcaccgcaaacgggcgaatgggattagtggaagcgtgggcgcgagaaacgagggggcaagatagtgggcgcgagaaacgaggagccgggcacagcgttggcaagggtataaagtcgtcgaggaagagatttgcttccttcctctcgccattattccccttgtcttcgccgcttgcgccctaactccttgtttcctgtgccctaccttcgccacacgcgctcgctctcaaacatctcttcttctggcatcatggcacggggctccgctccgcttgacggtagcgtgctgccgccttcccgcatcgtgagcgagagacaggccgggctgccgcgccgcttcatgccggaatctgccatcggccgggagatagtctcgctgggcgagggatgcccggcgccacgctacccggggcggtccgtcttcttcctccctttttctatggcagggctggttccgccattttcttctttcttcatggatgttctggagttttacgatctccagatggcgcacctcacccccaacgcggtaatgacattggccatcttcacgcacctgtgcgagatgttcatcggggtgcgcccatcccttcggctgttccggtggttcttcaccgtacagccggtgtcgccgccgtcggtggttggtggttgctacttctagccgcgggggccggtgctgaaccgctacattccctgcgtcctccgcaagaagtgggatgactggaagagcgactggttctacacccccctcgccgacgaagcgcgcctccgacttcggagccagcctccagcgcaggcctccagctggtgggcgccggtagatctgggagatggctatgacgccgtcctcgaccgcttggcgggcctgcgattccaggggctcacaggggccatggtgtacggcgactatcttcatcgccggatcgcgccactccagcggcgcgcccggggcgcctgggagtacaccgggtccgaagacttcatgaggacccaccagggggtcagatgggactgggctcctgaggacttcaagatagtggtccaacgggtgctgaatctcagctccgtggaggcatcccttattcctcaaggagtcctccccctctgcagcgatccagaccgcgcctccatcctgaccatcatgcaggcggtcggggcatcggaggagcgggctcctcgaggccacgatggcgcgggcgggagccacaggggggaacaatctaccccgggagggggtcgtgcttctgggccccgcgacgggggcccggggagcggccgccctgccgacgcccgggggaagaggaagcaggaaggaacccctcccccatctcctccccgagggggcggggcggcgcgtgccagcagcaggcgctcggagggggccacaccgacgtcgcagcccgagggggagcggaagaagaaacggctccgcaagatgggggggacagaaccatcccggggaaaccttatttcccctccaaggtggtcgtttaaccgaccccctcgcaggttcgtcccacgcccatcgtggccgtattcattccctcaacgcgagttttcactcatccatcttgtttgtcttctggtcttttttctgtttcagcgagatcccgtcgcgtccctcccgccattccaagtccggccagtctgaggccgaggacccggcgaccacagaggcccggaggcgggaatctgaccggcgagaagccgcggatcgccttcgggaagccgaggaggccgctcgggaggccgcccgggctcgccagaccgaggaagccgctcgggaggaggccggactccgccaggccgaggcgacgacatcctccgaggcgacccgtgaaactgaccggcaagaggccgcggatcgccttcgagaagccgaggaagctgcccaggtggccgtccgagctcgccaagctgaagaagccgctcgggaggaggccagacttcgccaggccgaggcgacgacgacttccgaggcaactcgcgacgaggccgcgggcgcatcgcttgggcccactcccacgtgcgacgctcaggacaaaccaggtccgggggacatccccgagtctggcacgtccatcagcgggccaagccgcgcggcatcctcttcgaggcggctcttccccacgcctttcgttgctccactgagcgcagaaccccttctgcaggccttggccgtcgcaaacaccacggtgttggacgggttaagtgcccaggtggaggccctgcaagcagagcgggcggagctcgacgccgcatgggcgcgtgtcgaagaggggcgacgctcggtggaggccatggtggaggtgggccgcaaggcacaccgccggcacgtctcagagctcgaagcccgtcggaaggtgctgggggagatcgccaaggaggtggaggaggagcggggggctgccctcatcgccaccaccgtgatgaacgaggcgcaagacaccctccgccttcaatacgggagctgggaggcagagctagggaagaagctcgacgccgcccggggggtccttgacgctgccgctgcccgagaacggcgggcggcggagaccgaggtggcatcccggcggcgcgaagaagcccttgaggcccgtgccatggcgctggaagagcgtgcctgcgccgtggagagggacctggcggatcgcgaggccgccgttgccatccgggaggcaacgctgactgcgcatgaggccgcctgcgccgaagaggagtccgcgctccgcctccgcgaggacgcgctcaccgagcgggagcgagctctcgaggaggccgaggccgcggcgcaacggctggcggacagcctgtccctccgcgaggcagcgcgggaggagcaggcgtgccgtaatctggaaggtgcccgcgccgagagggccgcgctgaatcagcgggccgctgagctcgaggcgcgggagagggagctggacgcgagggcgcgcagcggcggggcggccgcgggcgaaagcgacttaaccgcccgcctcgcagctgccgaacacaccatcgccgatctgcagggcgcgctagactcgtccgccggggaggtcgaggccctccgcttggcaggcgaggtagggcccggcatgtttcgggacgccgtctcccgtctagaccgcgccggccggcaggcgggcctctggggcaggcggactgcgaagtacgccgccaaccaggggggcctcgcccagcgcctctcggagatagccgggactctccaacggctccccgaggagctcgagaggacgattaagtcatcctcgagggacctcgcctgaggagcggtggagctcgtactggcgagttaccaagccagggatcccgacttctccccatggacggcgctggacgagttccctcccgggaccgaggacggcgcgcgcgcgcaggtccgggacgccgccgaccatatcgtccacagcttcgagggttcggcccctcggctcgcgttcgccctcaactccgacgaggaggacgaagacggcggagtgggcgacagtggcgacgaggctggcgacccgggtgcatcggagtgagcccccaggcccccgccaacctttaaatagtttcttcttttcttcttccgaggccttcgggcccccttcttgtatagactaatttaatctgcaatcaaataaagaggaaattttttgtgtcaattctatttgttgtgtgtatgagacgaggatgtctgtgccgcggtccttttgtgtcttggcttgaacaagggctcgtgcccaggtcctagtcctcaaatggctcgggtcggggctagtgcctggggagatccacatgtcgagactggccaggccgggagcgtggtgaccgagggttatgggtgacccgattgtgggtttttgccgattcccccccggagttcactacgccccggggcacggctcggttctgggccccgtttggcgattttagccgacccgagcccccgagggcaggattgaacacgagtgacctatttcaagtcaagatccttcaaaaggaaacaacagcacagatacagcctttaggaaatcgaaaatgcttttattgaaatacagatataagagaaataagaatatgcatatgtggtagcccccggccaaccctgcacgcccgaggggggtgcggggttggcccgagcccgaaacctgacacccgatccccctttaggggtagaagcgacgaaggtgttcgatgttccacgggttaggtagctctgtgccatcgcccgtggccagccgaacggagcccggccgggggacgccgatcactcgatacggaccctcccacattggtgagagcttgctcaatccagcacgcgtttggacgcggcgtaggacgaggtcgtcgacgcagagtgatcgggcccggacgtggcgctgatggtagcgccgcaggctctgctggtagagcgcggctcggagggccgcgtgccgccttcgctcttccaagtagtcgaggtcatctctgcgaagctgatcttgatcagcctcgcagtacatggtggcccgaggggacctcagggtgagctcggatgggagaaccgcttccgcgccgtagacgaggaagaaaggtgtttccccggttgctcggcttggcgtggttcggttcgcccagagcaccgctggcaactcctcgatccacgaatcgccgtgcttcttgaggatgttgaaggtcttggttttaaggcctctgaggatttccgcattagcgcgctccacttggccgttgcttctggggtgggcaggtaaggcgaagcagagcttgatgcccatgtcttcgcagtaatcgccgaaaagttcactagtgaattgggtgccgttatccgtaataatacggttaggtactccaaaccgggctgtgatgcccttaatgaatttaagtgcggagtgcttatcgatcttgacgaccggataagcctcgggccacttagtgaacttgtcgatcgcgacatacagatactcaaacccgcccggggcccgcctaaacgatcccaggatatcgagcccccagacagcaaatggccatgaaagtggtatgatctgcagggcctgggccggctgatggatttgcttggcgtggaattgacacgctctgcatcgccggaccaggtcgaccttgacgaaaggctttgccaaccaaggtgcgcgaggcggagtgggctccgcattcgccttcatggatatcggcaagaagctcgacgccttgttcccgaggaatgcacttcaggaggattccgttagccgcgcgccgatagagggtcccttctaccagcacgtagcgtttggagatgcgctggacgcgttcactcccttcgcggtcctcgggtagagtcttatctgtgaggtatgcttggatctcagcgatccaagcaatcaatctaagggagctgggagcgctcccctcgggtcccgaggcctggactccgacgggcctcgggggcctgttaggcgcgtccgtctcccctaaggggtcgggtcgcgccgacggctgggcaagcctttcttcaaagacgcccggtggggtctgggctcgcgaggaagcgagccgtgagagttcgtcggcaaccgtgttatcccgtctgggcacgtgccgaagctctatcccgtcaaaatggcgctccatacgccgtacttggcgcacgtaagcgtccatctgcgggtcagagcaccggtactccttacaaacctggttaacgaccagctgggagtcgcctaacaccaggaggcggcggatccccagtccagctgccaccctaagtcccgcaaggagtccctcgtactctgccatattattggtcgcccgaaagtcaaggcgaaccaaatatctgaggacgtctccgctcggcgaggtcaacgtgacccccgcaccggcgccctgaagagacaggaagccgtcgaactgcatcacccagtgggcggtgtgaggcagctgcgaggggcccgagctggcctcggggactgagacgggctcgggagctggggtccactctgccacaaaatcggcgagggcctggctcttgatagcgtggcgtggttcaaagtgcaaatcaaactcagaaagttcgattgcccatttcaccacccgtccagtaccctctcgattatgcaagatttggccgagggggtaagacgtaaccaccgtgacccgatgcgcctggaaataatggcgcagtttcctcgaagccatcagaatagcgtaaagcatcttctgggcctgagggtatcgggtcttggcgtcctggagggcctcactaacaaagtagacgggccgctgcacctttcggtggggccgatcctcttcgctaggggccacatccctagggcgctctttgtccaagcggcctcgcggggtgcactcgtcttctgtgccgacgacctcggggtcggaggacgacaggggcggccttcccacagtggcctcggggccgtcctgggggtcgggggctcctggcgtcgtcggacaagcgggcaaagggccaactctggtcgtcaggggccttaggccaccgttcggctcgggggcctcttctccctgctctctcccgggtcgagtcggcacagggttagcctcggggtcagagggcgataggtgcggccttcccgcagtggccctcgggccatcctgggggtcgggggcacctggcaccgtctgacaagcgggcagagggcctgctccggtcgtcgggggccttgggccaccgttcggctcgggggcctctcctccctgctctctcccgggccaagccagcacagggtgggggtgcacggaatgaggattgtcctcatcgcgctccacaaccaacgccgcactaaccacttgcggggtcgccgctaagtagagtagcaaaggttcatttggctccggggcgaccagaactgggggagagctgagatacgccttcaactgagtgagggcacgttcagcttcctccgtccaagtaaacggcccggagcgtttgaggagcttaaataagggtagcgccttctctcccagcctcgatatgaaccgacttagggcggccatgcaaccggtgacacattgcacatccctaagcttgctgggggggcgcatccgctctatagctcgtatcttctcggggttggcctcgatgcctcgggcagagaccaaaaacccgagaagcttgcccgcaggtacaccgaacacgcacttatcggggttcagttttatgcgggcggagcggagactctcaaaagtttccgctagatcagagagtaaggtctcttggttgcgcgtctttacaaccaagtcatcgacataagcctcaacattacgtcctatttggctacccaaagaaattcgagtagtacgttgaaaagtaggacctgcattctttaacccgaagggcattgtcgtataacaataagttcctatgggggtaatgaacgcagttttttcctcatcctccctagccatgtgaatctgatggtaaccagagtatgcatctagaaaacacaaaaggtcgcaccccgctgtggagtcgacaatctgatctatgcgaggcagggggtaagggtccttaggacatgccttgttatggtcggtgtagtcgatgcacatccgaagcttgccgttcgccttgggaacgaccaccgggttcgccagccactccggatggatgacctcgcggatgaatccggcctccagaagtcgcgccacctcctcacggatgaaggcttgacgttccggggcctgccgccgtactttctgccggaccggccttgcgcccgaccgcacggcgagacggtgctcaatcacctccctggggaccccgggcatatccgccggtctccatgcgaagacgtcagcgtttgcccgcaggaaagagacgagcgcgtcttcctatttgccatccagaagaccaccgattcgtgtggtcttggacgggccgtcgcccagggcaacctccttgaccgggacctcgtcgcacgtgactatccgctgcctcggggcggcggggatggaggtgccaagcctctcgtcgccaccctcgggcttggacgcagcggcgaggtggtccgcgcgctgctccatacaagcgagcgcgactttgaggtcgccatggacagagatgggaccaccgaggcccggcatcttcatctggaggtaggcgtaatggagcgccgccatgaacttcaccaacgcgggcctccctaggaccgcgttgtagggcagactgaggtccgccacatcaaagttcacccgttccgtgcggaagttggcggatccaccgaaggtgaccgggaggtcgatatgacctagcggccaagtgtgacccggcgtcacaccgataatcggctgggacagccggagcaccatccccggggccttgatagcgtcaaaggctgcgggggaaaggatgttgagggctgctcccccatcaatgaggacacgccccagcttcacgttgcaaacagtgggggaaaccaccattgcgatctgtcctccccgggcaacgcacggtgggtggtcggtctggtcgaaggtgagggcaacctccgaccaccgcgcccggcgcgtcgcctcatgagtaggggccgcggccagaagctctcgcttcatggccttgaggctccggcgagaaacgtgagcacacgctcccccatcgacagtggcaatggtggccccaggctcttggaaacctaggtcatcatcgccgtcatcgatgtcctcggcgggggccttctgcttggcctcacttcgccgattgccggaaggaaccgccggggacttgccctctcggcgctcctgcctcctctcctcctcccacttcctcgtccgctcagccaaacttttgactgcgcggcagtccgcgaggtcgtgaagggaggtgttgtggacgatgcaccacttgccagttgggcgctccctactgggagcgccggcctccttctttttgtcgctcgcaggcctcccctttcgggtggcccgcgaagcgccctcgacggcgaggacatgaccctcgtcgtcggaatgggctgacctcttcttcctcctcctgtcacgccgccctgtccgagcagcggatccgggggcggccgaagctgccacaccggaaccggaggggttccaggtccatgcctcttccttacgagccactcggtccgcgagctaaaaaagctccgcggtagtctggggctctttggaggcgatcttttcgagcatgcggttgtgccgcacaccccccctgaacgcgtagatcaccgcgtgtgcagggatgcatggtatggtgttgcggacttgacagaaccgctgaatgtatgagcgaagtgactcatcatcccttcgctggactgcatgtaagtccgcttcttcacctgggcgcggatatgtgccttgaaagttcatggtgaactgttggcacaaatcctcccaagagtggacggacgcgggtggcaagttcattagccaaccccgtgcctgtcccttcagggccatgggaaagaaattcgccatgaccctgtcgtcatccccggcggcctcgatcccggtcgtgtagacctggagaaactcggcggggttgacgctcccgtcgtatttttcggcgatggtgggccagaaccttgggggccaacggacgttccgaaggctcgccacaaaggctctacagccgacaccaccaaccgggggcacggagggttgatccccgcgtccgtgttgatgtgacactccggacgaggaggcgccctccgttgcgtgggcagcacgtcggccattacgctggtgctcgatactgatgcgggcatccggccctccacgcagatcttcctgggtcggaggcgctgacgaaggagtggcggccgaatggcgagcaacagccgccgctcgccgcgccctccgccttgacgacacggagcgggtggtagcagcgccagaggtcttggtggcggaggaccgcccaccagcacctaggcgctgctgtgccgtcatgaccaagttggccacgtcgtccagccaacgttgggctggagactccgggccagggacaatgggcgggtgacgtaggagcgcgcccgcagcttggagcgcgccctggggcgtgctgccgtcgccgtagacgaggaggcgacgctccccatctcgccgcccttccccagcacccgtggatgtcgaagtcgcggatccttcgaccctctcgagcgcctcctcccgcctaggactttggcgtggaaggggcggtggagtacgagctcgacggcgtgggttcggctccccgtcgtcaccgctaacactcggagagaggctgtgcgcctttgcttgttcagccattgggctgaacaggaaaagcttggtgcacacgaaagagtgcgagagcttagaagaacacacgcagaaccccctacctggcgcgccagatgacggagcgtggggctcctcaccgggagaccgcgcaggcccccctttgccggttcggccgggggccctgggtgagattctaagctcctagtctgtgtgtggaaggttcgcgagaatggaaacacacaagacacgggcgatgtatacaggttcgggccgctgagaagcgtaataccctactcctgtgttctggtggatctgtgtatgaagaagctacaaaagagctggagaaccagagagctctt

SEQ ID NO: 38884 - DNA, 3576 bp, Oryza sativa
tctgcatgttcgcccctcttcatacaatgtcatgcttgtaatggttaggatgaagcctggtatatatctgaccgggaccaacgtgccatctccaggagctaacacgctggctccggctagggacgagtgcttggaggctctcatcctgacgggatggggcgaggcgtgcgtcagaccgcctgtcgccacctaacccacgatctgatcggtctgtgactggtcacagaccggataaacgagtgcgctgcactgcgttacatgcggcgtgacgcgctcgtccaaaccgcaataaatgtggttaggtgagccccgctatgctcacctaccccatatacgcggcgcaaaacccacaaggggtcggggcgcctcggccctcggggccgagacgggagcggtccgacccctcggggagacaaagaaaagggcggccgtatcaccctcgggcccgacccccccccccccccgagggggttaggccacgtgggtgatcgtgtctgcctcaagtctctaagtcatgatactcccggtcccatgtgaaattttctttaaaaaaacatcatacggtaatttaggaaatgcatattaaggtggtgtttggatctagggactaatttttaagttcccatcgtatcgtatgttttgaaactaatttagagtattaaacatagattaataataaaactaattgcataaatgagagctaattagcgagacaaattttctaagcacaattaatctataattagcacatatttattatagcatcacataggctaatcatggattaattaggctcaatagatccgtctcgcgaattagtctagaattatgaaataagttttatcattaatctatatttaatacttctaatctaattaatatccaaacatccaatatgacatggacaaacagcccgattgaaaatcaatagtagacggcagccgtatataccgtctgggggtccccccattttctcccttttgtcctcccctttctccgtccggaggagccgaggagttgtcgtctgtccgtgggtctcgactccatcggtcttgcgcgctatctccgaggctccggcgacgcggctgggccttgtgcagcgacggccggctgctccgacgttagtccccggcgatcccatctctccgacggtttattttttttcctgcatctcttcaaacctctctaatgtttatttatgttcggtcgagtccaatgtactggagtaatgctttgagtttggttggaaaattcttgattcagttactgatgtagcaaaggatctcccgtttttaagtttggtgattgtgtgggttcaggtaagaaatggaagtggagaatttatagggcttttgttcgtctaatcccttatatatcccgtggagattggaggggattggggataataagccgttaccaggaaaaaaaaagagggttttttataattgaaatcctgcatcagccactatgatctgctagttgcatctccttttcaagcttaagctgattttgtgaattcgctatatatatggaaatggggattactgtggttgatgcaatatttttggcactcttgtagactgcagtggaattgctccgagagcagagctctccaggtctccatggatctggacaccacacgaaagcggccccgtgaaagtggcgtcgccgtcgatcggctcagcgcgttgccggactgcctcctccatgtcatcatgtccttcatgaaggccaggcaggtggtgcagacgtgcatgctgtccaagaggtgggagcacctctggcgcaccgtgccgtgcctcgatgtagatcatcgggagttccaaagcacaggtgaagctgcacagggcgacaatgaggtgtggcagaattttgaggattttgcggacaacctgatgcttcatcaccagattgcacacctggatacgttccagctgcatgttaataatgtgtatcgttggggtcaacatgcatctaggtggattcgtcgcagcatcaagtataacaccaaggttcctggcattcctcgcccgggattgagctgcagttcttggagcctcaaaagactacatctttctaacatttgtgtggatgatctgttcgcaaagcacattagctcaatgtgctgctctctggaggatttgaatctcaaaggatgcagatttgcattcaatgagatcacgtcccactcactgaagagcttggtgatcgacagctgcgacagcaagctttgtccttccaaactggttgtcacggctcctgccattgcctccctgtgccttattgtgaaattgtggtttttccccggcggtctcattgtaaatgaaatgccattcctttcgaaagcatccattcttgtttcagccacctacgacggaaagaacttccaacacaatcaaagcaagtttcttggtagcctctgtaatgtgacaactttagagctgtcaggttttcagacaatggtatgtattctgtcttcacagacttgcttcttctatacgtttaccttgtggtgccatttcagcattatatatttcagattatacctgaggaaccggttgagttaccagaattcaagaacctcaagatcttatcccttgacaagtgtgatcttagtgacaacttccagttattgaagcactttctgcagaactcgcctaatttggagaagctcacgttgcggctttgcgaggtattcatgctcttattttggccttaacattcttacataattaaatttggctcattattggacatcctttactatactgccaacagctgccaaaggattctaagaaaaggaaagggaaggccaaggcgaagaaaacacgtttggtggatatccggtgtgagaacctaaagcttactgaaatcatctacgatgctgatgatgtcctccaactggtcgggcttttgctgaacgattcagcaaatcttcctaagaacaacataaaactcagcaaagttgatcgttagtatggttagttcaggccctcttttgtgatgaccgattcttaggcctctcctgaattcacatgtcttgtctgtcttccgatgcactgtcagttgtgtagttgaaatgcacctatcttttgacttgtctaatcggtttaagactgctctgttctgttagctattgcatgtgttcttgcgcgctgtgatgctaggttaatgaagtgatagcgattgatacttatggctatgaacagaccaatttcttactatagagcatgttcaaaacgtatgatgatccatgctcctggttgcctagtacaatgtctacaatgagcacagcaaaagcacgtctctattgaaatttgctgtgccatgtttttttaggccttatacgtctctacagctaatatcatactatcaacaaaacgatttaataaacagcagatttatatgggtatagacgtataatggtgtttcatatcctaattcatggtgtgctctctcagcccctccattctgagatgcaagatgtttagattttgtcgtaagttgaacttatacttgatcatacagaatttttacaggtacctcaaggaactagtactacagggtacctgttgt

SEQ ID NO: 38885 - DNA, 8845 bp, Oryza sativa
cgattagccgataggtataggttgaacaatcggttgttggagacttggaacccagatgttgataacaattgcagactcgagtctcgggtgtgccaaaagcgtgtgtctgctgatagccgatagcttggtgtagaatcggttgaaggattcggtgccagtacttagcgctgaacgcctttggttgttgatgccaactgatgttaatgggactttggacgattacctgaaagcttgttgtagaattggatcggctggaagtccgatacaaatagattcaaatagttatataagaaatgaagcctttgctacaattggttaaaactaacttatgtataattattagcaaacctttctttatgaaagacaatcttgatagattggacttaaccaagatagtataaaattgaagtcgatatatatagatttatctaacaactacactaatctttataagccaatgtaacacttagaaccagtaaccagataacttatcgactagtactccgatgaaacataagcctaaaaactctcggcttaacaagacttagattatcagtagcaatctaaaagatcaaaactaactgagagagtatgagatataagcaaacgtgatagatataacaaatctatcttaaaatagcattatgtttaaagagacatcaacttgatcataatatcagaccgaaccgaggaagttctaagtcgatgttactctaaacaacaatgcaatcaaaagtagagacaatatatcagatagggaacacttgcttcggcccgaatagtatattggacctaactgaggaagtcctagtcacgccgttgtaagcgaaggtgatgtaacttacttctcgccggaggtcggacttaaccaacgtagcccatgctcgaaactaagaactcgccgggagtaaactagggtgacgatacgccgaaagttgtattgatcaactgatattttacaatgatctaggatgtacatgtttatacacccatgggtagatgagtgttcgaagcacccatgggtagatgagtggtcgaagcaacctcatcctaatgctattgaatgatgagtcttcgttgaatgatgacaatagatttatttttgatatttttgaggtggttcaaataatgtatggtaagtacattgaagaatcgacaggagtgggtctgtctttagacatgaggtgattgatcttgataaattggctgatcattggagaatataccatgactacttttcgaaagaacctatataccttcctctttattttagacgcaggtgcgtaatagtgaatactccctccgtcccataaaaaaccaacctagtatcagatgtgacacatactagtactatgaatctagatatacatatgtccagattcgtaatactagaatatgtcatatccggtcatagattcgttttttatgggacgaagggagtagtattttttcaatcttggtttgaattaccgacttgagtgcgcagtgccgttcaagtgcgcaacgcacgggaagtccgcaagtgcgtcggaacccgggtttcccttaccgtcggtaaccgtgcggttaccgggcttaccgcgggggtacggtaatataaataccgcagtaacctccttaaattcaaataaattttaaaaataatttaattttttgataaattttgcacggtttttcgcggtcaccgcgataaccgtgcttatcactggggcgcggtaaccccggccccgacggtttgggaaaccctggtcggaacacactattgcatcttcgtgccttcgggcttcatcggttcatccatggtccaactgggttcatccatggtccaactgaatcagcaacagccaacatgcaacagattacacatggaatcatagagtaaaggcagcaatcaggcatcagcagaagcagaagtgcagaacgacgggcgtcgccgtcggtcgacggcaacagcaagagaaacctgcgcggctcggacgaagtaattaatttgtttcgtttgatattatggaacggatgaagtaattgtatgcatgcatacatacaattaattaggacctcttctacattaaattagtacttttttaaatcctccatccttaagatgtctaattctattgaatgcatgtattatactctctccattccaaaatataagacacaaccaccctatatccaaagaccaaaaaacaattattatcacctctttgtttcaataatcccaactaatacaatacatgcacccagtagaattaagcatcttgatttaaaaaataataatctaggagagagaatttgcaattaattatcatgcatgcatgcacgccttatattatgaaacatctttaaaaagtagttgcgccctatattttagaacggatggagtatttattagggtgatctaaactaggagatgataataattgtttcttggtttttaggttaagggtggtagtgacttatatttttggaacggagggagtagcaaccggtactcacgaacatgcggactcgcgaagatataggaaaccaacaggtttgctagtggtagttggaaattaacgaagatcggaagatactatgatcatatgatcatatgcaacagtccggtccggttttgaagcctaatccagtacgtttcgctaccgaagctaaacaagatggaacagctagcgcgccgcgtaatactcagatccgatcgatcaaagcaacaactcacaacttcgcgcgcgcggcgcggctcggctgggggcgtccgccattgtcgtcgaccatggagatcgagggctcccgcaagcgcaagcgtactcccgccgccgccgccgccgccgaggaccggctgagcgagctgccggactgcctcctccacgacatcctgtcccacctcaaggcccggcaggtggtgcagacgtgcgtgctgtcgcggcggtggcgccacctctggcgctccgtgccgcgcctcgacgtcgactgcaaggatttctggtcgccgccgccggcgtcgacgcagcagcagcagcagcacgcggctctgttggcggcggagttcgccaggttcgaggacttcgccgacaacctcctgctccgccggagcgccgccgcgccgctggacgccctgcgcctgcgcgtcgacgagcgatgccagcgcaccacctacggcaggtgggtccgccgcgccatggtcatgcacgcgccggcggcgctcgaggtcgtccgccactacggcggcggcggcgccgcggcgccgctcttcgcggcgctgccgctgtccctgccctccggctgccaccgccgcctcacgaggctctgcctcgacggcgtcaccctccccgcggggttcgacgcgatgctcgcctcggggtcggggctccccgtcctggaggacctggagctcagggcagcccactacccgttcgcgcggatcgcctccgccacgctcaagaagctcgccgtcgagcgctgcggcggcggcggcgcgggctacctcaccagcgacgacggcggcgtggtcgtcatctccgccccgcgcctctcctcgctgcgcctcggcatctacctcgagcccaactggcccgccttcgccgtggaggggcccacgccgtccctcgtcgaagcatcgatccaagtcttccacgccaccgccattgatgcacatgcacctgagccgcagattacgcagaggatgagcttgctgaaatctctttgcaatctgcttgctggcatctcccacgtcagtagcctagagctgtcaggccttcatggactggtacgcgtcaaatccttcaattctcaatatatatagggagtggattctaatccctcgaggggatatcccctcgtatacctttttcttctaaattcgatgcaaatagttgtgaaaaaatctgaaaaaaattgacaatgtagagtataatgatacctattagtccaccaaaattcatgttcaaattcgatctacacatcgagaaacaaaaaagacaaatttagatataaacagtacactactattcatacgctgaatttgtcttttttatatctcgacgtgtgagttgagtttggacttaagattttgtgaagttgtatatatgtgttgtatgaatgttgtcaaatttttccagaatttttcataaccatttagatggtttttgagcaaacgagggaacatcccctcgagggattagaatagtttcccatatatatatatatatatatatatatatatatatatatatatatatatatatatatatatatatatatatatattcctctttccgttttatatttaattctttagttaaactttattaagtttgatcaagtttataaaaaaaattagcaacatctaaaatatcaaatcagtttcattaaaattaacataagatatactttgataatatatttattttgtattgaaaataccactatttttttctataaactctttcaaagttgaagaattttgactagggaaagagtaaaacgacttataatatgaaaatgagggagtacttcgttttgaaacatctgtgccaaaggagtatttcagaaatttcagaacaacattttttttgaattcttaacaaattttggtcaaatttaaatagatttctaccaaatttaaaaacaagaaggaaaattcgggaaaaatagtttcatgccaataccgaggatgcaaacatttacttctggcactgaaaccgaaccgtataaaataaaagagaaatgttactatccttgaggagatatcaaggagtatcatagtcgtatatcgtcctaaagagagatcggacattgagaggtgccgtatatagtatttcgtaaaatttggtgcctcaaggacataacaaagactctagagggattgttcctgttacattatcattgatttggtaattctgaactaattaactgttcctataattaactagctactcctggttttctgtatttcaggtgatgccattgcaaggagagggaaatgatccttacaatcaagcaccagcaggccagcactatcataatccagacaagaacctagctcagtattatcaagcattgcctcccatctttcagtatcaacaaccagttcagtattatgatataccaccactccatcctctctttccaccttataattaccagcatcctaattgggcggcgcaacaccgtcaacctatgcccctgttgcaaacaatgctggatgacaaccatggcggattgccggtgttctctaacctaacaaccatggtgcttcgcgagtgcaatatccatgtaaatgacagcatgaaaatgctgtggcgtttcctgcagaacacccctgcgctggagaagctcactcttcagaattgcaaggtaaacagcatgcaaacttttatttccttttagttaatttaccttgcaatatatgtatacatctttagaattttgactctattaatatttgctttggttttactaattaatatacatttgtcgttgccgaaaatagttctcaaatggtgctgatgttaggaaacatggtcctaagttgaagatctcttccagcttaaagtttgtggatatcatatacaaagatgtgaatcaccatgatggcgaagaagatgagtatgaagacgaagatgaagacaaagatgaacatcctgaggaagttaataaggttttgttcataatgtcaagaaaattgaaagatgttactgtcaaagttaagaaagtagatggatatcaatagtatttttagttgttttccgttgttgggaaaaaccattgtatttaatctatcgcgtacagtttgtctacttcgaaacttaatcgcttactatttttctcgcatgaatcatgaatggataatcacatatactgttcataatagcaaattaaaaccatttgtaacaagttgttttaatgatattcatagatttattagagtgagtagtatgtgagcgtggtggatccaacaatccaaccccaagtcatggatgtaaaattatactccctccgtttcaaaatgtttgacaccgttgactttttagcacatgtttaactgttcgtcttattaaaaaaatttatgaaatatgtaaaactatatatgtacatgaaagtatatctaacaatgaatcaaatgatatgaaaaaaataaataattacttaaattttttttgaataagacgaatggtcaaacatgtgataaaaagtcaacggtgtaaaatattttgaaacggatggagtagtattctactgtaatcaggcaatacgaattacgaagcgcactcgtttatgatccaaccatgggatacaaagctcctgaattcctgatgctaacgaatgcacagcttttgtagcttgatatctattgaatgaaattgacgtgtcgcccgtttgttaaaataaacttttacagcttgatcgttgggcccaaacaaagtgataagtcgtaaacacagagcaacaaaaaataatttatgaatattttttttcatttacggattagcaatttaaaagccagttctgaaaaataagctacgatatgaaaacctcaaaattatctttaaaatcaaaattcggttgcccatgggtttgtaattgagaaaaaaaaatccaagaccattagttttttttggacaaattaagaccatagtacctggtttgtgggcttaaattagattgggccggccgtgctgagaagcctgagatttggccaggcctgactggcgagaaggcccaatttcatgctgggcccactctctgcttcctgggtcgccctcctccgtgacgcaccttgactgcccccggtttttcctaatctccgatttaattaacttttatccccaattatatcccctccttttatctaatttcctttccttattttttttcctctctctctctctctctctctctctctcttttcccccacctcgctctctcctctcttcctcttcccccaatctccgacagttgccaaattcccttcccacccccaaacccaaaccccagcgacgacggcgacgacgcgcagcagacgaaagcgagcgagaggcgagagaaatcccatcgtttcccaaaccctaaccccctcctcctcctcctccagatctcggcggccgcgcggctgatgcgaggtgagccccgtccgccctagggtttgcggcggggtgcgtggtggtggtggttgggccgggggggacggggccctcctgctcgcgggggtgggggttgggtggggatggcggcggcgcgcgcgcacgtgaaggacccggcgcaccggaccaaggtggtgctccggaggctgccgccggcgatcgcgcagcaggccgtcgtggaacaggtcgacgcgcgcttcggcggccggtacgactggtcgtgcttccgccccggcaatgccaggtaacgcgcgattcctctcgccttgctccctccgtgtgcgtcgtgcgggtgcgtgcgtgcgtgcgtgcgtgtggttggggggcgtcgggggcacgtttggtctgtagctagggattgggttcgaagctgtttattagcctgcgaattgtgtacggggaggtaccaccccatgaaatttcgttagtagatttcattggctggttttgattgagtagctgtggccagcaattagcattctataatcgtgcaatttacagatacaagtttggactgtttgcctctatctagtgcatttggttatgtctagcaacaaataggttgctgtgatcaagtagttactgagttttaagtttgcaatcctaactgattgtgggccatttacagttctttcgcgttgttgtgatctcgaagcatagtggattgtgtacttcaaattgtagctaggatattttggaggtgtattttagtttattcttattagatttaatattagctgtgaccaaattattgcttggagatagtgcccaccttcttagttttgttgcataattttagctgtaagtgaactaaatgtgcttttgattgcagctagtataagtgaggtcaatatgttttttttttataaaaaaaattaccttaccttgccattttggctgctggagtaagaggttttgttctgtttgttcatttttatgcttctgtaggattgccttaagacatgctagttatagagaaaatttcctataagaaaacatgcacactgcaaaactacttggcagcattgagccttttttagtttgtgctgagtgatgtgcaacgtactgtggccattcgtatgtagctagtgattcaattgttatgtctgcaattcttaactcattgccgtggaagctaaatgatagtggcattctccacttcatttttattctcatttttctgacaatgttattgcttgtccagccaaaagaatcacagatattctcgactctaccttaacttcaagggcccagaagatgtcgttgaatttgctgaggtcttcaatggtcatgtgtttgtgaatgaaaagggtaactttcacatttatgtaccaacgtttctttttgccatgcaaatttatattcaggattcagaacttatattctgattatgtcaatgttgtcactatcaaaactagatacacatgtagcaatataagcagtgtggatctttgtacaaactaatagtgcaacatagagaatcagaatgaaattgcaattattgagcatttacatagtctttgaattggagattgatcttgtcgaataggattttgggactaaacagtaggttttgcatatttttccctattcaacttattgatgtctagtattatttttccctttttgattagtgcgcagcaaagaaaatattcaactgtaactatataaattccaatattatggaaatagtttaaattgag

SEQ ID NO: 38886 - DNA, 798 bp, Oryza sativa
aatatatcacagtagaaattgataacctaacttgcattttggaggctggagaccatcctacaaacaccaccttttgttactatttattggttactgatgtatgttattgctattctttcttatacacttcatagcattttaacattttcagatgcctattttcagcatgctggtataattgacattcatgttaagttattttcttatttttggtattcaagttaaaaaagaggttgacttttgatggttgcaagcaagcactgcttataatgtgatatattttaggtcggaacataagttaatacttttaatgtaatcaaggtgttgagttttccttcaacagtcgagcacatgcttgtaaatttaattttggactatgcttttttgttttaaattttattgtcatgcatgcggcctatggttcctgtcaggtgctcaatttaaagctcttgtggaatatgcaccatcgcaacaggtccccaagtcaaacacgaagaaagatgctcgtcaaggaactataatgaaaggtcctagacaatcatttaatctcattctccatcctgtaggtgacacaatttcatatttatcattacttcaaacttagctggcatcttttttgggatttaatatccagatccggaatacttggagtttcttgaatcgatttcaaagcctgctgagcatctgccaagtgctgaaattcagctcgaaaggaaagaagctgaaagggcaggtaaagtattgtttgtaatatcagattataattatgcctttcaaagatgccaaggggctgcagga

SEQ ID NO: 38887 - DNA, 1695 bp, Oryza sativa
tttataaaaccttgtttagcaaatgaactaaatttctatatattctttcttccccacacacattttctctctcatcaacttacaactaaattttggagacaaaaaaagtgtgtaaaacataggtgcaaatgtagtatgataaaaaaaaacattggaggatgaagttgcaaaccttttaggcacctccgatttgtatgtaatcaccaaaataaattcaatagaaattttggcatgacctcccctctttttgaagaaattttgaagcttgctcgggcagctggaggaggaagaagacatatatataggggtgggactttagtcccggttggtagtaccaaccggggctaaagatcaccgggatccggttggtattaccaaccaggactaaagttaagatctttagtcccggttggtgttaccaaccgggactaaagatcccgggggggcctgacaggccctgacagcattcgaaccgggactaaagatgatctttagtcccggttggtaacacaaaccgggactaaagatcaaatatgcccgttacccttttgaaccgggactaaagatattgcatccgggactattgtggaaatcggccgaccgacgaaagatggtttctccaccagtatacatatactttagtaaaataagttgaatttgctacaagagcgttattttcaaagaaccccctaatgtgattttagctttcaatgtaaccggtatcttataataatgtagtgaaacatgtatttttgaagaaaaagacataatatttctccttttctaatgctattttttctcatccttttattttctgttagtgaccaaattaataaacctgtgaaggagtaagatggcaaatacatacagatatttagtagataatcatatcatcgagctagttgggtattggagaagacacgaatattagggaatgatctaacatcaaataattagaaagggtgatgcttcgaatccaggtcgtctagcccaccaccctgtggagctagccggaagacccctgagtatttctcactagtaaggtattggaacgaccgaagaagagtaagatagttattcatatttataaggctcgggtttttctccgttttagttcagatttaagaaggttctagattttcccttagtatttgtttgatttatctcagcttttgtaagtgccgcgtacgtggttcagtcatcattgggcaaaactgtcggtttgagaataataagattggccaagtgccacctgccaaatcacctgtgaataacacaggagtaagcaggaacgagttaccagctaaacagagtatggaggattcagccatcagcacagcaggccagcagggcttcatggcagcatgggcatatatcacaatgtcagcatgtgttaagcagcatggaaggaaagaaagacgggcataggttggctggacttgttcaattcccctgcgtaaaagaaagcaatacgagcacgcatgcgccacgtcagcattgccagtatggcgctgcttgatctgtctatcacgcctatctacaaagcaactttacctgtgtataatctcgtaagcgcacaatgataattcatacgtaattcatactcttatcttaattacctttcagcagatgatattgaaaatttgaaatcactaccagcgattaccttactagcaaattattaagcagatcgaa

SEQ ID NO: 38888 - DNA, 8607 bp, Oryza sativa
tggcatttgccgtgggagcagtattactgtcacattagcatgcatgtaatctgttttcttgtcatatctgtatgtagctccaagctcttggtagtagtaactccaatttgcaaagcttccggtatcgcgtatggcgaaggagacgtccccatcaacgacaaaaagcttcatccagcggtcaaaattgatagattctctcttaggaagccggcttgccagtgctcgccactgccagtagtactctggcgtgtcgacgtgttcttcactcgcgtcaatctgatcaacggtaggcgatcactttacagtgcaagcagtagtatgaattttgagacaaatcgaacaagagcaagcacagttgtgtagtaccagacaggatacaacgtcgaacgcagaacggagcagataaaatgtgcttctcatgatcggcaaaatctagccatcgaaagggctcatcatacttgtctgccacgcccaagatcggctccgcccagcccaccaactttatcatcacggcctcattgcgtgtcagcctaatcgagaacgtgaacattctcgagctcaatttcaaattaaccggcgccgaattccgatcggttttgaacaaaattggtcgtgtcagcgtagcgtgcatgggctgcttgctgcatgctcctgtccagtgtccaccacgctcgacgacatacgtcatgggcacgtaacacgctggcatgcacaagctcgtctcgatcgcttttcttttttgccttggaaaaagaaaccttaatttgctccattccattctcctacaagcaaagtgatagtggtgggaatatggggaaatggaatgtatcgatcaacgtcggattaatcgacggcgcaccggcgaaggaaaaggcagccacagccacagcctacgcgaggattggggaagcgccaagtataatacgcgcaatcattgggtactcaacccgcgaccccgacacgctgccgccccgccgcgcgacacgccagcggcgcgtgcggagtccagggccccgcgcgcgcgcgcacgcgcacgcgcccgatcgcgatggctggtggctagcggccgggccgggccggcgcggcggcttctgccttcttctcttcggtacatggacgtggctggtggccatccagtgcatgcacgcgtgcggtgcctcagcgagcgatcaccaccgtttttcgctggccggtgggtggtcaccccccaccgcacgccgcgccgaacgcgccacgcgcgtttcgtcggaaaaacggcggcacgcgcgccgcgcgcggctggctggccacctcctcactcgcgtcgcgtggccacgagccgttcggggatgatatgcttgcacgggccgagtgagtttgcccaacggatacgatgcggcttgggccaaagtccggatgggcctgaagcggcgggagccgggagaggtagtggtggggtgcgagggattagtaccacctcggggagttgttgcggatgacgaggtgagagctgctataaagagggagtgctatggaataggtgaaatcacgcagctgcgtggtgagcacaaagcgaactattctttcgccttttactaaagaataccgtgtgcgctccacatatagcagcatacgctatttttttgaggtgtccctcctttctggaagggcgccaacaattcaaacttaaatctttttcttttcctggttgcaattttgcatcttttccttttcctggttacaattttgcatccattttgccaattggtgaggttatcgtatttgtgcaagataataggaaatgtgttgatgaactcttgcctcaaatctaacatgaatgaaagggaatgtgtaacattatcagcacaaaataaatatattattaaaaatatattcgatgttacgtttaatcaaacagaacagtggaaatatctgagcagaataaatagaatagtgtgacagccttgtggcgtatgataaaagaacttgtcaatatcgtcagttttataatgaatggagtgaaatgtcgtcagtcttgtggcatttgacaaagacattgccttcacccagatgcaaaaagaaaggaacagcaaagcaggctaagcaataagcatttgatctcacactggaaaggattatacatattcatcgttttagttgaacaacaaaagcttatagctcgaacaagaggacatattatcatataggtatggcaaatctttcaagttccagcaatcaggacgagctaatggtaagattttccatctcgtttgctacatcatcagctatctccacttctagagctcccagggacttctcaaatctttcaagggctacaaaggcaccctcaggtgagccaccaaggctcctgatttccctccgcattgcattggcgccaccatacaatcttttcactgaggatttcatctcagataagtcttgtggtgggtacacagacgccccgaggtcgttaatctggtcagcagcctgtctgcaacagctcaacaattgttccattgtctcaactttttcctcattagctccacttcggttacctgagatcttaagcaaacaagtaatgaaacgaattgtttctttcaccacaacaagcgcatcggaagccacagtgacaaccaatttggcaacagcaacctcctcttcagtgaagtcctcatctaactcaaggtcacttgacgatccatctctatcagaacaacttgtggtgtccacagctccattagaagatttttcagcagtgccattagaatcaccaattggtagttctttcatctctcggagaatatccttcagatacacacctatctgagtcatggctcgtcctatggcaacacagttggttgttggtaccttgttgagagcaagacatgcttcccatacagttcctgtcacctgaggtatagttgttttccggtcaggactgcgtgattctgcacgtcacaaaaaagctgtgaatgctagtaacatcctcttgcatactgcattactattcaggtttcttactgcttatccacttatgcattacatcgtgaccaccataaggaaaataaaaagcagaaaatggtaaatttgtccttctcactttagtcgtaaggaaattagatcatcaaatttagttatgagggttgtccgcatacattagttaattctgaatgactatttagttatctactcctaatagttacgaagacaaaagggagcttcagacaaaggaagatccttgagaaaggtttttacttaccataagcagaaacagcttgattgaacaatgagaagctggagtcaacaacattctttgcagagctacagatggatttgtgaagtgtgggtcctgcgccaactgtgctgccgtggcaacccaaaaggaaaccctgcaggatgttgaaatatgcgacgatgttctccttgagtgtttctacatcaggcaaatcaccactccagaccattccagctgtattgaaaaacagacatcagcgaacagtgacaaagctaaggttacatcatcacagaaacggtatcagtatatcgcgacaccacattggttggatattgcatttgctaccctaaccactagaaagaaacaaatggccaatgcaaataacatttccctgctatatgatgatatacagcagctgaactataacctaatgctgctacattaattccttgccaagcttaattgggcggaataataaactaacaccttgatttccccaacagttttttctatccaagcgattctttccgctgaaattaaacaatctaaacctaccgacgctaaattaagtaggtgtatagtccgatcaactgagcgcacgaaacgtggggagagaaatcgttcgttcttagacctaccaacagtggcctgcctggagacttgctcgccgagcttgacgacctcagaccactccgtccgctccaagccgccgggagccgcctccgccatcatctgagaacccaaagtaaataagcacgccgccgcgccgtgagttaccgtgggattggaggcttagagccgtgctatgaccccatcgggatagagagactcgggtgccaaacctggaaggtgtcgttgatggtctggaggtgcgactgcaggaagcgggacagctcgccgccgcccgccggcttcttcgccgctccacctctcctcggcatggcaggcagctaccgcctcgtcgcgtcgcgccggcgaagaagagagggagaggaagagggatgcgagccgcggcgaggcggcggcggcggcggcgggggcggaagggtttatttcgttagggcttttgggggaagttgggcttggccggttggccctcctgacattgcgtcgatgtgggccgttcgattgaagttaagattcgtgctggaatacgaccgtgattccccgtcacagctggactagccacttagtcgcacgttgcgcgacattaaatacccgtatgaaaaccttgtatacatgagtcaaaatatatggtatgaaattctactttaaatttgaaaattgacaataccatagaacttaataaataattgttagaaccaccgctgcataggttggaagtatctctctcgcctatcttaagtaataatcgcaagtactgttatcagtacgaaattggaaacaatacctataaatcatctctgcttggtgatgagaggaactgactcatatactgacagagagtagtaaaatctaacaaagtgatgtacaaaatatttctgacttcaaaagtgtatgaacctaagttatcctaccatgtgcacttcgcagagttaacaaaaatgaattaggttgggtttggagtatgataaaagagtaaacaaatccgatgtatatccatacggatttctgtatttgcagctcttcaattcaatctagctttcagcagcaaaatgaaatatgtgaaatataaagaccaattagagtcataggagttattctaaaagaaaatttaccaatatttctaaaaccgaatatgagcatcaaatgaatcattgtgatgctgtacatgcgcatatggaatctgacaatgtagtaaaataggtaaattggcattctgtgagttactttatcatgtgacaaacaatcatacgttttatcaatcgtagaaaaggttggtgcttcttccttgaagatgtatatcagttacagaaaatttcagtgccttctccttctagaccataattgataagtgttcatcactattctcttatttaaaatgatactccagtattaattatttagttaatgagggaagacaataatgttaggacacaccaacagaagagaacaaaaatataatataggtcttgtttagattccaactttttctttaaacttccaacttttccgtcatatcgaacttttctacacacacaaactttcaacttttccatcacatcgttctaatttttactttcaattttagcgttgaactaaacacagccataaaaccaaagcacattaagttcaaaagctacataccaaaagccatcatcaactgacggatgaatgcatcgcttattcgcttcattgcttgagttaaattaatcgcaagtttaagctagctagctagctagctggggagttcccacggactgatcaaatagcagaccaatctcaagtaaacttttcatcgagcaccttgtgtgcatcggccaaagcatagcgaagatcctggcatgcatgcttggagcaatcctgacatggcctctgcagagagaagaataaggatgtggtggcgcacagctagaaggcctaagcatctatggggtcgccggagcatgctctacatgggccacagccgcatctacacggaccactactacgaccccatcgagctccatgggcagccgccgccactgctgtgagtctacatggcactgacctcaatggttccatttgagtttcatggctttcgccgccgccaccgccgcgtggaaccagggcgcctctttgtgatggctggcgacgaggggttagcgctggccggatttgggatgggctgaccggtgatgctgtgatctctttatacctagtggtgtgccgcaatctgtgaatggggaggagacggaggggattgggaggagacgcggtggcagcaacgatgggaggaggcacggagagatggcaccggagacttgaggaggacgcggcggcgagggggacgcgcgctgtctccgactatccgcctctccggacgcgagtagaacgaaaggaaattattctttccccaatagggcagggacgtggaagggcctattttttaaaaagcaacttcttaaaggaatcttgatattttatctattgagatcggacggttgctaaccacggaacgaagaatcggacggtccatgtttttctggtgacgtggcgcattgtggtggtgaaaaactttagttttttcactactttagattcgaccaaggaaaagaaaccgatggaaaaaaggtaaaacagggaaagatcaggtagcacccccgcttttgtatgttttagattttttataatgaaatataaattccggcttttacttgaaaaatatccaagcatattcaaatattgaataatatctataacatttttattaaagctaatatttaatatatttttttaatatgtttgttttgtgttaaaaatattgctatatttctttataaataatgtagttaaacttgtgttttaacttgaaaaaagttaaaataacttattgatatgaaacggaaagagtcgataaaaatcacaggagcaaaatcacgtcatggtaatatttcacttattaatctgaaattagccatccctcttgcgaggcaacaattggctattgtaaaacataatgtgaaatgtagctgaaaattgctttatcctaggatttaaagttacataattacccatcacatttaagttacatcatcacccatcacatatgtacatcctatcaagaagaagaaacaagtttgaagggggtccagagtcgaaaatcttccgaaaaattaatccattatagccgctttctctgatatttcaggtgattcctccaagaccatgcaagcaagaaaaccactagtgctacccccaccgaactccaaaagatgatcaaccaagtaggcatgggatcatgaaacagccctatccagattacaaaaaagttaggcactcttaacatttaatgttccaaatatatactactccctccggtttcattttaattgatgttttagacaatgacacggtctacaaaatatacctttgatcttatttttctattataatatatacaataaataaatacatgtttacttttattatagtgttttgaaagacaaatctatatatgttgttctagtttctttaaactaaatatttttaaagttattgatggtcaaagttataaaagtttgaccttaactttgtccaaaacgttaattattatagaaccggagggagtagtatatatcacgagaaaatcaagcgaccataaggtaatttttcaaatcagatcaattatttcacaagtgatgatgatgtcagaagagagtaactcaccatgtccaaacttcatacatataagaagctctacaatgcatatagctagagagagccagcaaaaagccccaaccttcttcaccggtttgctggtgtgaccatgaaaaaatatatattagcaagccattaagtaaaattgtaaaaaatgtgcaatgctattgggcgtgcagggaaattgggataacctgttttgcaagtaggagttgtactcacggatggttggaatagcaatcaaccaccataggattaatctgtacacaaccaaaggattccttggaggaatccagaggcaaaatttaagaaaaaatgtgttgagctccactgtcatgaaaacaacgcacaggaacaacacttgaacgaaccgcaacggccccatgaaagggtaccattgatccttgtcccattgtgcaggggtgaactggctcagtgatcttttcacctgcatatgcaagtaaaggaaggtcggtaaactgtaaatgggttcaacctaactatagtatgcagtctgaagcagaatgtaactgcacaaatgtgcatatagtccaatcagataaaacacactgaatgccagaatggtatacaacaaaataaattatgaagtcaggtatcaataatggcaattgacagtttagagtttggacagagcaacagaaatcaatacagtcccactgggaaaacctcacatgttgtttggcgtactacagacaagaagtcaaagtgatttacttttgctcagcgactgcattgttatagaatgctcccatggacttagcagtagcaagaggctcttgtaagtcgtaactcaagaaagaatcgatgaggaaattcttacaaaaagcacaatagcccaggaaaattcagcaggtacaaaaaaaaaatctaggcctaagggccatgatgaatgaagattaaaagaacagtcctaaaaaaaggtactaacctatttgcaaataagaaacaatttgtttgtttggtaacataccttgcccatgatgcttggctgtcggctcagcccaacccactcatatgttttaccgtcaaagtaacggactggggtgcaggaa

SEQ ID NO: 38889 - DNA, 8750 bp, Oryza sativa
actgtgtgcatccccgcccatatacctgaataagaatattagcatttcagccaaaatatttagatgaagctgaacacataaaacactccatagcctactgctaagagtgaggcttatatggcagatttgttcttcctccattcacatttacttgtcacttttgaccctaacgtgcatatgcaggtactctttcaataactggttactgaaatagaaagattgctttcaacccatgaactgatagaagaagataaattatattacttcataaacagtaagtgtttaatgtcagcagtatgcatgtgcatcaggtctaagttttcttcttaaaactctcagatacatcacatcgctattcattttctatattatcatgttcagttgataagagttagatccaaacaaactgtataaaatatgcaaacccaaaaacactatattattttaatctgcctaactttgttttactaataactttagatgtaaaaaatgtatcatcaatgtcactgaatgtatacaacatgaaagtcagctgtctccgattgtcctaccaaaccagttgcagatcaagatatccaaaataatactatcccaccagcactcattaaagtttggcaacatatgtctgaatgtaagctgcaaaaggtcataataagcacaataccttgttagagataacaagtaaaagataacaaaaggttgagtaaccatatctaacctccattagctcgaaaccaatcgagaggacccaaagaagaagctggtttcgtatcattacggctttaccccaccaacccaaaatatgggcaaccacaaattcgtcaaataatgtctcctatatgtatatcaaaccgtcaaatatgatggggtaataacaatgataataactacaataataacaaaaaccagagcatgaaataggaaggttcaaatgaaaaatcatacataaatatttatgaacttgtttttagggttttccggaacatacagacggcagtcagctccataagatctctccggcaattctgcattagtgtacagaaatgtttgtcagcaccatttcttctacaatatttaatttccagtgtaaatcctttcgatgtaaagatattaccaactccaagatcagggtaaaggtgtttcatgaactggcgagcatcatcgcggttctggaaaacgagaaagaaataagaattattacagtacaagatatccaagatgtagcatatctctacgtagttgaggcccctcgctcaagagtcttgaaaaaatgccatttatactgaattttgataatcaaatagtttggatacaagacttccaacttttttttttgacaagacaatttgcatttgcttggatctcaagttttttctttcacaaatacttgccacttcacgctcctgtaagaacttcccaaaataaccctatgaataatagacatctcccgccattttctaacattttacgtgcatgggatattattgaaagggcattttttgtcctactttatcgatgtatgaatttttcaatagtaacaactaacctggaaaagaagaaaggctagagcgacaaggtaaacgacagccagtccgtgcaccaggcgccagacagcaggatggggcctaataagtatcctgtgacaatattgccagaacattgaatcatcatcatgcaaaaatattagagatgcacagtagatttacaggttctcaaattgttatgaacccaaggagataaagaagacaaaagtagcaagtacaaaaacagcatgagaatggcattggtattgggtccctcaaggtaatttttgtgtcaccattaaaaacaacctgacgaataataagccctacactttcaagagaattggccactatatggtctcactcatacagtaacacgtgggtcacctctttgaagcagaaaaccttcaatttccctacttaaagaaaaatgcctgacaacgacagccactgcactaacatagttccaatgtttgaaatacatataagaagaggggggctaactcacgttgaaggtgcttggagagtgcagtaagcaaggaagactgcaatcatagcccagacacccctggagagtgtcagtgagaaaatatgagtcagtgtcactctctcccaatcattgtgcagtggtgagaggagaacagctcaagtccaaaagacacaatcaaagtagagaagtaaccagagttcccttagatgattgcatcactttccagtaaagtaaaaaaaaaaggttttcggtcattacctcttaatagatgtcgcactactgtgataagaagcaccctctggatcaagcgctccacttgcccaactgaaacgggaacatgattgaacatgaaatcagacagcaccacgagaaagtgaaaaggagaacgccccagcaagttcacaaccaaccactcaacagcctagcctagctaatggttgtttcagacacaaagttatatgcttaatcctttcatgaagcaatagcaacaataaagttcttggtgagccgtttctacagttaaaaaaaagggacgagaggaatgtacttcccatgtaatttgcacctgctaaaaatgatatgggaaaaaatgattgttctagggaagctttcgcacgagattcttgaacatgattccgattctcctcagccactcgtacgctcggttgtttgctagccttgctgaaccagactgccatgctttcatgttcgttcaatcattcagaaacctcaacttgctggcacaaaatcactaaatttcccgacccaaaaatttcacctttttctttcagagaaagtaaaaaaatcacaatgagtactacatgccctgctttcaactctgacactgttgatgcacctgataggcagaagccctggcatctgttgaattgtactttgccccaacacaacaaggcctttttttccagttctcccaccaagaaatttacagccttagcccttaagtcacaggcagaggcagcaaagcgagaaaaaaaaataaaaacgaatttgtgaaatttaatcgtggaagagcacttacattagaaggcaagcaccgacgaggagcaccgagatggtgtgcggcttgtagagccacgccgtccatgggtcgtactcctcggcgccgccatccgccgccgctacgagcctcctctcctctccgtcgcgatgcctcgtcctctgcttcgcctccatgttcccacttccagaaccctctgcgatatgtgacaggagaaaactgccgcggcagccaaacaacacgccaaaccaagcgaagcgcctgcgcgatataaccaccacggattgtcgcggtcaggtcaggagaggcgaaagcaagagacgagacgagacgagacgagacgagggggacagacaggacatgcagaagaagaaagaagcagaagcgaaggattacttcagagcccgagagagggagagagagaacgggtgtgccctatctccacgcgcacgcggaaatctcggcgtcggccgcgatcggcgccgcacgcgcgtgcgtggggtggggaggaggaggaagtaggaagacgacgatgacgacgcgggttgggtacttgggttggatgagacgaagaagtggcggtctcgtcttctttaaaaccaggggagaggagagtggatgatgacgacgacggagacgaggggagggggggtcggcgtgcgtgcggcctccacgtaacgcttcggccttcgggggcgcgcgcgccgcccaacgccgcagcggccgcggcgccaccgactccgcgagaccgagaggaggcgcaggcgccgcggcgttgttgggctggtccgtcgtgtgggcgggtggccaccgcacctgtaacggggctggctggcagagggtcccgggcgggggttcctgggctggcaaaacccggggtacggtggatttcgtcgccgagttccaactacctttgttgtatttttgcgtcttgtatccaaaatcccattcatcgccgtgtcacgtggctggtgacacacggatgtcttggtgtggtagcttctgcattatggcggcttataattgctctgtttagcaaagcttcatatcctttaaatgtttatattgaatataaaagacctgttcggctattatttttgtggctgcggcgtagccggcatgaacagtgccatcctcgctgtgcgcagccgcagctgtggcagctggcctgccgaacactcccaaatgtttataagttaaattgatcttgtttaaatatgagccctagtgagaagataaatttcagatatctcattaaactcgatgaactgaacggtttgagggagcactaaaattggaagaaagaaatttgtagaaaatatattagagaaccgaattaatgcatacaaaaaaatatgtaaactccttgcgtatctccgatggtgcatgtcacgtgagtttcatttacattttttgaaaaaaattcgcccaaaatgcaccaaatactcatatacggcatgccgaacagattttttagcaaacagttgccgaatttaagcaggtttcgaccgtatctctttttttttttgatcattttcgaccgtatctagcacaccatttgtttgtagaaacgatccggtctagatacatgggcagggataaatgacggcaccagtctacctacactgcaattgccatggggtccttgttaaagaagaaaaaaaaatagagtaagcgttaggtaaaagctactatgacgacggtgagctcaatttgttcgattccgcttgttcgttttctcggttagccgcgggtagtcgtagtactagcagataaggagaggaggacacggtggtggcgacaaccgcggcgctggctgtacgatccgcgtccggagcgatccgggccgtacgtgcggcccctgtcccgatcggcacgtgttggcttgggcgtcgcgcccaagcccgcgcgacgcaggcgacggccacgggtggcgcgggcgggcggggcggcatgtccggcttggagccggccgtgccatttgaccggcacgaggcccgaggagaggctgtttgagtcaaatggtgtcacaccgtcgtcacctcatcaccggcgctcgcagcggaaatcagcgtaacaggacggacgaatggacgaggaggacgatgtgctgctgctgctgatacggcggcgagggtacactgaacggactcaccttacggggcgagttccctgttcgcgatatgcaagttgactgtacgtggtacagagttttttttttttttgggtgcgcgcacacgaaagatgcacatatacgattcattgatctcactattactgagagtgttcgtgcgttcgttagaatgagagaataacggaaagcgactgttttccacgcgcatgtttccttagttgttaaatgttgtgtttttaaaatatagataagttattttttaaaagaaatacattaacctgtttttaaatttaaaatgactatactttcaattaatcaacaataatcgctcacctaaatatttttaggtcctgtttgtttcagtttaaaattattgtaatctagattattaagtcagattactctaaactggattataataagctgatataaaataatctacgagttgtttgtttctctgcattattagagacatttaatggtagtggatctttagccactcaataatctagaaaaagctcctctagaggagattatagattatagtaatctagtataataatctgcttgtttgtttcagcttactcctaataatctagattataatatctaagctgaatcaaatatgaccttaatctactgcttttccctcctctcaaacacaggatattgttttcacgactctactactacatcgctactccttcccgtccttggtttatgaatagaaacttgatttgcacttagaaatacttatatttatgaatagattccaaatgctgaaattgctaatgtttataaagagagtagatcaagcagacagatgtgataaaccacaccaaacacgaacacgtcacaaaaaggctccaatcccaatccttcggcaacacatgtagtactgtaataaaaatctcgcagcagtatattcctctatgctttggcatccgattcttccaaaagattcttcttctcctcctgtaccaaagtgccatccagcaatgaaccaaccctagattactaaacagatcgagatgattagccatatctcatcagcatctaccattgttaagcttcccaaaggtcaaacctggcaatcctctcctcgggccccgagctgcaaaaacttaaagaaaccagacttaggacagtcctaatccataacaatagacatggtttccataaactccacatcataaaaaaaaactagtactagacactactattccaatgcaaacaccactattatatacttcaatttaatgctacttatctcacatgatatcttggatgttgtgtagaaaccatgtctcatgcaagacatggtttacttatctttcctcatttattcacttgtcacattattttttttcctatgtggcaacttatttaatgctatagacatcatcttagtcattgggttgggaatgctcttagatgtgatttgcatacagcgcatgaatcggggattaattggaccacgcgtaccttatgcatgaaatggaattggaattgtggcgatgagctgataatgcaagcaaggaacctgatttgcatatggttggttggttcggagatccattgcacgctctcaccggtcgacagcgtgatcgatcgggaccaaatcgcggctggaaatggaccacgaggtgggtgctatcgatgctacagtggaagaagattccttggaaccccgattgtcccaccgtatcttattttttttctgaggatgatgacaattatttgaaggtttttagcggatttggatggatcagccagtggtttagcatttggatcgtgatctcagccgtttgatgtcgtatctgtctatccaaatttggttggcactgctcgtggagtctgtttgaaatcgataggcagatggatttagtggttcagatatgaggtgtgttcaatcaacaaggtgttcattcagagggatagcagctgatacatgattttttccgactgattgctgagtcatgacacagcacaaatgttggtgccactgctgtagtagtgtttaaactttaatccagaatgagctgcgatgatatttttgtcaaatcgatgactgatatgttgattctttccccagggatttgcaactgtcgtgattgatccgacaatgagcattgttcatcttcctatcagtgtagcacgatccaaacgtttattaatacattattattattattattttcacttccagcacaatgttatcttcagttttatctcaaactattattcgccaactttttactttgagaagacaagagtgaaataatttgtacaccaaaatggcattcagttttttttagcttgcagagtagccgcccagcccatcaaaagatatataaatgggccctttctgggccaaagtgggcttcttcagatctgaaatttctaaaaacgaggcctcttcagtccaaaacctcagctcccgcaccgcgtcgaacacactgacaccagagaaccctagcctcgccggtcgccgccatggccgcctcgctcctccgctccggccaccgcctccgcctcctccgccacggcagcctctcctgggcctccttctccgccgccgccgcggaggagctcatcgacgtccgcaagctccccactgactacgacgcctccaccttcgaccccaccgccccgtcccgcccaccgccctccgaccgcgtctggcgcctcgtcgaggacgtctcctccctcaccctcgccgagtccgccgctctctccgccctcctcctccgccgcctcgacgtccccgctccccccatcgccatcctcaactccgccgcgggcctcggcggcggcggcggcgcgggtgccgcgggcgccgccggggagaaggccggtggggcggcggcggctgagaagacggtgttcgagctgcgcttggaggcgttcgatgcggcgagcaagatcaaggtgatcaaggagatccggtcattcaccgacctgggtctgaaggaggcgaaggagctagtggagaaggcacccgctgtgatcaagggtggtgtctcgaaggaggaggctcggacaatcatcgataagatgaaggctgttggtgccaaggtcgtcatggactgatcagcatcctcatttcaattttcaaggttagatgcagatttcctcttcgattttagattcaacttaaatgcacgaatgattgacatggttactgtggataaatcgatgatgtatagtaataatcggagatttactttgtgaaatgtcctcagaatgctgtaaatgtgcatcagttacatgcaagaatgatgtactgtagtacctttgtcccaaaatatattttgggcaaaatccccgatagttacatgcgcaaaatcccctatattttgggacggagttagtacgaattaggatgtgaaagtggtcttgtaaacttttgaaattgcgaatctgtcatgcaggagaagcattgggtttgaaaatagctattttgtaaagctgtgaagttgttattatgtcatgccgaagaggcgtttaggaaattgagttaatataacctcttgggtcagttgtcacttgtcagtaaatgcattagggaattttggggtgcag

SEQ ID NO: 38890 - DNA, 6587 bp, Oryza sativa
cccccacagtttttaactgtgctttctcatggtttgatggttgatgcggattggggtgccagtgttaatatcctgtcaattggcattttgaaagcccaatgatcttacaacacactggccaatccgatggtgccatcatgtgtttcttgttcggtcgatgaattctctgtcactaacaagaaacatggaataatttctgttgaaaaatgagatcaacagggtgcagagctggagtgtgaccttgagcctggagtactatcttttttggttggcttcaccggctgtatatgtatctcatttttgtaatgttactgaagctactgagctagatgcacgctgtggcgttcaagtttttatcctctgcatttgtgaaatgacctcacatgacggtatgatatgggtcatatggacatagataatccatttatgtgtttcttttttgaaactaccatatagtgaactgatgaatgttgtggactatattttcaagtatggaattcaggaacccctaaaatgacaatgactgatccctgtagggctgtatgctgaatcctcaaatttctcaaataaaaagggtgtgggtagtaggagtgtgtaatgtctaaataaaaagggtgtgggtagtaggagtgtcttttttttttttttgcgggggggtagtaggagtgtctaatgtcttttgtgtagtgaactctagccatgagccaaaagcaaagagaagaaattgtcacgccaggtcggctaagagtggcagctgccgtgtggctttcactttcacaatgggctgcagaatgcatgaagaggcgaattcctgaagaagtttgctgctccaagcagatagcagtctactgacttgatcatcagtatcaccctccctcctggggattaaccgaacaagggtgtgtttagttcacttcaaaattagatgtttgattaaaattggaccgatgtgatgaaaaagttgaaagtttgtgtgtgtaggtaaattttgatgtgatggaaaagttggaagtttgaagaaaaagtttggaactaaaccaggcccaagtcatgaagaaggcaaaggaactatcttggggattaatcgaacaagccctgaaggagaccgaggaactagcaaagacgccatggtctgagagggcacatgcatttcaaggtgaaacgaaagtttcctcttcgattaatttaacttacagatgatttaatcttgttactggggacaaagcaacggggcttttaactatttgccacttttagatttagcaaataactatttgccacccctatctcaatgacatgtggatccacacgtgtctatgacatgtgggtccaatggcaaaaagttaattgccacatctaaatgtggcaaatggttaaatatctccaaagcaatagtctgctaatggtaataaacatcaagataatttgccaaaaggagtgtgatccttggaatgcctgatcatgcatcaattacatgtaaatatgtaattacgctgtatgatgtaaaaaaaaaaagccttttttggtatttggcgaagttatgataagtcattcagaagaggttagcctcattttccgagagaagattagccttttattctttctgtccacgaagagtggaaaatttatctatacttctataggctggaagtattcggaacctcgatctcgtacatacatatcgccatcatacatttcacatagagttcttgatacattctcccggatccaacaaatgcaacagtacaactatgcacactgctttacttcttcagcagattccctacacatccagaggagccagtctcctccacatgatccgatcatccgcttcagttcgcgtcaacggatcaggatgcagaatcagaccgaattcgttgcatcaagcaccaaatgttgcttctctgacggtgtctcgccgaaaattctctccctcgctttctcggcctgcagaagcagcatcaggtcagtaggcgggagaaacatgattcagttttcgagtgatcaagatttgatgatgttggggagaaggcttggagtttcagataaagaaacaaaccatcttttgccagttgctgaagaatgcaatgacggcgagaagcaagaattgtaatacggaaccacaggcgatgcccagccaaagccctttgccttccatcttgaaaccaaagccaagaagtagggctaccggaatgccaaccaggtagaatgaaccgaggtttacataggctcccaggtgctgccatccgcaaccccgagcaatacctgataacaagtaatatctgtcagtgttaagcaatgacgtgtggtgcatctatcttgatataatcttctagagaggagaaacaatagtatgtttccgtgctggagctgaatgagatgtgtgttttcgcaagttcagttcattgtttttggcatgtccacaactgctcagaagcacaaacaatgaaatagacctgtgaagcaaacaccagtgccacactaccagtctaccactagccaggggaaaggtgtaattgcatacttagtgaagtggagtccacacttaagacgacatcgctgatagatgcgtgttgattgtaaacaccaccatatccatgttcacgtaagagcacatgtttgaaggaacaaacaggtaactccccgagtaacaatgtcggcctccacaacacaaaatagcattagtttcattgaacaaaggaaaaacaagaagcggcaagttacctggtatgtctttacgataccggagtgactgaaattaacttgctacctgaggtcttggtagagatttgacaacagcgcacacattgaattaagcaatcaaactaaggggtaaaagataccgttgggctaacaggctaaagatactgaatggtgtaaatgtaatggccccaaaactataagaaccagttatataaaaaaaatgaaataagagagaggcaaggccagttagatcaaattttcgaaaacttcaggcatagctgaatactccattttttccattcttttgaagggaatgaataattaacagataaatcaaatgttaggaaatgtaacctgataaaactccttgtaggctatcagcagcaactgagatgcacacaaaaggaaccattgaggtgaaatatgtgacaacctcctcatcactgctgtaagcatagcccaagatgcgctgtgctgcaaacagcatcccagtaacaagaactgcctctgtcccagcaatagacattacaaggtgaacagccgatcgagctccttcaggattcccagcgcctaactcatttgctactcgagtgctgttcattaaaacaaaattcacaaggctgttaacacatgattattctctgagaaaaaataatcattcacagtagtggtttggcttctaccttgcagcgcctccaagaccatatggtatagtatacatcaaagaggtagtcgtcaagctgcataaatggagtgcttataaaataacaaaaggtgcagctataagagaatatattgttaagtgcgacattgaggactcttattttcttaccatatggaaagaactgaactttcaagctctgggttgggtagaagtcctgacaggagaacaaggatctcaaatgaccaccattcaaaactacaaaataatagaagaaaatccattaatccaataagtgggaattttttaacaggaaataagaaatacttacatataaaacaaggagattctgaagctactgtaattaccataacattagtgcagatggtagtgctattcgcagaaacaaaccgactcctctgaatgcctcgattgtaggaggcgagcgagtcaccttacaagaacatgagaatctgatgtatgcagcgagcatgaatgtattcaaccagtaagatatgctaattgctaaagcagctccagtaaatcccatgctggtcttgaacaccaacagccaagacagagggatgtgcaggagcagagttgcaatggaggaccagagcatgggaaatattagactctgagactgcagaaattttgtgagaggctggcagaccgcgtatgcgaagagtcctggaatcaaccacactatgtatcttccagcttcatgtgagatcacggggtcctgacctattagggtcaagagtttgcctatgaatacccatagaagtgagatgggaattgtgactactgttagtgtgactattgctctgtaggtttgcactcctaacttgtcatactgttttgccccataagcttgaccgcagagagtttctaatccacttgccattccaacctgttttacaagttcaaaattcaaattatgggtggtttcaaaattaagatcacaaactaaaaaggcaatccgtgtacaactgaagagaaaagtaaaaaaaaaaaatcctacagaatatttcgccagagtatcgaagtagtcctctaggctgtacacacttcgcagattctgaaagctagttgaaatcgtgacaattgactagctcaccatctgtgcaggcaatttaaaattcatcctagaaaagcattcagcgtggagtagtagactagtagtgtaacttgttatttatctctatatttaggagaacgttgattttaaattttgtaggtttgcaaactgctacttgtatacccaaaaaaaaaaaatctgctacttactatgctatatccatgatttatttcagaatgtttggaacacgccaaatgttcaaacagtattccagcaaaaattttaggcactgttccaatcaaaatcccccttccaaactaaccagccgcttgtacggctaaactttttgcctgtcctcctactgctaaatttgaacgccacattgaacaatatctgaaaccgtgaaacgtgcctctctggctaaagtgctaaacagttaatccaatgagaccaaatcacgcaggcaacaaatatggatataagcaaatcgaggacgcgtgaacgagtggggaaatcaggatatgcgatgacgacgtacgaggaggctgaagccggagacgctggcgagggaggtggcgatggcggaggcggagagcgggaggacgccggggaggtgccccaccatcatgttggacgccacctgcacggcgttctgcgccacgctcatcgcggccatgggcagcgccatggaccccacctttcctgcctcccgcgccagcccgctccaccacctatctccgccctcctcctccctccctcctcccactccggcggtgccgtccgccgggaatcgtttcgagagcagaggtattctctcctccatggcggccgcagtgcgcgcgtcgtcgtcgtcgcctccaccgaccgagctctctctctctctctctctctccctctcttcttctcagagacggctttggtgtctgtgtctcggcgctggtgggcgggggggttttaatgggaaaggactctcgcgatcagcggcgggttaaaacaggagttatgggaaggttgttatgtcaaagtgtcaaatgtggcgtcctaattttatactgcgggttaaaagtagaatgcaaagttttatacgagtgagcatccccccctcaaaaaaaaatactggctaaataaaacaactacactgtgaatattttaggaatgctttgaaatactcgctctgttttatattataaattatttttactttactctaaatcaaattactttaaatttaattaagtttgtataaacaatataataatatttataacactagattaattttattaaatctataattaaatacattttcatagtttatttgtattgggttgaaaatgttactacttttttctacaaacttagataaatttaaagcggtttgattgtaaccaaagtcaaaacaacttataatctgaaacgaagagagtaaggtttataaaacataaataaagagagtaagatttataaaacagagaaagaaaaaaacatactaatagaatgctatgctcttgtctgcagaattttaggtcacgagaatacgaatcaaacataggaatataaacttttcaggaaatttgtttggataggggagagactagatagagaaaggaatataatgcatacaagagtttgagctcatacttatttttctttggaattgaaacaaccaaattcataggatattcaaagttccattgtttcaatccgaagtataccataggaataaaaatcccaagaaattgaatcctctataaatactatgaaaatcctccaattcaagaaaggcatgttagcattggtgagcgaatcttgttgaggctttttattttttagaaacacagtacaagcgcacatatgttttttataaacgtacatacacatatcctacacctagcatatctttgagattgatgaagttattacggacacatcgctaacgacggatacattgtttaccattgaaaatgtcaaagttttcacctttccttcaaaagaaaaaaagaactctaccaccctaccctggtggtgttttcctagcatacatctcttcatagtatattgcattcttgccaagataattataaacaggctactagaaaagatcaaactgattcagtctctatgtgctagtatgtacccacc

SEQ ID NO: 38891 - DNA, 1884 bp, Oryza sativa
catggaaccagctgaagatgctgtcgatttttatatgtgaggacagagagaactcaagtagtagtagttcggcgtcgactatatgcatatggcaatgttttttgcagggttctactgtgagttacagcacacgcaatttgaagttcaaagatctatagaaaactgaaaacctatgtgacaaatttggcagatctgaatgtctgatgcggcaatgcagaagcctgcatccaccggcggtgccatcaggaattctcgaggaaacagcctgcagccgatggtcgctgtcgccaagacgtcggtttgccgaaaagacggcatgcgagtgcgcgcgctgactcactgcggcagcgtgatcggcattgctaccgcgtccgagcaggcgtgccgatccaaaccaacgcagcgtcagaatcgcctcatgcttcagatggtttatttatagcgataaccggataaggtagcggcgcaggcgggcgaaacaccgaacctttttcacttctccagacaaagagaccatggtgtgagacttcgaatgctggtgccacacagcttagacttgtttatgagaacttaaaattctaagaatctgagatttagagaagctaggctttttcaaaatatggtttctagtttactttttaaattctacagccatagatttttagaatctactaggtaataatatggactgtttatggactgtttagggaaactgaagcttttgtgagaagctgcagttgctaggaactaaacagacactcgattcaaagaccaccggcacaagtagatacaccaaatacacaggatatactaatgtagcatctgatttcagacaccacaatacatcagctgttacactgcatcagacattcagaactatctcatttcgcaagccaaatcatgaaaattgaggctgaacaagcatcccgcttacggatcataccatttaacttgcagaagtgcgcaaaaggattccggttagttacagtaatctagaccacaaacacaggacccatgactaataatgggttctcttggcctattgtttccggatcataccctattgtcacaatttaggggaaattggagaatgaacagttgctattgtgttagcccaaagggcatatatgagtacaatagagataggaaattactaatatacccctaaacacataatactcaacacccctgctcaaatgcaatgtgtatacaatagcattgcatttgaaactaaacacaagataaatgacacactactataaatacaaagtccatgtttgaagatgttgtcgaagcattgctcttgaatgaattagaagaagagaaaaccatcctatcctcaatgaagtagacctcgagccttcacaaactgttcttcagcccttagtaccaaaagccttcacaaactgttctttggctcttcactgattcagagacggtgatgatgacgagatgaaggaccttcacaaactgttcttcggcccttcaatgattgatgatgatgtcaactccgatggggagctggtgatatgacaaagatcagctccgacgtggagcttctggtgatgatagaaggctaacttcgacatggagcgagcgagatagtgataatgattgacaagcatgacttcgacgaaccgatggactttgatggacttgataggaaacataggaaattgatttgtagatgacattgatatactagcaaatgacttaggatactagcaaaagacataagagaacaattgatgcagatgacaagaagcaatatcaaaatcaaaaggacatgcacagggctgtgccttggttttctgttgcctatctcaaactgaagcacaatgatatgtttgcaagaccaaaggatattaattgacttgttgatgg

SEQ ID NO: 38892 - DNA, 1199 bp, Oryza sativa
ctgttcttcggcccttcaatgattgatgatgatgtcaactccgatggggagctggtgatatgacaaagatcagctccgacgtggagcttctggtgatgatagaaggctaacttcgacatggagcgagcgagatagtgataatgattgacaagcatgacttcgacgaaccgatggactttgatggacttgataggaaacataggaaattgatttgtagatgacattgatatactagcaaatgacttaggatactagcaaaagacataagagaacaattgatgcagatgacaagaagcaatatcaaaatcaaaaggacatgcacagggctgtgccttggttttctgttgcctatctcaaactgaagcacaatgatatgtttgcaagaccaaaggatattaattgacttgttgatggcagcagtaagcaagcatagcaaacacaaaatagatctgttgatggaacaattcaacaatcaagatagttgagactatggatggcttcacaaatccggcaagagcagaggccggctgcatgatgagggaagcataactcgatatgggcttctctactgctatttgttgatgtttgaatatggaacaaggtggatctgcatgacacttgcaaattgctgtcgctgctacttgatattagggaagacgatggcttgttgctgttaagtccagtaaccagtctccaagcatctatgtggagaagcagagagaacagagcaggctagaccaagaggaccaggaccttgacctgtgcggcgacgatgcagatggtcacgcgcgcaggcggcggacggaaagctggacgactgacatgggaggaggacggcgctggcggcgatgaagagagcgccgcgaccggccaatgggaatgcggcgacaacgacgagccacggcgagacgcgacgacaagatccgcgacgagtacggcctggctacgactgacgtggtgacgaagaactggatctgaatgcttgttcatgcatccgctgcttgcttgtggatttgattgcttgatgctgcttgttgcttgtgctgactggatctgcttgctgcttgtggacgaacgacgaaacgattggctgccacgattgacggctcgacggtggtggacgacgaagctgacgaggatgtgcacggattggatgggctcgccggtggcgagctgccaccggcgtgccggcgtcgact

SEQ ID NO: 38893 - DNA, 3914 bp, Oryza sativa
cagatgttgcaggacgccagggaagactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggttaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctcccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcgctgctattcgtaaccatcaacgattggcctgcacttagcaacctatccggacagtccaacaaggggtacaaggcttgcactcactgtatggatgaaacagaaagtacgtatcttaaccactgtaggaaggttgtatacatgggtcatcgtcgattccttgcagcaaaccacccggtacggaagaaaggcaagcacttcgaacataaggccgaccaccgtacgaagcctaaacatcgcagtgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcatgtaatgatctgaagcatatggaacaacgcggcgaccttcacccggaaccaaaggaaaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataagggctatccatccagacaatgtccgggcaacaataacaaagatatgtgcattcatgaacgcaatttcgcagaaggtcatcgatccggatagattagaagcccttcagaatgaagtggtgcaatgtctcgtcagttttgagttgatatttccaccttcatttttcaatataatgacgcatatgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaatggttatggaacagaggaggtcatcgaattttgcgtagaatttatcgaagaccttcgcccaatcggggtacctgaatcacgccatgaagggagactacggggaaagggaactctcggaaggaaagcaataacgacggtagacaacaatttattccgtaaagcccatttcactgttctgcaacactcttcattggtagctccttacatcgaggagcacttggctctagttcgcgccaggaacatcggtaagtccgatgcatggattacacggcatcatattgatactttccccgcgtggctacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacgaaccaaaacagcgttgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacatgactgacgaggattacgatcagttggatgggcaaccccctttcacggtgacgattgaccctagcatcctcctatcaaatgaagacaccccttactcacgcagcgatcaccaggagggaacaatagtgaggagaaagtacgtgccgtaattattgtgtacacgatgtaaactattttggatgtattgattatccatataaatcaattgatgtatggcatatgttaattacgcacgattattagaggtttcaacaagtttaaatcatgtatatgctagttatatgtgatacttacaatttttaaaagttttaaatcacacgtgtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactacctttcatatgctacttatatatgactattcgaatttttaaaaggtttaaatcatgcatgtggcatttacatatgttaattagagtttttagcatttaatttaatataattcctacgctaagtacatatgatgattacaatttttattaattttaaatcatgcagtatgtacatacatatcttaattagagtttttaccaatataataatattattcatatatatgctaagtatatatgattattggaatttttattaattatatttgcttattacgatttatccacttaatttattacagacaaaaataatttttcgaaataattgtcattaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttgttgagaacaaccaggactaaagatatctttagtcccgg

SEQ ID NO: 38894 - DNA, 4581 bp, Oryza sativa
cgccgccgccacgccacgcccgccgccgccgccacgccacgccacgccgtctccgccaaggcctcgcaacgccacgccgccgccgccgtcgccacgccgccgccgccgccgccacgccgccgcgccaaccgccgccccgatgccgccacaccgccgttaatgaacgagaacgagaacgatcgaacgaacgagagcgagaacaaacacgtcaacgtcgttgccgcgacaacgtgaacgagaacgagaacgatcgaacgaacgagagcgagaacgaacacgtcaacgtacgttgccgcgagaacgtgaacgagaacgagaacgatcgaacgaacgagagcgagaacgagaacgatcgaacgaagacaagcgagaacgagggaacaacgtgaatgagaacaagcgaacgaacgtgaatgagaacgagcgaacgaacgtgaacgagctagggaacgtgaacgagcgaacgaacgaggacgaacgttaacgtgaaatgcaatatatatatatatatatatatatatatatatatatatatatatatatgtgtgtgtgtgtgtgtgtgtgtgtgtgtgtgtgtgtgtgtgtgtgtgtgtgtgtgtgttacttcgcatttatcctaatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacatgactattttagtcttagcatgtaatattatttgagttttaatataatattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggaagacaccaaactttgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggcgatcagatacgagaggctgcgcgacgactaacagatgcagtggaagcctcctctcagggcacgttccgaccagacagagatagggacgagctgacactcgccctgcagactccagagcatccaggacgaacacgagggaaaggggtgattccttggaagattggtttcaaggaggacatccacacgtacaagagtcggatgaggagcaagagagataccggggcgaagattgcagacctagagttccgagtatcgagctacgaactcaacatgcaagaggaggtggcaagaaaggttgatgaacgcatggccgcacatcggtcccatgatccctagccgaccattcctcctgcaatggtgagcccgtcaggaaaccgtagcagctgcgcctcaacggggcaggtagaatcacagagcatggacgccatgcaaacacaggacgaatcgacctgtcccgttgatgacatcactcagcggacaccatgtgagctacatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaagcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaaggccccccccagctccaccacctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttagagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagactatagaaaataatatactccctttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttgctgtcttcctacataccaaatttcattcccgtacgaacttgctaagtgtttcatatgtaatgcatcccatgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgagggcttg

SEQ ID NO: 38895 - DNA, 1590 bp, Oryza sativa
atatatatatatatatatatatatatatataaaccatgcagcaacagggccatgcaaaaaaaaaaaggtcagcttgatctttactcccggttatttcacccgggactaaagatagcgatctttagtcccggattggtactcccggtttggaaaccgggactaaagggggttacgaaccgggactacaaagggtttctccaccagtggtatatgcaattgactaatggacatataagataaatacatgacgggtcatatagtaggggcgctgattttctataatattccctgcaatgatatgtcttcctacaatgacacgttgtaaacaagaaaaaaaggaaaaatgaacgtaagaatttttacaattctttcggaaatgagttgtttatgaatgaaatcgagatatttcaacgaaatcgaatggggccctggtttggtgaagcagctatactagattgctttcctgtgtttcaggactgcactcttattcattcctgtcttgtgctgtatctagctagggccaattaatagagtatttttcttgaggtaattagtggattatatggattcatttactgttcaactaggggtagtacatgcccattgtttcattgagacatgcacagaggcaccattcgagaggcgttttccctccaatgcattacatgaaagtcatcaacaatccataaacaatcatatgcttctcttcttatcatggggagaatcctattctaaaccaacatggcacttttgtgcatcaaacattaacaaagcaaaggaaggctataaagtaatccaatatacatacactggtaagaaacaccagggaccgtttctctgagcggctaaacgcgcatgttacctctactttgcatgctactccagcatgcagtagaaaaagggggaaaaggatagtgaaagaagaaaaggagtgaagcttccatgcctaggtgagctgataagtgacatgcacatggaaggagttgttaagtccaggcctaagcatgctttaacaaaccctaatcccccactaataagatagattaacgctgctaccattgacaagccaatgagttatccttaattaagcgatcactgtctgcacaaaaggtgcatcatggattacttattgttagctccatgcatgcagctagcgagctacgcaagttagttatgctgctgagaggagttcacgtttaccatcctgttagggtattagggtgagtgatccacccactcaccataaacaaatttacacataaaaatttacagaagtaaatcagaagcaacagtcacacttgcaatttaagtcaaaaaagcaaaaagggcatgttcttataaacgttatcatcacttttgacctacaaacctgccaactttacaaatactctgaatgtaagtcgattgaacgagttacatatgtcaaatttggttagctctatttctagtgaagaacaactgaacaagttcagaagacaatgcataagtagtttgatgacaccgaagcacctgtatctgttcctgctactgctagtactccatattttagtcgaattctttgaccagtttgataatcatagtgtcttttct

SEQ ID NO: 38896 - DNA, 15221 bp, Oryza sativa
gtccgtttggctcccactgctagataagctctctgcttgctccatgagctgagcatgaggaggaggaagatgcagatggtgtgagcttgtggggaattgaggcttcatggtccgagatatatatatctctctctaggtatctcaaattagtagctacttactaattagtcttcctagttagattatttcttttccttttctttagtttcttcttcttcttcttccttgtttttccttttttggtttcttgagaagctctaagatgaggggcttcttggctagaggcttggggttctacctggtttcagatcttgatgccttcatggtcttctaagtaatgcaataaacactagtgttggaggtagcctcaagcttggaatgaatcgagttacaattcattgtaatgcatctataatctctgtgtttttgcatatgttatctgctgctgcaacttaacactccagtgtgcttttatgctgctcttgatgacgtggtacgagtaatatacaatcatgtggtaatttgattgatttatttattttttgcaagaagaccataccaaatttctttcagaaaaacaaaattcgtctgcagaaatgcagaagcatgtggataacgctctacacttgcggacaaaagtgatagtattagttttaatccttcaaacaattctaatgaaaatctatgctaacaggtgtacagcattaggctgaaaaatgcagttgtacagcatcaaatgcagcgaaatgcaggttttgtagtcgggacaaaagctgtgaagtctttctggtcgccaccagttttaggttgctaatcccagagggagtaaagtattcaacgtgacagagcaattgagagcgagagaaagtacaccagagagagcttaaaaatttgttactcctacagtttggtcacagtacagcaaggcgtcagaaccgttaaagttctctgaagtctgaagcgccccaacggtgaagtgagtggagtacatgcaatctctgcatcatcatcaaatgcgtgcaacgcaatccatctctgcacccaaaacgcaccgatgcttcggtagatcacgcacactgccgttacactgttacgcgagagccttgtgtaggagcagcaaactagactggcaacatagaggcagattcagagagtcagtactggtactacgagtaggagtagcttaagctaggcaggggcgctgggaggcaaaggcaaacgcagcgtgggagtagagtagagagggctgtggggtggcgtgccgttgtcctggcttgcctcaatgcctcccctccgagctctggctgttaaaatggtgcagggaatattcagcggctgctgcgcaggcagtggtcgtcgaatgcatgcactgcagcgccctgtgctgtgttgtgctctcgtatggccccctggctcctgcatccatcctctctcctctagctctagccctcctgccctgcgctgcctgcctgcctgcctgccgctttcgcttttgcctttagctgctgtgacaccactccgcctctctctcgcccgcccggttttgctggtggtggtggagcggtggatgcgagcgagcgagcgcaacaacagcgagccagccaagctagccactgatctcgttatcctcgtcctgttgctatcttgtgtggcgttttggacgattctggatacggggttttcaccccctccgaaaccaagggggccatggccgtggaattgtcatttgtgtcaatcacggcgcattccttggcagccattgttgtacggaatttctatttaaatccttcatagtaggtaggattagggatttttttacatagagatttcggtgtgtatcggcgattgtttccgttttgtgttgttcggaaacaaatcgaatcgatgctaccccgttttaaaatatactaccatttcatgttttaagactttctagcactgtttatatttatatagatgttaatgaatctagacgcacatatatatctagattcatcgatatatatgtaaatgtgggtaatgttaaaaagtcttataatatgaaacggaggaagtaacaattattctaatttgtttcagtatataataatttgtttacatctttattcgattctggttttgttttgttttaaaaaaacggtagcctcgatttgaccatttttccgacagtgtcttcgtcccgacagggctggcattccacagacaacccggcgcgacgacgaggcgatcgaatcgatggatcgtgcggtgacaagcgttcgtccgtggggttggattttagcgtttccctttgtcgagtttccatggatgcgtgcgtgatcttgacatgttgatcgacgccgcgggctgccaaagccaaagctggtgtgtagatgtgccgatcgatgaggaaacccatagcatatggcatggacggcggatcgacggatggattgacgtttgacaccactaactcacggagcgacgggtagtacagtacagtaggggcctcctcctcctccccgattcttcttcgtgatccgtgcacagtgcacgatgccctgcacgacgctacgcgacgatcccctcaagacacgcatcgctctgaacacgtctcatgtagctgcgtggcactgtgcatacatacgactacgtcttaccatatggaaacgaatcaacgatcgacttcgctgtgcgtgaggtggcatcaatagtacttgtagtagtgctgcatgcgatgcatgacagaggcgcatcagggagagacgtgcagggtgtagcgtagtgtatgcactgtacatgcgacaaggagtagcagtacatcgccaaaaacctgcgatcagaaaggacgctagtatcacaattttgatgtcgttcgtaccggctctcaaatttgaacgtacactgatgccctgacggagaatatcagaaattgtatgcagcaatagtagaaaatttgcattcacttcctgtagaaaaaaagtatttcctttcatgttacttatcatctcatggatcgtcctttcagtaatacactactccttgaaaaaaacatctcggcgtaccaaaaatttaaacttaaaattttgatatctcgagttattaagtaacaagaggtattaagttttactgcataataaaatatgtggtatctctcttggtattttttcaaagaaggtggaattaacactgatagtacagtacaaagacatgaagtatgatgcactccatgcatgcccgcccggagttgctggcagtgtactccaattaatcccatctcttttccccgatggtccaagatcaacaaagacacgctctgtgcaatgggccagcctctcgtggggacaaagtgcaaagtagctgaagacagtttgatatagattcttcagttcagtcccgggtgtgcacggcagtagtactagatatcctagtagtagtagaaagatcatgcgtgcttgcatgcatgggtgcagatcagatcagagcaaggccaaattaacacccaacgcacgcagggggagtcaatggttttcctgagcaccagggcaaagccattaagaggaacaggagcgaaaccgcagctgagttgcaacaaatgcgtagcagcagcagcagatcgtgcatgggcatgcaacgcggcctccggcctcggcatctcgggtctcagttgagctagcagacgagcaacagctggccgctaaagctcacggaaacgaaggcttttacgttattacagaagtttgcaggaacatgaagtggatagtagctttgacttggcagaccgtggagtacccatgcagttgtgcacaaggctcttgtacatgccacgagcacgtgaattgttacgagaaggaaatgtgttttggggttccattataatgcgtgatgaggacaaggcattgatgggtggtggcgctgcgtaaagcgggtgccgtaccctgctgcgagcaacgagtaaaaaaaaaagaggcagaggcagaggcaggcagcaaggatgggacgccggagtcagtagtggcaggcggacaagacgtgagatccgggagatgctgctgccgctgcctccgcgctcacagtcacagtagtggtgtgccgcgcgacgggacgggacgtgacaccgcgcgcgctgcgccgttgcgcgcggcggcggcggcgtcgcctccgtagccatacgcgcgcgcgtgcgtgcgtgcggctgcgccgtgccacccgcgcagaattgatgggtgggtcggcggctgcggctcaccccgtcggggcgtagagtattgggcatgcgaccgcgaccggcacgcgcgctcgcgtttcggcggggtgcgtgatgcgtcggcgtgcagttacgagtttgcctaccgctgcggcgcacgtaccgcgcgcgtggctcgcttcatgggagtgggactcgccgtgagaccgcgagttcgtgtcgatgcatacggcctcttctcttcacaatgcgcgtgagagacgcacgcagaaatgcgggagtagtagtttgtttgatgcaactttgcagctcttcgtcagtgaacatacatgaagtttaattttgaaattagttccaaccaagtcgttgtagtatagtggtgagtattcccgcctgtcacgcgggtgacccgggttcgatccccggcaacggcgtaatccttttttccccagttgatttgcttcaattgccattgtctgcccttcttttttcccacttgatttacttcaattgccattatctgccaatatcggattttcccccctttttttggtttacttcaattgctaatatgagctgatttgcttcaattgccattatctgccaatatcgattttttttttctttttttggtttacttcaattgctaatatgagttgatttgcttcaattgccattatctgccaatattggattttttttctctttttttggttcgcttcaattgccaatatggaacgatgaatgcttgttttctgatttgcttcaatgaccaaattatggaatgctgaatgtccgttcagtttagcaaagaactcatcaggcatatacagtctactagctacgatcatccacctgaatgcctgcacacacagcagtggtcaatgcaacaaagacgacattttcttgtcttttcattacaacattttatactcctgctgctgctctagattcaattctgacatttattttgccaggcaaaagggacgcataacaccaacacgcacgtaaaagaacaacagcccacgcgcggttcgcattctcgtccatctgagacaatcaaacgatctttttaaataatacattttctcagtctcagacaccaacggcgacgcagaaacaatttcttctatacctggtattccaaaaaaaagaaaaaaaaagttctatgcgactatgcctaagcaatctagatatgacactattaccaaaataaataaaagaagaaaaaaatgcattatctacatggaccaggcaacagtcagcaaaagctgagcgaattgtaagtctacctcctgagagaacaaagcatggaactttggcacaaaaccaatgcaccatctcctgctcacgccattgcatactccttccaagtggatctccatgttgccatgcaactccgttgctaccacaaactgtagggaagtgtcgtcgtcgccaccgtatttgccatcgaaaagctcaatgtcatcagctatgcggcctgaccgagctgtgcagcgcaaatcaatgcctccgggaggcagcctgagcggctggagctcaacagtggcctcgacgcctttcagaatcctggcgagcttcaggcgcatcattggagtagagcggttgccacaaggtagaatggacagctcattgactctggaccaatcgtgccgatatatactaggatgctctactactccttggatcagctcacggtaactgtcaatgccattacctgttctctttatcttcaggttgaactcgagcaagatttcaggattggtatgaatggctctccgagggctcaatgttggcagccgcaaaacaccctgcagagtaaagcaatatggccacatagagatttcattatttccgcttagagaagaagtcctgaaaagaaatgtggaagagatggagtgcatacatgtcgtgatacgacggtgaaagggtggcctatttctctgttgaaaatgtaattgcgccgtccatcacgtaagtccctaatcgcgacgaatccggatatgtcgagtttgcaggaatgaagagaatcagctacaatgatctcgagggtgtaaacttgcaagatgctgctgggtgcacaagtacaccactccaaacaaacaagtctaggatgcagattcctcttaggttgcaactttgctggattcaaagaattacttaattagcctggattatgatatgcaacatatgaaaaatacaaatcaggccaaagcaaacaataaccagtactcagacctttgtcttacagaaaagaatgtatgatttggagaaaaagtctgacacaagtgaatctgtctagttatttgaattgcaaagttggctccttagcgaagccccaagcggtaaccaaattcctcatgtgacataacacatggcctgatggttaaggaaaagtgcccttttcattttttgagtgttataatatatgttcttttccccctctataacactacatcaaggttggcacactgataactattgcttgcaatgaacacaaaagaaagccgcctattcatatggtaaactggctactactgctgattaacatgtgtagcctttctacctatattataaggattggtaggagttttctatgtgaccacaatccattttgctatatagagtatggtgattaagtccagtaccaatatatactgtattagtcctactgatcagtgatcaccacttttctacccaagataacaagaaatcagtatatatgtgtaaatattagtgctcatggagaagcagttcagattgatataagatgtgcacttacattccgatttgtcggacaaggtccagtagtataataacaccgcatatggctcatccgttgggagctctgcttttgtagtgctcctgctgcctgggttacacatgaaataattcgaacccctccttggttcctgcactggttgtatgattggctccatgaccagcttaagctgctccttgcgccactcttccctcttctgaatttcctcctcagttggaaacttgggtacatatggctctgaaaccttcgcccaatcagattcctcaggagattcaaacaacaagctgtactcgccttctccttcccctccccctgatagtgtcccaggtagagataacgcattaagcctcaactcctcgttttcttgctgcttctgctgatacagaagtccctgatcttcctctgcttctaatgcaaagatggcactgagtccaaaatcatgttcttgccagtctatccttgcggcatttagccggcaaagcttcctattgagctgaagaagcaaacatgaacatgatattgggttgttatcatcaaccttccattctagaacttggtgtgtccagttatctgctgaggtgaaggatgggaatgcacagctgttgtcatcatctccgcaatggatgctcaccgtgattccactccacccagtaagaacaacgccgtcgttgagccatattgctagattgtccactaggaacttgaaactaaaaatctgatccacctgcggtgacatcgacaccattgccacaggtctcaatgcgactgtcttgcctctttgttctgtgaagccatccatctttgggtccaaatagccttccacaaatcccactgcttgaagctccatcgtcgtcaatggcagaacgaacctgtcatagcaggcaagcctccagcgcatgtcgcgaggacattcttgttccacgaagctgcagcgaacttccccattggtgcccactgatagttcgaaccttcggtgcatcgcttcatcaggcgattcccactttatgtccccatggcctagaggaatgtaggcaagaggcttcatctccagctcctccctttccctgtccaactcttcttgcttcctcctctcctgctcttgcttctcgtgaagtatcatctcttcttgctcctcttgctcatacatctggtagagattcctggccagatcctccaatgcggccgtgatgttgatgaattcatggccgaccctagcatacagcttctcctccgtccatttggaggggatacggaaccatcgctcggagaaggcgatggtgactgttgagccgtcggggggcagaacgaacagcttgtcatggaggcgcaccgcgagtcttgcgatccacatgttggtagtgagggcaaggcggtcgcctccggcgccgggaagccgcctgatgacggcgaccaccctcaccggcggggagcccgccgccacgacggccgcgaccatctcggccttgcgggacagcccggactgcgatgtgctgaggcggaagcaggagagggcgcccacctggccgccgtcatcttccagctctaggcaacacccgtcggcggcgaggcgggcgaggcggagggggaacccgccctctcgctcggcgcagaagcgacgggtctccctgtgcgaccacaatgcctgccctctcttggaggagagcttgatcctgaaaagccgatggcaatggcgcggcggcgcggcgtccctctccttgccgtagattggtctagcgtactgccactcgtggagcaccgggtcgcccccctcgaacatgtcgaacggggcgaacagctgatccaatagacgcagatgaatctcctcctcttcctccttttgatgagccgctttctcttccagaaagatgggggatgaacaagcctccatggcttgtcgcccgcgtgtctgctactaccattgaatccgtctccgtcgccgcctccgccgccgacacgatcatatggaattgtttttcagaatctaaagcaaaattagccgccgccgccgcggctgcgatcttgacactgtcgtttgcgtcgccgccgcaaaaccctagaggcctagccgcgctttcggtcaataaattggtcgccacggatctctgtattgttggtcaggttcgctccgattcggaagaagtcttcaaagttttagacctcctcctcctcttgatcagccgcttcgtctttgaggccaatggaggtggcggagaagctctcatgggttggcacgcgcgggcggactatcatcttctccatcgcgccggccgccgcaatgccggcgctggggacgacgccgcgtcgaaccctagccgcttgccgcgcgcggcttctgttaatgcttaatgccagcgcggaatctccggcggatttcggagggagtttgtatcgattcacgtaatcgatcggagtctggactctggactagaagctgatcatcctgttcactggaacggttcgagtgtctcgttttctctcgggcctggtttagagcatgcccaacagattacttattctattccctatccttaaattaaagaaattttaaccaaaattctcatccaacagattccctaaccaacatcccaataatccaggttcccatattcgtatatgtcgttactcatttgcagggaaccattttttcttcccaatcgtggtcgtcgctgcctcgcgcgcgtagggggaaaattgttcccgcgctccttttctcgccctcctcgccagtcgccagcaacaaaattcctcttcctcccaggcgtcggcagcggctttccaggcggtgaagcaacggccaaccccttcctcgtaggcgtcgtcgactgagttccacgcggagatgcagcggtcgtccccttcctctcggtcgcaggggtcggcgtcggtgttgctccaggcagcgatgcagcggccatgcccttcctctcaggtgcaggcgccggcgttgctccaagcggcgatgcagccgccgtcctcttcctcgcaggcgtcggcgtcggcgttgttccagggggcgcccgcacgtcgaccaccgcctcctcgatttggggccgacggccctctgcgccccgcaccgccgcctcgccgtcgtctcggtctgcctcatcctcaacctccctactccggtgtgcaggcgacaaagtccatggagggacatgctccatgggagacactgaatcccctcttacacgaagctcctggcgtcgatttctccatagcttattctgtgagtgatgaagaattcctccataggagcaatttcggtaaagctatccctgattcgttcgatgtttagattaattttcagagtgttgcagcctgatctgatgtccattctgtgactgacttccccggcttgaaattcaggaattgctacggcttctctttggtgttccgttttttaacaaatcgcagcagtcaggacactggttgactggctggtgatgatggcgctaggtcacggcggcgcaggtccggggaggaagaagtcgatcagcgctggtgcgggagggagaagacgtgcacaagtaccgaactgggccccaccttgcttacgtggcaaactaacaaatgacagggaattgatttttaggcatctcttggaggagggggtcattgttgggcccaatttttattttggtattcctaattcagattttttgggaatcaaatattgggtgattgttgggcatgctcttagttcccaaatttttcttcaaacttttaactttttcatcacatcaaaatttttctacacacataaactttcaattttttttctttaaacttccaattttagttaaactttcaattttagcgtggaactaaacacagcctcggatgtactccaatattggaagaattctctagttactcctcctaaaatataagtattgttttaaatttgatatactcttcgagatgctactttgaacaataacatttatcttcgagatttgaacctcaaaccacgctcatttctcacggttgacctcgtcgagcagctagtcgccttgtgggaagcggtccggaatgtgcacttagacactggagaaccggatcagattgcctggaagttcacaagcaacgagcgctacacggcctcctcggcctaccatgcgcaatgttgtggggcgccgagcacaaacttcaactccttgatttggaaagcctgggcaccggggaaatgcaaatttcatgcttggcttatcatccagaatagagtctggacatcaggtcgcttgcgattagggggtggcaaaataacggttgttgctctttttactgccgcgaggctaagacggcactgcacctcgttgccacttgtagatataccaagatgatttggcaccttgtctctgcatgggtgggctatcaacagctggagccgactgaatgggaggaaacccagtctgtcaaacaatagtgggagagcctcgcaaacactcctagtgtcccaagaagggggcttcgatcgctcatcctattagtcgtctgggaaatctggaaagagagaaatcggcggatctttgatcataaagaggtggcaacgagttttctgctaacgagaatcaaagaggaggttagcctttggactttagcaggggccaaacggttgcgtgagttaatcccgcattctgtatagtgtacatctatagtgcttctctttttccctttgtcccttggggttatattttctcatgttcaattcaatgaaaaggcactcgtgttgttttccgttaaaaaaaataacatttataaaagtaaggtgtttatataaaaaaaagttgcatatattatgatagtttgtttaaatctagtaacaccaattttacatgattgatctttttaatttttttactatcaatagtcaaaattaaaaatgttaaacctgtcactattctaaaaatgcttatattttggagcggagaaagtattatgtgcggccagcagccaaggacaaagacaaagcatgttgcaattcttgagtaaagggaaaggagcaaataatgttagattcagagctctatccatgatctgcaaaaaaatatatcaaaatcgtccatataaatcaacaaattgatagccttgctaggtgggaaaagaagggatagccctgtaatatgaagctctgaacttgatcttgacttcttgctcctgtagatttagctgaaacaaaccaaaaatcatgcactggactactggagtaaaaaggtactactagtagccaccataattatcggcgaaagggatgtttagtttttcagcttagctcagaaaattatgaatatcccgaaacgaagatgtaactgaaatcaggagctaaaactgatttgttttccctagctgatgaaagatttggtttcatccattgagatccggagctattttttttttcaggctagcatgtcttcctttctcaagccatcatggaaaccacctcactggtcactgcaaagccagcagggagccaactcttctagcttaaggtattgtacaactctatattgtactcccgatattgaacagtgcaaaatgttgagctcagtgaatacccaattttattcacatatatacatatactgatattgaacagtgcaaaatgttgagctcagtgcttcacttgtttttttttttggcaatattgctgtgtatgaaatctgtgttcaattttgctgtggtccattttggcaataatacacatactcaaggcactataacctcaaggaattcatggagcaactgccatctgaactgcacatgtatcagttttaatcaacaagaatgaatttctcaggcaaaaagaaaacattcagttcactgttgtgtgagttctggcatgcaaagcatgtttggacagcatgtcctgatagaaaaaagaacactgaattctgcacgattcttcactggctcttgttccatatatgccgatttgcaatttgcaaccaacaatacagacagactacagacaaaatatatgatttcttccaattattccaattgacattacagacacaattccaatttgtcatacttacacaacacaaatttgtcaagctcacaagattctactatacaccatccagaatttctaccaaaaaatttggcactacacaaacacttaaatttgcatgctcacatggcaaatttctaccaaaaaatggatttttttttccgaactgtacagtgcggaagccctattgaccagaactccagaagttaacgcctcgaaccattgcatttgcatgttggatgttagaagttcaggttcagattctgaagttcagtttcactgtagctttgctgggacatctgaagagtctacatattcaggaaaaagaaagttcattactccaaggtgaatcaagattcagtacttgagtaactcaattgagtaactccgaggtgaatcaagattcagaacttgagtagtaatccttgtatgcaaagattacaccatgaactattagctgcaactctgatgatttactgctcaaactgcaaaaaatcagcttgctctcagaaacgcggcagcatgagttacaaggacctttgcacattccctgcaatatccaaacaatcacattcctttttttcctgaaaacatgcagtcattgagaagttcagaattcaaattcatgaaaacagaagttcagaacttcgagatcagggaaggttcagaacgcacataagcagcatggtgctcagggtgcattcacacagcagagtgcaattccatggcacacctgctgcatggacaaaactgcggagagcgatcaatctagttctcttgtcaacaacacatcgaataaaatatgtcaaaccaaaaataacagggaagaatgaagctagaattttatattgctttttatatccaccaaatggttatttacaaaagaaaggaacaaatgtgacttcccttcgacaatgaaatgaccaaataagccaaaaggtaacttgaacaaatgtgacttcacatggcaagtgattgatatccgaaatggatagtaggatttggatttgaacccgacaagttcacaacaatgctccaaatgaagttttaccattctttccatagctaaaagaaatttaatgtaaaccagttaactgcaaaaacctcaaatagcagagttttagtttagaggaaggaatgatccatatattatttggaacggcaccattagaaaactaccattgatcttttcatttgtcaggaatggtcctgttgctaggaacttgcaaaatagctgataaaagaatatggcagagcaaattttgtgcattcagaattcagaaatatgcttggcaactaatagccagatgtagcactaaaatcacaacatgccaccaataactcatattagtaaaaacccaaaagatggccatattgtaaaataatgaggcatgagaaaggttgaatctggatagcaacagaaaacctaccttttattttaaagaaacctagcattgtcttctccttcaacatatttccaaaacagattatagccaaaaaaaggcacgccacaaaaaacacagggacatttggtacagggcttaatatgtagcatgcatgatttaatggaatgccatggctttagaataaatatctacatgaaagaaattgcagaagaacaaacatagatatatcatatatgaaaggaagagtagtcatattagtacaccaaaaagatgaccatcttgtaaaataatgagccatgagaaaggttgaatctggataagaatagaaagcctaccttttatttaaagaaacctacaattttcttctcctccaacatatttccacaccagattgtagcaaaaaaaaaaacgccacaaaaaacacagggacatttagtacagggtaagtaatatatacatgatttaacggaatgccatggctttagaataaatatctacacgaaagaagccgcagaagaacaaagatagatatatcatatatgaaaggaagagtagagaaagaaacggaatgacctgaatttttttttttgtaatatctgagtatccccaaccattttcagtgaataagtgtaaaaggtactacattctgtccataggacacactgaagtctgaaatttcataaaaaatgttcacctgcaatataagtatttgcccaatagatgcctcttatcactggtttctaatgtttaggtgtaaatggttgcctacttatactaattcaagtgagattaccttcacaccaccgagctgacaatgttaaaaaggtgaat

SEQ ID NO: 38897 - DNA, 11290 bp, Oryza sativa
  unsure (1)..(11290): unsure at all n locations
atgtttgttacacctacaaaagcagaaacttgatattgtcacatgctcacaggcatagcaacagtgtgagagacaattattacagtaaaataatcagtgagagagagagagagagagagatgtaattttaccatctatatttcatcttgctccagattcttatccaatcctcagaagaacttgtgaacttcaggagtttttttttttggtctaatgtaaagctaatctggatgtgattgtagaagatgttatctaaatgactacatccagtcagaaccatatcgcaactggtttgcagcattaggggtgtcctaaaaaaagatgttctgattttcctatcatctgaatgttcagccacatcatcggtagccactaaattttataaaacaatttgttttataaaatgttctatgcttgaacaatatagatacgaaacagtatatagcatctagtatcatagattacatagctagaagaaaacacactgcataacgttgtgcagtttcacgcaggcattatctacatggaccaggcaatagtcagcaagagctgagcaaattggaagtctacctcctgagagaacaaagcatggaactttggcacaaaatcaatgcaccatctctggctcacaccattacatactgcttccaagtggatctccatgttgccatgcagctccgttgccaccacaaactgtagggaggtgtcgtcaccaccgtatttgccatcaaaaagctcaatgtcatcagctatacggcctgaccgagctgtgcatcgcaaatcaatgcctccaggaggcagcctgagcagctggagctcaacagtggcctcgacgcctttcgaaatcacggcgagcttcaggcgcatcattggagtagagttgttgccacaaggtacaatggacagctcattgactctggaccaatcgcgccgatatatactaggatgttctactactccttggatcagatcatggtaactgtgaatgccattacctgttctcttcatcttcaggttgaactcgagcaagattttaggattggtatgaatggctctccgagggctcaatgttggcagctgcaaaacaccctgcagagtaaagcaatatgcccatatagagctttcatcatttccgcttagagaataagttgtgaaaagatatgtggaagagatggagtgcatacatgttgtgatacgacagtgaaagggtggtccatttctctgttgaaaatgtaattgcgccgtccatcacgtaagtccctaatcgcaacgaaaccggatatgtcgagtttgcaggaatgaagagaatcagctacaatgatctcgagggcgtaaacttgcaacatgctgctgggtgaacaagtacaccactccaaacaaacaagtctaggatacaccttcctcttaggtttcaactttgctggattcaaagagttacttaattagcctggattacaaatcgggccaaagcaaacaataactagtatccagaactttgtcttagagaaaagaatgcatgatttggagaagaagtcttacacacgtgcatctgtttagttatttgaactgcaaagttaaggctccttagcgaagccccaagcagtaactgaattcctcaagttataaaatacacggagagatggttaaggaaaagtgcccgtttcattttttgagtgctaaaatatatgtctttctcccctatctacatcaatgttcgcacagtggcaattattacttgcaatgaagacaaaagaaagttgcctgtccacttagtaaaccagcgactactgctgattaagatatgttgtatttttatctatgttacatgaattggtaggaattttctatgtaagcactctatcatgctagttaatttcagtaccaatatgtattggtcctactaatgaccatttttttacccagtataacaacaaatcagcaaatatgtgtaaatattagtgctcatggaaatgcaattcagatgaatatagatgtgtacttacattctgatttgtcggacaaggtccagtagtatagtaacactgagtatggttcatgcattgggagctctgcttccctggtgctcctgctgcgtggctcagacatgaaataatttataccccttctcggttcctgcactggccgtatgatcggcgccatgaccagcttaagctgctccttgcgccactcctccctcttcctaatttcttcttcagttggaaactttggtacatatggttctgaaaccttcacccaatcagattcgccaggagattcaaacaataagctgtactcagcttctccttcccctcccactgatggttccccagatagggataactcattaagcctaaagtcctggttttctagctgttcttggtgatacagaagaccctgcacttcctctgcttctaatgcaaagattgcactgagtcccaaatcatgtcttctctttctgtcattgcggcatttagccggcaaagcttcctattgagctgaacaagcaaacttgaacacgatattgggttgttatcatcgaccctccattctagaatttggtgtgtccagctctctgctgaggtgcagggcaggaatgtgcagttgtcgtcatcatctccgctatggatgcccaccgtgattccactccacccagtaagaatgatgccatcgttgagccgtattggtacattgtctactaggaacttgaaactcaaaatctgatccacctgtgtgtgttcttgcggcaacaccgatagcattgccacaggtctcaacgtctctatatagcttctttgttctgtgaagccaatggtctctgggtccgaatagccttccacaaatcctactacttgaagcttcatcgtcgtcaatggcagaataaacctgccatcgcaggcaagcctccggcgcatgacgcgaggacattcctgctccacaaagttgcagcgaacctccccatcagtgcccattgatagtttgaaccttcggtgcatcgcttcacaaggcgattcccactgcatctccccatggcctagagggatgcaggcaagaggcatcatctccagctcctccctttccctgttcagctcttcttgcttcctcttctcctgctcttgtttctcctgaagcaccatctttttttgctcctcttgttcatacatctggtagagagtcctggccagatcctccaatgcggccgtaatgttgatgaaatcatggccgaccctagcatacaacttctcctccgtccaattggaggggacacggaaccatcgctcggagaaggcaatggtgacagttgagccgtcggggggcaggacgaagagcttgtcatggaggcgcaccacaaggcttgccatcctcatgttggacacgatggcgaggcggtcgcctccggcgaccggaaaccgcctaatgacggccacaaccctcaccggcacagaatcagcggcggcgagggctacgacctcctccctcctgctccaaggccatggcctggactcgaaacaggagagcgcgcccacccggccaccgtcctcttccagctccaggcgaggggacccgtcggcggcgaggcgggcgaagcggagggggaatccgccggcgcgctcggcggagaagcgaggggtctccttgcgcgaccacatggcctgccctctcttgacggagagcttcatcgtgaacagcaggtggcaacgacgcggcggcggcggcggcggcgtggggtgtctcgtcttgggtcgagcacattgccactcctccagctccggatcgcccgcttcccacggattgaacggcgcgagcagctgctccaattgacgaagatgaatctcctcctcatcctgcttttcgtgagatgatttctcgnnnnnnnnnnnnnnnnnnnnnaagctttcacgggcacgcacgtcgcgtgcctccattgcgtatgccggctgccgccgacacgatcgtatatggaacaatttttcagaggcgaatacgtcgaccggaaaatacctcgccgccgccgccgcggcgatcctgacactgtcgtcgcgtgcgccgccggcagccagaaaatctgggggttgtaaatcagatgcatatacgcgcgttttctgttaataaaacagatgcctgcacggggattaggcaggttcgtgccggttcgggagaggagagagaaagcggcgagattggttcgacttctccgaggagttcttcggaaggggagtatgagaaaaaaaaaaaggtttactatgtgtcatatgccattataaattccgtttggaaatactacctccatcccaaaatatttgatgcggttgatttttttaaaaatgttgacggttcatcttatttaaaaaatttaagtaattgttaattctttttctatcatttgatttattgttaaatatacttttatgtatacatatagttttacacatatcacaaaagtttttgaataaaacaaatggtcaaacatgtttaaaaaagtcaacggtgtcaaacattagtgaaggagggagtatgtcactgcagtttacgtgattgaaatcatactacattttaatagatgtttgagattacatcattgatgcaatttctaaatattttagaccaaaatagccttgtcttcttcctccatcaattatttatgtcctctctctaacctttcacctctagctacggtcggtcgtcgtccctatgcgacgcgtcgcacgcctccgctccacaataggctcatgcagcaagcggccacgacgctggaagagctgttatagggcacaaccgttggcggagatagaggggaccggtgatgccttcaaatccgatggcccgaccttgttgctgcagggacctcatgcctagagcttcgtcaccacacgacttggcgtcgttggagcaacaagcctgcggtgcacaggaagatcagcaccggttgcgatcctcgccatcgacattggctctagcactgtgaccagttatagcccgtggacgctgcaaccgctgctctcttccagctacacgagctcgctggaagagaggagagagggagaggaagaaggggatggatggagaaaaatggataatttggtcctaaaaatttgaaaaatgtaatgaatgagtaagtagtggtatatttcgaatatgtgtgaaatttcaatggcattgttctaatttcacaaacaataatagtatattttaaaacgggtaaatttataatgtcatagatccaattaagagagagagaaagtaggaaataacgcaattttccttcaatccaaagaaaatagtggaatcccatgaatgaacaaatatcagggcccctttaatttggaggaaaaacatagaaattttagaggatttcaatcatataggaaaatttcctatgaagctctttgaaacaaatgattgaatcatatccaatcctttgaaattcctatggaatgaacaatcctatagagatttttggaggaaatttagcaagagctccaacctcttgctaactttcctttgagtctatctctctcatccaattcctgtgtttttcctgtggttcaatcaaacggtcattcctgtgtttttcctgtgttttgcaatcctctgttttaaacttatattcctatcaaaattctacgtttttcctattcctacgttgtctccatcctgcgattcaaaggggccctcagaatgtgcactacctgcctctccggtcctttcaccccaatatctctttcctcctgaataaacgcctgatatgtttcgatcaagtgtttctgttggtatagccgctgattggccttgaatggactcgtgagctgtgcttattgtgactgaactctggagacttggagttgacccccaatttgttcatcggatgtgcatggaacatggggctactctactcattgcacgtccatccccaattccccatggatcaagcaaggaactactgctattatttcattgcagatcatgcagccagaccaccaccatattggcgctgatcgtttctgctggttgttgcagccagcaagctgggcatcctgttgcagcggtagaaaatgaacttgcattaggctggctgcagccagcaataccgatcagcgccattgattgcgggcgatatgactacaagaaaatatcgctgatcctctctctcacacacacatgtatccgaagatgttaccgtgaatcagaagtcatagggccgtttaaattagtgtcattttaaatcataccaatatttagtaaaattaaaaaaaatatagttgcatttagtttatgtactccttccgtttcacaatgtaagtcattctaatatttttcacattcatattgatgctaatgaatctaaacatatatatctatctagattcattaacatcattatgaatatgggaaatgctagaatgacttacattgtgaaacggaggaagtaccaaatagtgatagtgcataagaaattttggcacaacatatttttattctatactatcaaagtttgaaaattataccaagtaactaaaagttaaaatttgaaagattgatcttgacaattatctgaattgaacaggcacatacccactcaggaaacatctaggctctcacgccgtctcacggtccccacctgtcggcgaccgagcgatggaaggagcagcgagacggacggcacgggggcccgtcagggtggtccgtgcccaccgccacccgtgacgtttgctcgccatcgattgtgccggcggccgcaccgcccggctcggccggacacgtgtacgaccctccccgcgccgtgcggcctctgccactccccatcggacggtcggcctcgctccgcccgtgaccgtgtctttcgaattaaaggggggggcttccgccgaccgggcccgtccccccctgcccgtgctgatgggccggggctccgattaaaggaccatatttgcacataccaccctacactttctcgaaaattgtagtgctcgtactagtactggtttcttttgttgttctcattgagcattagcatgtgattattggctaatctctccttgtaaaccaaggatctgatgaagctttgaaaaagatccagatttgcagctggttttctaatcaacatggacatcgtaaggcgtgcacagctcttctataatgatcatgtccgtactactaccacatgtttaaaaattgtgttccacaagagacaccaaaggaaccattccttgcggtccagacccgatggcgattaaagtattaaaccaagaaaattaaaccggtcagtgaacctagcatgtcttttggcttcattgtttggcttattcgtggaaatatttgtaaactagaagtaatttattaataaaacttttatatacgtgttctcaggggcataaaagtaaagactgaaaactaaactttgataagaaaacctcaaaaccaggtttaaatttaaggttaaaaatttaaattttggctgataagtataaacataaacgaaaaaagataggtcagtttgtttgatttgaagagaattaaacaaaattaagggagagtaattccatatcacaataaacgtataataacttccctccaatatacttttcttatgctctatttccaatcttgcaaggaccctaatgtaaaagtttgcgagacacaaaaaaaaaatattttctttaactttcccatctctttcacaaatcacacacacccctcttaggctcctcctcatcttcttctcccttctctcgtcccctcctcccttctctcctaccgagtccagtgtcgaatagctagaggcgccggccgccattgctggcccctgcacgcgccgccccccctgcgccacggccgtcgccgccggcgggaagtgtagctcgccgccgccactctgcgcgcacccccttcgccttgctccgcccgccgccgccgccgccgccgccgccgccgacgccgaggtcgctgccggtgcccccgcgcgtgccctagccactccccctgccgcctccgcctccacattgccccgcccgcagctgacggagtcgccgccgtcgccccccgcgcatctggcatcgaaggcctcccaccctccaccgacgtcgctcggcttcgcggggaccctccggagctgtggccacaggttcggcgagggcgctgctgttggttggacgagctcgttggtggcctgatctgctcagtggcggtgcggggaggcacgacaagatccccgccggccggatcaggtggagattggttagatcttttggttggcatccgcggttgttggtccactcggtgctagccttggtacgctgcctcaaagccttgctgcggctatggttttggcgtgagaagctcggtggaagatgtggaaagggttcctcagcaagctgccccggaagacctcggcctctgggaggggcgccgacctcgactccggccagtgcagcaatggcgctgggaatgggaacccgatacagcgcaccagcagctgcggcagcatcccatctggccgctccacttccaccatcaagcgcatgtcatccgccatcttcccgtccagcgtcgtggctggtattgagccacttgtctcgttcaaggatgtccccaactcggagaagcagaatctgttcgtcagcaagctgaatctgtgctgtgctgtctttgacttctcggatccgaacaagagctcggcggagaaggatatcaagaggcagacgttgttggatctcatagattacgtggattccagcagttcccgtttctccgaggcggtgattgctgctagctctaggatgtttgctgtcaacttgttccgggtgtttcctccaaattacaggtccagttcatctggcggcggcgagggtgaagaggaggagccaatgtttgagcctgcatggtgccatctgcagcttgtttatgagctgctactgaaatttattggatcctcgtccctcgatgcaaaggtagggaaaaagtactttgatcactccttcattgtgaaactgctgaatcttcttgattcagaggatccaagggaaagggattgtttgaaaactattctgcacaggatttatgggaagttcatggttcaccgtccttttatccggaaagcagtaagcaatatattctaccactttgtgtttgagactgaccggcataacggaattgctgagctgctggaggtatttggcagtgttattagtggctttgcgttgcctctgaaggaagaacacaaaatctttctttggagagttttggttcctttacacaaaccaaaatcagttggtgtgtatctccagcagttgacatattgtgtgacacagttcatagaaaaggatcccaagcttgctagctcagtaattattggtttgctaagatattggccaataacaaatagtcagaaggaggtgatgtttctgagtgagattgaagagatcttggagacaatcagcacggcggaattccagaaatgtatggtacctttgtttaggcggattgctcaatgcatcaagagctctcacttccaggtaacttgcccaaataaatataacctatcgatgtttattttctgtttttgccactatgcatttccctcacctaagaaaaataatatataggtggtaaaaataatatatcggagtactacatatgaaagtagttgtggccctgtttgattgatcaattgccacgctgatgaattactatactagtcgctaactctaccgcttcacctagacattttattatataggtggtaaaattttatgtaaacatcactcagttgaaatggatcatgatcgtaaagctcacatggtatatagggtttttttggttgcatcatttatgtaaggtatgaaagcattacctgttgacttgccaaatggatgagataatagatgtctgatggtccgaaataaatgtggacaacaatagtgggccattatgttatcaactaatcatgctttgggcatggggttgctctgtactgttaatatcacaaatgtgagatatttggaccagcattaagaattgaagacatttgtctgccatgacagactaatgctttttatccaagtaattgcctcaacgagatgggttttttcaggttgctgaacgggcgcttttcatatggaacaacgataacgttattagcttgattgcacaaaaccgccaaatgatcatgcctatcattgttccagcattggaacataatagccagaatcattggaaccaagctgtcctgaatctcacagataatgtaaagaagatgttttctgagatggatgacgtgctcttttcggcgtgcctggtcaagtacaaggaggacgaagaaaggcaagcttcactggaatcaaagaggaggttaacatgggagaagctagaatcagctgcttctttccagccagtgacgggccatacagccgtcctggtaggccgccaaccctcagcaaatttgattgccacccttatttagcatgtgttcagtggaggtgaaaaattagcatgtgttcagtgaaggtgaaaatggggttcttcactttctggtgatgctcaccaactgaacgacttcagacttcactattttccccttatttcttttttatgtctgtattagtaagcagtgctgtaagttgtaactattttcgtatgtttatgctctgaaggcaaagcatgtatcgagtgcttaaactccttacctgtatctttgcctgtttatttatgagcaatttcctacgcctaaactcactcttcttctggtcatggttgctcaagcaacttctaatacgttgattcagtttggtagtatctcctaatgtggtattcttacaacctaaaagggcatctggtgtgcttgcaaataaaaattgtaagatgatctacgtaatgacccttgttgatttacatgccataaagcttccagtgtagcatttagctatttagctttgaagatttgttagtttacttggctacctgtgttttcttactgcctaaatgtgatcattcaatgtcttgtgtatttgaaaataaatacttcacttgaaatactgagatgcaaaagaagaatttgcaagataagaacatgaaaaagcctaaatgtgatcattcaatgtcttctgtatttggatataaattcttcacttgaatttcctgagatgcaaaaaatgaaaaaaagattccgttgccgggactcgaacccgggtctctcgggtgagagccgagtatcctaaccagctagactacaacggattattgagtattttttcatgtatagttatattcactaaggcacttcacaaacaactccgta

SEQ ID NO: 38898 - DNA, 7654 bp, Oryza sativa
attttctttgtttccaacaatagtctgacaagcaagcctccatgactccggtttctggcatatagacaagaaatacaaatagcagtcaattggcagctgttttggtgtaatcagaaaagcatatagcaacagaaagttcagaaaacagggaagcccagaaacagcattgcccaactgaaaaaaacctgaaatggaatgcttggtaccttcttcagataccggttctcagtgtttgttctttcattcaggagctccttgccatcaactatctgtgtcacattgacaattccaagctgtggttaactaatccagctacagtttaaagttgcatagctaatatcctagtaaggtgaaatgtttcagagtcgttttcagaattcagaccatgaacacaccatttgcaggttcggccaagcatcgaattgaggcaagaactagagatgccattggttaggcaagagagagtagggtacctcgacgatgcaagtgccgcagctgccgccgccgccgcagttcatcaccttcccctgcaaaaacaacaaaacagcaatgcaactctctctgttacactgcagcttggctagaagcaacctgacaaagtgacaaccgtagcaaaaatcttcagagaaatcgaggcagggcgagagggaaactcacatatgccgcgtagagctcgatcttgttctcgaccatgacgtcccggaggagcttctcgccgctgcccgccgccgcccggtccaccgggaacgacccatcggcatccgccttcggctgcacatcacccaggccatcacacatcataagaaggcaaccccaaccttccccatggcggggacaaccagccagtgacttactccgacgaactcgaggtcgatttggggcttgggcggcggcgctgcctcctccgcggaggcggctccggcggacgcgttcggcgaggcggcgttggagcacctgatgcgggccgcccggaaggggccactgccagagctagccttgcggtggcctcgggtggagacgacgcgggaggaagggatggccagcgagaagagcgccgtggaggtggagctcgtggccgccatggctttccttccccttctcttttggcgagcacgtggcctcgaacgagacggtttttttttatcggcaggaggcgcgtccacggtggaagcctcgcgcgccacacggttggctgcgttgcgtcgcttctcgcgggcttctttccgttttctctagggcccaaaccaagacgaggcgggccgcatcgttgccgtgggccagcgcacgcgcgtcttcccgttgttgggccgcgtgcatgcgcgaattgagattggaaaaagtacaccgaaggtccctcaacttgtcaccaggatacaaaagcgtcctgaaccgcaaaatcagatatgcgaggtccctaaactacacaaaaccggtcacctgaggtctttggtggttttgactccggtagtcagcgtgggacccacatgtcagcgtgccacgtctatgtggcgttctcttctttttagttatctttgctgcgggggagtagcatcgggcggcgccgcgcggggctgagcggcggccggcggaggcggcgtgcgatgggcggctggcagagagcagatgggcgcggcgggcgtgggcagcggccggcgagggaggagctaccaccggcggcggcggcgtcaccgcgatcccacaccttacccctccacctccacctccgccgctgatgtagcaaacatgcgcacgccgcactccccccatacacaccccgaacgcggcgcccgacgccgccgaagacgacgcatgctgacgccgctgctgctgaagacgacgacgactatggcgacgggttcgaggaggaggaggacacgcacctccgttatggggatcgctggtatcaagcagcaagcatccatcgtcggcgagccaccgtccgtcggtcttgtcatcccatcagctctcccgtcagcaacaagcgcatcttcatcagcaagcagcgagcatatccagatccacaggcaagccgcaagatccaacgccaagctgttaaatccacagacaagaagcaagctagcagcaacaagtagcaagtgttagcttcagctataatcctgtgccatattatcggttactgtaacgcgtctagcgttgtcgtttcttcagtttcgtcagagtctgtttctctgttttttttctcatgtaagccgagtcttccgggtcgtgcgtcgtgtgcgagtcatccgggtttcagcgtcgtggtcgcgtcatcgtgaatgatggcgtagtggtgttaatttgagtctgtacaaattggctatatatatgagcatcagaaaagtcacagcgagtaagcggcaccaaaaactctgttcgtgttcatcgttcttccgagaccagtgaattcgcgtgagagagagatagtgagtttacacaaatcttgggcttggctttcatttggtatcaaagccatgtccgctcccaccggcggcacgtctcgtactccccggcgaacaggccatcggctctcgccgtctcctccacggccacgcaggcgacagctcgtcgtgcagcggatcgttaaggaaggcggctcggtctcctatccaacgctcacacgctcaaattactctgattgggcggtgttgatgcgagtcaatctccaggctcaaggtctatgggatgctgtcgacaccggcgatgtcccgtatcaggaggatcgccaggcactttcggccatcttgcgagcggtgccggctgagattgtccggccgctcgccgagaaggacagtgccaaagacgcctgggacgcgctcaaatccatgcgagtgggcgcagatcgtgttaaggagtcccgagcatagaagctgcgccaaacttttgagtccatgcgattcaagaatggcgaacacctggaggatttcagccttcgtctccagggtgttgtcagcgatcttcgtctccttggagatgatctgtctgaagagaaggttgttcgaaaaattgcttcgcgtcgttccccggaggtatcgccaaatggctctatcgattgaaaccttgattgatctgacctcgctttctattgaggatctgactggccggcttctcaccgtcgacgatcaccccgactctgacggcgaggacgcgggtcaggcgctcttcagcgaaaaggaggcctcttctcactcaaacaaggaagctgggcataactcagccggggggagcgcgtccagctcgcggcaaccacaccgcagtgggcgcaggcgcgacggcaacggctccgacggcaagtcgggttcgtcccaagcggcgagccgcaatgtgtccaaggacaaatgccgttactgtggcaaacttggtcactgggccaaggactgtcgcaaggcgaagcgagaccgcgagaagctggctcaagcaaatcttctcatcgctgagccagctcaccccgcggacgaaggggagccgacactcctgatggcgcaagtgtgcgagcttgcccctgctaccgattctgtcattactgatggggaggtgacactgaacgaggaacgtgctcacgtttctcttcgtgatgaaggagagcccattgatccagactgaatccttgacacgggcgcttcaaatcacatgacgggctcccgtgatgccttctccgagcttgacaccaccgtgcgcggcactgtcaagtttggtgatgcgtcgagagtccggattaaaggacgaggcacggtgctgttcgcctgcaagaacggcgatcactgcgcactcacaggtgtctattacatccccaatcttcggagcaacatggtcagccttggccagcttgatgaggcacgttgcaagacggtgatcgaggatggcgttctcactctgcgtgattcacagcgacggctgctgtgtagggtgcgccgaggaactgggtgcctctatgttctccacgtcgagctggcgcaaccggtttcccttctcgcaaaggggaacgatcaagcctgggtctggcacgccagatacgggcacctcaacttcgacgcactccgctcactggcgagccgcggcatggcgcgcgacattcccactctggagcgggtcacccaggtctgcgatggctgtctaataggcaaacagcgacgagcgccgttcccaacagcggcgttgcatcgcgccactggtcgtcttgatctggtgcacggggacatctgtggacccatcacgccgtcgacacatggcggtaaaaaatatttccttcttctgattgatgatctaactcgctacatgtggctgtttctgctaacatcaaaaagcgaggctcccgctacaatcaagcggttctaggcaggagtggaggtggagaccggctgcaagctgcgcgttctccgcactgatcgaggaggcgaattcacctctgtcgagttcgggctatactgcgcgaacgaaggcgtcgctaggcagttgatggcgccgtactctccacagcaaaacggcgtcgtcgagcgccgcaaccagacggttgtggcaatggccagatgcatgatgaaggccaagaacatgccgggggagttctggggcgaggcggtcacaactgccgtctacatcctcaaccaggcgccgacaaagagcgtccgcgacaaaacaccattcgaggcgtggcacggtcgtacacctgctgtgcactactttcgcacatttggctgcatagtctacgtcaaggaggtgaaaccacacatcaacaaacttgatgatcggagcaaggcgatggtctttctcggctacgagccgggttccaaggcgtatcgtatctacgacccggtggccaagcgcatcgtcgtgagccacgatgccgtgtttgacaaggcagcgtcgtggccatgggcgtcacccggggaggaggatggggtggcgtcttctcaggaaaccttcaccgttcgctacgaggtagcggcggtggaagtgccgtcccgccactccgactccatgtcgtcgccggctcactcgggaccaccggcgccatcaatctctgcatcaccgggcgtcccagcggtcgagttcgtgtcgccgcctgcggaaacgcctgatgtcgacgacgacaacgtagggccacgtcgtttccggacggtggctaacatcctcgacactacctcgccaattgagctcgattccgacgagcttcatctggctgctgccgaggaaccaagtaaccacactgaggcggcacaggacacactctggcagcgagcgatgcaggaggaactaaagtccatcgtggagaacaacacgtggactctcgctgacctccctgctggcaagcgtcccattggcttgaagtgggtgttcaagctcaagaaggacgagacgggcgtaattgtcaagcacaaggcccgactggtcgctaagggttacgttcagcagcaggggattgatttcgacgaagtattcgcccctgtcgccagaatggaatccgtgcggttgctactcgccattgcagctcaccttgggtggtttgtgcatcacatggacgtgaagtcagccttcctgaacggagagctggaggaggaggtgtatgtcgcccagccaccaggtttcgtcgacgacaagcacccacatcaagtcctgcgcctgaacagagcactttatggcctgcgtcaagctcctcgtgcctggaacgcgaagctggatgttagtcttcatgaactcgggttcacgcggggcatcacagaacatgctgtgtacacgcgcgggaccgggaacgcgcggctaatcgtcggcgtctacgtcgacgatctcatcatcaccggcgctcactctgaaacaattcaaagtttcaagggggagatgcactccctattccggatgagtgatcttggattactcagctactacctcggcattgaggttcatcaaggcaacgatgggatcacaataaatcaatccacttacgcgcagaagctcttgaagatgggtggcctggcgggatgcaattcagcttgcgttccaatggaacccagattgaaactgacgaagaatagcgatcgaccaagtgttgattcaaccttttatcgcagcttagtggggagtctgcggtacttggtgcattcacggccggacattgctttcgctgtgggctacttcagccgtttcatggagtcgccgcgcgatgatcatctcacggcggtgaagcacattctgcgctatgttgcaggtactgtgaactacggttgcaagtttgcacattcaggagaagaggggatccatttgctgggattttccgacagtgatttggggggagatgtggacgatcggaagagtacctctggtgctctcttcttcctcggctcaagcccggttgcatggcagtcccagaagtagaaagtggtcgctcttgcctcctgtgaggctgaatacatcgccgccactggagcggcgtgcctcggcatatggctagctcgattgctggctgaagtgctgggaagtgatccggggaaggctctcctcaaggtcgacaacaagtcggctatctccctgtgcaagaatctggttttccatgaccggagtaaacacatcgatacaaggtatcattttatcaggcaatgcattgaggaaaaaaaggttgaggtggagttcgttccttcggacgagcaggttgccgacattctcacgaagccactcggacgaatcaagtttcaagagtttcgcagtaaggcgggcgtcgtgcagattgtcacccggcgacaagattagggggagtttgttagcttcagctataatcctgtgccatattatcggttactgtaacgcgtctagcgttgtcgtttcttcagtttcgtgagagtctgtttctctgttttttttttcatgtaagccgagtcttccgggtcgtgcgtcgtgtgcgagtcatccgggtttcagcgtcatggtcgcgtcgtcgtgaatgatggcgtagtggtgtcagtttgagtctgtacaaattggctatatatatgagcatcagaaaagtcgcagcgagtaagcggcaccaaaaactctgttcgtgttcatcgttcttccgagatcagtgaattcgtgtgagagagagatagtgagtttacacaaatcttaggcttggctttcagcaagctcccgctgtcgtcgtccatcaccacaagcagcagcaagttgtatacgccctcctgttcgtcttcaacagcatcagcaagtcggggcccccaggccgccgtcgatcgctgtacgccccgcgccgatctccgcccgcatgcgccgtcgccccgccagtttcggagttcggacgcgtcggcactccgcccgccgtcgcccctcttcgcccgcatgcgccattgccccactccgcccgttgccgccccgccggcttcgcgcgcgtcgctgctccgcccgccgtcgccccgcttcgccctccgtccaagatggactgtttcttgtcctccgtttgcacgccacttaatctctaggtacacatcgatgatatagatagatgctgctctgtgtggttgaggtgattttgatctttggttggatgcttgatgtgctcagttcatcgacgtggcgtcaaggtggagcgggcgaccacgacggcggcggcggcaaaagggggcgccgctggggaggatatcgcacgccggggccagaggcggtggtggtg

SEQ ID NO: 38899 - DNA, 13039 bp, Oryza sativa
  unsure (1)..(13039): unsure at all n locations
ccatgctccgcctcccgacctccgcgcccgccaccgccgaggccgccaccgccgaggccgtcatctccgagctcgcctcgcgtcgtgcgccgacaccatcgtcggcaacgcgttcgtccgcggcgtcgcctcttctgcgccatgctccgcctcccggccgccgcgcgctcgcacgccgcctccgccggccgccgctcagcacgctgggcgccgcccgttgctactccccgcagcaaagagaactaaaaaaaagagagaaaaaagaaaggggaaatttgacgtggcacgctgacatgtgggtcccacgctgactcagccgccacatagaccaagatcggtgttaaaaccaccgaaggaccttaggtgaccggttttgtatagttaagggacctcgcatatctggttttgcggttcgagcctccacatagaccaaaatcggtgttaaaaccaccgaaggaccttgggtgaccggttttgtatagttaagggacctcgcatatctggttttgcggttcgaggacgtattttatcccgatgacaagttgagggaccttcggtgtactttttccaattgagatgggatggtttgggccggttcttccagcccattcagatcgagttgcattgaccaaacccccgatgggactagctaatcgtttcaaattcagcggcatttgtgcctacctgagtgctaagtatatggtgattctctgaagatactccaagatattcttctcggcaatcgctgcctgagaaatatcttcatgtcagctagtggcagcgaagagcacattgcatggcgtcatggcgatgttgatatgaggcaagcttaccacttgctgcatggcactatgctatattgctatgccatctactggcactgtaacacggtgtctttttgtcacaaacgacattgatcccaacctgaacaatgctagctgcgagcctgcggcgttggccagcatcaggccggagatgatgcacatatatggaacaatccattgatgatgtgcacgtgtttgtctgcaaccttgcgccagtgttctgggtgacggttgtacatgcatatggtcgatcgagccggccagaggtggtgaatcttgaagatatttggtgatccgatccgatccaatgcagacacttttcatcttatcatcatgttctaatacattgacgtgtaatccttttaacgtgttcgcgaaatcttcatcatcatggggtgcctaattcgatcatgccgcgtaatttatcaaaacttctacaatattgttcaggacaattctcaactgatcgatttcaatggaacatatacatgcatgcatgctaaactagctaaagtaaccaacatctcatcatctagctagattcttcttcctcttcttctgaaggatcatcatcatcatctggattctggatggggaagaagatcacttcctgctcctgcatgcatggatcaaaatatcctgcagggttatggataaactcgaggcaatgactggctgttgcgtagccaattgtcgcagcagccaccactgtccactgctgacacgaccggccggtgttgggtaccaacgacagcagatgattgtaccaccacattggttgccatcagttcagtgcattctctcgtcaacctggcctctctttcacaggcagcacaccgaatcgcccagcaactagcacaccggaaagaaactaacttaaccttcagtaggagtcatgcattgacgtcgcccttgatcgctagagctagctgcaactcaaggagaaatggaacacctcaagcagcttttgtagaaccaatcaatatataattgtgatcagtttggatgtaattgcgagccagggcataaacgtcgccgcacactaatacactatcatattctaatgcaggagttgcagaatattaacccattgatgccaacttggattattctgtaagtaatatgcacgcatgaacgtgtgttagttttgtaaccatgtcatgtcatgtcatttaaagtccaaattaacaatgtgtgacgcatcaaaaaaaaaaaacaatgtgtgattccttcgctatatttgtgggcggacgcaggctagtcgaaaccgtgaagggatcaactgatggcgaagttttagatcagtggatatttgcatgattaattagttactcgatctgacgacctgactttgtcgttgcaaaggttgcagtagaacggactaatttttttctctctttttttaaggaagaaaatctgggctggatgatacgtacactatatccactttactttttgttatggccggaccttgaatctatgggaagattttgtagctgcagccaactgtttaagcaatgagatacttgtctggtggttgcccactcagacgtgtccaaagatgaaaatgatatgggatttcatggcatcttctcgatcctaatatattgacaggccaagctttaatgtgatcgtgaaaattaaaagatatagaatattgtagctcgatcaactataaatgagttgtcaaggctcaacaataggctgacatggaaagggatcatctaacttaattattatgctgttaagtcactgccatgtgagccgtaaaaaagtgaaacccacatgttaattattgggggagtatctccggatcaaaggaagctagcctccgaagggctgcagcgctccggagaaccatcctccccgggagatgaccgtgagtcatggccatgtcggtctgcagatggcccctcactccggaagcctcggggatccgattcggatcccacagtgcgagaggagcaggacctaagcaggctccggatgatggccgcccggctccgggaaagctccgggaggtcatagcaccatgggctccggtaccaccaaaggtgactgggctccgaagcccagaggggttcccaaagtctggaaggagagctccggaggctaccttagggcgtgggagctccgaggggcccctaaagcccgatatgccggccggagcggatcatatctcatgtgctctcacaagacaagccaagaaccaggcgctagtggacgtgaataaatgcgtactacgcgccccaactaactctgacactgttgatggctgccaagcggagcacgctattacccaggggatgcctttacccgggtaatagcgaggtcgctcggaaacagcggtgcccccatgctgggggcagcactcctgtcctctgtcaaattaccgctaggaccaaggtgggcccaccggtaagtcgcataggcatatcataaggatagggacactgaggccttttcctcttatgtatccatgtaaataaatacttcctccgtcccataatacttgtctttctagcatttaaaaattgtcccaaaatagttgtcattttgaagtactacatgtcacatcaaccatttccaattcaaatttctccccattctacccctaaccaccattccacatccaactatccattattaattaaggggtattatagtatttttcttcaaaatattagtatatgctaaacaacctataacgacaagtattttgggacggaggtaggatgtaaatatcacccatagagggcagattgaatacatgagagaaattgagacacttgttgaattcttgcaacaacattaatgactcaactatatatatgtgtctcagactcgttcggtctaacgtatatatctagtggtatttttcaaactctgaaacttctatggtggtgtttatgcccgaatgtctttatttccttgtttttctcatttatgatcatgtatattttagcagttttaaattacttcccattttagattttccataagttaaacatgtctatctttgactaccaacatctacaaatctaaaaaaaaatagtttgacaacatgtgaagtatatattatgaaatttttttcaaggtgaatctaaaagcatactcctaaatcttatgatgttaaattatataattttttagaaaccggtagtcaaaataaatatttgacttaagatatataggtaaaactataacaagaagtaatttgaaacaatttttttggattgatcctatatatctatgtgcagtaaatgtatactctgtatatgatcgattgactatttgacttgtaagaggatgtatatacccctatatatctacttgtgaattatactctatctattgactacagtgtctcgaaaaaatgtcatgcatgcatagacatgaccactagataatggtggaaaactggaaataaatcagttaatactgccatttatgaggcttatgtgattagaggacgcgtctgagaagatagcgcgattatgacatgctgatgaagagagatgcggcatttagcaggcgatttgtacttccttccaatccacgtacccaatagataagacgttgctgaatgctgatcagcaccgggcggattgtccaattaattgtcctcttttggctttcatgttcaggttgggtaacactaggaaacttaaagaaataatctggaccggtgatcccgaagatcacagtacgtacatcctccgataattttctgaatcgtagttaaacatgcgaaaataattgtaaatcaaaaacagaactcgaacttcagaaccagcaatgttataactcaactgttcaatcaaagaataggttgaaaatgacaaactgatcgagcatcataaggattttgacatatgcatgtgtttattggtatttccagtgatcagatacaagagaagtcattgcctcattggcatctagagttgaaaattttaatgttgaatacgtctagagaggaaattgcattcttacttctattatctaaaaaacatctgctaagttgacaatgacgatagctacattttccgtttgggatgtgattatatatatgtgcatatgcagagaaaaacctctatgttcttaccacacttattgtcatttttcctgtggacaaatctacccattggttctggagccattagtcgggttcgatgatctgtatcgtgatataaacaaacgagagaaaaattataaatagaatggtacatgagtcatctgaattactccctccgttttaaaatgtttgacaccgttgactttttagcatatgtttgaccgttcgtcttattaaaaaaaattatgaaatatgtaaaactatatgtgtacatgaaagtatatttaacaatgaatcaaatgataggaaaagaattaataattacttaaaatttttaaataagacgaatggtcaaacatgtactaaaaagtcaactatgtcaaatattttgaaacggagggagtatttaactttcatctttgtaggttgacgacatctatatctagtttctgaaatgttcagaactaggagcacccctgcacttggtttctcaggctaaatcctttgttctgtagcgtttcagagtatgatctcacgagtagcatcgtgcacatatataaagtagtaacatgtttatgatttttaatttttgcagagatcagattcctggtcccattcttgccgtgcttgacacatactcttctggaggcagcggattcctgtgtagctaggtaggctgacctgaatataccagtggatacgtgcagacaacgagcaatatattaatcgtgatagtggcaaattcaacgctttcacctctcactaatcgcagttgcaacccttcaaatccctttcgttcacgtcaactctttgggtgctactagtggtcgagaataaggggatttaagccaaccttgcttggtcaattttgtggatcacggtaatgcgattggttgactacttaagcagttgtggatacgtcttggtaactatcatgtgtaaataaagttaattacttcattaccgacgaactaataatcaaggtgtagcttgcaattgttaaggcttaaattatgtgcaactgattaattgacatactaattctttgtgctcggtagcatgattaatcacattgattcgagcccagaaattattgaagacctctctctatcttcccttttattttatttttaaaaagaagcaaattcttgaacttctcatcttaggctttggtttagcattcaattttgcagagaagcgttgttttgtccatagaaatttgtcatgaatcattgtctttccgttgtcacaagccgttgttgtaatctgcaaggagatatccttgataggacagtaacaaggggtatatagggcatgtttagattgatgcccaaccaaaattttggtagtgtcaaattttgggcaagttttggtactatcaaaattttagtagggtagagttgaaaatgtttatttggattgaagccaaaatttgcccataagagacaagttcataggcaaagccaaatttatggcactggtagagttttagtagagatgtttggtttgctaccctaccaaaattttggtagggcaaattttggtagggtagcaatttaaattggcccataattttaacttcgagatcttgtatttaatccctaactcgctacaatttatacttaaaaagtatttagaagtacgactctcctccaaaatctcctcctgtttttgttgtcgcctgcacgagtgcacgtgtcagcttgctggtgcaagcgatcaatcggtgaccgcctgaccagccggatcgagatcgatcagatcaggcgccgcttgcgcctcagctcgagccgagcggatagcggcgttgtcctacgtgcaaatggcgctacgcgctaatgaacaaagaacccaacaaatccaacgcgacagccggatcgatcgccgttaaacttgtggatcgataagatgatgatgatgagaaaaggtgaaaaacaactgggtttcgccgcctaattgagcgcgcggctttggctccccgcgcccgctcgcctcatcggcatcgccgcatcgccggctgtgcctcgctgtcgccgtggcccccgccagccgctccccgtttccgcacgtcgctctcggctcgctgcagctgagctaaaagattctgctttagctgcgtcggattacgggctttgcggtttgcgatcaacaccctctgaagatgtaaattatcgcgcattttgcccatagttttttttcctcttgtgagggttgatggaagattgtgagcttttgaagtctacattgtgtaatcttcatataactgtcatgcagttctttgtaactttggatgacagtatagaaatatggttcaataattatgtgctttttatcttgtgttgatgttcattcctttgtgtttgctttaattatgggagtgttttttaagtttactttgagatacactcgcttcaagtaatttgatgtaataattggctgtaactcgctaggtaaaggccgggatgattttatattccataattagaaaaaaaaacttttttcaccacctgcagactgcagttacatttcctaccaaaatgcatgccatttgataaaattcttagttataataaatttaggacggaggagtataatttatagcatactgtagaaattttttcaaattatgatatgtccctggaagtatttgctgtaaaacattggagtcccccctcccggccatgttgctttagaaaaaaaaacattgatgccacctacaaggctacaacaagaatcaacgaagaatcagagggagaaaaaaaaagaagtccaagaaaataccacacgaaaatctacgggaagatagggggtggtagcggctattgcgggtcccacacaaaataaccctataaaaatgagggcgcgtgctgctctgtagaacttcagagcagagagagaagaagcgatacacactacactaccacgaggtggagaggcgaagaagccgagcgatcggagaggggagaaagcggccggcgagccgcagttcgccggcgatctccatccatccgaggtgaagaggaaacgacagttcaaatcttccacagaatcgtgaggtataggaatctcagctttgtttgtttttacggcgtgatctgcttctactacgtgtgttcgtctccttttctgttcctcttttcccggtagatttctcggtttatccgaggagttgttggtcacttttagttatccgtaatacggagtagtacttatcttggttttatctaagatgggtagaactagacaattctgaactttctgcaagctaatgtgcagttctatattttaaaaaaaattctaatatttttttataatttaattaactacctttgttattatctctaacgttttctgttgcatttgcaaattttgtgtgcagatttaaaatagcagttctactctactagtagcggaggcattcgttcccgcgcgggcaatgtcggcggcgcagggccttgcgctgaagctgcgcgccgcgccggcggcgggtggcgtccgcggggagaagcggcgccgcgcggcatcggcgaccgcggcggcggcggcgcggcctcgccacggcgccatgtcgctggagggcgggttcctcggcggcgcgctccccgccgaggaccgggtggcgccgcgggcatcggcgtcgcgccaggcagaggcgggggctggggcgggggcggcgcgtcctcctcccaggtcgatgtcgaagatccccgagagcagcattgggctgtacgacccctccatggagcgcgactcctgcggcgtcggcttcatcgccgagctctccggcgagtacagccgcaaaacggtgaggtttccgcggctaagcacggcgctggagttgattgttcccgtgcaaacaatcgaaacccccaacgcggcgtgaatttctgatattctgaaattgttctcggttttgcaggtcgacgacgccatagagatgctcgatagaatggctcaccgtggcgcctgcggctgcgagaagaacaccggagatggcgcaggcatcctcgtcgctctgccgcacaacttcttcagagaggcaaacctacttgaagttttaagccgagaaatatgggaattttctaccgctgggggaatcatttttttttctgcctgtttttgtttttttgtgttctgacaggtcacgaaggacgcaggttttgagcttccgccgcctggtgagtacgccgtcgggatgtttttcatgcccacagatgacaaacgccgtgaaaagagcaagcttttgtttcgtgaggttggtgaccaagcagaacactagaacagttcagttcaatcctattgtaactgatatcatgataccattctcaatttcgtgttgtatctttggatttgtttgggttcatgcagaaagcagagttgctggggcataccgtcctcggctggcgccgggttcccacagacaactcgggcttgggtcaatcagcggtagatacagaaccagtgattgagcaagtgtttgtcaccaaaagtgcaagttcaaaggctgattttgagcggcaggttatttgatgagccagcacatttgaactttatggatttcatccgtagctgttaatttttccttgacttgttcttttgttgactgcaactccagatgtacgtcctacggaggttctcagttatgtccatacgagaagttctaggcgtcaagaatggcggaacaaaagatttctacatgtgctctctatcttcaaggttctgtgttaccatcccattaaagaatgtggtttaagtttccaaccttgggtaatttgaagcgctagccactaaggatttcagttatctgtattaagcaacagtaagctgtgatatggaataaaaaaaaacatgtttcagaaatgcttcattttgataacaaggaatagaagaaaacttttggatgtttttttttcctttgtgatttgatctcatctgaagtgaagtttgatttggtcacatgtgcatgcattccattttctgccaagtaattatttcctgaaattcggttttttacaggaccattgtttataagggtcagcttaagccaagccaactcaaggggtacttctttgcagacttaggcgatgaaagcttcacaagttacatggcactggtaagtgaataaccatttcaatattgtctgaacaacaaaatccatgatcatagtcagaagataggattactagcagcaagatttttgtgaggatatataatgcttctaagcaggcatcaaatatcctcttttcttttattaatattaatatgctatttccctcctgtttcgtgatgcctttggctgaagctgtagaaactgaaactgtgtcagctgatgcccaacaaaaaagacacttcagaatccttgtgtagttctgctattaggtactgctttttcagaatgtgtatcctaattaggtggtttgaacaaactttatttggcttgaggtagcttaggttctgaaactgttttacatggatgatagcatatggagcaggattcaaggatagatagtactggcctactgggtattcatatgaaaccatattgcatatcatttatatgtagttgtgcaaaagatgaacaaggtatagtttaaaagttatgcatgcaaacagatccactcaagattttccacgaacaccttccctagttgggatcgagcgcaaccaatgcgtgttttggggcataatggcgagatcaatacccttagagggaacaagaactggtaatttcactaaacacatctctcatcattttcttgtgagcaagaatcttcacatgcctatggaccatggagcttatatttatatgcttacttgcacttttgtcctatttccatgtttggtaggatgaaggcacgtgagggtctcttgaagtgcgagggactaggtctaacaagggatgaaatgttgaaacttctgccgatagtggatgctacatcttcggattcaggttccattcctttatcataatttacacatgataaaaataaaagcagtagtttgctgctagctctgtctctgaaacaatgtgtgtgtgtgtgtgtatgtatacatatatatattgggaatacgtgagacgcacatttttgtattaagagaaataaatgtgtatatttgggattccatatcccttttcacctgtcaaatggaagtatggccatctttgcaaagttatttattgaattatcttgtgaattcaggtgcaatcgacaatgttcttgagcttctcatacaatctggaagaagtgcgccagaggctgtcatgatgatgatccctgaggcgtggcaaaacgatgttaacatggaccctgagagaaaagctttgtatgagttcttttcagcacttatggagccttgggatggaccagctctaatctcatgtaacaagataaaactaaactctcttcttaatattgatgcatgcattatgatagataagtatcaattctgacctggtcttcacgcacagttactgatggccgctaccttggtgcaacccttgatcgtaatggtttgaggccaggccggttttatgtgacctacagtggccgtgtaattatggctagtgaagttggtgtggtcgatgttcctcctcaagatgtttcaagaaagggtaggctaaaccctggaatgatgcttttagttgattttgagaaccattgtgttgtgaatgatgatgaattgaagaaagagtactccaaagttcgtccatatggagagtggctgaaaagacaaaggatacaactcacagatatcatagaatctgtaaatgaagcagagagaattgcaccgagcatttcgggtgcacttccagtaagttaattatcttgctaacttttggagtgtcctgttggttagtaatttaccatgtaatggtgaggtattttatggatttttcacactttgctgcagattacaaaggagaacaaagcagatatgggtatctgcggaattctgactccgctgaaggcttttgggtaagcaacagcccaatcttagtatgtttcttctcatcctccttgttgaaaaattacctatttggttggattcaggtatacaagagaagcccttgaaatgctgatgctaccgatggccaaagatggacaagaagctcttggatcaatgggaaatgatactcctctagctgtgatgtcaaacagagagaagctgacttttgaatacttcaagcagatgtttgcacaagttacaaacccaccgatggacccgatccgggagaaaattgacacatctatggagtgcatgattggtcctgaaggtgacttgtctgaaacaacagagcggcagtgccatcgcctcacgcttaagagtcctttactgaatacaaatgaaatggaggctattaaaaagatgaactaccggggttggcgcagcaaggtgcttgacataacttatcctaaaaagaatggcaggatgggcttaaaacagactttagataaaatttgtgctcaagcacgtgaagctattcatgagggctacactattctagttctctctgatagaggtcagtaagattcagttacaccagactcactaagcatgaattttatgatccatgaatttatcatcatctagatatagattcatgagcaatagtgttagtatgaaatcaatattctccccaaaatctttacttttgagctgaattcaatattgtgttattgtggtatgaaagatatcaagatttttttctatacagatcatgaataagtatattttcgtaacaacatgttaacagtcaacatcttagtttcatcttaggttaggtcgtacttagtttttcttgctcctcttggatcatgtgtcaacatagctcagcttttcttcttttttttttttttgcatccaagctcagctttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 38900 - DNA, 1165 bp, Oryza sativa
ttactaatatacccctaaacacataatactcaacaactatagtctagacaaaagaagcatccagcatttgatgaaacagaacttgcgcaagtactcttaaccagattggcagatttcaagagaacatacagttttcagcaaccaccaggaactagggaacaatttgccttccaaaagacgagacaccaatgacaaacctaggagaatgaagaagcataatcaccactctcacagcatcacaagatatcctaaaaggcacgggcatcaaaatgttagcatccccactctgatcattgatcagcagcgggcttacttccttcaccgcctgtgtggttttccggcgaagctgtctgtggctcctgctgctgctgccctgcgctcgtactgggttcaggatggaagttgattgggaacttggtgactcggggcttgtcagccagaatgttcctctgcaccctgtctattagaagctttgccgggggttcctccctcagttgctcatcgtcataatcattgttcacatagtaacctactctcatgaactcctgtcccatgtaggaacatgtcaatagcagcacagtgacgccgattatgtcttcttcacggatctttgagggatccggtgggtcagcctaaaatggtaatggcacatcaattttgagatgcaaaatttaatagttctgtaatctgagtttaaggcttaattgaagcagaaaaaataaacaaggaacgaaagtgtggtagggtttctggatccattgtgcactataaagatattggaatcaaaatattagtattttagtatagcaaaaccaaatttacctggagtacaaaacggtaggtcccaacattgacggggccaacaagcacactctctaattgttggtcataattttcatcttcagcagatccaacatatataagcttccactccagatctaaaaggtaaatcaacaaacctttttatcatcacataccctcaagaaatgaaataggcaaattaaaagcacatatagcatatcttgccactgtccaacacgcatgttactttgtgcaattatcaacaaaccagaaccaatagagtagaggctagagaagaaaagcagcacatttcctgtctatcattgcacaaaagagaaacatctctgaacacttcaaggtccct

SEQ ID NO: 38901 - DNA, 8902 bp, Oryza sativa
  unsure (1)..(8902): unsure at all n locations
tgggacgaaaactccaggttgtgacaggcaaaatatcatttttttttctgcaattgactaagccctcaacaaaaacaatagaggaaaagtataaattcacagtcagctaccaggccttgcccagtagttttttctttattaggaaaatatttataaatatttacaaacaaacatgggaactgaaattacaaggtttgtaaccaatcaaaaaccaattatctgaagggatcattcatcctacacatatgtaggataacctcttttctgaaaccatggagtcaatctgagaaacttgggtctttcttcttaaaaaaattcccaattcgttgttttactgcgcattcaattgatgggcataaatttgtctgtgacatttgcgtaaagtgtgtcagctacactactagtctattatcgcatattgaaaaggggtagcaccaaacatcctgacaacagacactaacaagatcaatctataaactggtaggctagattcgatatcataacatactgccatgaggaacaaagaacatatccaacataataccaatactagagaactccgtgacaattaattttgcaacttgaactgatccctaactaaggcaaaggagaagctaacaaaacaaagagcatcaacttctgtctcggcgcacttctgcaagctgtggccaagcaactagcaaggtgccttctacgagaaatattagtctttcatcaacccatcgactaatttggtcatgaatcaaaagatgataaatgaaacaagtggttccttgagaactggcacatagctcaatggcaaagatcttgccttatatccatgtgacctgcgttcgagccctgctctcggtgctcaccattttgcctatgattaaatgctcagcagaaatattttacttctttcttaatttgatactaagttcctagttagtatcccatataattcttctctcagtggaaaaagagacaagactatgattaaatgctcggcagaaatattttacttctttctcaatttgatgctgagttcctagttagtatcacatattcttctttctaagaaaaaagaaacaagtaattccttagtttcgcctatgattaaatgccgggcaaaaatattttgattatctcttaatttcatactaagttcctagttattatcccacattcttcttctttcgaacaaaaaagaaacaagtgattcctctgatttgtcaagctggccaatgcataagaaacatgctagagtgtgtgcagcattcgctattagcctgccaattacacaaaacgctatcattcaccatgaatgaaatcaacatgatatattaccacccacatcacaaaatttatctggttgtggtggaaaaaatggaacccatggtagagtcatgcatcactccccaacttccggactttacatgctaacgacaacgaaaccaacacggcccaaagcccagcatcgccgaatcgagacggcacccaacgaacacccccaaccacacgaaaccctagcacgccgccacgcgccaacggaaccaggaggaggaggaggaggtaaggggaggcaggccttaccgtcgtcgagggggatgaggcactcgtaggagatctcgaactggaagggattgaggaaggcggtggggttgtccagcaccgccacgttggttatgttcaccgcgctcatcgccgccgccgccgccaacgccaacgccgccgggcggaggaagagaggagaggctcgccgcggaggcgaggaatcgcgcgcggccgcggcgatgggttggagagcggcgaggcgagatggggagggagaggcgagggcggaggagcccttttgtggagggtttatgcggcggcgggaattggggcgggaagccaaatcgggatggcgggagggagccgcctctcgcaggtttggagacgaacgggaaaactgagagggaggagagacttcacgagattccccattttagtacgcctcccagggtttacaaaaccaaaaccgtactattctcgtagttattacatgcgataatcttatcagtttttaaaattatgatatcactcgtggtaaactggtaaccgtgtgattttcatgataatcacgtggttaccgcggtaaccatcaaactataaaccccccaaacggtttggtaaaccctgcacctctctcggtccggcgattgtaacaataggtccatcctaaacggtttggtaaacccagcacctcccttgctcccgcgattgtaacagtagggccatctcaaacggtttggtaaatccagctcccgcgattgtaacagtaggatcaaacgcatactagaattggagagatttcacatgaattttggaagagtaataaaacaagtttggtaaattttggtgaattaactgcctttgattttggttcgatttctatcctcttatgaatgaattccatgaagagaagttttttctatgtgtgttatagtaacacttcaaaacacaaaacgtgatggcacaaccaaagaactgatgcaatgaatatacatgagaaggtttacatagttcataacagaatgtttgatacgctcttgctaagaattaaactcgcagatgtacagaagacgtcaggttttcgcacgcacaatgctcactgtttcaactttcaacaaggatgttcgcaagtcccggaagaacaccatactactattacacagatgagataaaaataaagggaacagctcgtggacacgtcgaaactcatccatccatcaccggaagacgtggaaaatagatccatggcacagtccggtctcacttttttagaacactgcaacacgaaagcgtggagaaatattagcaaatggtctaacaactatagtaacaagctacctcactagtatgactaaaagaaaatatgcaagaaatataattaagaatgtgggaatggtcttatgtcgtgtaaagagagaatgtcgagaagattgtttacttcggtattgaagcttgtctggaaacaaaaacacttacttgtaaagataagccgcaataccaagaataacacagagcaggacgatatcaatgcagaagttgcgactagatctcagctgataacagttcacgaggagaagcgaataagtatttaactcaagcaatcaaccaagcatgccaagggaagttagtgctaggtgttacctgaagaacggtctcttttagtctgacgttggtattcttcaaatctgtgttggctctatccacctacattcatcagtacaccatataaataagagataaataaactaagcattgctggatattgcacaattgcagaagaggaatccatggctattggagaaccaaccttctcgtccatttcatccatcaagggaacttgcctatccagttcctgatgatcacaaaaattgagcatggtaactatgtttcatataaccattgcatcgtatagtattgtataactcaagatgaagcacagcaaccaacctcattcatatcagatgccatgtttttcagagtttccagcccttcaccgataatatccaaaccttcatcctgcagaatttcaattccatacacaggtcaccttacataagaaatcccacttccagcagtagccaaaaatgaaaaggaagaaaagcgtgttcggggaattaatatattacctgtttcattttgcgcatctcatattcccgacgaaactgatttgattcttctgttcccttaaagtactcatcatcaaagttgccatctgtatgtggcaagcgggaaagtaggtcagctcatggctccttcaagaggaccaacaaaagcatctaacaggatcatgcccgaaatgatgagaaaagaaacagaaaaaccattgctcaaacaactttaggcatgactgcacgcatggttaatcagtcagctcatgactccttcaagaggaccaacaagagcatccaacaggagcatgcccgaaatgatgagaaaagaaacagaaaaccattgctcaaacaactttaggcatgatggcacgcatggttgatcaaaactctgtcaatctgatggttgtatatttcaacactgtcatactgatatagaaacaagagttacctaatcaaaatatacactaacatagtgtactaaaaagtagaagttggcacgtgacattgatgatggtgcggtaccaaaaatgacgtcgtaaaaaagcacatgtgcatatggaagcatgaacctaatattaggattccttcataaattggaaacgcgacctcatacacatgcaggatacttataaaatgaaccgacaaatgcaaaatgtacagcttactgcaatctagaacaaccgatgcgtaggggaagtagaagttggacacatctttaaagaaaaaaaatatgcatattttgtatatcaatatacagaacacacatgtgatatgttgaatgatgcttactaaccagaagtgtcaaacttaatggctccaccagtacgggatcctgaggcgccccaagtcccatttttctttgcacttgaactaccatctggtattgattgtattctatcgggtaaggcagcaaccagatcactacgggtcgcgagttcctcttttgtgagccctttgacctgttgcaagttgcaacaaaatattgaaaaccaattcttcaaaattctaggtgaaaaactgttatgtacaatttatagatatcatataattgaataatgtaaaagcatgttttaaaaatatagtataaccaacacaggcatgtatgaagaaagagtgtcaaggacatcacattgcctagtgcaaacatgcaggtggcgtggacagaaatctttagcaagggaacaacaatcttacaaagttaacactatggcaatgtcaagttaaaatgtagagtacattaagttctgggtcaacagaaaatattggaaggcttaacatcaactgcatcacctttacccaatagcctaattaaaataaataaatctagtctttaataaacacaggctactgaaacgatgaagagacctcatatggattgtgcacagcatatttgacgccaattacagaatacaatgtgtaaccacacgactatgtggtgagttcctctgtgagactatctagaccccagtttcacccgattagtgttcattctagcaatccaatgaaaagtcttgactcgttcatagtaaaatttagaaaagtctagtcccagacagtcgaaaccccaaatttccccccaaaaaatcaaacatagtccaccaatcctaaattccattccatcaacatcaaatggcccatgcaaatcacttcctcaacgacgagagcctccttacagtcatcctaaatttagacatccaccatccgcggtaaggtggaagctactacgagtactacactaaaacaaggagagaccgagtcctcgggccacagtatccgcagatctagcatgattcacccaaactaagaagggggagtgtatagatcagtaaccttcttcagcgcgaggcgctgcagcttgggcaggtcctcctcgacgagcttggccttggttcgccggatctccgcgttgagcgcgaccaccgtggcgcggttcttctcctgcttcgccgcctccgctttctgaaacaaagtgccccccagattcagatcgaggggaggagccagccaaccaccaaatcggacgcggagacagagaggaggaagggaattcgcatccagacctcgacgcattcgttgatgtcggcgtcgatggagccgtagaggcgggcgaaggggtcctcgccggcgacgttggcgccgttgagcctctcgacgtcgtacttgtcgtacttcttgcagatggagtccacccgcgtgaggatgtcgatcacgctcatcttcgcgcgcccccgatcccgatcccgatcacgatccctccgcccgcccgcgagcgagatcgaggcgaggattcgggaggaagcaagcaaccgcgacgctgcccttcctttctccgcccgagcaaaccgaagcagcgcacggtgaaagggggagatgacgagccgaaggtcagagaggctacagcctggccggccggtggcgatcccgtcatgtgggccgcaccaaccggcccggttagattggaatgggccgatttggatgaacttgggttgcatttgggctttctatatgggcctgaatttgaatttccttgggatgcaaaattctctcgaggaaaaaagtacaccgaaggtccctcaacttggcatcgagttacaaaatcgtcccccaaccacaaaaccggatacaacgcatcccccaacttataaaaccagtgcatactgatcccggttttagctgacatggcggctgactcagcgtggaacccacgtgggccccatatgtcaggatgccacgtcggccagcctctcccttcctttcctgtcccctcctttcgtctcgacttgttaggatgcaacgtcatcagcagggcggccggcggtggggagggggttgccagggtgagaggtccgacggccggcgggcgatgcggcggcggcaacgtggcggctgagacacgagagaaggggaaggcagcggaccagcgttgtggcggagaggcggcagcaggcgtgcgagtgtcgtggcggagagggcggaggcggtagctgcggcggagaggcgatggcggcggatgcgagcgtcgtggcggagaggaggcggcggcggcggctgccacgcgggagggcaggccgaaggcgacggcgtgggcgagcgtggaggcacgcgacggcgaggctgccgctccgcccgtcgcctcttctctctcaggtttctcctcgtctgggtgggcaggtcggccggcgggttgggaaggaagggaaggggttggggtgatggcttgctggagctgcttcggctgcagccggtcgatcgcagcaggaggcgaggtccggctgccggagccgttccagctgccggcgcccttgcccagctagccgcatggtctagggacttgttcgctttcatcgttcttcgaattctctccccgtttcttcgtgtactgtttaattggttcttaatctgctcataaattaatcgtcgtcatctatggcctggattgccggatagtatctttgtgcttgtaaattttcagcggctatgcgagagctcgtgccaaatttgatatgcgagagttttgttgtttgtttcgccggcgaccgagcaggacgggtccgggcaccggagcgacaggcaccgcgcgccgtcgcccaccgccacgcggaaacgaccggtgatgcggcagccgcaccggcctgccggaggaccgggcaaatggtgggcgaagcgggcaacgacgcgggccggagtggccggccggcggtgggcaggcacgctgcgggagaggaaggggctgcggcggcaggggcgcagaaggtcaggccgcaccggcaggcggctgtcgacatcgaccatttagagggcagagagaggacaagaacggggagaggagagagcggaggcggatggcgccgacggggagcgggatggggatagcaaggccgtcatcgccgtcgtcgtccatggcgtggggaggccgcctccgctccgcctgtcgcctgcctgccgccgccgacccgcctgcccaccggccgccgaacctcctcctctcccgcctcgccccgtcggcttcctccccaacccgtcggccggcctgcccacccagacgaggtgaaagctgagagagaagaggggaaagagagagatgacgtggcatcctgacatgtgggttccacgctgacatgtgggttccacgctgagtcagctgctacgtcggaaaaaactgaggtcaaaaccgccgagggacctagtttgccctggttttgtaagttggaggatgcgttgtatccggttttgcggttggaggacgattttgtaactcgatgacaagttgagggaccttcggtgtactttttccttctctcgatgccactggattgggccggtttggaccaatttgcgtgcattttgagctttccatgtgggccgtagtttgcattccttttttttttgagaaactaccagaatgcccgtatgttgcaacacgattttaattaattaaagaaaatatcattaatctattattataatcttttaattcaattgatgtagatatttgttcctgacttgtggatttttttagtctcacactctcccttttttttctttctcatgggagtggtcgatatgtgcagcgtctaacaccacatgtcctttttcttcgaaaaaagagttctcccttataacttttataaggagtatagatagtttgcattccttgcttgctgctttttttatagatataatttgcatttccttgttgcactgatcattagctcattagttcatcccatgaggacatgatgacagtatgacactacccagaatgattatttttcacttaatatttggagatttatctcgacgtcactgggtggcatataagggatgcgacaaacactccatatcaatcgaggaatttcctctcgtcttgaattatgactgatcatgacttgtcattagagaagttaaagaaaaagatgggacttatcaggagagactaaaaaaagagtagccctacgagtagtttagtgtgttttgccatactaccatgtgatggtgatgtcaaaaacatggggctcgcgtaaccgcaaaactaaggctgtcccagacacactaatcaaaagcattcgaatttagaactcctataatttgttagtttgtttaatcactctttgtgtctcatgatgattcatgcttgcataattgcatacacttctcgactctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 38902 - DNA, 4683 bp, Oryza sativa
agcatctatcaatacaaccatcgaaccaacggccaggattcgtttgcccttagaacacacgtcgtcacatctcctcctagggtaataacggatcgtatgttagttctgcgttgagtctgtccaaaatgacggtatagtatgggtttataaaaattttagcgaatatggatacggattcaaataatatgatatgaatacgaatatggtatccctaaaattcaatagatgcggactatcctatgaaataatatatgcataatcacactatctactctatatattatgagttgacacattcaatagcccaatttatcagttaccctattatcagcatgagctctcacgatctcttctcacgaccgcatactaccgtcacgcaccgacataacgcaggatgcaatgagccgcgagggaaacccttttcagcacttccccttccacctcctaattaatctctgatgtaggctctggtctcgtgatcttcaaggtacgtagcaacgacaccagcccaccacacacatggttaaaaaaaagtgaatattagagaatgatctaatatcaaataaatagaatgaatgaggcttcgaactttggtcggctaacccaccaccatgtggagctagccaaaagaccctaagcacttctcccaccacacaatggggttcacatcgtctgctgttgaggcttacggcaaacattgccattgcattcatccgtgccacacatccttctatcaacggctgtatgcagtgatcccaccatgattaattagggcctactaatcagcataattactaatttctcttttttaaaaaaaatcagaaaacagaatatgcacttggcggcaaagcgtgtgagaacaaaagtagagtagactgttttttttaagatttgataaattctatttttttaacttatatcagtctatacatttgtagggtgattcaaatggttgtgagttgtattctcaaggattttgttagtagcttcatttcgctgctagtttttggataaaaaatactctgtatggacatagtagtagtgcggcaatgctatttttgtcaaatgaatacttaaatagtattttataagatatgtactattgttcgaggatttggatagctctcagtataatagaagcttgctttgctgcagtattttgctctgctctgcttctatgcttgattgctcgcacgctttgccgccgagtgcgtattctatttgctgatttttttttcaaaagagaaataagtaattctgcttattagtagttcataattaatcacaatagtgggatcacttcatgcagctgttgatagaagaatgtgtggcacggatgaatacaacggcaaaatgtttgccgttagcctcaatggcagatgatgtgaaccccacacaatggttgatggtgtgcacgaacaacttgacattgttttatttacacacagcatctgagaattttaattattttccgaacaaattcgatatcgacccccaccattttcaacgtccgaaattatccctttcatatccgctccaacacataggtcgtagatactccctccatcctaaaatgtttgacaccattgacttttttaaaaatgtttgaccattcgtcttattcaaaaaaaatttaattaattattaattttttttcctatcatatgatttattgttaaatatacttttatatatacatatagttttgcacatttcacaaaagttttaaaataaaacgaacggtcaaacatattaaaaaaaatcaatggctttaaaaaagttaatggctttaaatatttagggaaaggagggagtacgatacaaccactaccaaaattaccgatctcactccaaactagaactcctctctctcctctccccgacagccgacagcagcagctgcggaggctgccgcgagaagcctccacttcgccgcgctctccacttttgcagcacatgccgcccccaaccactccatgccatcattcactcctaaagcggcgcgccacctccggcgcaagccaacaaatgcgctcgccacgcgcacgcccgccagcagcaaccacttcccactcaccacgcatgcagccgccgccaagaacccgcgatccggccatcgccatcgccggcgacggcgcggcgcggcgaggtcccccgccgatgcagccgcccgggccgccgccggtaaggcatggtccgccgccggtgcggcagcagcacggctactactacgaggaggagcagaggccgctgcacctgcacgtgaggacggcgaggtcgtcgtcgtcggcgctggcgtcgtgcctcgtggcggcggcgttcctggcgctggcggtgggcggggcgggggcggcgctgttcgtgctgttccggccgcgcccgcccgacatcgcggtggcggcggtgcggctgccggcgttcgcgtccggcccgaacggcacggtggcgttcacgttcgagcagacggccgccgtgcgcaaccccaaccgcgcgccgctcgcgcacttcgacagctcgctccgcgtcgcctacgccggcggcgagctcggctccgtctacatccccgccggcctcatcgacggtggccgcaccaaggacatgtccgccagcttcgccgtcccggcgttcgccgcggccaccccgccgtcgctgcctcaggagcagatggccgccgccgccgccgcctcggcgcagcagcagcagccggcggcggcggcggcggtgatggaggtcgactcgctgctggtggtcaaggggagggtgaccgtgctgcgtgtgctgacgcaccacgtcgaggcggccaaggtgtgccgcgtcggcgtctcgccggtggacggcaaggtgctcggcttccggtgctgaacaccactatggatttggatttggatgaaatccaaattaagccgaaattttgcgggaaagaatgtaatttaatttaaattctgcagaaaccaagcattcccgttaagtttctgagctccaaactggtggtgtaatggtagatgatgatatactatgtaatatgttccattcttaagacacggtgaaataccagagtatcagtagcattttagctcaaaggtatcatcaaggttgttcatgttctacatcaagataatctcaagttgttgcatgtaaaaaatatcatatttagcatagcatttgagctcaagacaaataggcccttcatacttaacgttgttctatctcaagttgttgcactgcatgccaaaatctctgactacagaagctgataatctggcaatgagaatgacctttctccagcagcataaccggacgtattcgattgcagctaaaacgtctgagtcacaagacattccatgcagctttggatggtatgtgccttgtccatccatcagcctgaaacatcaattcttacatggtgagtttgcaaagaacatataccatttcggaggtcgaaaagccgactctacacaacaattagccagaaatcggtgctgcaagaactcaaggacttcttcatccatcaggataggctgggtcgatgacgagggtttatactacaatgggtttagtttggatgatctttgttgggaggaataggcaaaaaacaaaaaaacaaaaaacaaaaagcacggaagaagagctacactactactcgcttgaatgggcagatgcgggataagccatcaaagcatctgttgagccagaatcgattcggggtgcacggagaactcaagttccagcaccgtaacaggaggcctgactgttactctcagtcaccatatcttgttcttgacccaaaagagcatcagtactattccaatcacaatggcaacaagggcatacttgcgaataagggcctgaaaaccattgaaggaaagccttgtcacagacgtgaaaacaggtgaagtggtaaactggtaatgcagatcaggtgtttgttatgcttaacagtccaccagtgatatgacatagataggacatagtaacgcatgagagattcccatatccctcacgtgcattggtgaacataatttgggggtatggcaggaattcatatgtttaacaaataaaggatgtagacatgttctaagcattactgtgtcaaattgatcgcaaaaggaccaacttagttgttgactacttgagcacaaattcccccccttttctcctcaaagagcaatgaaggtaaggaaatttgaagtggagttgctggaactaagcaatacaattttacggtttttgaaaataaattgcaattgcccatcgatcattctaggaaacaacggactgttgatgtataattttgagaaaagtaaagtgtcacaattctagaaagcaaatgagtagactcccttaagacttccatgaataaacagcagtcacgatttatcacatgtccaatattaattcacaatttattgaaatattaatttcatattagttgcttggagattgagattgccagatggcaaatgcagtaaagggaataagggatcacacctgacgattgagatccttcgccttctccgcataaattctagtatcagagatcaacctattggacatttcactcacctctgcaaacagaaaactttcactgagcaacagctgggaaatgtaaacctctaagcatgaaacgaaatgtgagatgagactgcaacaagtcttgccaaaagtgaagcagggctgcaggaa

SEQ ID NO: 38903 - DNA, 3120 bp, Oryza sativa
ttagtttcttaacatacggcattagtaacacaactttcctggcatcttggtgccattaacatccaagtatatgacgaaaggcagatgatgcatatagggcatagaatatacaagttcttgctgatgcaaaaattgggagagtggtagaccaagtaaaatgtctaatacaatacttattactcaccaattcactcactcccccataagcagcaagaatatgttgtcaatggaatgagcagttaaatttaaaataaagaggaaaactaaacagagtgtatgtatcaaccaacatatctagttggaatcattgtctttgctgctgcaattcaaatttgagcctaaaaccacaaaaagggtaaccatgagttaatcttttgggaattggcacggaacacctataaaaaaaatcatgagggaataatctttttcaacaggaactctaaatctgcagatagcataagaattaaggatactggaaaaggtatggcccagtctcaattgacatccttgatgcttcatgttgccctttcgataagttcttgaacaacagtttagcttgctgcttgtagaagtcagcatccttcagatcccgaccatcatctaatccctccactaacggaaggtcatcagtaacacgtgctatcattgtcagcttcaccattttggatatgcagcgtgaaatgaactagcataggcaatctgaaagtgccacctgcatggtaaagcagataaagggtagaagatacattagacatgtcccatagtcaaacttagctgcaaagttttaatgttcaatgtgaattctacttattgcaatgggccagatctagttttggagaaattccattttaatcactatgtctaaaccggagtgcaaatagtgctaccatgggattcattatccaactactcaaacagtaacagcgtaacacacattaagcttcctagtttcagagggcaaacgcaatccatacgaaagccaacagggatgcatgatagtgatcaaacaagctgcagcagaacaggtggaagtcgtctgaacttttgcattcttcaatcaatcactatctacacatgctaaaggcctacgacaaccaataccagtaaaactttagattataaaatataagcgcatattcgatattcttaagcttgacaggaacacctagaaattataaactaatcataccccctgcataacactagtgagactagtaacaacaatgttacgatcaacctaggaagtgcagaaacctgaccaaattcagccaaagtagatagctaacagtctgtgcctatagccctacagaccaatttccctgtaacactacataattgaccactcttgcaggtaatgaagcaaatatccgcttaatgtgggggcatggggtttcaactgaatccccaattatttttgcaaacaaactgctagcaaaacaagtcccctcaatgtcagtactgcaccaagcagcgaagaaatccggaatcaaaccaagggctttgttcggttaatccctaggaggaccacacctcactacgcgtggaactattcccttccaaacaaatcccatccaatctccttgggggaagattcaatcaccggatggatccccaatctacgcgccacgccggctcgtgaagcggccacaggagaaggggggagggctaagcgaggcgagaacgaatactaccttcaaaatttcgaatcgggccgcgaggtgggggcgccggtgggatgagccggccgcgtcgccgcccccggcgaacccgctcgccggcgatcgggggaggagaggagcacgtccgccgccgttgcctccggcgggagcagagagagagagagagagagagagagagagagagtaaagtgaaggagagaggtagatgaactgatgagggtgtgcacttagcattttggttgggtgaatgccatttttttttcctcaaaaatttatttgaattcgaaattcctgccactgtcgaaactcattttcgcccaaaggggggagtcaaataaagtgagatcgataactataagttttgttatagtaatatacatgttttctttaggaaaaaaattgcatagcgtgatgtttgcagtggtgtgtgcgcataggtacatatatattttatgtattatcagggaaaaaaaggttttaattttgatttgatctttgtgttacttaatgttttgagagttcatactaatacttatatcagctgaacatgtttaaagtccccataatttcatcctcaagaggaaactttaaaggtatcattcaattactttacacaaaattttgagacaaacccttgtttcaaataaaaaaacactgaacatgcaagatgttggtgagatatacacaatccattaatttacaacattcttcacttatattcatttacaatttacatcgagaaatgtaagaaggaccaatgatccttccttattattcatggaggcgatatcttgacacaaaagagacttacattacttacaaattcacttatcacacacactcgaaaccataattcacagtcatcttgaggagcatttcatttgaagagttcattgagatagcgatccatgatacctgagatggcttccatgaatgccttttcacctatcccaggaagaacaacatgctctgcctcttcaacaatctcttcaatctttgatttggttgtaatgttctccctacacaacatgttaccgatctcatatggagttagacctctcacagcacccttcttcaacatcatggtgcttagacgaaaaacacgaacacacttagatgatggttcacaaccattgagcttgagcaacttgatatcctcttcctcgtcaagtgactttatgtagtccagggtttcaacattgaaaggctggcgtgcttggggccagtaaagccaatcaaatgtgcagtcttcaaactataaattgtttagaagtcaaatcaattactaaaactaaaatagttcaaacattgtttacaacatgagaaaacaatcattgctagtaaccaaattaggacaaaaaatttagcaatggatattatattaaaatgtgtacatagtgtgtggtcgtgaaaattactccctctatcctgaaatataagc

SEQ ID NO: 38904 - DNA, 1718 bp, Oryza sativa
  unsure (1)..(1718): unsure at all n locations
tgaactagcggtacatatgtttagcgtcaagcatgtggcatcataagatttgaatttgaaagtacattcacgttatgtcaattttatagttattgatattaatactatacaaggaattaaaggtcaaagttttgcactgaagacagtgtaagaaacttatacagcttatatttttgacatggagtgagcaactctttatggcgattagtgactatgggtgatcatagatttcaattttcagtacaaaaaatgcagttcaaagcaaaacaaaatacttacgctttcaggcagacaatacccatgatcaattggtatcagctcaatctgcccattctcatccttacgaatcagtatgttgccgccatggcgatccgtgttagctagcctcatatccaaaacagcaatcttgtgcacctcttgcacagggaaagccctaggaccaaactcctcacaactcccagaattcttcacaaacatttgcaaggacccaattttcggttctttctccgcgcaatcatacttagtctgatcaacataaccattcaaacatcgaacaagaactgtcggaggaacaccagcaaaccctagttcatcgctcacgcgataaccactaataggatggtcaagaatgtatgctgcaacctccctgaatgcaccttcaccgactcttgttcctctctttaatccttccccatcactggacaaagggtagccattaggattgtcctttgccattggctcttcatttattggcttgaaaacagcaacatactcttggcctgatgaatctagcatgaagtagactcccccagtgccctctgaggacatcacaggtgtgtgctccatttctagcccagcaagtgtagcttcgatcatacccgtaatttttggagtaagggtaacacttgggttgacaagaactggttcaatcaggggatatttctccttggcatcatcaaattgtaaattgtttccaatgtcagaagaaatggataattgctcaaaagattcttctatttcatttccattaaaattttctgacttgtttgcaagaaaatcggtatcagaagtgttggtctcacaaatggtggagattaatgtgctttcatcaagcttttcaccattgaccaaagtcatgctctctccaataccattgggactttcaacatttcttgaaatctcttgcttcatatatctagcatttcgacgttggtccacttggaatttaaacttccttccataaacagtcctcacagcggttcgtcgtggatctgatagtcggatcacgagatgaagcacacttccatacctcaccccatagtcacggatatggctatcattgcgagagagctctctgccttcgaaaaccaacctttggtttctcgccacaaatcctttgctgttttggatccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 38905 - DNA, 1958 bp, Oryza sativa
aggaagaagattactatctggacgaggacgattgcatttatgatgatggcgatggatatgattatgaatttgatggcggtgactacttcaaccaacgtcttgctgataaatttgatgatttggatttgcctccaggcgtggaggctactgtaccttggcttcagaaaattataactaacgaagagcaaagcagttccaaattgacagttgaagatgaaagcgcaaataaaagtgcaaataaatctcagttgttcaaacagtttgacactgttaaaaatttctctgatcatcattatgcagcaacatcaggggatgtggtaatatgttgaatttgttgtttgcttttgttttatgcttgttttagatctgttatttcatttttcctccatgtttacattatattagacaaagagagactgggtgaagaggattcagcatgactggaaacttttggagaaagatctaccaggttagctatttgcctactggcatagtgagttagtttcttctctgcatggctgcacctgtgagttgatcgttaagtacccctttcacactaaccatgcattttgatgcaattagtgctaatagtttgctggtcaataatccagcacaagcattgattatgctgcttacactatttggtttattgactatatatgctcgtcatgtaagtgccatgtaagttgaacacaactgttcatggtttaaatatgtaacctgaatttccctttgagaaactagtatttcatcctgtccttttgataaggcttcatgtagatgtgatgctatttcctttcatttcctcttattgttttattctcactgtggaacttatgtctgcctgcacagaccattatcttttactactatctagtgagggtactaaagctattttccttctcaatcttagaacttacatctttgagccttgttaaagtgcaccttataagaaggaccagatttgatttttcttataacactatcagttctcaagtttgtttccaaatgttgtttatgttacacctgcttttcgtctgtaaaatatctttgggaatcctgtggtgggtttgtttccaaatgttgtttacattatgctgatcacctgccttttgtctgtaaaaattcttgggaatcctgcagtgagtttggaaatagtgaatgatgcttatgttaggatttagcatcctgtcactcaccattcatagctcatagatgttgaacatatcaggaaaaaaactttagaggaaattggacaaactatagctttctttgttgcagtgtattttctcattgtagaaatctgaatcctgattatttttgttttatgtagcatctatttatgtccgtgttgctgaagatagaatggaccttcttagggctgctattatcggacctaagggaacaccgtaccacgatgggctcttcttctttgatattcaatttagtaactcttaccctgctaatcctccagtatgtgcctaagtctcagcactgcttttatgacattttcacctttttattttgttgaaatatttgttgttgatgatgttgcagtcagtatactaccactctggcggactacggattaacccaaacttatacaataatggaaaagtatgccttagtcttctggtacctgggcaggtagtggttgtgagacgtggaatccatctcagtcgaccatgctacaagtgctcgtctccattcaagctctcattttgaatgagaagccctacttcaatgagccaggatatgcatcctacgccaatagtgtatctggagagcggattgctatggagtataacgacaacacatttctgcactcatgcaggacgatgctctactcacttcggcggcctccagaggtaatatttttgttaatttttgcatagactctaaagctgaaaagaaaggatatttgtcactttaatgcaacctggaaaccctgtccagta

SEQ ID NO: 38906 - DNA, 1692 bp, Oryza sativa
agacggagggagtactgattatggttagcacgcagaacatagagattgatggagggttaaaggttattttttcttgaaaataatgattataggtggaggatgaaacggagaagtttgctgaataaacacacatgatttgatttgactatagcttggtgctggattatgttaccaaccctacttccaatttttaacatcacaaagtagaacagaaatcaagtttccaagccgctttaacactcctctctttgccccctcgcagcacttcgcagaccttgttaccagccacttcagggagcgcgggcacaccatcctggcagcatgcaggtactacatggaaggccacaaggtcggatcggtggtccccgaagagaaggagccggagtacggcgacgcgggagcatccaccagcagcgccagcgccagcgccgccgccgcgctctgaagccgcggccggacaaggtggattccgtcagtagacgccccacgttcaacgacaacctcaagacgctgttcgaggagctcctgatggagttcaacgtgaagggcgccgacacggccaagttcctcgccgagaaggtgaagaagagctctggtgcaacaactactgcgcctgtaggaggcgcccgttatgcagcagaagtggtggatgagtggatggattagtctgctttgcctaactgcagagaagttaatatctttctctctcttttttatttcgtagtacataattagcttatggttgctaggactggactgggctgaacctgttgaccaagatgatgaattaaatagatatatgcctatccatctcaaggctcttaagacatcaaaaggttgtccgcaatctcatgttaacatgtacgtacatatgatcgatcgagattgacgtgttcctacttcgtagggtgcatagcaagtgtcatgtgtaacgacgtacgtatctttgtttctactctctgaatacatggagcaaatcaagcttaacatcaaaatctgaaatgataaacattttgcactgaatccagggtgcatcatccaccaatcatactcatacatgcacatggaaacatctcatacatgcacatggaaacatctctctcactacaagtacacccaaaaaccaaggcgatttcatatagatctacctatgtttatctgtcctagttgaatgtgcaatctacccttcttcactcacactaccatgcatgatcactcttaacttacaaagctaaacaccaaaaaaccttcttgtttacatcagatgatgacccaggtgacatccaaaacatcacattgcatcgagcggcaagcgatcgatcgatgatcacctgaaccaaggcctcgcattttttgtaattggttttaaaacacgattaagtttatactctttatcgggtaatttgcatatgatgaagatcatggcgtccggtgaccacctatggcaccgtgatctgcacgccgccgtcgccgcggcgaggagcggttcgggcgaggaggaggaggccgtccgccgcgccgcgctcccggtagctccagaacgcggcgtcgttcacggccgccggcggcgtgggctggcctcggggccggcggagcagcagcgccatgccgaggccgccctcgccgcgggactcgaggcgcgcctgccacgcggggggccggatggctcggacctcgacggcgtcgccgtcg

SEQ ID NO: 38907 - DNA, 14395 bp, Oryza sativa
ctgcacccctcattctctctcctcgtctcgtctcctcgtgagatgagatggtggcacttggcacccacgccttcagccttgttgttcttctctttgagggggggggggggggggggggggacaccaccattgcaactataaagattagcacgtataacgatggtagtgttgtctcgccacgtcaggtgagacggtgcgtgtgaaccggttttgtatctttgagacgcgcatgggtttatttgtaggtttcctttttaaaaaagaggtttggaaagatctaaatgttgctaaaccgagcgtgtaaagttggggttattgggatggagaagggtggtagtgtgatatggtatgcgcgagaaaatccagcgaggatgtgaaagctagcactggccacgggtagcacctcggattagagcgaagcttatcgggtcacatttgtctggtgcgcaatagaaaacaactccgacacatcactcaaatatgagggatagatcatatgcatcggtctgatggttattttctcagtggaccccatatttaatacccaaggtgatcatataaaacttactttacggtgctctctaatctaatagtgttgtgttacaagtagaaaatgatccaggttgttgatttctaggctataatgtatttccctacatatatgctttagacattttgatcatgcacataacctctgttgcatactgattggcgatacaacaatgtaagacctcgcgatataggttactctagttaaagttactaatacattgaatataaaaactcatcatatctcgaatatagtgctaggattttcaactctaaaaattaaaactttagattttagaagtccatcccctaatgaaaattataaggttacttgacaaacctatttttctcatgggcagactaactcatgaaccatataggtaatagctttcattcttcctccttccttttctctacgtgacgaaaaaccatcaatttctgaagagcgtatattcttctattatactccctccgttttgagttataagacggtttgacctatttcaagtttgattaagtttatagacaaatataataatatttataatactaaatttgtttcatcaaatcaataattgaatatattttcataataaatttgtcttgggttgaaaatgttactattttttctacaaatttaatcaaacttaaagcagtttgatgttgactaaagtcaaaacgttttatagcatgaaacggagggagtagtaagttatatccctcaaccatttcacttcacacatgataaatatacatgaaaggaaaacatatatcagaggtctcttatcttatcaccgaattacaaaattatccctcaactagcagaccttagatatttgggttttcggttgaaggacggttttgtaattcggtgaaaagatgagggatttcaatgtactttttcctacatgaaaaatagaggaagaagagaaagtcaaggcccaacaaaacctgggcacgagccaagcccaaaaaggtagaggccctaaggcccaacggcccaagcccaaaagctactctcgaatctcgagctagccaagccaagccaagccaaaaaaagccctagccgcctcgtccccacccaatcctcctccctcgccgctcgccgtgctcccgctcccgctccggccggcgaccaccgggaagaggagagctcgagatgagcttgcggccgggcagggcgcaccccctcgccgcgtctcccctccacaccccgctccctgctaggcctaggccccagctgaggctgagcacctccaccagctgcgccgccatgaagtcgtacaggctgtcggagctcagcgacgccgaggtcggcggcctcaaggcgcgcccccgcatcgacttctcctccattttcggcacggtgagatagagacgagatggagagagagagagagagagagagagagcgagctacactagccgtggtcactgcgtgaatttgtgattgattgtctctcaaccattgggcttagtcttttttttcttttttttgggtgcgagtaggtcaatccgattgttgaagacgtgcgcatgcgaggcgatgctgcggtcaaggagtaagtgatgatgatgatggtgtagtgttcgatccttttggaccatgtatagcatgatttttgtattgacttcctgggtttggtttgctcagttatacagtgaagttcgacaaggttgcactcgatgatgtggttgtgcgtgttagcgatcttccggatgtggaggtattcaccttgtattagttatatgatgactgcatgtgagtgcttggtgccaaacttgtgttctactagtatagaattatgttgtgaactctgtgtacttgcattcagagccttcaaatgctaagtgatagttgcgcctaaaggcgttaatttgtacactggcgtaccgggggatgggtaaccatgttttcattacttactggatgggtttcagttgccttacatgtgaatcttgaatcttgtagcttgatccagctgtgaaggaagcctttgatgtggcatatgacaacatttatgccttccacgtttcgcaaaagttgcctgaaaagactgttgagaatatgaaagtaagacccatttgttgatcccatttagctctaattccatccctgcctttaccttcctctcataccttttgacttgtgaactcttccctggatgtgttgaagggtgtaagatgtaaaagaataacaagatgcattggttctgttggcctttatgtcccaggtggcactgcagtattgccttccactgcattgatgcttgctgtggtatggtcatgttttcttaaattgtgttaactcatcattctcttctcattgttttttacaatttaatatagtaaatctctttctgccagcctgcacagattgctggttgcaaaactgttgttcttgccacaccccctagtcgtgatggtagcatatgtaaggtacaattttattggatgcaggattgctgctatttctgagaagttgatatgtttgtgtttctaatgttgaattatttggaatcggttgttgctcttgtcctccgcaggaggttctttactgtgctaaaaaagctggtgtgacacatgtattgaaagctggaggagctcaggtaggacatttgatagttcatagtactatcttgtgttccccaatatggcgttgagttaaattattgttgttttctttcaggccatttcagccatggcatggggaacagtctcatgcccaaaggtacttggaatcttttgttctgtaacttgtaggggctatttttaggtgcaccatgcaggggataggggctgtggtcttctctttactctatatatgattgttatagaactgcaaatatgagtatatgacttaaccagcttgagcagtttttgtgattgtattctgagtggattcgtattcttctaatacaaactagggaaatacatatgcactattgattctgtttggctggcttattgtcactagtgttaacttagcagacttcagaaatgctttagttgcactagtatttttctgtactcatttattcataacaattgtgtcatttccattatttgtggtgatcaacttatatactgtctttgtaggttgaaaaaatatttggacctggaaatcagtatgtcacggctgcaaaaatgattcttcaggttctattctgatcattctgtaaaatcctgaacaatatctgccctggtgacaatatttttcttgtttgatggcagaacagtgaagccatggtttctatagacatgcctgctggcccttcagaagtattagtgatagcggataaatatgcaaacccagttcatgttgctgctgatttgttatctcaggtatcttctattcttaataccctgcttcatactggtgaaatgtgtacttgttattgaacttcctttactctttgaaatgccatatttgagaatctgaggcataggaattacatgatgtcgtgaagctttgttaagtatcatattatattatataacagttgttcgttcaaaattttaggcggaacatggcccagacagtcaggttgttctagttgttgcgggagacggtgttgatttgggtgctattgaggcagaagttagcaagcagtgctctgctcttcctaggggagaatttgcttcgaaagctcttggccacagtttcactgtttttgcgaaagacatggttgaggtaattcttcattcctgcccactctcgaattatttataatttgtaaggcacgtactatacatcactggagtttgaggtcgtagaattttgcagcatgcatgaaggtaaatgaaaattatctgatctattgccgttcccagggattgttgacaagccccctctttcttccttatgtaggcaatttcattctccaatatgtatgcccctgagcatttgatcatcaatgtaaaggatgctgaacagtgggaggatcttgtcgagaatgcaggtataggcatacctgtcagcgtcttaatcttgacctgaacattttcatacttcaatggtaatctcaggcgatcgttttttcatcacagggtcggtcttcttgggacaatggaccccggagagcgtgggcgactatgcaagcggcacaaaccatgtccttccaacctatggttacgcaaggatgtatagcggcgtgtcactgaactcattcctcaagtacatcactgtccagtccttgtcagaggaagggttgagaagtctgggtccgcatgtggcaaagatggctgaagtcgaaggactagaggctcacagaagagctgttaccctcagacttcaggacatcgaagccactgtaaccgtgtagatttgttaccatgattgttctaggggccaacttggatgcagagaacaagaatctgtgaacaccctaatgagaagggatggtccagctgtttctcgaaataaggctcatccattttgatacatctttgaatataaagtttgtttgattgtgttacactttcaagtattcaagaggacgaaatctgtgaagactgtaaggaaaagggatatgatccagctattactcgaaataaggcccatccattttgaatctttggtccgtctattgaatgcaaagtttgttgactatgttactactactactcaagtattcaagaggggtaaacctatgtgcaaatggtatacaatttcagtataaaaatattgacagcagggtttcacttgcattatgtttctcggtagataccgtgatgatttgcacttgataatgccaatctaggtataacatatgtgattttacatcagcacaagacatcaaaaattgcaagattatacaatgtccatgttctaacatccccagtgcttatctatacacataagtgaagcggcatacgcagtctgcagtctataataatctcatcatctttgtaaggttagcgatcttaaatcaccgaaacagctgccattggcaggcatagcggtctagtttttaactccggaatcccactcagcttcacgatagagcagtttcgacggtttgatgaaggaaaccgggaggcgacattggtggcatcgcttcttcctgggcatcaaccatttctaggatctttcttactgtggcttgcaaatgatcaccttgggttatatttggatgaatagactccttgtttttgagatccgtatttgatgacttaaattttgcatgcgcttttgctgaagttaccgcggtggtgaatacgccggattccttgagaccacgaatgatagcctgcaaagatgaatcattcaagagatgagttgctgccttcattgttgagataaaggtactcctaatagaagttcgagattgtgacttgccattggggcatatatgcgtgtcaacacacccttcctcaaaagcttcaaattggtatctttgtcgttccataaaacatgttcccggaacctgaagaggaagtccgacaaatacaatctttagttaagggagagaagtagggagggtgcaggctacaggagagaaggggtgtttaccagttcctcatttcctcctcggtagctgttgatgcaattataaaggcctggcatgtaagagtggatccaaatttattagtgttatcaaactagctgcttacactgttacacaattagctatgctatgcaatgtcacaaacaagttatcccattgcaggctacaacagttgctcttggcaaagctatgatagagagaatgcaaagagcatcaacttctcattcttaagagactgttattggtatcatacaacaagaagtcgaccaacgttacaaatgaaacgaagggaaagaacacaaataaactcaccaatctgtcaaattccaagataaaacatcgcttcacatcttcctttgtgggcttgcagccacacctatccctccttgaagttaagtctgagaactttgtgtaagtgtaatgcagaatagcagcttcctccaacttgatttcactacatgaatatataactgatgactaaaatgaccagaagaaacactaaaatttgtcctctgaacaactttagttttataaaaaatatatgtcaatgttttcagatgtctgtcatcttactttggggttttcatgtaattatgccatctatgagcaccatttggacgcagatgctcctgaacccttgctgctgatttcccattaccgtaagtgagaaaatagtttggattaccacgcgttgcttctttgtataggccaaaatatgtatcctttggaagatgatcataatttttcttaaacatggaaacctgcggataagaaaaactgataagaatttacagagaatatgatggatgatagttgagctatgaaatctgtagacaacagattttggccagaaaattaaacaacagcttgaagcacatggacgcacattattgatcatgcacaacttacaataaacaatcaacaaaatatgtaatgaagctatagaagtcgcaacatagatagggttggtgtggaaacagcaatatggactattgcatattaactagtctccatcaagcaacaaaactttatcctcatgaagcttttcttcttttgacaggataaacaaaggggaattagttttaccttccaaagtttcaccagtttaaggtttcgatttcttagcgcaatgcaaagtgaaaggtaacactgtgactaaagcaggcaattctgaatacatactttaattcttctaaattttaagcatgcacctggcccagtaacaagggctcttgctaatagctgccaaaattggtgagcttctctccgatttgcttcaaattatgaagttctaacaacacaacaaattacaggcgaaatcttgtctactacaaatcccgaaatgctacagcctcacaaagtgttttcaaaattctagtgatcaatttttttctgtggagaaatattttttgcagtggttttcattaaatcatgccttctattgtggtatatgggcaatattttcctttacttttcttacttttatttgaattagtaatagcttacacacctctgtgaaaggatctttgatgtcatctcgctcaatgctgctctcctggggaaaataaataaaaattagatgtgaaacaggctacatcctcaacagaaaatttattctgcaactcacatagttggggaagataaccatgtcaacattatcaggaacatctaaaagcaatcgcctcagagagtactcccgggcaccagctggatgaattagctcatcggtatcaagatgaatgatccagtccatgccagcatcctacgataatcaaacagggagaagctcaaataaagctaatcaccaaaaacagggtttctggagaactaaacaaacaacatcatgcaaaatgccttcgtgagtaagcatattattataatcttgtgtgccaactgccaacaacggttgatgtaaaccacatcattcatatggcattggcacggtagtataacatgttacaattattgggatttcttaactttttgctgctagcagtagcaattgggctaacatttatagcggaccgtgaaaaaggatatgtgaattattgattatgatgattaactggtgtgtgtatttgtttttttttgtcaactttacatgcattagttgtaccatcccattactcaccctacacgtgagtgagaagaaaacaatataatgacaaaaaggttgattagttaattataccagagatattccccttttgttactgtagtattgttacacaaatcacctcatatcttacatgtttgtgctgtattatgctacacagttcaacagcgaggctgaacatgatatggtgataattatggttccccttagaaattgaggggaaatagcatggaggtagctgaaaaatgggtaaaacaaaaaggctatggtgcttttgaatcaaaattgtgataattatcatttcacaagagcatgattgtgaatattgaatcaaaagcgcatgaacatgcaaaacgaacagttcatacccttgccataatgatagccatttccatgttcagcgactgtttgacaaatagttcataattgcacggtttgtaaaagaaacctgccagccaagtctcattccaaatgcgactgaaaatgttttaacagtagaaattcagaccacgaaaaatatcaagaaaaatacaggtaaacttgttagcaacatacacatatttcactagcaaaagggaaacaaacatacaggacccaaacaacatgaatacttcagaaataagaaattgcaaatcttgtaaaatgggttcgatcaacaaaaatgttatagaagcaagaaggtttggttccatctttactactagaactcaaccacatcatttgaagcaaacagtataagacttaatcactgcttttctaatctatatcttgttaaagcagtgtcctagaagaattaaattttagattgtcagtggaccaatctccaacaaaacctcatcttttacaaaaaaaaactctaaacagcttctcagtacatcacaataccttctgtcctgtttctctttcaattctttagttctgtaaatgatttttacaccctaaattagaaacaaaaagaagtcagaactagatcctgcaaaagtcatacaagtacagaacgaaatggtgcagagttgtttacccgaatggattcaagaactgaggtaacagctggtttcgcagcctctccttcaacaaaaaggaaaaagtgtgaaacaccgatgaccttgtggtagtacaaccatggaagaatttggtgtaaccctgcagatgtgcttcccgtgatacagatctgcagaatcatgaagatatattcaggggcataatcagttaacataagctcatcccatgataaacgagactcgcataccacattctcacaaataagacaggattaattttgatgttcagattacaaaaaagcgaacaattgtacaaccatagtagggtgcatgaatcatagttgcaccatccatttcaatgcaaaatacaagatgttcaaataccgaaattttaatggctcacacaaggaacatgcaagactgcgaatcaaccaacacccacaaaccctgtcaaccaaagttcttggaagaatgcaccaccccgacattgctctgtgtcaaacacgtttcctatctctgggctacagaattcggttgaaaaagacaatctctaagtgaccactaacctctaaaatctaaatcacatcaaataggactcaatttgatgcagtagcgaaggagcaagtcaggaacacaacaatctacaatctacgacaaataaatcagcattgaagcatcaaaatactctagaagataggaccttgcccgcagaacaggcctacacagaaagcaagagtacttaaaccctagaataaccatttgatgccatcgccgtattgcccaaactgcaaaatattgctacattccacgaagatgactatctcatcctcgcaggacagaaatgcgatctcaccaaaacatttcaggctacttttggatctcttaatatcgcggctttcaaattggattcacgtctaaagcaaagcgcaattcagcggcacgaggttcacatcgaggccgctctggagacgagatctccacgcgcagatcagatcggggagcggaaacctcaccttgggggttagtcccgcgtcggagtcgaagccccacccgcggtagagcgagatgccgccgtgcgaggaggacgccgcgctccggccgaggatctcggcgcagtctgcggccgcggaggaggactgcgacgaggtgacggcgaagtaggacccgcctcccccgcccccgcccgaggaggaggaggaggatccgagcgggctgttctccatgccggggaacctctgcgtctccgcgggccacgccgcgcccgccgggtcgcgcatcccgccgcgccactgcagcgcgaaggcgaacgcggccagcgccatcggcagcagcgtgaggagcagcagcacccgcgtcgcgaacgccgacgccgacgacgcccccccgccgccgccgcccgaggcggaacccccgccgcggtatcccgccatggcggtggttggttggtggactggacagagacgccttcgccgcttttagttcggttgtactctctcccagcgtcgcacacgcgaagacgacgagaggagtgagaggtgagaacgagatgttgggccgagattaatgggccggatgggggtaagcagatgggataagtttactttgggtcactcatcgtggtgccgagttctttgaaccgcgatactcagatataatgcatttctcaacttgtaataccgaaagtagctaaggtcccagcctcccggggcaatattatgtctggtttttggctgacgttacgagttgattgtggttaacccggttggagtcaacatgacagggacagagacaggagtagggcaggttggccatactcctgatcctaaataaatattcattgaaattccattttaaaacttcaaaaactagaagataaagtcaaaattatatacattcaaccaattgagccctaggtttggaaaaattctggctctgccctagaacatgggatctacgtgttagagtatcctcaacagctcctctatctagtcatccatccggtgtttggcgcatggaggagaaaaacagtgctccagcagagtctccattgcacacgccatttttagaggtcctccaaaccgagcccttcccaagccaaatatggcggttctctctcctcacaccatcctcaactgcttacctcacaatcgaactcgcgccaccatctagactacataacgcgagagagtagcagtaaagaggaagtgcataccggagtagaggcggagaggtggtggatctggaggtggagagaaccggagtagaggcggagaggcggcgaatctggcagcgaagaggtgtcttcccactgctcttgcgaccgcgcctcccctccgaccggccgttcctcggatcgacgccacccggccatccccgccgctccgagtcaacgcccgcgccgccactcctctgaccgcgtcaccccgccgctcctccgactgtgccgctccctctgaccggccgctccttcgactcatgccaccccgccgccctcaccgctcaggtcttcgcccgcgccgctccccccgatcggcccacgtcctctcggctgtagaagagagagtggtgaggaagattttttttaagtggtgaaaagtgagaggaattgagtaaaaatatgtggtggttgaaaaatattaataaaatataggatgttaatatatggagaatgtaatatggatgatctgttgaagtgaaaagtaatatagagtgagaatctttttggatagccatctaattagaaatatggaagttgaaatttagatgagctgccggagatgctctaaatagaaatatgggataagcaaatctgcaagcacagtacatttgtctacaaccactttgctatcatcaccaggcaaaaaaatgaaaaagggaaaacttgtgaatccaatacacgatcatggcgatagtgcagtgccatgttacatgtctccaacaccatgacctaccaacagcctactctgctactcaccccacatgcactactctgctcacctgtattgatttacggcaaatccgaaatcagcaacgcacaacagccagggtcccagggaattctaaaaagaaaaaaaattactgcactgccccatgcagattttacaagcactgcgtatctctaccttatcaacatggttttttttcccgagaaatattcggtttcctagatgccacagagaactatgaattcctatgtctttctatcatttctgtgaagggatagatcaggtatctgaagaacaccaagaccaaaacgttcacttcggatgtgttcagttcacgctaaaattggaagtttgattgaaatgggaacgatgcgacggaaaagttgaaagtttgtatgtgtaagaaaattttgatgggatagaaaagttggaacctaaaccagcccttcgtcagaaaataatcaagatagaaagtttgttcctgctcctgctcctgcagtcctactaatcaaaagtaacaagatgcagccatggaccaattcagatatgtacattttcagatggcacatacacacacacgtacagtggtaaatatataaatatacagatcatatgatatgagaccatataactatatgttggttagttttcagaattattagctgcatttgcacatgttgtgtcgcctcgccctgatgagtggctgtgattggcgccgcgatgttcggaggcccgggatgcacgttgtctttgcatctggcaatgatcctgtccgtccaaaatagcaattgttttcaacttaattaactacgtgtgataattggttctgctgattattgtgccgcataaatgttagtatattagggcactgtcatgcaattgtggcaaatatattcagacatttgagctacttcttcatgcagaaataggagtacatgttttacatgtcacttttggatgaattttttttaaaggtctagattacttctaatatcaatagataaacattgtaaaagttttatttcattcacaaaacaattcatgtaatcaataacaacataatactagttagttatagttaatcaataacagcataatacttctagtaattatcactaggattcaactttttgttttcggtgtttgtatcgggcagcgccgatatggtgaaatttccgaaatttggaaccaaaattagtcaaatttgaacaaatattaccaaaattcacgaaaaaaattttaaaataaaatttttggccaaaataatatcgtatccggggggggggggggagtccgaaatgactgaaatatccaaaatttcggtccgaaatgtcaaactctagctatcaccaccatggcataataacgacctaaccaacgggagtatttagcaacctacagctagaagaggcactgctgatgtttccttagtgatcagagcttgtggttcaattttcatattatcataatcatagcactgtcatgtaaattgggtagatggcatacatgcatcacttgctacatcaacagtgacacttgctactatatcatgacacaatttcttgtacacactacaagcaaggacattcagggataacaagttttcttgccagctatatcaatccaatccatacggtgtgggtgtcacttgggctaaaccttaataaagttcaactcacccactaattacatgctactacctggattgtttataaatatcagatatagtaacatttgactaattaatttgagccgttgtgttaattttcaaatgtcttgattttctcggctttacgaatatatcgataagcatgttgggctgattgcgttgtgtatcaaacactctgctttcttctaatataattgacgtgcaattattttgtgcgttcgaaaaaaatgaatatatcgataacatatttccatgacaggggagcatgggttttctaagtttttttttaataaaaaggagatatggacaatcagtgagatttgaaattcataattgtaatgataactagtaaattcaaatattcaatttatcatcatgaggtaattaggcctgggaaccatcaatctctattcttgagccatacttatggtggtcctggtctcctagccctgtgccccccctggacttcctggcttggctaaaccaccagaccaaccaccaacacatcacaatcattcaagacaactctatgtaacttgtccaactaaactccaaaaagaaatgataacatgagatcagttttatcttaaaagaattgtttgcac

SEQ ID NO: 38908 - DNA, 11458 bp, Oryza sativa
cgagttagtttttttttctataatacactttcttaggaaatatatttttatggtatttactccctagataatagataatatgatcatacaaattatataaagacaaactaaagcgagtcaaagaaaggtaaataccactaaaaagaatattccatcccctgtttgtctttatcaaaaacctatcctttccgaaaacgaccaatggaaggaatctagctcccatggtttattatgtattgtgcctttgacaaccagctttccctatggtttagattcctatgaatctttcccattttttctaccgagtgcataaacttaaaaatagccacatcattcttgtgcaattcattcagctgtaagcaattgtatttatctgtttatgttcaagctcggttgcagctaatccgttctagctaaacgaacttggtatatgtaactactaggaaaaacacgtgatcaattatcaactactacagacttgaaaaaaattaatttatttgattaaaaaaactatatagaaagctttttacgaaatacactttttaagtagtttggaaagcatgttaacggtgaaaaaagagaattagcccacctaaacaatacttccaaacacagcctaactctcagtaaatagaaccagacgaagcgaatcaacaagaagttatttcataggtaaaaagtgaataaatcccaattaattaagccaatagatgaataatctagctagatttaatcatactatgagcctatttttcacggtgacattcctggcgacagggtatattgtcattgaagtactccatgtgtgtggaccttgtgatgcaagcttgagtgatgaactaaaacagcgacaaagcgcccaaggtattagaagggaaaaaaaattaaagagctgaaatgactactttgcccctgtcctaaacaacaaaagaaaatatcaaggcaaaacttaaatatcaatcaacatctttactcctccttttcttaatttctttttgagccctcactctctgtcctctctttttgttgaattaattaattaattctccctttcaatctttttttaagaactcttttctttttagaactcccctctcaatctctctctctctctctctctctctctctctctctctctctctctctctctctctctctctctctctctctctttttcccctttaaagatatgcgtgcagtgacgatcgattgaagaagcagagcgtgattaggatcaagctcacgtcgttttcgcctggcactgattgatatctggctcagtttgcttgcttgcttgcttgcttcaggttcctaagtaattatctctaaataattaagcttccgtgccatgatttggtacacatgcagcagtagtagtagtgcccagcttatttgtcactgaatttatattattcctcgtgcttatcttgtgaggaaaagtttggatatatatatatatatatatatatatatatatatatatatatatatatatatatatatatatatatatatatatatatatatatcaaggtgatgtcattacttaggtccagtagctttgaagtccaatgttcaagctttgatttttttttctatatgacgcgttgatgttttcctaaaagaatattggtggactttatttatgtataaacgtttgatacataaatatgggatatatatgtgtaatattgatatttgagaaatacacttttgttactagattttatacatataccatggtcaaattaatttattggccggcagaacaacaatctatatgtgtggcaattttctagataatgcctttaccccgaatttaggataagattctatagatccgaattaaacatttaggataagatttagttacacttttaaagctttgactatcaataattttccaaatgtttgagttagatttgccttggcatcataatatcattagatttgatggtcaaaattctacaaatttgattgaatattgctccaaacgtcagatgaagtacgtactagtatgtacgagaagatgcatatcatacatggtatcactcatggaacaattaattgcaaaggccagacatgtccttcccacctatccatatttttgtttacgtagtatgtatacgcaatcaaattaagttgatcacgacatgtaagcaaagattttctccccccaaggtaaccaatggatcaacaacaacaaactgtaccatatgaacatatatccacagccattaatttgtattacaattggagagggtgcatatatatgtctatcttcatcacacctcaagccgaaaatttgtaaacaaaagaaaaaaaaagatatggataatatacacaagctccttatgatcatgaccaacaaacatatgaatataattacacatgtttaatcacccccaaaaaacaagaaaccccacataaattaatttacaaccgatgaggcgaccatatatatatataggagagagatgaaaggatcaaagggtgaaagaattcaataacaaatgttcttgcatgccaagtgtgtgtatcttgatttttacttactttttgtgcagagactgagagagagtagtgtgatcacattaaccttaatcttgattttaattaccatcagctaagcttagctaagctagcttagctttgcttgcttctggagtgatcactactgcttctccggctcagccgccggcgccgccgcctccgctggcttctcctcctccttcttctcctccaccacctccgtcgacggcgccgccgcctccgcggcggcggcggcgggctcggcgggggccgcctcctcctccttcttctcctcctccacggcgacttcccgggaggtggtctccgccgccgcctccgcctccggctcgggcttgggctcctccttgggaacgaaaggcgcgaccttctccaggatgaaggcgatcgccggggagagcggcgtcgtgccggacttggccaccgcgtcgctcaccggcttggctccggggaaatctgaaaaaaaaaaagaggattgcattagtttcattgtaaaaatattaatggaaatttaaaatatcttttattgtttgcataaaaattatataatttttaggactacctaacgagcaaatatgtctattcaggaacagacatgttcaaatattttcagatatataaaaaattgattttaccgatatttcttaatgtaaaatttaatacctttctatacctccagtattaggaggtaccaaaacttgtattaaaaatattgatgcctcccaatacctcttaagactataaaattaatccactataaaaggattggtttttatatatgattggaaaaataagtggctgaagtttaataaaaaaaaactgtgttagtttcgtttgttttttgttcgactggtttggcctcttgtctgcgtcagctaaagaaacggagtttgcatgtgagattctgttcaaggaaacatggtagacgagaagattcctctgaagttcaattttctagcaagagggaataaagtctagattgttgctcagagggcaaatagtataggtctctatcgaataaaaacataagaaaatgaataaacatgattgctaaaagaaactacggattctactattttttaagggaaaaaaaggtgattcataaatgacacctaaattattttttaaaaaaataactcattttttatgttacgattcattttggaaataagtgataaaggttctttattttcattaaaaatgcatttttgaacgaaaatataaaaaaaggggacaagttacatattgtgattattctagtcaataccccatgcaatcaaatacaagccaattagaacttagccaattcttaccaatcttagccaattcctcaaggaacttagtgactgcaggaccgttcttcttgattttgctggctgtttttttgtccttcaacaaagcctgcaatatttttacagataagcatgcaaattattatttcttgagcaaggatgtcctcaagcaacctatgaaacacctgaaaaattattaccttaatctcaggaggagatgactcaacaacctccacaaccttgggctctagctctgtcttcttgtcatcaatctccttgccaatctcctcctacacaaatacatatgacacccaatcaataaaaaaaattgtgaaataaacacaaactatacttacaactttcaagtgtctctgtgtatgaattcgtagctaccttgttgaatgatttcaagaactcagcagcagcagccttctttccatccttgtcaaagagcttgttgagtccagtgagaaccttggtcttccagacacttgtcatttctctccttcaagaaattaatctctagtactccaactgtccaacagcaataaaaaatccataacaaaaaccccttcttaaaaaaagtacagaacaaaaatccataggatatttcatatatatcatgaaactaaacatgcatgcatgaaaccatggaaatgatcaaagtaagctagagaagaagaagcttacatgaagcaaggaggagaaagagaaagaagagagagatgcctattgcttgtgtgatgtgttgtgtagcttgtgatcaccagcagcctatcaatgggcagagtagtacaggagccaccttgccatgagagtgatatataatgggctggccagaaagccaccctgaacttgggagagatttacatgtctacccctgcagatgacaccatggttgcagtgaggtggcaggggcataagtgtcaaaatggagaagattatggaaggggtgtcattaagccacggatgacatgatggtgggtcgtggaggcttgcaagctgcgctggaggggagagaaagaggaagagtatttttgctaggatcctctgtgttactatgactctgtggtctttatcaactgaatggatgccaataaaattacaaagaggatgttcggctatgctacattgcaattgtacagccgtagctgcagctgccaccatagatcctcttgtttttactgtagctgtaggttgtaaattaatcacatctaacattatcgaacacccctttaatttaagtaatttatttgcaaaaaaaaagacataaggaaaaattagcaaaaatatagggctagccggctagtgcagccgccctattattgctagaagaaatttggcttggcttagctattggtattgcccatagctagcacaaccaagcgagttcatagattatgcttaactgttattttataaaatcgaaaagtccaatttagatattaataaactatatgtgatatggttatgcaatttaatgagttatttattgttccttgttttcctagaagatcacatagttgtctaatatattttttcctttttagcactagaataactattctgggatagtgttagctttaattttgacattcgttgataacgagttcacatcaaactggtaactttcctggaagaagttagaatgatataaaaaggacaatatccctctcctagataactttcaccttttttaaagaatagtgtttactcaatgacagttggtggtcaaacttcattgtaacactaccaccttgtctatatagcaaattaattcaactaaatatcaattgattttttttgctaaatagcattaactaatatatcactatccgaattgttctagatttctttatatagatcgagaaaaaatacgtgcgatcacatcacgagtacaatatgttaacacgccatttaaaatttcacctttgtcatcggctataactacctacacattaacacacacccttgcccccacagaagatcagggacagccagatagataatcctaacactgtccatgacactggcattcctgcgtgtggccccacacctgctcgacggtggggcccacaccttccgagagagaagtagcgtgagcacctcgaagaagcaaccacacccaagccaatcacagcgcctcatcctggccaagaagccaagagagtactcgcaatcacaaaaagaaattggattaatcagaagtttaatggaacaatgccccagctaacctgccatagtgccacctaatggtctcaggttggacaaaatccagcagccatgctggtattattgtttagttaacttgcatcattatattattatttgctatagtagaatactcttgtgatcttctccaagatttttattgctagagttttaaggagaggagaggagaggagggagaatacacaaatagggtgttgtactccaatgtgctggcatgaatggtacatctaccagcatgacagctcctctccttcccaagtgaccgtatgcattgccacatcgaatgtacgccatgtatgtctacattaagggagaagtcttgttgtgttctcttgtactcctaagtgattcttgcaaactatagcaatgtgttgcaaattatagcaaagtatttcttaagtgattctcgcaaattatggtaaatggtgagaacttccacactcgtcaataagaagaagaagaagaagtagaagaagcatgcgtgtctagagtgatcttttggggatgtaagaatttcttttatgaattttataagcacgaataaaatgttttatacagaattcacaagactcaaaatttttaaaaccaatgtttgttgtattttgaatgacaaactgccgagttagtctaataatactgataactaccatgaaaagaaatgaaagaaaacaaaacaaaaacgtaggccattctctattgtcctaaataattttaaaattcgtatccacttgtcacatgacagccctcatttgctgtcacctgtttatgagccaggtaacgagaccagctaactgatgcatatacctcaatcaacacaccaattcttagctcgaaaattatttttttaagcattttttagttctagtcagcaagctatgcttgagtgtgtgcagcacacaagcaacaatggtggtgtacttctactctgtttcctgcacacaaattaattaggtcagaaatggcttcctgaaaaagataaccagggagccccaggaatcaaattttccaggtcaagttacttgtgataactgaacactcaactgatgagctaagatttagtttgtttaataccaactgaataaaactttccttgcaaatgctgtttgtgtcactacaatcaaatcaggttattattcaggataaccaaccatccatccaaatagtaagtttttttgttgctttcttgaggacagaaattgcaatttcctcataattaaaagagaaattgcagggatttttcgtgaggagaaatattaaggtccttcctctttgtgccagcgcatttgccatggcaatgggacatgcaaatggcatttgccaagaaaacacttattcacaccctaaaattcttggcaatagaatatcaatcatatgtaatcatctgcccccacaaaaaaaatgcattgtacatgtattcctaattgtacaactatttattctggaacacttgatattaattattcaagccacccgatttaggagcaccatcttacaatgattgaagatacatttgtaatcatatttcctttgtacgtatgaagtgatcacagtgatctaggaatcatgcaatcacaatttcttacaaatatttcacaacataaagaatagtgttagttgcttttacactaataaaattcttataaacagtgacaccccctgagcatctatgtccaactacttctgctaaaacacaaaagtttagtaggctagctattgttttccaacgaatatacaaaatacatgcaaatattctcttaggtaagcagtgaagtacacgcatatatacacaatgacccttaaccacagatcatgaaaaatacaggaactaataaatacatgaaccaatcatgcttatgaacccatcaaggctcaaattaattcaaatcaatcatgcaagttcaaaatattgctgtggtgaacatgcaacgcaatcttctcgaaccctccaggccaattagttagctgccataataacaactggaagagaggcgatatatacctgtcgttgctaaccgtgctttgctaaaggcacagttggcacgatctctgtagattacattttttttccctatgattaattagttctaagtacaatatgattgtgctacacgtaggtatgcacgtctaaacagctgtgcttagcttccagtatggaaatagcttgagcatgacttcttcaagaaggttgcattgacagggacattgacataatattttcacattcttaaatgcatttgcctataaaaacatatttttttcttggcaaagatatgtccagatacaatgatctactaagcttctcgctgaatcaccatgttcaagtcgatcacatcagctgcatgcagtatctgtcaacagaagaacagaacaagttgaaaaaagaaaaagtaaagccgatatgtgtagaagatgagaagcaattcgtccaaatattccttttgactaaaaacatcaagaacgctagcacttgatagcaaggacatgatcaataacttattcagaatgagcactattaaaaaatgtggtgctcttattgggaatttcacaagagcaacacgaacagagactccctcatacatcaacctgggagacgcccaggtcagattggcagctaatatttccaagaatcatgccattacaaacaagatgtacaatgtactgaaaaccatagatctactaggtacaggtaaaagaacaggaggagaaagaagaaagaacatcagtaccataaaagttaccacacacagctgcagcatcgatcttagaatctacactcggccaaaccacctgaaagaacaggggggcaatcagcatgcctctggaggaagaattcagtcagcaactgtaactaatcctgtttttttttctaattcagcacgtcgcatcgcgaaagaattcggatggaactgagggcgggcagtgcttcttcgccacaaatttgtactgcagaaacaaaggtaacaaaggtataggagatcagcattagcaacagtacagataactgaagaaatggggaggatatgccgtttataccttatgttgggtatacttctccctgattgcaggaaggttactcccgggaccaacgctaaaaaggcggtgcaatgcctttacacagtcgcttaactctgacgacttgtattgtgtgtagtgagcaagggtggaattctgcttcaaatttacaatgagaagcatatgttagctcttgtaatttttttatttgaatgctgatataaaagatgtatggaaagttcaatacgatgatgccaccacttacccaagggtgctttgttggctgcagtatgaatttggccaagaaaatagccgatgccgctactagtgaaggagggtaagaaagtagattgtactccagcagtgatagctcagcaacataattggctaggaactcaagatgcaatgctggatcctgcacgatgaaaagctgttaatgcaatgcaccatataactattatggaattgcagcaagcaggagatgattaagagagcagcacctcatccgatacttgtgcaacacggacaaatctcctgttgtaggcaataagagagttattagagttcgattcattccagcactatagacatcgatgagatgaaagagaatagaacctcaaaaagcattttgctgtaggtgcagtcacttcaaacttcaggtaattcaggacagaagcttccatttccaaaacctgataatctatgtgttagtcatggacataaacacagcaatgttaacagatatgcaaaacaaacctcatctctgaagtatgtgttgtcagttatatagcagaattcttctacttgaggtgcacatatctcctcgtattttctgatataggaacaagccaaaatcagtacacaaaactcagatgcaaactgagaaacacatttaaaaaaattgctagtcagatcttacgcagcaataagcatacaagcaactccaagtaattgcagtctttgacgattgatctcattgccagaaagataacgatcaatgtagttaactgtcaggtataatgtatcaggaacaagacgatattcttcagcgacctgcacaaaggaaaagcacaaatacagtggtaagtaacgagtgtggtctttaggctccaatcaactaaaaaaatgtttggtataaaagcttacttccacaagccagtctatcaggatcgctctcatgcttgggtttacatccttttggattgtttccataaaatcagttgatggacgtttcctggtctgcttcaagtcaaatagaaaatcacaatgtaaatatgaaattcaacctagatttgaaaccactgtgctcaggccagattaattatcatttggtcaaactgactgcagtagtgcagtccatgtcacagaaaaaataatgagtaactgaaaatacttcaagagcattaattgtgacaattgaagtcatgtatcaattcgtcggttcagtcaatgctttaagtggattactccattacaatttctccatattatactgtcaaggtcaggatcacctatttgaggaagcgacgcggcaaaggacgaggcaaagcaagcgaggaagcgaccagctgatgtcgtgccggatgaggaacagtaccacgcaaattgctagcaattagttcgagtttgttaaaaagtcagtttggatgtaaggctatttagagccacgaatctatagttaaaggcaagcaagattgaatctatacttctcatctccacttctctatctcatcccctgtttctcctaaattgccaccactggcagggcgtcgaagaggctaccgaagcctcgacctcctgtgtcccattcatacccacttcgttcgcttgctggtgctcgtaacaacttggtatcatagaccatggttcttgaggaaacttcttcctccaagcagccatcccctagtgctgatgcactggccaagctctaggagtccatggcggatgtgttgagcagcatttcgctattggcttccaaaagcgacctcgccgacctcagtcgttccgtcgcgtggccacttcgcacatcacggccctcgagcagtcctccaccaccttgtccgcgcctcgcctgggcggcagcggcatcttgcctgccgccaccaccaccacctccgccgtcgactggaaccggctcggtgcacgacaccaattccggtggcgccgttcctccttttcacaaattggagtttcccaagtttgatcgcaccgatgatccgctcaattggattaatcattgtgagcagttcttttgaaggcaacatacgccggacacggatcgtgtctggatggccacataccatctcacttgagctgcacaggaatggtacttccattatgagcagcacatgggtcctccggattgggatacg

SEQ ID NO: 38909 - DNA, 16720 bp, Oryza sativa
cacacaatttcatcaccaccaagctggcccagcgcatcggcctacctctccaaccggtacgccaaggtctccgcgtggtggtggctgacaacgatcgcatccgcggcgcgggtgtcgtgcacgggcttcgcctgtaggtggccaccgaggtgttcgacgtcgactgcttcgccctcgacctcagctgcgtcgacatcatcttgggcactcagtggctacgaatattgggaccaatcctgtgggacttcgtcaacatgcgcatggcgatctggtgcggttgccgggtcacactctatggtatcctcgacaaccgattcacatccacctgcgctgcactgcacgccgacgatctccttccgtccttgctggcggaatttgacgacctcttcgcgctccaaccggcctcccaccgacccgatccatcaatcatcacatccacctcaagcccggcaagcccccggtagtggttcgaccgtatcgctacccacagcttcaaaacgacgaattggagaaataatgcgctgacaagctctccatctgccccaacacgtcgccattctcgtcgtcggttctgttggtccacaagccatggcgcttctacgtggactaccgagccctcaacacggtgactgccaaggacatgtttcccattttggttctcgacgaattgcttgatgaactttgcgacgcccacttcttctccaagctggatctccatttcgggtaccatcaggttcgcatgcacccggacgatgtcaacaagacggcattccgcacacaccaaggccatttcaagttcttgttcatgccattcggcttgacgaacgcgccggcgacattccaggcgctgatgaacatggtactcgccccattcttacgccggttcgtcctggtgttcttcaacgacatactgatctacagcgggacatgggccaacaccttcagcacattcgggcagtgctcagcgtcgttcgcgccaatcatctcatcctgaagcgctccaagtgccacttcggcgaacagcagatcaactacctcggccatgtggtgttcgcaaacagggtggccatggatgtgcagaaggtgtgcgcaatggcatactggtcgcaaccctctccgtgggagccgtccgcagcttcctcagcctggctggatactaccgtaagttcattcgcaactacggtgcgatcgcagcaccattgacggctatccttaagcgcgaagcattccacttagggatgaaaacagtcggaaacgatcggaaaatagcctcaaccatttctgtaaccatatttttctcggaaacgatatcggaaatatcgaaaaaccggaaacggaacaatacggacggaaacatatcggtacagatcggaagtcggtaacaaatacggaaatattaaactataaaaatatatatttaactttacataagtatgttatatgtatacataagtatagacatgccctataaatatcgatatatttagaatacggtaattaccacattataagaaacggtaatttccacgagaatacgataaatacggaaacgatcggtataacagcaaaaccatttccgttttcatttccatattttttgccatttccatttttgtttcggtcgattaccatttccatatggctcggccggtagaaagtcgaaaatgaacgtcggtcggccggtaattaccgttaccgttttcacccctaattccattggacgccagacgcagcacaagccttcaccgagctcaagcatgccctgtggatgggtcccgtgctgcaactacccgacttcatcatgtcgtttgtcgtcaaagacgatgcgtcggggtccaacattagagtcgttctacaccaagggacgggcccactagccttcttcagccgggcagtagcaccacgccatgccgggctcgccgcctacgagcaggagttgatcagccttgtccaagccatccgccattggcgcgcatacctctgggaacgggcgttcctcgtccgccccgaccactacagcctgaagtttctcttggatcaacgcctttccacaatctcgcaacatcggtggtggtaagcaagctcattggttttgactttactatagaatatcgaccgggtcgcacgaacgtcgtggcggacgccctgacccaccgcacgaaggacgccgagctcatcgccttggcaatctccgagctgacgttcatggcatttgacaacctccggagcgagtagggatggcaatttgggaggggagggaacgggggacatatttcacccgcgggtgacctctcctctcccgtacgcgcacccacatcacataggcggaggcagcggagcacagggcagcaggggcggcgcactgcgcaccggcaccatgcacccctcgccgtccgctccctctcccctcccctcctctctcttccagcctcccaagtcccacgaatcggcaccacgcactcctttggtctcgtcgtcccggtcgccctctccctctcccctgcggcctctcgactacctaatgcggggccctagtcgggttgcggggccctagaggggtcggggacggggcctgatttggcccacatctccagtcggggccaggggcgggggatgtagtcaggggtcgggggcgaggccgtttcagcccaactcggccccgccccgttgccatccctaggcgtgaggtgaccacgaacgaggacctagccaagatcgccgctgacatttccagtggcacgctgggttggttgggctagccatgggctttccgtggcggccttatccttcgcaatgaccgtgtccgtgccgacgtcttccccgacactgcccgcgctgctcgaccacgcccacaccggccacgaaggcgtcgagcgcacacttcacaggctgtgcacggacttcttcacgccccatgccaagcaagtcgtccaagaattcatgagcacatgttcaacctaccaacgcaacaagaccgaacaccttcatccggcgggcctgcttcagtcgctgtcggtgcccacgcaagtctgggaggacatcgccatggacttcatcaaaggacttccccgcgtgcacggcaagacaaccatcttcactgtggttgaccgcctctccaagtacgcccacttcattctgctcggccacccctacacggtgacgatagtggcgcgtgtgttcttcaacaaggtggtccgcctccacgccatagttattaaaaccggaccggagaatgaaccggtcaagctctcggttcactggtctagcggttcaaccactggttaggccgatccaaccacgattcgatgtattataggatgcaaatgtcttagaccaacaaaagtgaacagatggtgtggtggctagcgcgtgcagcgctcaaccacatgacccaaggtcaaatctccccacaccaacgtccttttccaccgatttttggctgagtttgctcagcgggcctcacgtcagcccatcaccaaaagacagcccggtctgaccactccggtttaaagcccggtttacataaaaattgaccggttcaaacggttttctccggttcaattacacatccgatcttttaaggggaccagaccggccgaggccctagttccggtttttcccggtcggaccgtcggtccagtccggtcctaataactatgctccatgcatcccaagctccattgtcagcgattgccgatcgggaccctgttcaccagcacgttctgaaccgaactattacacctggccgacatcaagctcaacctgagttcagcttttcatccacagtgcgacggccagtccaaggcagccaaccgagtcattagcatgtacctcaggtgcctgaccggagaccatcctcgtcactggctgtgatggcttccgtgggcagaatactgcttcaacacggtgttccagagctcgctgcgcacgacgccattccaggtctgtgtgtatgatcacggcacagcacgtgtgcgcgctgtcaatcaagccctcgtcgagcgggacgaattccttgaggaaatccgggaacacctcctccaagcacaggattattggaagctctactacgaagagaagcattgtgatgtcaccttctaggtctgtgactgggtctaggtgcgtctactccatcaccaagcagcatcccttcccggcttctgtccatagtggaaaaaaccagaccgggccggtggttcaaccaggaaaaaccgttaccagaggtctttctggttcggttaaaaaaaagtcaggacatgcatgtgacccgctttgaaccggctgaatcggacggtttttctatgaaccggccattaaaccatcaccgggcagactctcaaggcccatttagcctgcaaagagcgttttggttggcaaaaatcaaaggcccatttagcctgcaaagagcgttttggttggcaaaaatcagaggaaatatgcacctgtgggggttcgacctctggtctttaggatagaagcaagcggcgtagaccaccgagccatccaagcagttgtgatttagcaattacatacgttacacatatatgtattaaatcgcggtttgaccgtccggttcacggttggaccggcgaacccaaaggtcgaccgggtcacccaccggtccggtttttcctactatgcttttgtcgcaacaagttggcaccatgctactacggtccctaccaagtcgtcactcgcgtgggcgatgtggcatgtcgcctcaagttgccggccggtgccaagatacatgatgtattccacgttgaactcctcaaggtgttcaaggacacaccgctagaccagctgcctgcgttgtcggcgctctcgaacgaaagagtgctcccgcttccagctacggctgttcatggtcaattgacgcgccggagtatgccatgtgctcatccaatgggccggcaaaccggctgtcgatgcaacgtgggaagacgaagatgagttttgtcgcacctatcctacgttccagcttgaggacgagctgtttgcgaaggaggggagacatgtcatggtcggcatcacgtattcgaggaagcgacacgacaaagaaagtgaggaagcgaccgactgatgtcgtgccggatgaggaacagtaccacgcaaattgctagcgattagttcgagtgttatccctttttattaacagagttagtttggatgtaaggctatttagaaccacgaatttatggttaaaggcaagcaagattcaatctatacttctcatctccacttttctatctcatcccccgtttctcctgaatggccaccacgggtagggcgtcgaagaggctaccgaatcctcgacctcctgtgtcccactcatacctaatttgttcgctcaccggtgctcataacatatgatgtgcttctactggttctataaggaatttcaatatgaaggtcattaaatggaacccactattcagggaaaaaaaagtattcaagaatgttttatgtaaggtgtttacataatatgcagatcaacactacggaaaattgaaggtcgcaaagcatgtctggtatttgatgataaggtgcaccaacatagtgaaatgcagaaaagaacggattgtggtgaaatgtgaaaaatatcctcataaattacattgaaataatgccttatatccgttataaccactggaacaggaatgtgcacttattctcttcttaatttatggtctcatcaaagtaaactttttttacttgtgtttcatatggatgcaatcaagtctcaagtctgaaaacatactacaatgaaaaacaattctttacagtgctcaagggaaatgttttcagagaaataaggtgtagacaagaatgtattacctcggcctcgcgcaagtgcatgtagatatcagaagcaagagtagcacacaactgcggatcctcgtagttattgtcaacatcacaaatttggtcgatttccattggggaaggagcatccttattccacttagtttctgcgaaagaaacaagggataagatcaatcaaccattctaacagaatgcaccataactgcgcatttcagcaaccaaaacacaccttcaacatctctatcctctgagatacgcaggttctcgtttgctcttcgctgcaaggaacctagaactgaggaggaatccccattatcaatgtactcaaagtctgggcttttcattgagtcacacatcgacatcgtctcgtcaaccgaaactgaatctcctgaatgcataggggagacgaagctgctgcagggtacagtgacaggtgcgggtgcagcagtcggaacaatgctaagcactttaggaggaataactgactccttctgtggggcgctctcatggcgggatatggccggagctggcttggcggaagccgatttcaccgctgagacccgattcgtgcacacattgcggccactggccaaagatcccttcttcacaggtgcagcccaggtagctgaattaaatttctgcaggaggattgaagaaaataaatcaatttagaacttaaatttcaatctgttcatttgggattccagaccacaagcatgaaaaggaataaaaatttagaaacattagcagcacgcaagtatcatattaccaatagaagattccaaagcaagcaaacatacaagacacttcacgaataccaagaaagcttttattttgaacttttgaaggtgccaataaaccctcaagtgaatttagcctgttgacctgaatgctccccaagaaatcaatcaatcaattaaccatgaaaagaaaccagaaaatcagcaagataaatcttgtggattggaataggagtatcctcaaaatcagcaaggaagaatgtggcagaggtccaaatttgaatgtgaagagcactgaaaaaccaaaaggcaagaatatcttggggattggaagaggagaatcgcttgcaggctaaacaaggagaaattgaagaaatgaaaatcttgttgttggctgaaagaaagaactcaagaagacgaattcaagaaacactatttatttttgcttgaaaccaacagatcgaggcgtatgtcctccacaaacaagatggaaaaaaaccaaaaaaaaatcatacacagatcgcttcagccatttccgcatcaagcaacagcaactcacttgtgccccaagaggaaccaagaatcaagcaacagcaactcacttatgccccaagagcaaccaagaagcaaaaaaaaaaaaaaaaagccacccccaaaccattccaaccacctcacataccaaaagatctccacccaaacagcgcaaagcaaagaacaaatcttggagagagaaaaaaaaagcacaaaaaaagaagaagaagcagcaagcgatccttcacgtaccgcattgttggccgcggcggcaacgttggtgatgttgacaagcgcgacgcgcttcttggccgccgcggcgcccgctgccgccttccctcctccctcccccgccgcgggccgcttcgccgccatcgccgccgacgacgacgacgagcggcgggaggctaggctgctcgaaatcggacgacggacggcaaccaccacccgaaccctcctcctcctgctgctgctgcgagggttgcgagggcggcggcggcggcggggatcagaggcggaggagggcgagggcttggatccttcccttcccgacagaggaggggagagccggagaggagaggactcagaggagcggaggaggagaagagaaagaaaatggcgacgactctttcgattatttccagtttttgggccgttacagttgttcaaatttcaaatagtagtagcaagttgttttagttattcgaccgttttgtctgtctttctttttttcatgtcgtcgtggttgggttattacgttttcgaccgttattcataaacagaacggatgtagagctaaattaatttcgtgcgttactacttctgccgtagaagatgacggattttaactttgtattccctccgtccttatattcctaaaatgtaagagcacctttggatcaaaggatttatgtgggaatttcataggattcaaatcctataggaaatttttatatttggccctttgattcaaaggattgaagttttccaaatcctatgaaatttctatgaaatggcacacattgcatatggatttttgaggaaatttagcaagagctccaatctcttggaaaaattcctttgagtctatctctctcgtctgattcctgcgtttctcctgcgctccaatcaaacgaccattcctgtgtttttcctgtgttttgcaatcctctgttttacccttcaattcctgtcagaatcctgtgtttttcctattcctctgtttttttctaccctaagattcaaaggggccctaagtattttttaagcatagtgtcaagtcaaatatttgtaactttaattattaataagaaaaaaaataaaaaagatcaatcataaaagaaattgatgttactagatttatcattaaataaactatcacagtatgtaactctttttatttaaaatattttacttttataaatatcgtttgtcaaataagcatctttagaaccgtgtcgaagtctaaaaatacttatattttgatacggaggaaatattcctcatcgtattttcctacttatctctctcgtttttcacatgtgtgcttttgtcaaatggttaaacggtgtgttttttttttaaaaaaaatatatgtatgaaagttatttgaaaaatcatgttaactcactttttatgaaataactaatacttaattaattatgtattaatgaaccgttttgttttacgtgctggagggttagtttctaacactaataatcgaacacggcctttgctacttagaggaattttaatagtatatagctaactactagctccaaatcatttatagctaatctaatagtaaattatacaatagttaactacagatatacactacatcattaattactggtcccacttgtcatacacacgtagagcccgttagaaactcatgaaaggggtgaattaaattttggattaaagtggcacgctttttaaactgctaaacggtgcgtttcgtgcgaaaactttctatatgaaagttgttctaaaataacatattaatccacttttcaagtttgtaataattaaaactcaattagtcacacgttattaccacctcgttttacgtgaaacacttaatcttcatctttatctttatcttcaggagattcaaacaccaccgtagcgtttaggagtccgtgctgcagctggttacaaatctgtagcccgcttctattctatctcctctcttatcttcaccacataagcttgtagctgacttatagtctattattgtacctgccattagagttttatatttgaacttggaatgtagtatccaaaataactttgggggtgtttagatccaagagtgtaaaattattgcgtgttatatcgggtattatatagggtgtcgcatggggtgttcgggcactaataataaaactaattgcagtatccgtcagtaaaccgcgagactaatttattaaacttaattaatccatcattagcaaatgtttactgtagcaccacattgtcaaatcatggagcaattaggtttaaaagattcgtctcacaaattattcgtaatctgtacaattagttatttttagcttatatttaatacttcaaacgtttgatgtgaaagggtgtaacatttttgtgtgggaaaccggacctttgtttttaagaccggatggagcactttgataggaggtttgggagtttggaacttgtgcaaaacggtgtgttttaaaaattaaaaccattgctctcgtacataccagatatttataactaaaggtcgagaagttcaaaatgtgtccaaaggtcgagaagtttaaaatgtatccaaatcaacatattttcaatatttgagggagtaacatgatataagaccatatatttataactaatggccgataaatttaaaatgtgtccaacggtcgaaaagtgtaaaacaggtccgaacctagtgtttcaggatatctacaacgaatgcttgggtcgggacgtaaggttaaacctttcttagttgtgccaaaggaaattatgcgaatttttaacacggctataatggcacaatattgccaatgaaaaatacccttataaacacaattttgcttggcttgttgggattgataaaaaaaaaaccagtaaacttatcctggtaggagcttccgctatatgttgggctctatggttgaatagaaatgatatggtttttgacaaatcaccatctatatcttatatgcaggttcttttcagggcaacacactagcttcggtcctgagcacaactgcaaaagtgtgaagaagatatcaagttaataaaagctacatgtcgtaatcttgagtcaacggttatgcggctttttgccaactttggatgaagattcacaaatagaattcaataattttgtgatcttttcttgcgttggtttttagtacttggtgtgtgttcctgaccttttaggaccgtgtttttataacttttttgccatgcgattttatttgtatgaattggtgtaataattggttgtagctcattgaccaaaggctggattctattccaatatctaaaaaaaacacaattttgcctaattgtgttacctactatagaaaacttgcgactgtagtttctcacgaataacgttatcgtgctagtgggtgggccaccggtccatgcaacagtagccgtgccggcccgacacggcccaacacctccttgggccgttctgcccaagatctggcaccgtacggcccattacagttgccgtgccatcagcgggccccttgccgtgatgggccgggccgcccatttggcctgctacacataatgggtaacatagtaaatctgagctaaaggtggagtactcgagtatctcttcccccttcccttcgcgtaaaagagaaaaaaaaaatctcccgtctcgtcgtctcctccgcttcttgcgcccttcgcggctgaacaggggaggggaggggcgccgatctccatccggcgagcaagggatcctggtgagcatccacatcctctttctgatgattaatctctccctcccaccgggagtgcttctgtctggaatttgcttgcgtaaaccctagcttctcttgtagatctggaagaagctcttcttttaattccagagccttaaccttaatacaagtaacagtttgagtttgtttgttgttcccccaaaagtttggggggttcaactgaacccccatgtcccaagttggatccgcccctgttatttcattcatttcactaatttgtttacatacagtggaataatgtagtttttatttttgttatgcactcagaattcgtaatgtttaaaattgcctgcaaagggtttgcaaatcaagaaaaagaaaggattgtgctgattgctgtgccagggagagaggtttcattcctttttatgtgttttgtgtgatatcactgccaggggatccacatttgttctggatttcgtttttgtgtgtttttcaaggaagtttcaccatctatggtgataatgtcattctgttattacagaggtcaacgtgttgtagataataagtgacataggttgtatcatttgtttcttctatatgctcaacagctcaaggtcctgaactgttatgcatgtttcatttgttgcccctcgagtcattatttggcgcgggatacctcagtactttggatcaaataatcctgacgggaaggagtattagggtattcatattgtacatagccaaatgttcttttcccattgcaacacatgggcacctaactagggtatggacattattcatgtttgtggtcatgatcaaatcgctcataaaacatgtgcatcttagattataggcagaaatgtattccaataatgttatttggagtgaactttatccatcaacagaaaaaaaaattgaaacacaaatttctgctaaatactctattaaccttttctgtgttatactcatgcgtatgtatgcattgattgctaaacattttcacatgtgcatttgacagcttaggtgtgacttcagcaaacaagaatctttctccattagaagggatcaaaccgatcgagaaggatcaaatcaagaagagaaaggatcctacctagtatctcgatattgattaccttggctaagaggaccgatcggattattggagaggaggggctagtcgtctccacaacagtgaactgtgtccgagccaaaacagaacgaacgcccaaacaggcaaaccacgaactcgaaccctagaaaccctaaccatggactcgggaggcggaggaggggcatcgcacaaggcagcgtcaggctctgcgccctcgggggcggcggccgcgaaccccacagcgatgctctccgccctgatgagcaagcgcgccaagctccaggaggagctccgctccatagagcgccaggttaggtcttacacacagtccccaatttattgtgcaatctttcttaatgccttgggaatgatagaaatatgaacctatttggaaccaatatgctggaccagtgaccactgattgtcatttcacagagaggatcaattgtgacgaacaatttggatagaattaggaggaagggaagaaagtatcaatttgatattcttgtcgaatatgaccattctatttcttgtatgttgttctttgtgcctgagaacactttgttgctctagggtaaaaatgaaaatcagttagctacaacctgtaaattccatctgttcttattatcaagataagatgtggagtttctactgtgtcttagtcagaaattatttgcaacaagtatcaaatgagctacttctattcaaagtatttcaaagttacactatgtgctccaacttccaatctatgtttgtgatggtgaatcttggtgtgtcatccaaaatcattaaataagaggagcatttggtttagtagaaaccataatcctaaaaagggaggaaatgggtattgctctcatatcaagtattttaatggcacagatatgtgtttttttttagaaagaacaaaacagtcgctctttaataccaggaacaacacatgatctataatgtcaaccatctttgcttgactttaaggggaagttttgtatatgatattaaacactcataatttaacaaaatatctattcatgcttttaacagaattgttcttatacaacctgcaaatgatgtttatgtccatatgttgcaggtttatgaaatggagacaacctacctacaagagtctaatcaattcggaagtgtgctaaagggttttgaatcattcttatcatcgtcaaagaacacttccaagtaagaaaccttttcttagactgctatgccctttactatttggaggtcttcattcattttcttttgacatcccactgtatacttaccagttcgaaaccttcagaattcatgccacattctttgcttacttctgactgttgattgaatgacctactgtcctgcccttgaactttctaccagcctctgatcacatataatttagctaatattcagatgaataatttatagttatagatattgaacaaaaaatcctctgatcacttataatttatttactaatgatcagatgaacaaaagatcctctgatcactctagtggcagtggcaggtattatacaacagattcataacccaaaatatgctatgatagtgttatatcagttgtggccaattgcaggggtgctctatatgcactatctagcatcaccaagggagggttggatttatgataaccattggcataatcttccgtgttcattattctgcacaagcaaatgttttatcatgcctgttctgctaataggtcacatagaattagttatgacagtttctgtcttattaatttcagtctcaagcgctccaggaagttccaggctgatgagaggctgttctccctgtcatcggttacatctccagcggtatgactaatgatcctaaatcctaatgccactgaaaagccagtgcccgtttttttaatctgttggtttgctttgatcgatgattgttattccccctgtgctataccgatatttgtgaggttgctaatacataccattattttttattcattccaggtcgatgaacatatggctggacgagatggtaagttctctttcttgttttcattaagctgaaaccaggaacaattgagactctgggctcaataccagctgcatcctggcagatggaagagaatatggatcaggtcgttcgaaaggcgcaaccactcctgcaaacgggcagtaagtgctcagattacttttgcggcaaaaaatgtgctatcgttctcaactttacatacattcttgccaggggcagtgtttgtctaacacttctttatattaaaaataccagtgtttctaggaacaacccttttagttgaattgcctagttctgacccctcgtgtgtttggacagaggaaaaccaaagaaaggaggtcgccctggagggagagacggcaagagaatacggccatcaaatgatccagatctggacgatgaagaggacttctaactcgacatgttgtaggcctagctcagtgatgatttaaccttgctagactcatgcttcgagtcattctttctgtattgtaattttttttaatcttgtgttgcaatccatggcaagcaaagccttttccccagggagtagccttgctcatctagtatcttatcatcggcatttgcctgtgcttgcattttcttccttttcaacccacctcggcgttgtctgattgtctcccgttttgtaaagcagtagcaggttaattagacggtgataatttctgttaactctactgtaaacaacgttgctatagattccagactccagtgagacgaggatgagactccagcgagacgagaatctggattggccaattcttagtactagaaaaaaatgtctcatctgattataggtttttatattttgggacgtgtagttgctagcacaccggcacaccgccacgtttgcaagggccaaggtggagttgaatctgtgagttcacctgttgcattgcaagacaagctggaacttgtaatctcaaccattagattgcagggtgcctgaggttaatttgtgtacactttttttagtgtagctagcaaagactacaagtaatgctttttatattagtataggtgattagtctaagtacaatatgatggtgcaacacgcaggcatgcatgtctaaacagctgtgcttagcttcaagtatggaaatagcttgagcatcacttcttcaacaggttgcattgacaaatactccctccgtcccaaaataagtgcagttttgcactatttatctttaatttttgattgttcgtcttatttgaaaaaaaatttatgattactatttttattgttattagatgataaaacataaatagtactttatgtgtgactatttttaaaaaataattcataaatttttcaaataagacggacggtcaagcattggacactggtttccacgactgcacttattttgggatggaggtagtatttttcattttcaaaatcttaaatgcatttgtccatgaaaacatctttcttggaaaagatgtcagaagcttttatctaagaatctcgctgaatcatcatgtttaagtcgatcacatcagctgcatatatctgtcaacagaagaacagaacaggttgaaaaaaaaaaagctgaagctgatatttttttactagaaacatcaagaacactagtagcacttattcagaatgagcactgttgaaaatgtggtgctcttattgagaatttcacaaaagcaacacgaacagagactctatcatacatcaacctaggagacgcccaggttggcagctaatatcaaacaagatgtttaaagctttgctgcaggactccgatgtacaaagtactgaaaaccatggatcatctaggtacagggaaaagaagatagaagaaagcacatcagtaccataaaagttaccacacacagcagaagcatcgatctatctacactcagccaaaccgcctgaaagaaccaggggggggggggggggggcaagcagcatgccttgcatcaaggttatctgaacggtctacggcacaacctggcataggtgcctctggaggaagaattcagtcagcaactgtaactaatccttggtttatttttctagttcagcatgttgcgtcgcgaaagaattcggtcggtattgagggtgggcagggcttcttcgccacaaatttgtactgcagaaacaaaggtacagaaggtcagcattagaaacagtacagataactgaagaaatggggaggatatgccgtttataccttatgttgggtatacttctccctgattgcaggaaggttactcccgggaccaacgctaaaaaggcggtgcaatgcctttacacagtcgcttaactctgacgacttgtattgtgtgtagtgagcaagggtggaattctgcttcaaatttacaatgagaagcatatgttagctcttgtaatttttttatttgaatgctgatataaaagatgtatggaaagttcaatacgatgatgccaccacttacccaagggtgctttgttggctgcagtatgaatttggccaagaaaatagccgatgccgctactagtgaaggagggtaagaaagtagattgtactccagcagtga

SEQ ID NO: 38910 - DNA, 7008 bp, Oryza sativa
cgagtgtggtctttaggctccaatcaactaaaaaaatgtttggtataaaagcttacttccacaagccagtctatcaggatcgctctcatgcttgggtttacatccttttggattgtttccataaaatcagttgatggacgtttcctggtctgcttcaagtcaaatagaaaatcacaatgtaaatatgaaattcaacctagatttgaaaccactgtgctcaggtcagattaattgtcatttggtcaaactgactgcagtagtgcagtccatgtcacagcaaaaacaatgagcaattgaaaaatacttcaagagcattgattacaacaattgaaatgtatcaattcatcggttcagtcaatgctttaagcagataactccattaaaatttctccatattatactgtgcttctactggttctataaggaatttcaatatgatggccattaaatggaacccactattcagaaaaaaaaagtattctagaatgttttatgtaaggtgtttacacaatatgcagaacaaaactactgaaaattgatggtcacaaagcatgtctggtattagatgataaggtgcaccaacaaagcgaaaagcagaaaagaacggattgtggtgaaatgtgaaaaatatcctgataaattacattggaatactgccttatatcagtgatgtgcacttattctcttcttaatttatggtctcatcaaagtaaactttttttacttgtgtttcatatggatgcaatcaagtctcaaatcatgaggaagcaaaacaaagccttcctatgaaaacatactacaataaggtgctcaagggaaatgttttcagagaaataaggtgtagacaagaatgtattacctcagcctcgcgcaagtgcatgtagatatcagaagcaagagtagcacacaactgcggatcctcgtagttattgtcaacatcacaaatttggtcgatttccattggggaaggagcatccttcttccacttagtttctgcgaaacaaacaagggataagatcaatcaaccattccaatagaatgcaccatatagcacaaatttttctagctataactgtgcatttcagcaaccaaaacacaccttcgacatctctatcctctgagatacgcaggttttcgtttgctcttcgctgcaaggaacctagaactgaggaggaatccccattatcaatgtactcaaattctgggcttttcattgagtcacacgtcgacatcgtctcgtcaaccgaaactgaatctcctgaatgcataggggagacgaagctgctgcagggtacagtgacaggtgccagtgcagcagtcggcacaatgctaggcactttaggaggaagaacagactccttctgtgtggcgctctcatggcgggatatggccggagccggcttggcggaagccgatttcaccgccgaggcccgattcgtgcccacattgcggccactggccaaagatcccttcttcactggtgcagctgaggcagctaaattcaacttctgcaggaggatgggacaagagaaatcaatttataatttatttcaatctgttcatttgggattccacagaccacaagcatgaaaaggaataaaaatttagaaacattagcagcacgcaagtatcatattaccaatagaagattccaaagcaagcaaacgtacaaaacacttcacaaataccaagaaagcttgatttttgaacttttgaaggtgccaataaactttatgcctgttgaccatggatgctccccaagaaatcaatcaatcaaataaccatgaaaagaagcctcaaaatcagcaaggaaaaatcttgtggattgaaagaggagaatcctcaaaatcagcaaggaaaaatttggcagaggtccaaatttgaatgggaacagcaattagaaaaccaaaaggcaataaaatcttggggattggaagagaagaaccgtttgtaggttaaacaacgagaaattgaagaaacgaaaatcttgtactctggaagaactcaagaagacggattcaagaaacactatttttcgcttgaaaccaacagatcaaggcatatgcccaccacaaagatggaaaaaaaaagaagcaaaatcatatacagatcgcttcggcaatttccgaatcaagaaatcccccaatccaagaactgcagaaaagcgaactcgatccgtcccaagaacccaggaggaaccaccaaaagcaaaagaaactaagaaggccaagccaaaaaccattccaaccacatcacggaccgaaagatctcgaacccaaaccgcgcaaagaacaaagccttcgagaaaagaaaaaagaaactccccaacccccccacaagcgatccatcacgcaccgcattgccggccttccctggggcgccaccaccagcggcgacgttgctgatgttgctaagcgccacgcgcttctttgccgcggcggcgcccgctgccgccttccctcctcctcctcctcctccctcccccaccgcgggtcgcttcgccgccgccgccgccgccaccgaggacgacgacgacgagcggcgggaggctgctaggttgctcgacatcggcggacggcaaactaccaccgcaacccacctcctcctcctccgggcgctagggtttgcgagggcggaagcgagggtttgggtgctcttcccgacagaggccagggggattgggaggagaggggagggtaggggatgaaagaaaagggggaggagtgctactttaagaatacacccctgtactttcgattctttgcagttttgggcctaccattctactcacattttcttctagggttgtactggtaagcagttcagttgttcaaatttcaagcagtggcatgtgcttcaaccttgctactaagggggtgtttagatggggttaaaactttttagcccatgtcatatcggatgtttggacgctaatttggagtattaaacatagactaataaaaaaactaatttcataaatgagagctaatccgcgagacgaattttttaagcctaattaatctataattataaaaagtttactgtagcatcacattgtcaaaatcatgacataattagactcaaaagattcgtctcgtgaattagtccaaggatatggaatgtgttttgtaattagtgtatgtttaatactccaaattagtatccaaacatccgatgtgacatggacttggaaaaagtccctggaaaccaaacaggccctaataatcatcgggttgggttgcggttattttatccgtaaacggtttttagttattcggtcacctcgtgggtgggttattatgtttccgaccgtttttttatggatattgtggatgtagagctgaattgattgcaatgtgttacttcttttgttcgtggacggtaacggatatttaacatgatattgatgcttagatattcatgtttttagcttggagtgtgtccaaaataactttgtttttcgatagtggatggagcgctatgagtatcataccggagatttattacaaacggacaggaaggtctggaactttgtgcaaaacgacgtgttttaaagattgaaggcgttactctgttactccatacatgccggatatttataactaacggtcgaggagtttaaaatgtgtacaacagtctgaaagttcaaaatgtgtcaaaaacgacatgtttttaatatttgagggagtaccatgatataataccatatatttataactaacggttgagaagtttaaaataacgtccaacggtcggaaagtttaaaatatgtcctaatagacatgttttatatatatttataattaataattaatagacgggtcaaaacgtaagattaaacctttcttaactgtgtgaaaggctactatggaaaaatttaattacaccataatggcacaatattgccaatgaaaataccccatataaacaccatttacctaatcctgcacctatagaaaactttgcggccacagtttcacatggacaatgtttcatttttttgctttggttattccaaattcctgttcattgactctcaaatcatcagctgtcaaagcactaagattaagatttgacttttgtcccttgtggccagttgatactcctgcttctgtttttgaattttgaaatctgaatccccagggtgagatggtggtggaggactcctttgtcacagtgcaatttagggaggaccaagaaagaggtcatcactcatcaatgtacttactgcatggaaagagagcaaagcaacagcaaaaggctgcgtggatggagtgttctgttcaaccttcaacggtgcgctccctttctttattcaaaaaaaaagaagaagaaaaaaacaaatccccatttgtttatcgccacatctagtggagggaaacgggcacgtttgaatcgtcgatccatcccagccgtccatccgctcagcgacggcggggaaacgccctcgcgtggaggagcgtgctgggccccacctcgtctgggtgagagggcagaagggtgagaggattaccggggaggtgagcggaaggggcttcgtctggatttgaatcttctttttttttttgaactgattgggggaggactaggagagtgtgatttgggatctcggggtgtgcattcgttcaaatttcaaaaagttcaaaaagaacgttgagggcgaggcagacagacaacgtggggggcccacctgcctgccgccgtggccgcgatgccgtttgttcagtgaccgtttgttcatgcgtgcgtagtgaactggtgaacggggtgtggaaaaatcgcatagtatgtttgtgtttgcacttgcacatcttttttttatctttggattttgtaggaaatgatttgatagcttctctaaaaatagaaggcaaatcctatgttgtaaatgagactaaatgctaaaaaggatacgtgtgtgattctattctcttgatttagggtaataccttttcggggagaattgaattgttcgtaggaatagaacggtagtactattttttttccatgaaaagaaatgcaagtgctttgtgtattgaagatccttggagtacaaccttggaatttggtgagaacgaaacactattgttcttaggcttcgtcgttcctgggcgatttgggggattgagagagaaaagcatctcgttttccgcgcgcacgcttcccaaactactaaacggtgtgttttttgcaaaaattttctatagaaaagttgctttaaaaaattatattaatccatttttgaagtttaaaatagttaatactcaattaatcatgcgctaatggctcacctcgttttgcgtatcttcccaatcccttttccttaaacacaaccttagagcatcacttagagcaggtacaatagcagactattagtcagttattaacatattttaaggagattaattaggagagagaagagtagtgggctacagatttgtagccagctgtaacacggactccaagacgctgtgtgtatgacaggtgtaaccaggtgttaagggcacccacaatggttatctataagctctctacaagagatccatgtcagcatattttcctacttggaagagattaaatgcagagagagagcaaagctatctactaacatggagatagtctatagagaaaaacgaggcaatggattagagagctatagatactcatgtagacataccattgaagtggtttactattaatctagtctattgttgaggtgtacatgttttatagataacaccttactttaccattgcgggtgctctaatagtgtagtatgtaactattgtataagtgagctattagattggctatagatgaattggagttagtagttggctatactattaaacttgctataaggttgtgttcttatctccaagttcccaacccctctctctcgtttttcgcgcgcacgcttttcaaactgctaaacggtgtatttttttacaaaatgtttctatatgaaagttgcttaaaaaaatcaaattaatctttttttaaaaaaatagctaatacggtactttaattaattatgcaacaacgcgtgctttgttttgtgtgccagggagaaggggtttctaacccctcctcccgaacgcagcctaagagaatggctaaatcttacccccaatatctgtttatgggaatcctaaacaaaatttaaggtgtgaaaatggttctctttccattagattgggtaaaatcaactccctagaacaaaagggtggatcccatacaaaactactaacagaaattagtttattcctcctccttcaggtcctgtgtggtttgtccctgtacgtcgcacccctgtattgcaattggcactagtgtgctagcaacaccggcgctagtaaggccattcacagtgcggtgacttggcgtttggactcgcctcaccagctcggagattctgagctagcttggcgtgggtcgtgcctgaaagaagaacgcgaagcctcatttggatgcgcgaacctcgtcagaaattgtcaggtggtcccaatgagccggtcccctcctgatcttcaaccgttgccaccgtcgagcttcctcgccacagttatcgagctttagccaaatccaacgaggtagtggaagtgggtaaacggaggtcccactgtcgttgtcgttgccgtcgtcgagccactgccgtcgccacctcccgaggccagatccggcgagccccatgctggatctggtgagctcggtggcgcgtggtgatcgccgccatcatcgagctaccgtcgccaccatcatcgagcttccttcgccgccgcctcccggggcttggtatgggtggtctagacctcctctctctctctctcctcctcctcctcctcctcctcctttgcaggcttttcagttgatggacttggttctttactaggatccgagcaacctcacaaaaccatggtcccccatcttccctctcttccaccacaacacttgtcctacatggcgcaacgaatccacgcgacatgataccgcactgtgaatgaccta

SEQ ID NO: 38911 - DNA, 2640 bp, Oryza sativa
acgggtggcaaggcatctgagaggccggcagcgggtggtgggctggtgttggtgtggagcaaagtgaggcgaatgggaagggaaggagcccggctaggcgggcctcattggcatggtgatgccctttggcgtcggcgaggtcggcggcgacacggtggggggtgctggtggagaaaagaagtgagcccttcgtcacctgagagaggtagctcgtttgcatctcctcttcttcgttagtggaagctcactagggtagaagggggctcaccgaagagaggtgcagtgagctcatcggaggaaggacgtgctcactcgctcgctctcatgtcttcacgtgcatggtgggtgaaggcgtggagccatggggatcgaatgatcgagaaaaaggtaatgtagagagaggaggaggcggattgttgggctattggagtgcttgcacccactaggctcacttgggttagtgtaggcaaccaacatggaataagttcactttgactcccttaaaaagtgacccaaatctaatccatgactctaacccataaaactaaatatctcgacccccgaactattgaaaccggtgcaatttgactcccttggcggttttggagggcagtttttttgctgatgtggcgcctacgtggcggtattgaccggctcttctttacacttggcgttgacgtggcgcttaagtggcattagaattaaaaataataattcatttatcattcacacaaaggatgacatgtggatcccacatgtcatcctctctcctacccttcttcctcctccctctctctctcccttctttcattctctcccccagcctttctcttcaccactggagcggcagtgacggcggtggcatccggcggttgggagacggtggaaaggcggctgtggcgcacgacggtgggcaagtggagccggcggcgagcggaggagacgcgggcgtggcggggagtgaagacggcggcggcatttggcggtggctgccatggatagggtgaggtgggggatctcctcgacaacgtcctccaccgccaccatggcgtgcaggccggtcgtgtgctccgcctccgccctcacgccgttgcgccaccgccttctccccctcgtctgcgtggctcgctgctccccctcgtctgcgcggctcgccgggaaccccgccgccgcgaccacatcactctgccggcgctgcgaccacatcgtcctgctcctcgcggtgagctgcgccccccatctcctcccccgcttgccacccaactcccttgccgttgtcggcctgctcccgcctgttgctgtcctttgtcgcttcctctgccaccacgcaccacaggccgaaggggaagacgaaggggagagacggaggaggaaaaaggtaggagtcagggaggactagcatgtgggctccacatgtcagtgggcccacgtttctttttgtgtgaatgactaatgggtcccacacatattttttaattctaatgccacttaagcgcaacgtcaacaccacgtgtaaagaagacccggtcaataccgccacgtaggcgtcacttcagcaaaaccgtcctccaaaaccgcctagggagtcaaattggtgatggattagatttgtgtcacttctaagggagtaaaagtgaacttattcccgaccaacatattccatgtttgtcgatgacaattcatatgatcgatcgcctaccaatagcaaaatgtagaatttctcttcatataatgctacgtcattgctatataaatcaatttttttcacaataaataaataaatcactttacctggagtaatgatgatatttttctcctcctcatcacgaagaaatacaatctggatcaaaaaatcgtatggaaccatgacgtatagcaacgtaacctgggccttgggccgtcgaagcaagcccacctaaccacactcccagcgccgccgccggccgtacgccggagaccggagcctctcgggaacaccgccgccgcttggccatctcccctgccgacgacacgaccgcttccaccaccgcctctcctcttctcttctccactcttctcctccccccgccgccgccgccccacgcgcgcgcgcgtcctcttaaatttagccgatgcctcctctcctctcctcctctccatccacctattctcgccccaccctctcctcctcctcctcctcctccgcacccacatccaggccgtcccgccgcggctggatgagggctcatcgatcccttgccggccgccgcgaccgcggtgcgtccatggagcttgcgcgccttggcctctcttctgtcaccgcgatgtctcgccgtggagcttgaaggccgccgttggttcggtcactgctaggtccgtaaatttcgttctttgcttgtgtgaccattctttgctcgaatttgttgtgattggtgggagattcttctgcggatgatgaattctctttttttttcttctctcccatgcattggggaggtagggaattgggtatcgatcggttaggttcagttcttcagtttgattggtttatattacctcagttttttaatagattacgccgttgactttttctcacatgtttgaccattcgtctttttcaaaaattttatgtaaatgtataagatataaatcacacttaaa

SEQ ID NO: 38912 - DNA, 3126 bp, Oryza sativa
aaatggcacacatgttgttttgttcaaagaaactcaaaacggatcaagtatagatgtgccttttgttgttctagctgattctttttttttcaattataaagcttcaaaagtatattttgtgatgcgttcaagacatttgcacgacctatattatatatacctgcatgttgtattatattctaaacacatagtatgccctgtttggctcgatattgaaaaactatcatgatggacagtatgctataggagacatggggaaatgtaaaaagaaaaaaaagaattaaaaaaaaggtgaacgcatatgatctgatgatccgtatatatgcatttgtcggacctgcatttaccgttcttggagatgctcttgttcattggccttgtctgtttgagttccatataaatgtatctggaacaaattctgttgtctcacattctgcttgattttgaaatccattgaattctgcttctggctgatacttatgaggtcaggcagtaaatgatcaataaaccattatcatcactgatttgttactatcctaatctgtgcattttgtgcaagtttcagatgaactccatgtcatacaacaagctgtccataacgaatgacagaatggatttcaatacccgtggaaatgcagtccccaatggcaaattagatcggaatcagtcaggtgtttcagccaatcgatcctcagcctccaaaccaacagcacgctccaagaagaaaccggatcaagctgacaaaacaaccccaaatccagcgcagaattcagcatcatcagcaacaagatccgaagcagcgaccgtcacgacgaccacgaaatcgccggcgatcagcgtggacagaagcagcatcgcgagaagcaacagcctggacagcttcagctacggccaggcgaagcggcacaccggcggcgacagccggtgggacgccgtccggtcggccagctccgtggactgccccctcggcctcgtccacttcaggctcctcaagcggctcggctacggcgacatcggcagcgtctacctcgtggagctcagggacaccgacgccttcttcgcgatgaaggtgatggacaaggagtcgctcatcagcaggaacaagctggtcagggcacagaccgagagggagatcctcggcctccttgatcatccgttcctccctacgttgtacacgcacttcgagaccgacaagttctactgcctcgtcatggagtattgctccggcggcaacctccattcgctccggcagaggcagctcaacaagcatttcaacgagcaagctgcaaggttggttttggtcacattttcaagatcactccagcatatatcctctttgcctcaacatactacatacaatgcttgcacattgacatggatatatgtcattgagtaaatttgcactttacaccaggtaaaacgtactactttgttttccctttacaagaggtttagcacatgttttagctttacaccagggattattgaagtattccctccgtttcataatgtaagtcattctagcattaccaacattcatatagatgttaatgaatctagacacacatctatatctaaatttattaacatctatatatatgtgggcaatgctagaatgacttatattatgaaacggaggaagtaagtttcacttaacactaggacacatattatctaaaaacactaggacacatccttaaacctatataaatttgaagaaattttataaaagtctgaatggaattttctgaagcatggtctaaattgaagaagcctcaaaagttccactcatatttcacaaggtttcacaacgatgtacgatgcaacctagtacaaactgcagagtatttcaaaacaccctggtataaagtgaaaatgcatgctaaactcggtgtaaattgcctttaaatcatttgctcaccatgattctgaaaatctctgaatgttttttttcatcaggttctacgcatccgaggtgttgcttgcgctggagtacctgcacatgctaggcattgtgtacagggacctcaagcccgagaacgtccttgtccgggacgacggccacatcatgctctccgacttcgacctgtcgctgcggtgctccgtgtgcccgatgctggtgaagtcgtcgtcggtgcacgcgggcgccaacggcgtcgtgaagggcctcgccgccggtggcggcggcgacggcgagggcgtcggcgtcggctgcatgcagccgtcggcgttcttgccgcggatcctcccaaagaggagccgcaagacgtccaagtcggacctcgggctcctccacggctcgccgctggagttcaacgcggagccgacggacgcgcggtccatgtcgttcgtgggcacgcacgagtacctggcgccggagatcatccgcggcgaggggcacggcagcgccgtcgactggtggacgttcggggtgttcctctacgagctcctccacggcatgacgccattcaaggggagcagcaaccgcgccacgctctgcaacgtcgtcgagcagccgctccggttccccgacggcggcgcgttcccggcgccggcggcggcgagcggcgtcgcgcgggacctcatccggggcctcctggtgaaggaccccggcaagaggatcgcgtcgaggaggggcgccaccgagatcaagcagcatcccttcttcgagggcgtcaactgggcgctcgtgcgcagcgcccacccgccatcggtgcctgaccccgtcgacttcagccagttcggcgtgagggagaagccggcggcggcgccgacgaaggtggccaagccggcggcgagcgattcctcctccggcgacttcgagtatttctagctcccatctgtgagtatttctaggaactgaaaaatacatttagatacagaaaaaaaatatacagtctattgattctttgttactgttgtattgctccttaattacagtacacccatacatgattcttgggatcctggtatacacatgtacaaacaatgtgatagcttgttgctaacaatgattaatgaactgtaaaatattctgttacactactgacagatgcagatgttcatttctttagctgatcaagctttgccttatatgcagctcatttcttggctgatcaaacctgc

SEQ ID NO: 38913 - DNA, 1853 bp, Oryza sativa
gttgaaagacgtcatcaaaatggacgtcttcaaaaccaaagatagaacacgctctgctctgtctgttaccacgtaaatataggcatatataaactagtgcaacaggttctattaaaaatttaaaatgcagcaggttcaaagcctaggctggcagaattggaccacgtttcgatcatccaattggtgtatcaccagaaacagctactaaacaaaatggctagcactgaactcaacccgaattcttgcataattaatccgaacgatcttgcctccaaacaaaaaacctacacagtatgtgtaacgagtgctatgatctatacaccattttcacttttgagttaggcaggtgaactgcaatggtcaaatgctctgacgattctagctgctggtacactcaacgatctcatctgcggcagccggcgagtctcttgtcagtttcaggaagtgtgtgcggttcgcggccaagtccttcctgagcagttcagagtacttctccagtgacttcttgaaatctgcaaacgatctgttgttgtcgcggggatgcttggtgcccttcgcagaggatgatccaacgactgcgccagatatgtatgcgtcgcacgcatccaggatgacgcgctcacgctcatggaagtggcgtgcaacaagggactcaaaatgctgcagtgaatgaaaggtgtgtgtgagagcgaatcgatctgcaagaggtatatggaactgaattgtgtttataggacttcataggtacatatggtgatgaactgatgatgtttcaaaatcaaatgttcttgcgctgatgcgctcacttattcagctgtttatttgcaataacatactgtcaaaactccaaaacacattatcacaatgcgtgtctttgttagttaaatgtgcccacagataaatttttaagttggcaatttcatgacgcaacacaacacaattctcaagccggaaaatcgctctcctggcaactgaatgcctgctaaagagtttcacggagtgacaagtacggttggtacagcatgactaatgttatagtagttcctaactgtatatcagtatttaaaagcatataggcacagagagcagttcactttatctggatgactgtagaagcactgatataaccctgacagctgaaattcttctattactatcttttccagcacagagacttgtgaaattaccacttttaacttgacgagagatgggggttctgtagttacctttggaggcttccgaagtgaatacatcattgtcctgcaggatagtaggaaggcagtctgattataagccaacgagtacttttctccaggagctgtattagccgaatttttgttgcctggctcattaaagtatggtttatcattcaacacaagaccctggatggaaaccagcacctgcagtatggttgattttgacttgccccacttctcgcatccagtaccccaccaggtgttcagcaggctaaggcaaactttcccactctcatacaagtttggatttagccgaagcccacccgaatggtaatgaactttctgtacatgttggatatgattttaaagagattatattaatgatggtagtaacatgaaaataatggtgcaaagcgtgtgtgaactgtgaagtggttacataccggtggagattgtgggtattcagaaggaaagcgaacatcaaagaagaacagaccatcatgatatggagttccagctggcccaacaatagcagccctcagcagatcaatcctatcctcataagctctaacatagatagattctgcatgattgaaaccatgctgagatgcaagttgctagtactgaagacatcatataatttcaggcacagctcct

SEQ ID NO: 38914 - DNA, 20042 bp, Oryza sativa
ggactcagcaccagtcatgccaggactacaaaccacacaagcaaattggtatagcccatacagggcatccaactatctttaagtctagaaatatctcaaacgtattctgttggcatgtgatcagatacaattggcataaaacagcaggtctattataagaaaggaccattatatgtattcaccatctaggcactggcggtttgataaaaatgcatacattgatttgccatataaaagcatgtactgaccaggtagatctttctgtagaagcttccattcattttggattgtcttcacccaatctttggaggtctggtcagtggtcacaagtaaagacaggaaattaattcacagttggatctagtgatagaaatagagttcataaagcggcacagcttaccttccctggtgaattctttgcatagtaatgatcagaaaaatcttgcacaacatcaaattggttaaacaaattgtagccatcactttcagatccatattctgtccttgtcattgatgatacaacacttgaacattcaggctcatgtttttgcactaatagcacagtaccattcccacttgaaaagggatccaaaaggctgttgtttgtactgacatttgcagtggggtgtggagcggcaactgaaagtcagtagagtaactaatttcaaaccacgatgttataaaaaaaaagcacatcaatcttaaagacagagatacagaatgggatatggaagctcgcttaactgcaaaaataaagaggtgtacttggcatcagtactaactactggcagaaaaacagagtgatgaacatttagataatgtgtagttctgttaaagtaacaaatatcccccttttggggaacgggaggggaggaccctaaattttcattgattttattctttaaaaaacaggttcagcaacatgaagcatgagaattactaaaacaaataaggaggaacaagttgcatgaaaagatacctttacaaagaggattaatggctttgcctgcatgaaaaatattcttttattagaaaacgccaggcagaagagcaaaacacttgattttatctttctgaaacaaaatgagtagaactccgtgcttcagagggagatgggtatacaggctaatgaaatattaagtttgttttttctttatacagtttaacaaacttcaaaacagtgttgacaaccaagactcatggattcataacaccagactatccactagttcactctccagtggatgtatccaaccacactaatagcactctgaatttgtcaagattaagtttatactttacacatcacattttggtatactttgaagcatctggtatagcaatccagaccaatgtacagcacccacaattatccaacaattttaatccattatgaccacctcatttgatctgcagtatcctttcaccggaaaacacattaatattttcacttttttttaaaaaaaatgcagaattcatggaagaaagagtacacaagacaactaataatatgccatcaaaagaggaaagcatccttggatcaatcaaacaaacagaagcagctgatgtaaacatgatgttaaataggggcagtagtgcagctgtacagcacctttcttcttggaatccttcttcttcacacaaaacagctcgagcaccttgtttagaaccatccttaaaacccgcttcacgcgaaacgcacctgaaaaacatgagacgccatcgtcagaattagatagccagaaaacagaaatataggcgtcgtccaccatctccaaaataaatcatcttctcaccaagcgtaaccgaaaagggaaaaaaaacacaatcttttggagaatcccaactcccccaagcaactagtattttctcccttatatttacttctatttacacaacacttcatgagtgaacttttgggttggaactcttgttcatctgcctcacctgtcggcgtctaactccacactccaattccaatcagtgacatacacgaaggcttgtccaatacgatcgggacaccattacccccaagaacagacaacaacaacaacaacaacaacaacaacaacaacaacaacaaaaaataaaaaaaaaagaaagaaagagaaaaggagaagagagaaggcattgaaagcaagaagccaagaaacggcaactacagcaacagaacaaatccgaaaaaaaataaaaataaaaaaggaataaacttggaccatcgccatctatgaacaggagtatcaaccatccatccaccacccccaattccacagagaaaaaaacgagagatcgcgcgaaggtggtgataatccccgatcagcagccacaaaaaaaaaagaaaacgaaaaaagaaccctttccccgcaagaacgatggctgctggctgcatcgatcaagaagaagaagaagaagaaaacctcgggtttgtctgaggtggtggtcgcgctctgcagttgagaggggccggaggaggagggttttagttgcagtcggtggagacgagactgcaggaggcaggaggagaagcggagacggacacagggacacttgctgctgctgctgctgctgcgttgcctctaccacttcggcgagagagagaggcgcaatggccgcgaggagggggtggaccgcacccttgcgtgccccgcgaggaaaagaaccaagcaaaagtgtagtactactcctactagtatctctccgccgctgcgtcgcacggacgtcgtctcgtcgtgtacgtgtaccggagtgtggccccagccgtatcggcacgcgacgtctcgttcggcagaaaaggaagtctggcgctttcccccaatcagacgaccgctacggccacgccacggcctcaccggtgtttcccttgcatgaaatcaaaatttatttccgtttttaatttttcatccaagtttatttcttatcattagtttctaaattgctaaaaatatatacataaaaatttatttataaattattaaaataaaactaatttgatattttagatgttgctaaattttaatataaacttgatcagatttaataaaatttgactagaaaaaaattaaagaatttataatatacaatagaggaagtagaccctatctctatggaaatcttagtacggagtactccctccgtttcaaaatatttgacaccattgattttttaatacatgtttgaccattcgtcttattcaaaatatttattcaaaatatttaagtaattatttattcttttcatataatttgattcattgttaaatatactttcatgtacacatatagtttaacatatttcacaaatttttttaataagacgaacagtcaaacatgtgctaagaaattaacggtgtcaaatattttaaaacggagggagtatattagtagccatacggtatattacgggaaaaagataggccctacgtgtccacgtatagggataattctatgggcgatctcgcgacgttctgggcgtgatgcgtagtagtagtaaccaaaacaagccttttgctgctaatgtaatccatccctataaaaaaagattatagagtacggagtacttttttttacatggcgagatgcgacaaagatttaccttctctttttttgggtttgtttttctactgatggaaaccgacagaaatttcagctgggattctggcaaaaggcccagatatgatccggtgaacacaaacggttctggctgggctacctgtccttctggcgcagttgaatttaggcctgtttgaatgagcctcaatccaggcccataagcatgagggtaagtgctatgatagatatgactattgtctccaaatttatctattttattcactcataaagcaagaggcaacccatacaatgtatcacctctagtttacaaataccaatatatctaatactctcacatcctttttgaaatttgtgtggaggttgcctcttaatttaggggtggctcatcatctctctcttcacttttctcctccacctcatcacttaatccaatgtggcacttgtaggagcaacatataaagcattatagtacttgccctgatgtgctggtgtttgagtcacgtggaggaatatgtttcattcggacttggagtactgtgttccaaagcctctgtgattttaattggaaaatccataagtaaattttcgtctctaatggtatctaatcttttagggtatgtttggataatgggaaatgaggagtgggattgggagtgaaaaatgaatgaatggttataattaaatggaagagggagaataaatggttaggatttaaagatgtcttttggtgggtgaaaaatcatttccctaacacattaggcaaacaaggcattaggcttaagttgttagccttttggattatataatttataaacaaaagtcttaataagttcaatggtggagtcgtatctctatctcactaatagtaatagtgggaatctagttcaaatcctacaaaataaaaagatcgagaaaacatgattttttttttcataactccctgtactccctgtctccatcacatccatttcaaaacggtgcttcccaagtttgcagtacagctaacgggtccttttagatcagtaatactttttgaaaagttcctcaaacagaaggcattttataaagaatattttcatgcgtgctaatattaagatatactaacccaaagacatttttttcctgatcacttgaataaatacagtggtattagatattttaagggtcttttgatttgtaggagaaccataggaattttggaggattttatcttatagaaaaagattcatatggagacatttgaaataaatgattaaatcatatcctatcctttgatattcctatggaattaaccatcctataaagatttcggagaaaatttagtaagagtttcaacctattggaaaactttctttgagtctatggctgtgtttagttcacgccaaaattggaagtttagttgaaattggaatgatgtgacggaaaagttggaagtttatgtgagtaggaaagtttgatgtgatggaaaaagttgaaagtttaaagaaaaaattgggatctaaacacggtgtatatctctcatcctattcatgtgctttttcctgcagtccaatcaaatggtaattgcagtgtttttcctattcctctattcttttcattcatacgattcaaaggagccctaagactctgtttaagaagagaggaattgagaaaattgagaagatacacaaaacgagataagctattagtgcgtaactaattaagtattaattttttaaacttgaaaatggattaatataatgatttttaaataaattttttataaaaagtttattcaaataacgtaatgtattacaaactaaagaactcggagcctaagtacaccacgggttctttgtcagaaaccgtcggagattcgtgagatggggcgaagaacagcccacacagcgcattgcgagaggcatagccccgtgcttccagccagcaaccagggaggagggccgccagacgggggaggaggtgagggccgaagaaaggaggaaaaagcctcgctgttcgatgtccactcgccgccgaggccactccaccatgtcgccggccatcgacctcagggtcgatttccccttgtagcatccggccaccggccagatccgcgccatcggagaggagctcgaggtcgtctaccaccagatccataccagcgagctccgcatcaccctaggcttgattggtatagttggctacggctgcaactgtgctgcatctacagtatcaataacatatttttgaattggagctgttgcagtgctgtggctgtgcagcagcagcaaagctgaatcgaaacaaaaaaaattaagaactgaaacaaaaaattttagtggctaaaatattacatatagccacttgcactatcaagaattcagattttggatcatccataaccctagcctacgtgacacccccagacttgtcaaatatgtgtgacgcacgtgaataccttgtcttctttctgcgtgtactccctccgtcctaaaaacacccaacctaccacttagatgtgacataatttagtactccctccatcccttttaagtgtaaccatgaattttcgtgtctaattttgatcgtccgtcttatttgaaaactttttataattagtatttttattgttatgagatgataaaacgtaaatagtactttatgtgtgacttatatttctaaaattttttaaataagacggacgatcaaagttgaacacggaaaatcatggctacgcttaaaataggacggagggaatacaacgaatctggatagagcctgcccagattcgttgtactagattatgtccaggttgagtttttttggacggaggaagtacgtctacccatattcgttgtactagattatgtcccatctaaataattggttgagtttttttttggacggaggaagtacaggggatataaaaacagatttagcgaaaataaaagtaggccccgtttagatcccacctcaaaattttacaccctgtcacatcgaatacttgaacacctgcatgaattattaaatatagggtgtgtttagttttttgggtgtaatgtttttgaagtgtacgaacgcacatttaaagtattaaacgtagactaactagatgataccccgcgcattgctacgggattgcaaaggattcattgagaaaaatataaagataaatcatatttgtacctttaagaactatatcagttagatatcatatatagcatacatcagtatatattgcattcgtgtgatgcataatactgaaaatatggacaaagttaaatgcgacccataaaccatccaatttaactggagaacataatttaaatcatatcgaaaaagagtgaaattgtacagatatagagaattaggaaataaaaatattagttgcgtgagcatcacttgattgaaccttctataagaggacatctattttgagacatgggagcaacaaataaaacattagcagagacaaaagacaaaaaaaataaatcaatagactaacagaaaccacatgcttgttttgttgctatgcaaaacgaatgcaacgtgcaacagttctgctcgtcacggtactattaaaatctaaactatgacgtgctttttagtggtgcacagtatagcatgaaaggcatactgaattaaaaaaaaagtgaatagaattttaggcttacaacacaatttgcgcagtatagcatgaaaggcatactgaattaaataaaaagtaaatacaatctttaggcttacaacacaatcaattaggaatatttgcaagaaactatatgatcaataacaaatattctgtgattgaccgcacctaagttagctgctagaattgttcaagtgtttattcaccagcaagaagcaagttgccatatcaatattttaattattgattcctctttcccttgcatattctagtaaatagtaataggaaaataaaatataacattagataaaatataactctgcatcggagtataacaaattagacagtagcaactacacgaattattgtggtgtgaatacaaaggaaataccaatataaattgccaaatgttggtagtatgtgcagtgcgcaagacaattaactaaaggatttttttataagaattgtattgagtaataaatctgacactcgggtaaaactgaactattaattctttgttaaaaaaaagaaatatactgaaccaaccatccatctgtttcattgtaacgacatttttgttggtgatatatacatatacataaaactgcaaactcaatcaggccaccattgaccgttggtgaccttctataatcaaaggtcatggccacatgagacaaagtgactcaaagatgatagtgtgaaggtataagtaaaatttaactatttcaatacgattaagaaaccaacataaaaatgaacaaatttgaggtgataattaccagctcttacgaattatgaaaaaacaccagtccaccttgaattcgctcttaacatgaaaaagccaccatttgatgacaacaacagggttgaaggatatagaaagatccatccttataatatgatcatcattcagccattccgtttaacatatgacagggacatctgaaaatatttccaaccaacgccattccataaccgtcaattacaggaattaaaaaacggattagcagtaaaatactcaccagggagccacagcctatgggagtgaggagctccctggtgtactgctggccaggtaagggaaccgacgcacggggagggagtgagggagggagggagggagttgagcgggtggaggggaagcagcgcaggggaaggggaaccatgcggcgccgcatctacgtggggaaggggagcgaacagcttggggaaggcaaaaggttgggttgttgggctgtcaaatgggcttttcgtgtgtaatacttgggtgttctcaccaggataacatatgcattgatatcataccattgagatttcatccaacggctgctatctttttggatgacgtggatcaaccacagtgcagagaattggtaataactgcagttagtggggatcacttgtataggtatataggataacaaaacaaattacagattccgcctgtaaactgcgagacgaatttactaagcctaatcaatctgtcattagcaaatgtttactgtagcatcacattgttaaatcatggcgtaattaggtttaaaagattcgtcttgcaatttacatgcaaactgtgcaattggttttgtttcccacatttaatgccttatgcatgttatcagggttatgggtaccacatacctaataatagttgactaagcacgataggacccaccatataccaagtctcatacggaatcatacctcgtatatagaaggagttctggataaggaaagcaaatagagttgtatatggaaacgaaaaggactactcggatcgtatccatgcttatctccctagttctatttggacaagagggcatctatgagtataaatacaagaccccctaggaggagaggggttaagccacaagaccaagatcaacatagatgaatacaagccaacacatgccaagacaaaccgccgaatatcgacatcaaagataagtctagacaaacccaatattgtgtctgcgaaagccaacaagagggatctagcgctatctctgatctcgccgagtgcggatttgaggaggaaggctaccctgtcgtcgactacgagttggttatccatgccgccaagtcgacgacagctagataggttatcctaattattgtattggtgtgattatgatgaataagagcaataccggcttcggccaacaggatgtaaggctattacctgtcagataaggggcccgaacctgtataaaaacccttgtctccgtctcttttacttcaatctcgcatataccctggtaccaacgatccatatactatgcaaaataccgttgtcgcggtctcaaacgtcgacatatgtgtccaaacatttgatgtgacgtttttggccaaaattttttggatctaaacaagacctaggcttaaaaatataactaattatatagattacgtgtaaattgcgagataaatcttttaagcttaattgctccatgatttgataatatggtgctacagtagacatttgctaatgacggattaattatgcttaataaattcatctcatatgctaattagcacacgtttactgtatcatcacataggctaattatagattaatcaggctcaataaattcgtctcgcaaattagtgtagggttatagaataagctttataattagtctatatttaatacttctaattagtgtctaagaccctgtttagttctaatttttttcccaaaaacatcacattgaatttttagactcatacacggagtattaaatatagatcaatttaaaaactaattgtgcagttagggaagaaatcatgagacaaatttttttagcctaattagtccatgattagccgtaagtgtcacagtaatctacatatgctaatgacggattaattagtctcaaaagattcgtctcgcggtttccaggcaagttatgaaattagttttttcattcgtatccaaaaactccttccgacttccggtcgtctgatgtgatacccaaaaatttccttttcgcgaactaaacaggccctaaacatcaaatgtgacatgtaagatcaaatttaatcgttgatccaaacaggcacttggggacggagggtgtagtaaaaatctcctgcgatattgctgacacctagtcaaatcagtcaccacttgcgcggagctgaagagccggctcgttcctctccttcccgttcacatttcaaaacctcaaagcccccacaaacttcggaatcgaggtgagcgggagttcggagagatcaacccgagggccgccggccgatggcgatagatcagcccatcaaagcaagttctttcctctccctctctatctgtatctctcgtttctcgattaaacccagtttttttgggggtcatttgcttcgcttattcactgttcatccggttgattagagaccgagggttctttgatttgttccactctctcttgaatcatcgattaatggcggcggatttgggggctaaaagtttttgtcttttgtgttagatttcatcttcttagctgcttttcttgttttgattcttcgatccgagtgggagactgaagagagtgttctgtgtgtgtgagagagagacgtgttcttgaaaatttccccatgctttttttttcggatgacggagtgatctgatatttcagctatgttatatggttatctgtgatcttcttggagattttgcttcctctttgatcaatttggttgtactgctcgttcttggatacgatttttgttttctgtttaatgactgaaatattggtgtttacttccatgggtaatctgaatctaattcgcttgtcctttggttggttgttcttgagcagaagagagggagaccaccaggttccaagaacacgaagaacaagatggagcagaagatggaactagtccatcaaaggctcgccttacttgacagcagcagtggcagcgacagggatgacgatattgggccgagggtgagattcttgcattatcatttcccattgatgcgatacatacattgttgttgttgcaaggcattcaaatcaggacaggttctaactggaaaaaatgggagaggcatatactacaatacctgggtgtatgcccaatctggattcttaatttgataatattatctacttctacttaaatgctaccctgaataattcatgtatcgcagcacatctgtatgttgatatgtcacttcacaatctggattctatccgctcgttcttgcatgtttatgaagtgacatatcacatattaatctactccctttgtcccaaaatataagcatttttagctatgaatatggacaactgtgtgtctagattcatagccaaaagctgttacattttgggacggaggtagtatcttatcaaatttttttcataactatttggatgacatacaagaaagagggattaaaaagagtttcccgtaggttcacaaattttgtaactctgaacaggtaagtcatgacaaattatcagatgctgtatttgcttaaatggtcactttatgtgttaactgtgaattttatccaggtctataaagtactatagatgttaatatatttctctataaacttgatcgaatgagagaagttttgacttaggacaaaactaaaagaccttgaattatggaaaggagggggtatttctagcttatgtttcttttttctgttaatgctcattaacatctggtagcccctataataatcaagggttaattggatctatgccattataagaatcatgtatttaccatgatatcaagaatatatgttctttttgtacttgcagaattataatcttgcttttgttgttgctccacaggctataataattgattgtgatgaagatgatacggatgacgtgatggaggttgttcctttgaaagtaagggcagtgctgctttagttagcgggtggaattttgtcactcgagaagacatccccttgttttgtgcatgttgttcaaaaagtcataaaaaattgaaaacataagatagatcaatatgtaaaatatctcttcacaaacatgcaagttcaaattcgacctatacaagtagaaaaacaaaaacaataaatttgattacaaatagtgtgttttgttctatcgtgtcacatattgatctataatgtcaaatcttcttaaacttttttatgatgttttgggcgacatgcacaaaacaaggggatgtctcctcaagggacaaatagacttttccctttatatgattatctgtttacaatggtgtaagtttatatgatataaactacatgtgctctatttagagcatccctgtcaatgatgctacatcattgatagcactctatgtagcaacaatattttcaattgcacaaactcacaatatctgtcctccttgttatctcataacttcatttattaattctcatctcaaaaacaacttattgattaagtgttctgatttttcttggatttcttactgtgcaagatgctgatgccaaaggaggtggaaaatgagcaaagaacggttcctggcattcctcaaacatgcaatacccagaacactagcaatggacgcactaacaccactgaagtaagatatgttcaccaactctatctgtattgtatgaatgcagtatgaatgtaattgtaagaggactttcagttttcatctataaagctcataatacccctaaagatttttatatcataagccatagcatttaggatttcgattggctggctgaaatctccggttttccaattcgaaaaaaaaagatcacataatgtaatcctggaacacatctccaatctttattcagtggactttaccatttcctttccaattcctgtataatgtatacgaaaccgttgcacttttgagctccattactcataactgaatgagttgtgacttaacaggtgccagttaagggccaaaataaatgtgcaaggtattccagctctccttgttcttcttatgaaaaaaactacttatgtagctcacaagcttgttcaatcacacgcagttatcttccaaaaaaatctagtgttcaggcgttctgtggatctgctatgaagagagctcaagagattcaaacgaagttaccagcagagcatcctagctttgttaaacatatgttacattcacatgttgtcagcggattttggctggtaagggttgtagattactaacttttcttatgcttgtcaatttatgaagccttagataattgtttcttatgaacaggctgtggagaagcaccttctgcagaaacatacaaattgcatttactattagaagattttatttgtcaaacaaatgctctcactaaaattagaaagtaaaagtttaaagcgtgttatggatcttatttaaaacttcctactaccctattaacatgttctaaacttctaatctttttcattaaattttgttttaggaagagaagtctcacacatacaagttatatccaacttatgtacatttcttgcatgttagctcttactgcttgagttattgtgtttatgaaaatggctgacactagttctgcacaagccacctagaaacttctttttggttttctctgcatctgattattgttctcctctgcagggtctaccagctggcttctgcaacaagtatctcccaaagcatgacactgacattgtgctcgaagatgagaatgggaacaaccataacacaaattacctgggtggtaagcagggactcagtgctggatggagaggttttgcgattaaccatgatatcaaggttggcgatgttgtggtctttgagcttgtgagcacaacaaaattcaaggcaagtgtttctgaaatgcttgataactttcttccaaatctactactactacttgattgttcctttataatcttcattcatacccatttcttgagttcccttgtgggttcagtcttccctaatccaacaatacaattacctcttgtttcttcatgccttacattcaggtgcatataattagagataaaaacatcagcccaactgacagagcacccggtctcaagagtttttacgcctgcaagaaacggaagatatctagtgagtcaaagtttatgttgttagttttgcaccttgaaatgtgttagacatgggaatatacactaactattgaatctcccgaatcatgtgctgtgttctacatgacagaagaagctactgataatgccaccaagcctaaggaggatccagagactactagagtcagtagcaaagtggctcatgatgatacccagaatctagttcatgaagcaatagacggcatcaggttttcagactcagagatgagctttgacgacgtgatgagctacagtaacttcaacatcgtcgtggacggcttggtcattgactgcaagttccccgatcaccagcgcaggacgtactatgagctgtgctgcgcccagaagtcgttcctccacaggcatctgctgaggcagctgagcctcacgctcgtcgtgggggtgatcatggagacgatcaacatcgctgagggcatcagggcctgcggggcgggtacctcctcgcaagaggacttcctgatctggaagaagacgctgcagtcattcgacctgctgggaatgaatgttgcgttcttgctcaagcgcgttgacgatattctcggcctccccgagcaaccgagggatccatcggagtgtagcaagtacaatgagctgaagcttgagcggtctcgtgctggggagaaggtgaaggctctggagtccatgatgttgacagtgaaggatgtgctgaagaagatcgatgccgagatggaggagatggagtcgagcgtgaggaaccatgacattgcgctgcggaagatcgccactgcgccatggtgatcctgcttgacatctggggtacttgtctgaaacattttgggttcgtcattcagggtttcagatgatgatgatgatgatgatgcactgggaaaccttcgtggtgagtgactgagtggtgaatcctgctaaactcaaggactgaccacatttttgtgtacatttcttcagttactaccacgcagctcagtgcctatctagaactgttcagcagcaaacctgtctaggaatcaggatgctgtttttacacggtaaatcgtataacagaagttgtaaattttggggggcgaatgcgctgtaagcagtgcaggaaatgcgaggaagaaatgcagaacactacttaattatttcagactccgtcattcagtgcaccctgttcttggtgcctgtttggttggtcggtaaaggaggcgtgatctgaataccggatgccaccttcagtaattttcagattgttctaatttacatataacaaatttgtcatttcttttagcaagcttgcatttccatatgtttccaattcagatgttccctacgtttcacaatgtaagtcattctagcatttcccacgttaatattatatatctatgtagattcattaacatcaatatatatgtgggaaatgatagaatggcttacattgtgaaacggagaaagtggtatattttatggtggaatgcatgagttccttgctttgccttgtattttattttactggtcaaatacccgtgtattgcaatgatttatatataaggaaaaaaaacgagtctttttgttgagaaaaaaatggttgcttctatttggttgaaatgggattctttatcttaaaaagacaaaaagaaaagggacatagtatagttcttaaagtgagacataaaccctttttcacgtggcaatgaaattctcattactaacaaattgtgcagtgtaattaacttaaatgtacaaatgaaacttaaattttcatggttttttaacttgaatagaggtgagaaagaagcaaagcaatatagcattaaagggttgcaacccgattagaagcacccaatttcctctttccggagaggaagagcaatgactgcaacacacaaagcaagaggactcacatttgtactgctctcatggccccactcgtcagtggtgttggcggcatcatcgccacaagtctttcgaaaggagtatggaaaatgataaaagtacattaagttttcttatgccattcataatacatctgatccccatgcggttgaggagtggaggaagcggggttatgacttccacaggatgatgctctctctctccccacgttacttacccaggattaggctgaagaacgagtgatcaaagttaaatacggggacttcaagtaggtgcgacagaagcgaacgtaacacgaaatatttattgggaaacgctgaggccgaatgccaactcaatgcactgtaaacgcccttagctcatgtccattagtgtttttattcattcataggcaaatcggaatgtatctgttcaaatttttgtttttacagatatgattcttttgggcaacaaatggcatctgaacgtatgtccgccctcaaactaatggtaatgtgaccatattttccacaggttagatactgaccatttcgtacttctctcacatttgacatttttggcttcatgcatgggtttcttcaaaaaaaaaaaaatattcgagaaccgccactatgagaaccccacgaaaccatcattaatttttttcctcctagatccgccaatgaagttcatgcatcatactacttgatccatacatcataataaaattggaaagtatttatcttaaacattccttaaaactaaaatgcattataacgttaataaaactaaaactatatcttgaatcatttcttaaggtatagtttatcagtcaactaaatgtacatattgcggtcaaagagtacacaccttcttcaacatcatgacacgcatcttaaaaaaacatttcttaagatacgttttatcggatgataatatagaaccaattttccctaccaaaatacagttacctcagctttctaattcaaatttgaacttgcgagttttggaggttgcagatcgaccctaccgacaaggaaggtaccaccattgaaatttgttgttcctgatgcaaacatgtatatatacacataatcccacataaatgcacaaactatcttattctgacatgtgtttctgaactaacaacttcagtggctagtctctgaatgaaactccagtcagtggctagtctctggatgaaactccagtctttgcatctagcgggccacggtagccaaacagacgcctgataagaccattgccaaaagctgtaattgcaagagataataagcgttaattaccattagctgtaaagcctaatcaactgcagataatgcagtcagccaaaattagccgactcatcgtcagatgtgcacacacctattttcgagaaacttttaggaagctcaagctttgacccaagccttcctggaggtgtagttagcgtctccttggtctgtgaatcgaaggtagggttgtctatgatcacattgaggaagacccatagatagcgcttcacatcatctacattgaagttacactcctcatagtgctcattcagaaggttcatcagatgggtggtaatcagctccgtgacgtaatcaacatgggttccaccttttagtgtctcaaatccatttacaaagctgacctgcaaaaccataaaaaacaggagtaaaatgcagcaacaaccatggcatttaactaagaagctaccctgatataaacataaccaaaacatttacctgctgaaagtgtccatcatcactcaggctcaaacagacctcacaccaatcatttaacttctcgtaaactctgaaatcgatcaagaaggcaaaggtgaattcagctaattaaaaagacaaaaccattatggatagatttcgatcactcaacaaactaatatgctcgttcgaaacaacacagcacaataaccttgggaaccctgctcctgatctgtcactgacaggggaatcgatatacaggcgcacataatcgttgaagctgtttatacgcagcctcacgccatcccactcaacttgcacggagtctcctagaattcctgccatatcaaccactctcttccacatgagcgtcacgtgatcctcttcgaggtaggtcatgttgaacccagcaagatctggcttgaaggtgattatggtccagttctccccttgattgcagtctgtaatatggggcactgatttcttccccatattctcagagaaaacctggaaattaaagtattcaaggagtaagtaacatcatgatctatattgttttgatagtaaactgacctatccaatgctccatgaaagtagtaactacatctaaaactcagaaaatttgttgataatacagaatttgcatgcctataaacgatgagttttttttagcaagaggccaggcctcccatttccattagtagaaatggagatagacttacacagagttttttgactcattgactactacctggcaactacattcctccaaaagccaaccaagcagctggatcagatctggacatcaaataaatgacagcgagtatatatcaacaacaaagccgataacccctgccaagtaacaaggtcatggaataggcaaagaaaacatatcatgatcccaggaaatactggtcatggtataggcaaatataacatatcatgatcctaggagatactggtcatagtgtgcaggatctaacagttagaagagtcaaaaacagtatcaggtgtaccaaactatgccacatgctctttccggctttccaatttatgacgccgttgactttttaataagatatactactttatggactctgttattaacatcgtcttgtcactgcatgggtccttttaattttttcacggtggaatcaaaatttataagttctttgatgttaaaatttgagtataaacaaccatgcatattattagttgctgtactgtgcgagccaccgaattttcgccatctctacttatgcgtgaccaccttattctccttgtatgttccgtctatcctcctacttgtgatacatatgttttagcaaatgtaattttattttacatatttgaataggtgttaagagaatataattgacaggaaacaataggcggttttccaaaatttaatttattggaatttgatttgtccaatcgttgattagtttttttgagttgcaaattaataatactccctccgtttcacaatgtaggtcattctagcatttctcacattcatattgatgttaatgaatctagacatatatatctatatagattcattaacattaatatgaatgtggaaaatgctagaatgacttacattgtgaaacggaggaagtagttttttttcttttgtgtctcttttagatttaattgaacatgttgcttaaccccacgatcattcggcccactgaactcaaccgatcccatcccatgatcatgcttgctaagcgatagctgaggcggagcgttgtttctttttcttttcctttttttttaatcctctttcttctactactatctctctctttttaccttcaggaaggctcttcatttgaacggatggctacgatttgtcatttctgttttgtcgttttctgtatcggatggtcaccgttttgttcattacatggctcatccaagttgctgttttgttcattacatggttcatccaagttgctttgagagatttactttttcagttaggtagatttgatgatttattttactacaaaatattacgtaattatcgtttattttatggtgacttgatctatcatgaaatgatctttaagcatgacttctttttatatatatttgtacaaaaattttgaatgagacaaatgattaaacgttcataaaaaaaatcaacgacatcaatatattaaaaaacgaaaggagtatcaaatttggc

SEQ ID NO: 38915 - DNA, 2941 bp, Oryza sativa
ggagaacaggttggcgagcttgacaccgtagccaccgccgccgtcgttcgtcgccttgttctgatcatcctcttcgtcgtcgtcatggaggtggccgaagaacatctccggcgcgtagacgccgcgctcctcgtcgacgagctcgacggggacgacgccgcggccgttatagaagacggagacgctgcgctcgacgacgtcgacctcgacggagagggtgtccatggaggggtcgcgccgcttgttgctcgcggcgtggacgaggacctcgtcgaagatcctgtggaggcccgggcggtaggtcacctcgcgtggcaccatgtagtagccgtcgttgatccagaacgtctgcgtactgcgcttctccggcgagccgatgtagccgtctggccgccggaggatgcgctcccgcagcgtcgtgtcgccgccgccgccgccgtgcgcggcggcgatgcgggcggacctccgccgcggcggcgcctggcgattcatggcggcgtggccggcggcgctagggttttgggtggtgtgtgtcagtgttgtgtgttcacactcgtggaattaattgagagatccgggggagagaagatgcggttgcctcgttttattcggagtaaatttcatgaatttggagccttcgtatatatcgttttggataagatgagtggtcaaatagtgcaagcaaaatgtcaaaatcccttatattaagagacggagggagtaacaaatttacggaatcgctataattatgtcgacacattttctcctccatcacagtcggtgttttgaagcgttcgatttcctttgtcccgtgccaatgcaatcatgtccgtgcatattgctatggcaggctaacgttacggctgtcaacatgattaattaaaacttaacgtcttcattagttcaaggttttacacgcatgcatactatactttatacaaatttacaccccacttacacatgtaatgtaattactatataattttggaacttacacattgccgttcttttttcccccaaaaccttgataaaacctggagcggcctccaatccttcacaaaccaaacaaattgaagcattggagcccgatccggattggaggtggccgcggccatgttacggaccaccggagcggctgccggaatggcggattaccagtggccggccggtgtcggtgaagcggcggcggccggtgcatgattgcacatgcacgcacgcacacaccgatctggcaacgaacaagctaagcactcgccgagtcgccggcacgagcggatgggagtaatgcgataccacatcaccatttactcctattgccctattggcatcacatccataggttcaggcccctttgattcaaaagaaattcatatgaggctgtgtttagatccaaagtttggatccaaactttagtccttttccatcacatcaatctgtcatacacaacttttcagtcacatcatctccaatttcaaccaaaatccaaactttacgctgaactaaacacagcctgaatttcagagaattttattcctataggattttttcctatatagccctttgaatcaaaggaatggatcctatggaatcctatgaaattcctatggattgtcttttcctatgcaagttttgcaggaaatttaacatgaggtagaacctcatggaaagaatactttgagtctttatctctccttaaattcctgtgtttttcctgcggcccaatcaaacaatcattcatatgtttttcctgtgttttgatttcctctgttttacacttgcattcctgtcagaatcctatgtttttcctatttctccgttttttcattcctgtaattcaatggggcccttatccttttctatttgcttcggttgcacattttttttaattacacattaaagcgcacacatactcattcttatgaacatgcgtacataaaaccctatcgtgtctgatcacaattttgagttttccattgcgaattgtatgagttcccttcgtagtttaaaatcggtgtgtaaatgactaaatgcacaccaaatccagtcgacacacccaaaacttggcaatatgaaaatcaccgaaattacaaaaaaaaaaggtgaattccgaagcaaagagtggccagtgtgaaactaactcagcgaacactctcctcacagctataaattctatgcttcacttgtctcgcttttgctccacttacaccaacagagatttgcgagtagattttgcatggcccatgccacgctcggctcgcctgagccggcggcaaagcctcggctccggtgcgccgacggccgccaccgccgccgccttatcgtcgtcctgtgcatcgtcggcgtggcgctcgccgtcggcgtcgccgtggcggtggcgatcgcgtcttggggaggtcgaggatgacgtcgtcgtccggcggtggccgggcgccacgggggcgcgcgccgaccgaggcgatcgcgcgcacgtgcggggtgacgctgtacccggagctgtgcgtcggcgagctcatggcgttccccggcgccgccggcgccggcgacgccgagctcgtgccgatgtcgctgaacgcgacgcaccgccgcgtggtggacgcgctgtacaacgcgacggcgctcggcggcgccgccgcgctgctcgccggggcgcggtcgggcgccgcgtacggcgactgcgtggagatgctcgacgccgcggaggagctcctcgcgcggtcggtcggcgccatcgcggcgccgccgccgccgccggactcggtcgacgccgacacggcgggacgggacgacgacgacatcatgacgtggctcagcgcggcgctcaccagccacgacacgtgcatggacagcctccaagaagtcggcgccggcggcgacgccggcgacgacgacggcggccgcatcaagccgcagatgctcggctacctcggcaacctcggggaac

SEQ ID NO: 38916 - DNA, 3282 bp, Oryza sativa
catgacggtggagaaccgcgccggcgcggcgaggcaccaggcggtggcgctgctgctgagcggcgaccacgcggtggtgtaccggagcgccgtgctggggtaccaggacacgctgtacgcgcacgcgcagcggcagttctaccgcgactgcgacgtcgccggcacggtggacttcgtgttcgggaacgccgccgtggtgctgcagaactgcacgctgtgggcgcggcggccgctgccggggcaggagaacacggtcacggcgcaggggcggcgcgacccgaaccagagcaccggcatctccgtgcacggctgccgcctcctcccttcgccggagctcgagctcgcgccggcggcgcggcgcggccgcgcggcgacgtacctcgggcggccatggaagccgtactcgagggcggtgtacatgatgtcgtacatagcgggccacgtccacgccgccggctggctcgcctgggacgcgtcggggcgcgcgccggacacgctctactacggcgagtaccgcaactccggccccggcgcggcggtcggcgggcgcgtgccatggccgggccaccgcgtcatcaagctgccggaggaggccatggagttcaccgtcgggaggttcatcggcggctactcctggctgccgcccaccggcgtcgccttcgtagccggcctgaccgtgtgaggcgactctcactgactcatggtagcttaagccaataagttgcatttgctaattgggagataggtggtagtaaaagtaggtgtaatttttcaagtatgatgtaatcatctacacatgctaactgattcaggaaaattatgattaatgattagtttgtaggcttgaatttggattgagaaatgagaattctgaattgggcacaaaaacaccatgaatgtgaatgaataaacctgtgaaatattatacaataacgatattttttgcaatgttggtgtaatgagaaaataaattgtttgtccaactacttggtccctgcaagcaatgagagtgcagatgaaaatagtgtactagctagtaccctggaaataaaatatgccaaccaaaaagctccttttggttgtcacttaggctgctcacaatatcacagtgagaatatatgcttttctttgcattggatttccaggaaatagtacctgctagatgggtgtggggcttaccactagaagatcgaaagaaccaaaagctagcataaagagagaatatcagagagtggcttataattgatgggctattgccactaaattcctggcacaaattcttagctaaaatatcgtgtatttgtgctccttatcttgtatgtaggggaataattgtgtatttgtgttcgacaatcttcagctattttttcccggcaaagcagtagcattgtatcgttatcaacaatgacaactgataaaatctaaacataaacaattggatccaaaccttcacataaatacataatcatgtgcaatcatctgtacatagtcccatgctttctcatgcgattcaattctgcttgcttgggcatggaaggcgagcattcatgttgatatatccatggtgttttcgtctgtcatttcctacttagctaaaaggccatcgatcagtgcatgccttttgaaagcaagcagagcctttttatcccaagtattcccaactaccccccccccccccccaaaaaaaaaaaaaattccaaaggtgcagcttcttttgctgacaaagtagaactagaaggtagctatcacacgtaccagatccaagattgaacttgggcggtgaggcaatgtggagcccttggaagagttgatcttgagcacaatgatgtgagcctgaagagtgacagattctcatgatttacaagcataatgcaactgttagaacacaggcacaaatttaaagcaaaattaaggtaactctaatctggtggacaatgtccatgttaaaatttacataaataaaatgtccatgttaaaattggctcaattgaaaagcaaattaaagaagcccaaatagagagctccatattctacttttctgtaacaagtgatatcagagcattttaaagaagtacggacacaattaaggggaatgctacatgacaattaagaagatgtacatcagttaagtccagctttgcgatggaggacgccagttgaatgaatccatgtcgcgcggccgacatagttgccaccgaggccagtggcgttcttgacggcgtcggcggcgccatcctgccgaggctacagccgggagccttcaccaccgcatcctccctcctcgcctgcgcgtggcccgccgcctcgccggcattgtagctgagcagcttggcttggtcgaccatggcgatagctcaagctgctgctgctgctcctagaatttgaatataaacgccccccgctctctgtacgtcttgccgttgccgtacgtcttcctggcgcgcggccgccatttgtaggtgtacgtgcgtggtcgccggcgtgctgtcgctacatttgccgttgcagcttggcatgcgcgccccggccgccgcacgaggaggacgaggagaagagagaacggccggccaacaagcccgtaatggatgggccgtgaaggtactgtgatgacgggaaaaaagttcatttgaggtccctcatcttgtcgtcgagtttcaaaatcgtccctgaaggttcagaatcctatctttttataaagttatcccccactaactgtttaaacttaacatgcaaagatgccacatcattattcactaacaagatgccacatcatcatccactaattaacaagatgccacatcatcatccactaacaatgatcacatttaaacatcatgcaaacatgctatatttttatagtttttataatttaagagcttttcaaatacaaacctgttaaattatcatctaacataattcacataatgtttcaatgtattatgtttttttttgatacatgctatatctttatgtattatgttttttttatatcctatatacttatacagttcatccttacttagttagtacttaaatgattaatctatggtccaaattatctttctccttttttttctaattaagtcatatcacattaattgtttttagccttgagatgaataatctacggtacaaactatctccctacttttcttcttctataaagtcataccaccttactttttacgtttgaatcaccattctacatactatttaaatttaaattatcataaaccatattgatttacttaatctgatattatctagctatcttacacatta

SEQ ID NO: 38917 - DNA, 2612 bp, Oryza sativa
  unsure (1)..(2612): unsure at all n locations
taaggagcttgtagtacttgtggccagcttaagatgcacatctgaatatgtcatgctaagatattttttattatgataatatcatgaccaaattgtattgttgcagacaatgttactgatttgtaaaaaaaaaaaaaagtgcttgccacgtagtgtatgtatgggcaatgtttttccgaactaatcaacgtcactttcgctgttccttgttgacaaaatagcttaaaaggcttaaaagtcaggactgatctgtctagacaaaaagcacgacgctatcgaattaatatgcaataaaaataactgtactaatttcgatcaagtaaaaatactgtatagagtattattagcttatcaacggctgccacgtatcgtgggttacatctatttttaaatatatgatgttgatgaactttagatatgttgatgtttgaccatttattttggtaaaataattattttttatattatttatttatgacttgttttgttgttaaaagtactttacatgcatatgacttatgtttttctatacttatgaataaaatgaataattaaactacgcgttgtgagcctatgctatgtgtttctaaaataaaatgttataccttaaaggcggaatttttttccccaagcaggaacgtctgaattctatccaaatttcagtttcctcccaaactcaagcctcctctcacctgtaaacttcggacctgttcagattatagctaaaataaaccttaccaaattttgctacagctaaaattttggcaagttggcaatattgccaaaattttagcagaatttcttatatatttactaaatttggcaacaaactaaacgtagatatttttttacaacttaaaaaatgatatgattgaaaataacattaatataaagagccccttcagtttcagttctttcatataataatgaacttccctttcacgcagtcgattacgtggcacataacgatatacgtctcttcatgtgatcgatctggcatcgatctcgatcctcgatcttgattgtcgatgcgatctgggtcaagttgtcttgtacctgaagataagtcgataatgtcgccattgttgccgctgtgcttgagacagtaccttcattcagcctcttctagatcagcctgccgcccccctgcaaatcagaaacctccaagcatccatgatacagattgatcaatttattaagcgtggaccctgcagagacagatcgatcgatctccagactccagagagtgaatgaaacgagtgaattgaatcatgaatcatatatccagctgatcgatcgatataatgaaggtgagtgtgttgcatacgtttgtgcgatacggccatgaactgacagacagcatggctgaaagcctgaaaacaatgtgtgcgacatgtatcttccctgtctggacaaaattgggagatggtagcatgtaactacgtatgaactggtgagacgaacgcatcgcctgtactgtaatgcgcagtacagtggttagagcgactctggacagcgataggtggcatctgaattctcaccgcgcacgaatatccccttgctgcagccacacaaagaaagagtgactcatcgtttacccaaaagctggatataaatcataacggtttattagcgattcaaaaataatttatgagtaaaatttttatatatgtgttcttaccaacttagaaagttaatgctgaaaaagaaactacgttacaaatatcttacaatcaacgataggattaaaatttaaaattttacttcggcatatttattttaaaattttaatgctaaaaatgaaactactttgtgttacaaatatcttaaaatcaactttaaattaaaatttagaatttaactttagtagtatttttttaggcaaccaatggggcgctcccgaaacaaagccgtgttaatgggctcccgcatggcgtgaaactgaccgagccggtgggctcacgaagcccgataatcccagcccatactcacgctcccggccggcccatccatggcctagtaagagcgttgtatagtactttgtgggcctcatcttcttagtgggcctcggattcgtcgtctccgcttctgggccggcggcggtgtgggcctcgtcgtctcgtccccacaccaaaaaaaaanaaanaaaaaaaaaaaaaaaaaanaaaaaaaaaaaaaaaaaaannaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaaaaaaaacaacaaaaaaaaaaaaaaaaaaaaaacacaaaaaaaaaaaaaaaaaaaaaaaaaaaaaaaaaaaaaaaaaaaaaaaaaaaaaaataaaaaaaaaaaaaaaaaa

SEQ ID NO: 38918 - DNA, 26410 bp, Oryza sativa
  unsure (1)..(26410): unsure at all n locations
gggattcttggggggctccgctgctggtggtggtgggggagggatcgagaggatggccgtggagtcgccattcagggcggatgtgttgaggggcaaggcggcgctggtcaccggcggcggctccggcatcgggttcgagatcgccgcccagctcgcccgccacggcgcgcacgtcgccatcatgggccgccgccgcgaggtcctcgacaaggccgtcgccgccctccgctcccacggcctccgggtgagccctaagcccctctcccttcccgcctacgctacctaccacttcttctctatttaggattaaaaattgtttgttttttttttcatctcccagtcagtctcgtggtgctgctggtgagtcaaaatctcgatagagagattgatgttttcttgtctgagtccatcaatagatccgagtattcgtgggggaaggctaaaaccttgtgagagttgctagcgttaacgcgtctatatacgaggagcatactgaaaatttttctgaagcgtgctcgcgctgcatataaggattcctcatgactcatgcagatgtgatttatgcttcatgttcatgtgcctgactagtgaaataaatatagagttcatcatgcttccctctgatttcagtgctgatctttgggggtaagctagtcctaatctgtaagtgtaaccctgtagtaattctggcttgctgtcacgttcacaggctgttggttttgagggagatgtgcgcaagcaggaagatgccgcgagagtggttgccgcaacagttcaacattttggtaagctagacattcttgtcaatggggcagctggcaatttccttgcttccccggaggatttgacgcccaaagggttcaggacaggtacttcgattgaatcaatcctcgcacattagcagcattagttatgattttcttttgttccatttagatgttatgtgatttttctagtttgtgcagttctgctagtctggtatctttcaacaacactcgtgctattaacttgtctaagtatctaacagcagtctacttgagttcttgatgtttttctcttttacagagaagttagtattgactgggttttctctctgcagtcgttgacattgacacagtgggtacatacactatgtgctatgaagctctaaagtatctgaaaaagggtggccctgggaaaggtccctctactggtggcgtcatcatcaacataagtgctactttgcattacactgcggcctggtaccaaattcatgtctctgctgctaaggtacttggatcttctattatctgtgacgagaaaaggattgaaataagtagacttgtcctgatggattggcttctgtaggcgggcgttgatagtataacaagatcattggctctggaatggggaacagattatgacatcagggtcaatggaattgcaccagggccaattgaaggcactccaggaatgaggaagcttgcacctgaggaaatggccaaggggagtcgggaaataatgcctttatttaagttgggtgaaaaatgggacatagctatggctgcactttaccttgcttctgatgcaggttagttatgttcttgcatgttttctatccaaataatcagaagttccatttgctaactgaagttcagtaagttctgagcagctgcttacctgaaagttatcttgaagcaattgcttgcttgatagttataaatctaaaattatctgctattatattgtttgccagctttggtcaaataatgttcaacaataaatcagtgaagtgatgccttattttccaaatgaaaattttgccatttcatgttctctacaattcaatttgcaggaaaatatgtaaatgggactacagtggttgttgatggaggtctttggctaagtcgccctcgccatattccgaaggaggaagtgaaggagctctcaaaggttgtcgagaagaaggttagggcctctggtgttggtgtgccatcaagcaaattgtgatgtcctctatggtttatatcgccctcctacgtgtactgtagaatcctttaccgaggagtcccgtagaatacttggatgttgctatcacttgtcatcgaagttttctatgattctatctatcaactcctgtaacatgctcagcacattcaccttgttcacgctcgagttaaacatttgccaaagtggttctcattcatattgtatctggtaatattgcaatcaactttgaatcgcaaccaaaagatgtccatcactgaaatattcctatggcatgtcaaaaatgcacacttaaacaagtcgaggaccatttcatacttttgatacatgataaaatgctatgttgaagatttgaactactgccttgtcttccatgtttcatagagtcatgaacctatttaaatgttgaatttgggaagagtatgtcaaaatggactgcctgaagtggtaacctgtaactactgcaacattcaggcaagtggcacacaatttgttttgacaaagaatttgtatgcataaaacactaacacagcacataactactatattccttactaggtgtgaacatggctgaagtctcttagaaaaacaaaaacagataatgacacaccaggcaaatatgtatgagccttggcctcctatgcctcaactgcctcctgataaggagagcataatctccttaccatataagtcactatgatggttcccgaactccattggaagtactccatttaagagaagttctgttttcaccttgttctgctggctcctcatcatgacttatgaatataaattcacaagtgtccttctgatttttttttttttgaaacttaagaaacaccttgagactttttttttcttgtgaattgcaatgaatgagcaccaaaaatctgaaaaaaacctatccagagaaaactctgattgttcatcacttattattttctttgagaccagaactggtaagctctgggacttacattggtacaaagtgaagatatgtacatgtggcatagtatgtcatatatattgactatgacatccagcaggttaggtgtgtagggtggaccagaagctgccttactgaaaacattattgcttctagttattctctgtcttggtcaattctagcttggccttcttataggagaaacctggctgcaagcctgcaagctcatcacttgctatgctcaggggcagttacctgtccacagcaaggctgtttcaagcctccagcattatcttctccagttttttggtgccatctcaaaatacacacaaacccacacataaactccatcagcatgtatataagtgctaatttaaggacatactgttgtatgcactagttcacatgatagatatctggaacgtataaggtagtttaaagtctgtgtgcaaatacattttgttaaattgcataagttttataggaagttaatttagctaaatggctttatttgcgagttcgatcatattatggtgtgttatgttccttgctgcaatatatagtgggacaacctgacaagagatcatcactggtactggtcttttaagactgacataagaatttagcaggcatataaaggtgccctgagcccctgaaaactctctctctctctctctctctctctctctctctctcgtttcctgaatctgaggccatttgtttggtacatttctcatcatgcatttgaaatcatttctttgattttggtcttgcttgagcttttgtttcatgatccatgactagtacattttgaagaacactttctttgcaggctgaacaggaggaaagaagcaccaacctgatcaatggggcgtgggagagtagagctcaaaaagattgaaaatccgacaaaccgccaagttaccttctccaagaggaggatggggctgctcaagaaagcaaatgagctggccattctttgtgatgcacaaattggggtgattgtgttctcaggcactggcaagatgtacgagtactccagccccccttggaggtatgcataaagttttttgtttcaagttattgtctgtcctttgcatttcggtatttgtatttgaggcgaaatagaaatttcagacatcgttcataatacttcttgttaaatttcttcggtttcttcgatcagttctgctctattctacaacttttctatgatttttggaacttgtgttggaaaaaattgttgataatatgcaatgtttcatcatcatattttgaactgaattattagtgatgaactcaagggaatttacaactgattttatacaagtttctgccacctacagccatttcaacttagcttaaccatgtgaaattctcgaagagaaaccgatgatcaaatacataaagtcttttccttttggcaggattgcaaatatctttgatagatacctgaaagcccccagcacccgttttgaggagatggatgttcagcaggtacactggttcttgtaaaccactaccataagattttactttcattaacccaaaatcgttctttggcataaagagaatcatccaagagatgacaagaatgaaggatgagaacaacaggcttaggatcatcatgaggcagtatatgggtgatgacttggcttcactgactctgcaagatgtgagtaatcttgagcagcagattgagttttctctgtacaaagttcgtctaaggaaggtaaaaacaaaaacaacttgatgcagtagctgtaggttctgttacttgacaaaactctgcattcatcactgctcattgctaacaccctgatttgtagcagcaacagctacttgatcagcagctgcttgagatgcacagccgggtatgtaacaagaggatataccggttcagtattcttccctaccttatacactatattgaaataatcaagttttgattgccctctttccatcccaataggagatgcaaattccaggagatcagagcaactatctgtgccacatggtaagccatgctctaagctttctcctcaagtgaaattatgttgcggatttctgtattcgcgtaacttgtttgcgcctgtcaaaagaacctgattggcgagcaggcccaggcacctctgatggtgaatccgaagccgttcccgctgtgggatgtgggtggcagcagccagatgtacaatcaggatgctgagtcttccatgacagcgctgcagctttcacctcagcttgagtacaagcttcagccgctgcagcccaacctgcaggaggaggccaacctccatggctacgttcttcggctgtggtaagtcgctctctgcctcgtctttggctgctcgtttgatccatggacaagatcatcagtagtttgaagtgccataactttgcggttgtcatcatatgacagaattaaaatcctgtaaactcatcatgtgctgtaaattgtggttacctggaacttttttttttttgccgggtcgacaaagaagccgaccgaagtatattaagtattacctggaacattttgatcagtcatgaaacagaatgatctccaagaaactttatacattgacaaattgagttgttatctgcagattcctaaggacaccatggagtctggatgcaactgagcaaccaattgaggataatgagcttgtctgcctgaatctgctccagaactctagtctaaccagctgagaaataaactatatatacgcttcctgtgttattgaactgtttggctatgttgcatgtaaagtaatgataagtatggctttcttgtgtgttttcaagaactaatggctactattaaggtgtgtaacggttatgtacaacatatatgatgaccgtacatggtgagaatgcgtcttatttgagattgagccatattatgccggggatttccttatagcaaataaatcagtaaatcataaatctgaacaatatttcttttaggttaacaaagatgacacacacgggttaataaaggcggctcaaggttcattcaacatttcttttaaagattttattttattttggtaaaatactaagtatgaagttttatgttactggaaacaatctcacgccttaatcctttccacaagttgcttggcaacaattatcacaatatttggtgagtcataactcataacaactactccctccgttgtaggttagaagatgttttgattttaatcaaagtcaaactgcttacttaacctttcatattcatatgttttgtacatgaatgaggatggatagtactgtgcattaggtgagttggcagacacccgatcaagattgcaagacctagatatcgtgctacaacaattttgctacactaaataatagagctacggtaaattaatgccgttcattacattagttcactatgctacttacataaacaacagtgatctcgatccgacgtcacaacgctaaggtaggaattgttatacttcactctccattccctcccatcaatgcctcctcacccaaacgacccggttgctatttttaggtacacgtgttttttgaagaaagcacttttaaaaaggaaagtagtaaaataaaaatactcaatttaataaatcctaaattatctgtggcattgaattatgaaagtaaacactgaaagtttaccatttacaaaagtaaatgtactacccgacaatacttctcctcgagtaggggaaatagcataccatacttctttcgctgggcactgtactttatgacctttcttcgacacagcatcgcattcctcctctctcaggcattgaggagttggctcatccatgctatgctatcaatcgataatacgtaaaggatcaggtattacaggtaaactgtacctgtactccaaagcaatgaaaccaacagggaactctatcgttctagagacagacaaccagtgccatcccctaaaggcttagggattgtttggctgggtgcctgggtgtttcaacttgcacacatagcacctatcaaaagtgtggcgaacgaaaccctcaccgtatctttggcttaaaaatatgtggcgcgaagcagcaaagagccgcttaactttctttggtaggtaaaactatagaagcaaaacaaacaaggagctaaacagctgtgacgtgactaacatgatccaaacagcttcttgatgagatcctataaaaataaataaaaaaaagagacgtggtcgctgacacttttttcttgagagggtataattcaggatgcccaacaacacacaccacaacacacgcacacacgggagtgtgcgggccgaaacggcccgcttaaccggcccaacctaccaaatcattcgagcgaaaacaaaaaaaaaaactagaaaccggcgggaggagccccgggagggcggggcggggaggggaggctgtcaagtgggtcccaccaccgaatccttccgctatacatacatatactaccacgagttccccaactccgccaccgcgcagggcacgatctgggagggagagccgcgtcgccgtcgtcgtcgccgtcgtcggagatggagcccaacatcatcccggcctacggctgcgccaagctccacgccgccccgccggattacccctgcgtcgcccgcctccgccaccgccgcctcctctccttcctctggctccactccttcaaatccaccttcgaagcgtacgcatgatcgatgcaccgtgttttttctttcttttttttctctgatgatagatttcatccttgttcgcaggatggcggaggagacgaaggtgctactgtcgctgccgcggctggagcggctcatcgcccgcggcatgtggggcgaggccatcggctacgcctgccgcttcctgccgcggcggccgccgtcgctgcccgcgcagcggacgcacctcaccgcggaggcccagaccctcctcctattcctccacatgcacaggtgcttcgccgacgtcgtcgccggcaacgagaccggcgccgcctggtccgacaagcaccgccgccgctactgcctcgcccgtgttaccggcatctcctcccacgccatcgccatccgccgcattatccaaaccttcgtcctgtcggacaagatcaggtactagcagtagcagctatacatctcctctcttatttttccctttgaacgactcgcatcagacagcatgaagtttatattgatagagtagaaaaaaattactatctccgtttcaagttataagactttctatcattgcctatatttatatagatgttaataaatctagtcacatatgtatgaatgtggataatactaaaagtcttataatataaaacagaggaagtacaagattttttttttggggaaaggaagtacaagattacaacctttaaagatcgtaaccagaaaaaagaaaaaaaataactataagattataatccctgattaattgtaactaggaaaaagaaggaaaaatagccaccacccccacaatgtcagctatatctcctcagtttgaatctgagatcgaaaattagctaaattatataaaaaagttagcttaattaattgattgtatttgttccagggagtccatggattggggacgcgtgagagagaaagtggtgcgggtcgtccgacgcttggttcacgacactccagagctcgccggattcttggacttgccgggcggcatggtgaagccgcataacgtgctccccattggcttcgggtacaccaatgctgctgatttgattactcaaatcacaaactttattcttcatttgtgactgatttaatccgatatattgtttgctggaattgatcccttttttcctagtttccgatccaagcgtcacgtgagacaacaaagacggccgcgagcatatactattgcccagctctatcttgagatgaagagatggtatgcagcacaattatgtactaccttgagagtaatctcgcttcattaatgttaaatcttggcaattgcccattgttctgcccttttttaaaaagcccttttgtgacattcacaaacacttgcatatgttgccttttgcagtgtgccttcttcaggccagcctgatcaggggttaagtctgggtataatttccaactgtttaagtagcgtgttatcgtaattcgtaaaacaatattgcacctcttttattattttcactgttaattcttcacctgtgacaactgataaccattcatatttctaccacagaaggactgtcagataaggcgaggggctggatggcgcatatccttggtaaaactagccttcactctgcatatgccatccctttttttaatttccactttattatgccttgttcggtttaatccccataagaaaggattgaatcccctccgattcccctttaatcatattcacttgggggatggattaactgaacaaggcctttgtaggatttgattgctcgttcacgcgttttatgttatgatgccatttgattgccatgaactatcataattagaatgtaggtgatctggtcctactgcactgcgtttgagaaaccacatgtgtacagtatttatatgcatgtcaacttgtgtgatcatcagattcaagcttacgtgctggctgtgagtcttcagaacaccatcaatggcggtatccacttcgatcaagtgagaagaaaggtaagttaaaaatcgctgtctaccgaaacactaatatactcaaactcacacaaactcttctgtaccctttgtctgttttgttaaaaattttatgggagaatcagcttctcattaagtttaccatgatactattcaagtatcacacaatattcctgtgcagcagcctcttcaggattgatgttttctttgcattttatcagcatcaggctaccctcttccatctctaatttctgaactcattttcaggtgctccggttgctgcaatcactcagactatgtttagcaccataaaaactgatagtgaaaattctgggactgcttcagcgacaaaaaagggtaaccttcaatttcaatcgtgcatgtgcacaacacaattattcccttaaattgttgcacttgctgtagccatttctaacttctgagctcatgtaggcgttcttgacagtatagtcttgcagactaagtttggcaacatgacaagtcctgaaaaaaactatgggttctcatcattgacaaatgcaggtgaaactagttgaacatacttaatatttgttttctaacaacggcaatcctctatgttcacaataaatacttgtaaatgttgttaaatgacacaattttagtaatatatatgggcctatatgcatcggtgatgatgatatatctgatccatgatggcaagaaatgcaacatttattgtactatttgatctttttatgacaatagcagctgtttccaaattcagtatttgaatcacgggtcatctgctcatattttaatttagtgtcctgctaaaaactattggatatcatgaaaaattaatgaaaccaaattaagatcatggtctttttccccccaaatgttcaaatttacctttattcatctttaattttggatgtattcgctgttaagagaactgagaacattatacataaaaattcatccaatgtgatgatattacttaatccagtgatccttatgagtacgtgttaattcttgggcaggcacatatatgcattcgagtcaagaagattgccacactgagaattattgccagggtttcattccaaggaaacatcaaagggaagaactagcacctgaggaagatattgaccctaaaaggcaacacacaactctgacttttggtgaagcaagtctggtaagatgatggatttttatttctttcctttactatggtggagtaatagcaggaacaaaccaattaagggtgttaacagtaaaagactcatttattaacgtactagaatgaatttagtatcaaatgcatgattgcttctgtatagatctttagattaagcatggttgttcttaggcaagtcaacatccaacaacagcacaaaaatagtatctataacaacaaaataatttggtaattaatgcttgttggaaatggttgatttggggtatgctatggcatacatcaatttggtattgacttgtgccagtttattaaatctggtggagacaaattacctcaacttctttttttttaagcaagagacagcagccgaaaggttaaaactgttcttcagccatgaatatcaaagttaattaagttgcattatcgccatttcttttgctgaccattgcccttgatttgtggtagaactgattatgccatgaatatcaaaataattaagttacattatcgccgtttattttgctgaccttcatatatactggtgttcttgatctgttgtacagagtagcacaaccagtacactgtcgactagtttcaatcatcaaatggagatattttttgaagcatgatttctgttggctaaattaatcaatgcattttacaaaacatgagccgtgtacaggagagaattaacatgggctatttttttttatcctgcattatgtgactaattgagttccagaatataattaatacttgttggagttgcagccattgatcgctgttgctgaagctcagggtagagctcgcccagtggaactctccatgtgaattcggatgagctgcatgcagcatcggagctgttctggtctgctgggtgcttcctggatgaagaagacaagacagtcgatgaactactagccaatgctgttggaacatttggcgctttttttattttgctgctcctgctacctagccagctgaggcttttcatgtctcctaaagatatatatgttatcgcgcaactctacctgtctccgagtgcttaattactagctaagaactactactgttctattatgtaaacttggtcagactaaatcactaagatttttttttttgaatggaccggtacttagaatgtgcaaccaaactcatgcccatccgttcgttacacacatgggcggagctaccatgattcctgagtattcccggaaatacctaactttttttattaaaaagcaagtatacttcaagtatatacacatgtacacatattagtgcacctaaatcctcaattcttcgatccaaacacagcccaaccggcctcttgcaacgcctcctaccaacccgacccactccgtcatgatccatcatatatcagttgacccacttagccaccactcttccacacggccccctctcactctccctccgtgacccatccctccctggctcggctccctcgcgccgctccccatttccaaaccctaggcggcggcgtggcgaggcggcacgagctggaccgtgctaccgcggagggcggcggccggcgcccgccactccgccaagctcagacggtcaggccggttgggtggccggcggccgcgaggggtagtggcggccagcggctcagcgcttcgacaggaatattcaactttaaaattctagctccaccactggatacacacaccaaaagaaaacccattcgttacctcaaaaagtggaggatctactctgcagtgatctactctgcagttccgagtctccgactctgaagctattgctccgcgtaagcgctaattcgcgcaaacgcgcgacttaacgcgatgtcgcgcgcattttcagcgcgtgtacgtagcttatctaacatgattagtttatatactattaagtaattatattcttatatcatggatacagttaaggtaacccatcggcaagaaggttgattccatttttactagaaatttaaaaagttatacttcaaatttaaaatttaattcgaaagtttaatttaaattttaaaaactttcaacccgaaatttgaaaatttcaacacaaatttcgaaactttcaacgcaaattatgaaaactttcagcttaaattttgaaaccaaatcatgaatactttcaactcatagttgtaattttgaactccaaaattgaaactttgaactgataattcgaaattttcagcttgatttattatttattattttattttgcaaaataaaaagaaaaaaaaacatgtttagcgctaagcgcgttacagaggcaggcatgcatgcacagcgcagagggtgcgccacctcccgtgctggcgcaggtgcgcacctgagcgcgcgccgactgggctgcgtcgggtacattacaatttattacaaacacggcggaagctgcagccggtggccgccgcgtgtaatcccttcgcggttcgatcgatccatcagacgcctacgccgtcttccggcgcgctccctggactacccctgcgtcaccgccgactcctcgccttcgggtgcgttcgtttcagcttataggattagattcttctcatttttcgtcagcacgtttttcaaactgctaaacggtatatttcatgtaaaaactttctataaaaaagttgtttaaaaaaatccaacaaatttatttataaaaaaattatatattaatacttaattaatcatatgttaattacatttctcgttttacgtgctgctaatccgctcatcctatctattgaaactagcgcacccttcctcttcaacaacaactactccgatgcctaccatgagtacgttctacgaatcaatccccctcagttttcgcttctcacaattcgatcgatccatgagtaattttttgtttttcaggatgaacaagaggacatgtttggtgttccatgcatgtgatgtgagcgatctggtggaccttgtggagacgacgtacaggccagttgctgaaggcgggtgtgctacgtctggaggttcgccccgccgttcgagtcgagcgccgatcgaggccatgacccggcctcgatcgatcgggaggttcattgaccagctcatggtccggcggctggttcacgcgcatcctcgccgccgaccaccggagcttctccaaagctctacccttacagctgcgtcgtcctcgctggccacttcctcgaggcagccaagaacatggtggactctgccagatggtcaggtccaaggtggccaagttggccgaggagatggttgggttttgtttagttgaattttatcaagtgtcattcatcttgtctctagtcctcgttctattagtcggcgactataaatttagatcccctaataattggtgtgtgttgatttggtcgattatcgaatagatctaccacttcgatcgcaactattcctatgtgcttaatcacctattcgcaatatttaaattgcatcttatcttgttcttgcagtgttctctcatttgcattgcagggatcatcaaccgtgcgttacggttggtatgacaacatttatggtgtagcaattgcacggcgttctggacttgttctggttggtagtcacgtcgtaaacgttgcactcgatcaaagcaagatttatcccctcaacagaagatcaggccacgagagagagcgtcatcataagtttttaacacggtttattcttgtaatatgtttttgtaaagtgtcaaattgtcaaaacttcggtgcactggatatgcaactctatttgtcagtgcaactacagttagacgagcggtacgcgaatcgtttccaactctgaaattttgtactatgttcagcgaactctagatcagttttcaccctacttttctaattcctaaagtcaatgcaggtgagccagatgcatgcgtagaaacttggatgcatcccctcatgaaattatgaaattatagagagaatcccttatatgctattgaaatttgattcgatccctgatatgccacacaaaattggctcttcccttatatgccattgaatcaaatttgcacaccctctcgtgccactaccatgagttgactgatgttagcatccattaatctgtcaggttattgcataaatgaccaaaataacctctggcatatcgtggcgagggcggtgatctggcgaggcgagttcggcggctcgatgcgtcgagggcgtcgcccggtcccgggaggggcggcacccagtcgcgggtggggcggcgccgacaagggcgttggaggaggtcggcgagcgagtgggtgaatcagtgggtgacgcggagcgcgtcgcggaggacggagtcgaagacgccgacggagagcatggcgccgagggcgtgtttagccgccggccccggggggaggcgccagggcgcggttgagcctcgagggccgccgtgagcgcgcccttgccgccgccaatgccgggcagatgtggaacgccgcctggaatgacgatgcagtcgcgagcgcacctgagcgcggtcggcgagctagcttgttcgcgcaggatcggcggccaccgcgcgtctcccttcaatcctccccaagaccggcggccatcgcgcgtctcgtccccaacttccgccgctttcccccatcctccccaataccggcggccatcgccccatagatgacgacgacgagtaggcgtggtctgcgcggcggttgtggtgggaggagaggaaggagtcgttgccgccacccgcggcggccgcatcgaagagctccttctgcctccgcctccgccaccggttgcccgagcgagctcctccgctgccggccgcctgctccgcctccgcctcagccgcccggggaactctgcctccgccgcctgccgcccactccgcctccgtcccagccgcccgccatcgccgccagcgcccgagcagctctgcctgcccccgtccacgcccgcacgctgcctgtgaggggagggagaagagagagaggggggagagattgggatagagatagagtatggagagagagggatggggactggcaggtggggcccaccattttttattaaccaattggcactcatgtctaacaactcaggggtaaatatgtcttttcacgttcaagttagcagtcaacacacggttagctcacgggagtggcatgagagggtgcgcaaatttgagccaatggcatataagagaatagccaattttgtgtggcatatcagggattagaccaaatttcaatatcatataagggattctctcgaaattatatgaaggaacgttatctagcgtgttggagaaacgcctcatcagctaatgtccaatctcaggaatgaattgaagtttctaggcttctagcttgcagtctagtgcaatgcttgcgcaccatgagatggtttctcaggatcgatggtggtttctttgaaacacaaatggtatagtagtgcaggtcatgctgctactgctgctgcaagtatcccccagctaccgatgatgcgattgatgatacaagtaggcaagctgctgctcagagttttccagcttatctgtgatgatcatggtggtggtggatggtcaaattattcagacaacaggatgatgagtcctggctgcctcctcttgcatgagacagtaattgccaaattggcagacaatttatctttcttcctatccataaatctaggacggagtgaataagtgtaaatattaatcaaaactagcaaatatgctcgtgccttgcaacgggatatccaaattacatgtatattattcatatttattacacgatttgtgcttttctttacttatacgatagtggtgagacagatgattgacatgggaatcggggatatttgtttttaaaatgtttgtcgtgggtacacatgattgatgaaacatatgatagagatctgaaggtcaatttacgtattgttgctaggtctaatgattcgtattcaccacaaggaattgtgaaatcactccatggacctgataagcctgggatggtgaatcaaacccacccttgttggttttaataaaaagatgtgtattattttattatctaaattttaataaaatctattacatacacaaccagtgaattagtgaaaaacaatcaattaatagctaaaagtgcttcatgaaaagaaagcacaacacaaaagttatataaaaaatgcacggatcgataaattttataaaatctacttatacatcatgtaagaatatatcattaaatttattttttccatgataaatcagtaaaaccagagtatagaaaagaaagaaaagtaaaaacaaacaacgtagcatcgccttggctagcttctcataccacttcgctgagccgctcaccttgccttgttactcgcctcgtggcttaccggcgctaggtggttggatccgatggcctggtgactaagaatgaacaagagaatttagagtcaaccttgatgatagggagaatcagcatatgctcagagaagagccaattttcatatagtccgagatattaggtgaaaatatttatattaaattataaaaaaataaaaatagaaagagtatagaagaattttacttttgaaatcatttaatgaatatcatttcaccgtgttcacgcaagtgcatgcactgataatcgcgtcctgtacaagctttgtgatggctagggcagtttggctcaggttggtgccggttgaggacgtgtgatagacatgcagttgggggctgtgggcagatggcccagctggcccaaagaaaagatcagcagcgacgctgggtgcagaggaaacgtgtaacgcgggcccaactccgagccagcgcgtgcgtgcgtgcgtgaacggatgatttttttttcgcgcgaggacaacagataaaaaatcagagacggacaattacttttaatctcgggcaaattttttttacggacgaaacaaaatacggaagccttacctattttttattaggtatatatactagcaaaaatccccgtgcgttgcaacgggtaaataaattctaataataatatacgtttttcatgcataatcatgtcaatgataatgtttgtattttaatgaccgacttattttttttataaacggtgtattttttcttgtgcgattttctcaaaccatttttcagaaatggcgcatttctttctaaccgtttcttcctagcatgtttttttttattttttttactgacgacgaaaaccatatttttctccccttttttgcttttcttttctcacgcgttttttgcttgttttttaatgttctttttttgctttttttccaatataggagaatatatgacgaaataaaagccgtgtaatagatggcaaaaaaatcgatggatcctatctgactcaagcatccatcaatttagcgtttttttctaacagttttttcagagcgattttttttttgatagacggtgtttttttcatgcgcggttttttcaaatcatttttttagaaatggtgcattttttcttacagtttttccttgcatgttttttttaaaaaaaatttacccacgatggaaataatatttctcgcacgtttttttatggaagatggaaaacatttttagcatttttttgcgcttttttctcatgcatttttttaaccgtttttatttttctcgtgtattttctctttttaaatagttagattagattagagatagagaagagatatatactgattagaaatcgaaatttgtttagctctttccatttttttctcgcgtgcattttttattttgtacgaaccagctttttattttttacgaaccatttttttcgccattttcttagggaatcggacgaacttttttaaatgttttttcagattttttcgtctttataggaatcagactttattttcccgtttttaaaggaatcggatctggcctttatttttcaccacttttttttgccttttataggaattggatctacggtttttttttccacctaggggaaacaaaattttattgttgttgtttttcttctttttttttcttttttttgcagtttttttctttttatgcacctttatgcccttgttctctcccttttattattttttcttaaaaaaatgacctcaagtatcttattgcaagattatagggactcaaatgtaaatataaaaattatagggactcaaataaaaaagtacaaacccaaaaattaaaatcatataaaaatggaatgctctcgaccggtaggttccgttttttcaaacagatattcaatccggcacatcaattttttttcaccaagatgtatgaaatatcacggcatagattgaaaccaagaggaatgtgcctgggatctcggactcaaactaagaccgagaggagtggtgtgttttattttccgtttttaagggggaatcggatctagagtcgggctttttgttcgtttctgagagggagtcggactttattattattattttttcactatttattttgttttgatgggagtcggacttttttttatttttttcgttatttattttgttttgacgggagtcggactttttttatatatttttttcgctatttattttgttttgacggacaaagaaaacatctcttcttattttttaagtagtagtagagatatagatatatagattaattactactccctctgtttcagtttataaagcattgactttggtcaaaatcaaactgtttcaagtttaactaagtttatagacaaatatagtaatatttataatactaaattagtttcatcaaatcaataatcgaatatatttttataataaatttgtcttgagttaaaaatgttagtattcttttttacaaatttgatcaaacttaaaacagttttactttgaccaaagtacgtcttgtaacatgaaacagtagcttcaggtgctaaaccgcaggagcgagaaatgttactgtctttattctgccagtagcttctggtaggcgcgcgcctctctcatcccgtttcaaacatggcccagtacatgaaggcccaacatgtctaggggatcccgttccgggcaaactaattcggcccaactctgatttcgagtttttttccacgtgtcgcgtgttttctgctaccttcgatccggagcgtagctaacggctatgagtaaacctgctacagttaatagcggtccagcatagaaagaataaatagtcatgaatactcgtttccccgtaagaaatctaaccagttaagttacgtttaagtctttgtagtacttcctccatccttaaatataaaaaaagttttagagttgaatacggttattaagaaaataatacttaaggcttattcggattataagataggaaaaacataggaaaggaaaaatataggaatagaaaatgaatctaagtgtaaaacagggaatgaaaaacaaaggaatacaaaaattgagagcattcggatcacatgaaattgattgcctaggatttgcatgcaggaagtgaaaaaaagagcttgaggtggatggatttttcatgtacttttcctgtgaaatcagtaccaaaggaatttcctatgaccagttttcatgattcgaatgacaggaaagaaaaaaattcctatgcacagtattcctccaaaaatcctgtgaagatcctctaattcgaataaacccttagaattaaattgggggagaggggaggaattgtgattgattgagaagttgatgtaggtagaaaaagtgaatgatagatagttgtgattggtgggaaagagaatgttgatggagaagttattatattttaagataaattttaagtataagaagttgttatattttaggatgtagagagtattattttagccctgtgtggattatagtttgggccgatcagacgcgcttgatctgtagtgtgaagatttaagacggaggaatgaatagtggtattgctggtgaaaagtaacctatacgctgcacgcgcctctcgttatcttgtttcgttttggatggatggatgaatggattaacgggtccatctttactcatatgattatgtttattcatacggtttattaacaacataaaaactttcaacgcaaaatttgaaaactttcaatcaagatttaaaaactttcaagtcaaaattaagaactttcaactctacatttgtaaagagatgtgtgaaagatttaaaaaaattagaaagaaacggtgaaaaattaaaaaaaacgggcccagagataacaaaaccagaaaaaaaaggtcgaacgaaaacaaagcggcgccaaaatcggaaaaaaaaagtcgaaaagaaaaaaaagtgcgcgcggggagggggccagctggcgcgtgggcgcgcattaggcgcgctatgcattatatttattagagtgatatgaactagaagatgataataattgttttttgtttcttgagttaagggtggttgtgctttatattttagaatggatggagtattgaatagcccacacccatatccgtcgggtgtccggattgatagtaagggcttgttcactttgcttccattgtcaatcttactgttttttttttttgataaagttacccaaaaagtggctacgtttagtttgttgctgaattttagtaagtgcatatgaaatcttgctaaaatttagcaagcttactaattggtaatgtcaaaactcgataaagttaaaaatggtagcaaaataaactagcgctaaaattaccatccctggtccgacgctcggtttgactcgagtctgcccgagttaactcgttcgactgggcagcagtacatatatacaatacaacacggcggaaggcgtagcagcggatttgacggagaagccccttccgccccaatctctctcgcggctcgctcgctcgatcgatggacgccgagggatcatcagacgcggaggaggccagaggaggcagcaagatgctgctgcgctccctggactacccctgcgccacgcgcctccgccaccgccgactcctcgccttcctcatcaacaacgactacatggatgcctacgatgagtacgctccaccaaaatccaaatccccccttacttttgctccatcgatgagagtggagtagtaaagccgtgttgagttacattcaaatttccaaaaatcacgtcacataaaatatttacatacatataaagtattaaatgtggacgaaaaaaaccaactatatagtttacatgtaaattacgagatgaatcttttgagcctaattacaccatgatttgacaatgtgatgctatagtaaatatttgctaatgacgggttaattagacttaatagtttcgtatcgcagtttatatgcggaatctgtaatttgttttgttactagtctacgtttaatattttaaatatgtgtccatatacgtcaaaagaattggacgggaactaaacacaacctaatttgtgtgtgtacatgtgttttccgatctttcatcggggcttttaactatttgccacttttagatttggtaattaactatttgtcacacctatctcaataacatgtggatccacatgtgtatatgacatgtgggtccagtgacaaatagttaattgccacatctaaaaagtggcatatagttcaatatctctctttcatcaggataaacaagaggagacgtttggtgttccatgtgagcgacctggaggatctcatgaaggcaggccgtttggtggaggcgaggaactacgtgtggcgtttcgccccgcccggcggcggcggcggcgagccgagctcgagcgccgaggccgtcaccctgtggaagttcatccaccagctcatggtcctcgacagcttcgcccacggcggcatccgggaccacacggcgatccgaggctggttcacgcgcatcctcgccgagcccccgggcttctccgtgctcaatcccctcgtgcctcgccctcgccgcccacttcgtcgccggccgcgtcgaggcggccagggacatggcggactggaaggtggtccgctccaaggcggccagcttggccgggaagatggcgcgcgaggcgccggagatcaggtgcaccatgctcttgccgcttgcccgggccaagcccaaggacttgttccccctgattgcttcttcgaggtgcgtttctcttaacagtttcagcaaacttcttctaattaattcagccctgatctgatattgtcagtttcatattatttggtcacttctctttccaatcacattgatatatactatcttatctccattttaggttataaaatattttgactttggtcaaagtgaaactgtttcaataattgaatatatttttataataaatttgttttgagttgaaaatattactatttttttctacaaacctagtcaaacttaaaatagtttgactttgaccaaagtcaaaacgacttataatctgaaacggagatagagtatatgaagataatatatgaagagttgctgctattctcggtatttcgatcctagttactgccatttttttaaagactactgctgtgtatctgtcttcaattttgtttggctagttttcgtcggaggcgttatgtgaaggcagcacgacgggcatcatcatctcatcttgctcagttctacctgaacaagaagaagaggtctggtccaacagttacagaatacgaattaaaatgctcttcgattactctttctttttgttagtctttggttacaactaatcaatgtaatgttccttctttaattcatgcaggctgccttctccaagtcatccaggtgtgttgttatggaaccctcttttcttgctttctgaatttacttgtgagcaaatacgttttatagctcatcttaattaatacatgtagcaggacaatcatatgtcagtagatcagagctgtttgcacttcttggtatgtactagttctgtatttgcttcaattcaacttgcatatcgatcataactgttcttttgttgctcgtgtgtccacattattgtctgctgacacacttggattacatatgtatatgcataatgactgactgacttgtttgttcttcagaggtatgtttgtatactggtaggcgtccgcggccttgtactgaagatctttccaagcaaggtgtataatttgaattctatgaagttcatataagctgcatgttttaactgcgtagtttgttgcttacctgcaggcatccatagtgtcccatttatgcggactatgctaacaaattcctcaaacaaaggcaaccctgcaaacatacatccacgcaaaagtgctgtggtttaaaattcaaccagtgatgaaggtatcacgcaaaagtgctctccaaggttaaaagaaaaaagaggctgtggtttaaagttgctaatcttgcttcttatttgcaggtgagggattaaaaaaaaataggatgacatcgttcaagttgcgcgtctgcgcgcagagcaatagcttgtaatggatggactttgttttaacggatgggccttttggtgtgtgtaacaaatggatgggcctgggtttgggtgcacgctctaagtactgggcaataagttcactttaggtccctcaacttgtcgcccagtctgattttcatcctcagtccggaaaactggatacaacacatcccccaacttacaaaacctgcgacgaggttcctcgatggtattgatctcggttttggctgacgtggcgcttacgtggatcttttgactaatcttcgtcctacgtggcattgacgtggcgcttacgtggcagtttgatctggaaaaaataaaattaaaaattaaaaaattacagcaaaagatgcgagcccatatgtcagtcaataaaaaacagtggggcccacatgtcagtgggtcccacttcttccaccccatctcccaacctctatcttctctctccactagcgctcactcctctcctactccaccggcgagcacgcgcagatgccaaagagggacgaggtggggaggccggtgagggggggggtgacaagatcgggctcgtgacgccgccgctgataaggcgggctcaggagagggaaggtggagactgaagtgccccaccctcgcgagcttgagcttcgtctacaagcgacgcttgcggccgccaccaggaaggagcggcgagtgggggagtgaggggattgagatgagagagagagagagagagagagaaagctagagagagagatggtgggagctgcttcggccgtcgccgcctgttccgctccgctccaaccgccgcccgctccgctctcgatgacctattcgggccggcgccaagcgcaatgggtagggcatccatcttcttctagtggacgcacgcctctctcatcccgtttcaaacgtggcccagtacatgaaggcccaacatgtctaggggatcccgttccgggcgaactaattcgtcacaactctgatttcgaaattctttttccatgtgttgcgtgttttctgctgacttcgatccggagcgtacgcattgatctaacggctatggttaaacctgctacagttaatagcggtccaacactgaaagaataaatagtcgtgagtactcgtttcaccataaggaatctaaccagttaagttacgcagttttagtactactccctccattctagaatataaaaaagtttcagaggtgaacacagttattaagaaaatggttagaattaaatgaatgaaagttgtgattttgagaagtagatgtaggtagtaaaagtgaatgatagatacttcctccgtttcagattgtaagttattctagcattttccatattcatattgatgctaatgaatctagatagatatatgtctagattcattagcatcaatatgaatgtgagaaatgctagaatgacgtacattgtgaaatggagggagtagttgtgattgattagaaagagaatgttgatggagaaattgttatattttgagacaaattctaagtactataagttgttatattttgggatggagggagtattattttagcctgtgtggataaaagtttcggctgatctgacgcgcttgatctgtagtgtgaagatttaagatggaggaatgaatagtggtcttgcatgctggtgaaaactaacctatacgctgcacgcgcctctcgttatcttgtttcgttttggatggattaattagcgggtccatcttttatcatatgattatgtttattcatacggtttgttagcaactaaaaacttgtaataagaataattttacacgtgttgttaacgattcaaagcaaatgataaataaaactcataaattaactttaaaaatttcaattttagcataaagtataagtatagacgaaaagatgatgttgtaattaacctgcgatcttttgaaagtgagaatttattataatatggttttaaatccattattttaattttataatagctatttcattatctttttttatgatttattcagccagcaatcctcagtcagataagattatcctccacttcggccaactcaatttggagagcatgacttgcagcagcagtacttcattcgacaacgacgattacgtgcgtggaacaatcatagtccggccgtgatcagattcatgaatcacatgtctgacgttcgtgacaacaaccaatcaaccaccgtaaggaattgagagagattgggcaacaaaatgggaatnnnnnnnnnnnnnnnnnnnnnnnnnnnnnnnnnnnnnnnnnnn

SEQ ID NO: 38919 - DNA, 2357 bp, Oryza sativa
  unsure (1)..(2357): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacggatcttagagccaccctgcacgataacttgattgttaataagctcgatagattaaatgttgaataagcacatttgtccagcagttgtcaatgcaatgctgaattttcggtactccacaaagttggactgtcaaagtacttacaacagcaatgtccagccatgcgtttgcaagttgtgtcagtgtatggtcctcatcaatctgttgcatgatctttaattgcttctcggcatagtctgaacggtgcatcttaatgaagatctggacattcaatgcatgcctgtaaccgaaaagcaacagatagtaaacaagatcatcaacaaacagtattccacaaatgaagggggcaccaaacagaagattctgaccaccaaggtttgcagttaactaaatgatcagcaacatcaaatcgaaatcagcaaagatcagcaattaccagtgttgaacaatagaaaatattaccatgctaaagatcatgaagccagaaagcacatttaagatgtatcatgcagtaatgcattttcaccaactctcaaaacgtcacattttcaacaagataaacataagtgcatttgcatgtgcatagttagcacttagcagcatataagaaagaaaagtgcgttgaactacaatgtccgagtgataataaacgtgcacaacactgagcatttgaacataccttttcggaaacaagatttttgacttatcttactggataccaataaacttgaccattattgtaaggtgatcaaaattcacaaacaaaattttctattgttctgcacctatgttttctaaaaataaatctacacctggaaggatgaaccatataaagttcagaggacaaatgaaactcacaggtccagagttccaccagagtgtgtgtgcttgagagcttcagtgtagtcttgctcatgcataaatataattccagcaatcaatcgtagaacaggattgcttccaaccgccgaatcactcaaccattccttcagactgacaatcgcactttccttcaaaagttgtacaaaagaataatacatagcatttcagtgtatggacaaaccagagggaagagaagacaatatgatggaaaaacaaaacaaaaaactatttttctaggcttagctgtactggactactggttaaatactcataaagtgcatgacatgaaccaaaataagaccataaaaactctgaaatgcaccagaaaacaatcgtattattggaccataatgtatgcggtagggttaaagtgaaaacatgcatacacaagttgagttcatggggcctcatagcaatttggggaaaacatataccaatgatccatctatgtttgaggaggtggtatccctgaattgcctgtgattgccaagttgaccatacattccccagcagactaccaaccaacattatcactgatgaatgccggtagtcctagtctcctagatgcatggtaggcagtatgtatgttttcccccaatttatctgaactgaacaccctgagatcaagtttacgttatactggttccgttttgttttcttcttttgggttttaacagtgaggaggaagtagctctaatggcatatctttgtgtatgcaagtgtgtctatgctcttttttttttactttaaactttaaaggaactgtggtttcaacctatggtaactgaagtttgaaacgaaaggtcctaatatgcattgcgcaattgagctgaagaacttaacagcttcagcctctgaacaccatcagagtctattcatccaattgaaatgaaaaataggaaatcaatgatcaagtatcaacgaactaatcaagccctgagcctctggcaatgcatacgatccactagatctaactccagatcacataactcaatatagatctagcccttcgatcacaacaaagcacaccagatccagactcagacatcacgttacagaggcgatgggatcagatccagcgtgctaaccttgtctccggagaggtacagcgcgagcagcttcacggcctgcagcgacgtcgccgcggacgagtcgatctcgctgatcaccaactgcaacagccacatggggggaggggacacgcaccgatcagagccgccaacccgttgtagagcgagcgagcgcccgagggggaagggaagggagctgagctcacctggtagga

SEQ ID NO: 38920 - DNA, 17826 bp, Oryza sativa
tcgaggcccgggacgtcgctgttgttgatggcggcctggtaggcgccgaggtagaagaggttgcgcaggttgaagaggaggtccggggacgccatggggtggctgctccggtgctctgccgccggcgacgacgaggaggaggcggctcgtcggcgacgaggagtaggagatctcgcgagcggtggcgctgctgctgctcctctctccttggcccgtttggtctctgtgtgggttggtaaagactgaggcgtatttataactgggctcgattgggccaaaaacttctggcccgttgctaggtgggcccgtcggaaatctgcagagaggtgggcccattgtttgggccttagttctatagtgggccaaaatatatccggcgctagcaaattctagtacagtacatttttgctatatatatttttgtcgatatttttttctaatataatggtaatgtacattataacttacatggtaactataatataactttcatataattttaatcgttatatttatttcaacattcatgcaagttagaaagaaaaaaatccgagcgcatatgtgtgacgattcggtcccacaatcttcgttttataaaaatagcatgtaactaacaaatttttgaaagttacaagttacaatataattacatcatgattgcactataatttatatgtataggcagtctcagtataatttggtcgtgctgtcgtggtacaaatccaactccgacttggtaacaaattatcttctagattctaatcgataaatttcaacgaaaatttgacgagccttttggccaactcgagagtgacgtcagcgcgcacggcgtgctcggcccatcgtcttataggctcttagctcaagacactggcggagtcataaacagcgctgtaaaacgagcagcgcgcgcacgccgatcagcaagccgccactggctacttaaagccgtagcctgtagctcagctccaccgcgcataaacctagccagctagcaaccgacaagccaaggcgacggcaatggcgccgacgacgacggccacggcggcggcggagcaggcgccgccgccgcagcatacgaggaaggcggtggggctcgccgcgcacgacgactccggccacctcacacccatccgcatctcgcgcaggtatgaacagccaaccgtataccgctccatgctaagaggatctttgtcgtgctcgatgattgctcgatgattctcccgcgccatggcgccattgatgggagattgggagacatatggagcttttttttttctctccagagtttaagatgatctatcgtgtttgaatttgactgttactctcgtagcaacaatagtttacaggatgtccacatcgaattagtgaaaatcgccgtttggttcatggagttaatagaatctgaagctctcatgagccagcgtcacttgagctttcgatttttgttttccccttccatttccagtcatttccagccttctcatcggatttgtagattgtagttttgcatttgatttccctgcgagcaacggtgctcagcatttgcacatcgaatttcggtcatccatgtgcaaaggaagcaaaattcaccactttttgaaactgttcttttttaaaaatcttttagagaagtgtatttattacctggcctcgttcaaccggatatatgcagccatttaaattggttctgaaactgttcttgatcaaatggagtatctcaaccaagccctttcgtgccaaatcaacaaacaacagcaaaatctttccccagacgtctacagtacaaaaaccctgaccatccagcaccagccagcgctggctcactgacctgcagcaaccagctttaaaaaccatgcgcatttgcagcacgtattctgtaccaggaatacgggatccgtcagatctcaactgcaaggcaccctttcttcaattgtttttggtggtgagttaatactgttcaacagtgaccatactgggcatgcctcagctgcaagaatttatggtgctcgatcgctactacgtcatccatcttcttttcatgtgcgaccattctggctgtgattggctggctgctgctgtcaaagtaacaggagtgatttactttcacagtctggttgtatggtacataattcagttatccttctggaatctgaactcctcctggcttagtcatagcagtaaaaatgttcattcaagaaacaggctttcaagcagtaggcggcttgctgcacatggcttgtttttgttaccagtttttttgtcgagcctatgtgaattttcacaagtttacagccatctgtgtgatggtaaattgaggatcttgctgtatgccaattcacttgctagtgttgtaagcatgcatcttctttcagcttcagcagttcaaggctgttgatttgatggtactgaattagttccctgaaatacttcagataaagtaaaagggaaagcaaaataaaagaaaaatttcagttctaccagttcatggcttagttaaaatcttgggaggtgaagcatggtgtttaggctctctcttcttgtgtacttgagagtctgaactctcaatgctgaagtaataaccactgcagttctgctaaaaggttattggctcagtagagaaatagtatatgtttctgacttgtgttctatatattgccatttttcaggaaaactggagatgacgacgtcgctataaaggtgctgtactgtgggatttgtcactctgacctgcacaccatcaagaatgagtggagaaacgctgtctacccagttgttgcagggtacatccttcttattgcatcaccaatttatcaatcaatcgtttttcttttcttcttggttctgtgcgcatccagatggaaaggctggatgcaatttcattgcttagtgaaatatccattatcagttcatactttcttccggcaaagctgaattatcatactgtaaactgcaaatcttgtcagttttttttcacgataatgaaattcattttgtttttacttcaaagaagctacaaccaaccactaccgccgtttcaggttataagacgttttaactttagtcaaagtcaaactgcttcaagtttgactaagtttgtagaaaaaataataataacattttcaacccaagacaaatttattatgaaaatatattcagttattaatttaataaaactaatttggtattacaaatattactatatttgtttataaacttagtcagactttatcaaagtcaaaacatcctgtaacctaaaacggagggagtattactctaaagtgctttcaacttacttggaaaaaagaaatgcaaactttggctgcatggtttgattgatgcaggcacgagatcaccggggtggtgaccgaggtggggaagaacgtggcgaggttcaaggccggcgacgaggtcggcgtcgggtgcatggtgaacacctgcggcggctgcgagagctgccgggacggctgcgagaactactgctccggcggggtcgtcttcacctacaactccgtcgaccgggacggcacgcgcacctacggcggctactccgacgcggtggtcgtcagccagcgcttcgtcgtgcgcttcccctcctccgccggcggcggcgccggcgccgcgctgccgctggacagcggcgcgccgctgctgtgcgccggggtgacggtgtacgcgccgatgaggcagcatgggctgtgcgaggccgggaagcacgtcggcgtggtggggctcggcgggctcggccacgtcgccgtcaagttcgccagggcgttcgggatgagggtgacggtgatcagcacgtcgccggtgaagaggcaggaggccctggagaggctcggcgccgacggcttcatcgtcagcaccaacgccagtgagatgaaggtaattttaaagctagtttgatcaagtcaagagattattaaatgaactttaagaacggattacacgatagtaattacaatctacaactcctgtacaagtagtaaattaataggaccactttggactgagttaagaagagatcaatgaactattcagttctacattaatcgtgtagtcatatggaaggacatcctactgatgcagatgcagtaatatggcacatcacaaacatacaatttcaaatttgacttttacaagttgcgtttgatatgttatttttgttacaaattatagaagtcgaatttgaatttgcatgtttgtggagtgttatattagtagatgtcaatctattttttcaattttttttaatatttttataatcgtttaattaacatgcaataaacgggttaacatccactcaagtggttataatccatctccatcaatttattgatgtgctgcagtgcaactttgcaaggctatgcaagccgaagaatctttgaatacaactgatgcacctcattgccgacagagcatcttaagattgtttggtcaagtatctgaatttgcattttggacttgtgtttttgcaggctgcgatgggcaccatgcatggcatcatcaacacggcctctgcaagcacatccatgcactcttacctggcactcttgaagcccaagggcaagatgatcttggttggcctgcctgagaagcctctccagatcccaaccttcgctttggttggaggtaatttactagtttgtctgacgctgcatcgtctgattccttctcaaattcatggcaaaatttgacagtttgttttgtgacaaatctttgcaaatcaacagggggcaagatactagctgggagctgcatggggagcatcagtgaaacgcaggagatgatcgacttcgccgccgagcacggggtggccgccgacatcgagctgatcggcgccgacgaggtgaacacggccatggagcgcctcgccaagggcgacgtcaggtaccgcttcgtcgtcgacatcggcaacaccctcaggtcggattgactagggagctcactgtcactggtctcagctctgtagcataccggacctgcaatcctgcaaagtagtgcaatcttcttgctacaagacatacatatcacctctacttggtgtcaataaatgtagcaaaagtggtacattgttgtactaatctgtgtttaatatagcgttgcaacacacatgtatattgtgtaatggaatggaatgggtcactgactcctatccaagaacgagccatttgcattttgcaataaagcattactgtacttgtacacagggacaagggtaacgttctcactctgatggttggacaaaaaagttatactagtatacaatatgccaatatggattctgcttgaatgaagctaaaacgacgtactacagagatagacatcatcaccttgacatactaagggacctggggatagagagcgatcggacctccggcgccgaacttgggaacatcacgttgagcctgtgcatcaggacgtcagccttggatggtatctcgttgagcaggaactgctgcacgatcggcttcttgaaccactcgagcaccgagtcacctggcgcccgcagcaccaccttgctcacctcaaagggggactccagcgacgccagcacctgcgccaccaccatcttgagcgttggtccagtcactagcttgatgcggcgcggcaccaccccatagtagagcatacgcttcctgaaccggtgcagcgtgtgcacggttgccactagcgctgcgccaacggagaggtttctgacgtccagtgaccaggcgatgtgctggtcgaagacgatcgccttggcaaacagcttattctcgtaggcgaccttccagatacagcgggcacggttcatctgccccatgagaactaaatagttgagaagcacattcacgaagtaccttgccgcactctcctcattgtcgtagtcgatgccctggaagaactcccggacgaacgagagcactggcttcttgcgctgctcaggcccggtgaacagcccgcacatgaagtcatgtgccttgtgcttgcttacactcaggatgtccatgattgcccgctcgcgtccctcatcctggcaccgcaccaaatgtgcaaggatcgaagtgtagagtatcaagtccacctttgctgcccccgcgacatatgtctcgagcaatggccgtgctgagtcatacagccccgtcttcatacatgactcgaatagctgccttatgatgaaattgttggtccttatgccagcggagcccatgaaccgaagccaccggagtgcaagctccgtcgacccttccttgatgtaaatcatcaggaggtcgctggcggtcacctctatcgggaaccctgatgccttcatctccagcaatacctttgcagccaaatccagcatcctcttattcgccaacatcatcagcaatgctgtaaatgtgctaagccccggccgttgtccagcatttgccatcgagtggtacaaccgcatagcagcatccacctgccctgcagaagcatgcatctcaaccagacaagcgtatgtcgctggcgtagggaagaagccggacttctccatatcaccaaacaactgtgtggcaacatccaacctcccggaccgtgcattcgcctcgacaaccatggtgtacagaccaaagcttggacggagccctcccctcctcatctcctcccagagctccatccctgcatccaacttcccagccctcaccagcccctccaccacggctgtgctcaccgccgggcttgcacggtgccccaccgccaccatctccctgtacatccccatagcagcatcgagcctccctgcttttgccagcacgtccaccagcacgccgtacatcccagccgacgcccgcccaatcccctccctcttcctcatttcatcaaacatcttgcgtgcggcatctatcctcccggcgcgcgcaagggctggcaccacgagctcgtaggttccctcgtcgagcgcgcaccccgacgatgacatttcgtcgagcacctcaaaggccttgaaggcgaggcccctggtgagcagcagcgagaggagggcattgtaggcgtgcgtctccaggaccctgaaacccgcgtcgcggaggcgcttgaagcagaagaaggcgggctcgaggaggccatgggtggcgagcgcggagagaacggcgttgagggtcttggggaaggcggcggggtcggggagggcgagggtatcgtcgaagagggagaggagttcggaggagtgggtggccggggcgaggcgggcggcgaggagggaggagaggtcgtcggaggggacgaaccatggctggacgcgcgcccaggcgacgagggcgaggagcggggtggggtcggaggcggggagggaggacgcggcgaggaggaggagagccggatcgggctgggacggcagcgcggagagcgcggcggagagggatggccccgagcggaagcggagcgcgagcgccgccagccgcgccgccgccgcggggcgcgggagcgggtgggccgaggagccggacaggatggtcgcgtcggcgcccggcaccgcggcgcgcgcccccggcgccgacgagaggacctcccccgactcgtccaggtagtccaccgtgtcggtccactccgccgccggcggaggcggcggcggcgaaggccccgtcgagagccgccgcccccgcgcggcgatcgagaggggcagcgccgccgtcgtgaggcggcggcgcgagaggccgacgcggagtagcatcgcgatgacgctgccgccgccgtggggctctctgcgactgcaagtaggggacttcgctagggtgccctttgggccgtgctcggcccatccaattacatgttgttgggccgtggcccattacaaggcccatcgcacaccgttgccgagtcgtcttcttcctcttcttcccctcttcttctgctctgctctactcgcgaagccaaagcctccgccgcgatcccctccgccgctcccacgagcttcgccgcccgcttccgtcgcgcgtcggcgattcgcgctctccccgactccagcgccttcgtcttcttcgacctcctcctccgaaggccccgccgatcgatccccggtgtccgcgccttctagttcgccttttcgagctctttttcgccggagacgacgggcgtgggcgattcggctggattcctctccggtacgtgcgatctcgctccagctctgctgatttatctaccctagctttgtggttgcggaacagccctgagtagcacccatgttttgagatgtttcgactgtatcgacttgctgtgcgcgcgtccctgttaggtctagcttccactgggtgttgtttactgctcaatctatactttaccactgtagcttctgccaccaatcggttggtcatgtgtatgcctgtgtgaattccactgggtgtgtgtgcacatgtatgaatgtgtgatgcaaaccaatatggtagatccagtggatgcttatactattaactgcttaagtaagatgtatatgccatagttttgcgcaatgtttgggtgtagttcattccatgttgttttccctgcagctggttgtataattcatggtgcatattttgtcttgcctctgtttcagcattcctgttaggacttaggagaagtaatgtcaggagtattagcaaaattcgctattgcatctgcggtgatgtggacagctccagttgccatcgtgtatggattttactaccagatgattccaggtttgactattgtatctaatttacattgtttttcatcgctacttttaaaactgggacacatgatattcataaggagacttcatttgctccctgatcaggtgtgagtcaactgtcatcctcgacgcaaactctagcaagtggattccttgctgttatatcgattaatctggtaatcggcttttatatatgcatggcgatgaaggagactccccaccaagagccacaacctgatccaaccttcttggcaaatgctaaagcaagcattgatcaaccaactccgtctcaagtgaatgatgattcccatggaaagggaaaggtggagtaggtcatatcacaacatgtgcatgtttcacatgttatccagaaacagttcttctcgataccctgccttctaattcaatattatcttctgtaaatcttgagaattatggaaccaatatgagttttaccttttgtactgttattatcgagatactgtgttagaattatttttgtttggctgcagagaactactttggctggctgtatttaagtcaatttcgtttttcttcaatgtggtcagagatctcctttagcatacatttaataagataaatattatatctatttagttatccattcgcaatgtggcactgtttttttaaaaaaaatttctggttaggagaacaaacctggagaaagttgtgttccaaacttatgcaaatgtttgcccattggaagtagatgatttcatggagtaagcctattatgctttagggagataataatttattagtgcccatgccactcactcttatggatgctcgacgctagaatggtactgatctgaccaaatgggaagctcagaatctactttacccttagtcattcacatggcttagcagctaagaacaagttaagtcatcatgtattatcatatcataaagtacaaagagatcacctgagataagctttggttttagaaaatctaggatggatacaataaatactccaccaagagtatgttattttgcgaagatagaaaactcatagattaatacaaatcaagcctatctgggaaataagatcctctgttattctgaagatctatgcccatatggcaagcattgacatcagtccagcacctaggaaaagtgcaaggtatgccatgagctgaagctttgtattaatctgtagcttcgggttattgaaatctgttgctagaaggtcaactagggacatgtagatcaaaattcctgctgaggctgagttgaagactccttcaacgacgaaggcagttgagctatgcacattgtagctcgatgaaattgcaattcctagcacgatgcccacaggtgcagtcagggagaaaaatattgccataatgacggttgcccttaccttaaaattagcctgcagtaagaagaatgaatcaaacatattagctttttgttgctgtaagacatgatatgttatatgcatagttgtctctttcttctttgtgtccaattatttgatttctcgataaatctattattattcttacctaactagtgaacctatgttctctatatgaaacagttatatttctttatttttcttttgcagcctgttactttgttctcggcttcttttttttgtggtctgttacttcgttcttgaagaaaatggctaataacttttcatgcttgcaatgtgtcttgttgctattgtgcctttttttttccaactttgtatgtctctgccttatttctttttttctctccccttctgcggaagggcccttccactggcctacgagcatgttgatgttaagccttttcgagcaagcattttgctatcttttgtcaaaagtcgaaacaacaagttagatatttgtcatcaggtgtctactatctaggttacagtacttggacatacctgaacaatgcaaccacccaaacctacaccttcaaagaactggtggaagctgagggcaccaactagtggcctgatagtagatggcctcacagatgcacctaaggatactccaatgataactgaatgcaccaagattcccagctcaagaacctgcatggccaaaaattcatgtggttattgcaagagggcctatctggttttgtgaagcattcatttagttggcaatcaatgtgcaaatggagttaattctgagtttagtgggaaaagtttcccctgaagtgcagattatcagacatatccattgaataggtatcttctcttccccatatatgttttctatgtgttttatggaaataagtaaaaagagatattagataatcaacatcatcctgcactattgtagtttcaagattacaatagactaaacttattctcattactgttgccaggaaggcctatgagcttcaagtgactgctgttacctgagatactaccttatgtcgaattgattcagctactgaaccctcctctggtgagccacagaccactatatcaccatgtgaatgtgtatgtcctccatgtgtgtgcgcatttatgtgttgtgcatgttcagccctctcgtctccagcatgcttgtgtacgttgatgttgtcaactgggcgtgccttcctgaattgagaccggtgatagtatccagcagccaatgagtccaccaccattgtggacactgcagcagacattgaaacaaggcccgcaaaggggaagggattcctatccccaccaccccttttgaggcatggagatgtgagcgcatcaaacgccgctggaagaatgtgcaccatgccagtggcaaggatgacgccggctgcaaatgccttgacagcaaagaagatgtcaccatcagggcgcagcgcagccatggagcggccaatcactggcaccaagacaccagccgccccagctgcaaggatggatgcaatggcaatgagctttagcttcattgcaccctgtctgtctgccccgtctgtggtgttagcacagtcgcaggcactggctgcagtgtgctgcgcaaagagcagtagccatggaagcacttgcaaggtatgcttcttggctcccattgttgctgattatgttgattatttccctgtgatacgatgtatgtatattgctatgagtcagagatgaaggtagtactgggttctttatataggaggggatgagatgatagggattgatgtcatcctttgaccagaagatggaggcaatgatgggttttttcttcttctttttttatttaagtagaagggaataagatgatgagaagagatgtcattctttggccagaagatggatgcaatactgggtcatttatataggaggggatgagatcatagggagatatgtcatcctttgtctaggtgggatgagctatgcccatgtgtcaaaaactgtagactaaagcactttggacaaagttgacccaaaaatgtggaaggaccaaactctctccataaatatgtaaaccgtaatttaacgctatcactctatcatgatgttaattgacaggtgtatcatggggcatggtaaagccataaaggtagatcaagcctgggctcatgtggaacttgtttgcatccatggtaatcagttgtggggtgaatgtgaaaaatcttcatgttcagtgttaacgtccgcatgccatgttgacccatctcctgattaccaatgaatatggctgaagcagatttcacctgattatattcaccttgagtaaagctggggatatagcattcagatagatttttttttgccttctattgccacccttcttcatctcttaagacttctaattaacattattgttcttatccggttggaagatgtacaggtgcaaatctgatggttcgaacacaatagttttgcattgagctgtcaatctgaatcaagcaaatcagctaccagcctgccagtgagtcctgaatgtgcaatctgaattgattagatggctcatgatgaacttatcgtcggacatgttggatcggtatgttcatcacatttgctccctttaattagctttaggcacaattgtgctgcatcattggtggcttatcgattgatatgtacatgcaagtaagaagtgacttggaaagtatttgttgcctatacggatgggtctcaagatctacactcgtgggttctactgttgacaagaactaatgcactgtttacaagaatattagcaggattctgcatatttccttcaccaatcactactacccgtatcaacctaagactatcatgttttcctttttccttgcacctgtttctgatagttagaagtgacatttttaagtgcttgttgatacagaccattcgtttatattcattttcataaaaaaaagaattcagttatatccaagttttcaaattttcaagcaggggtatccttgttcctcgctgacctcgggctcggctaatggtcgaacggatgcaccagggagaaaagaaggcgacacaacacaccacaaggacagcatagtgggtaggcagaccagctatgttcttgtacacgaacaggagaagcaccactgagccggccggccggccagccaaccgcagcggagtggaggtgagccaataatgctatcctagctcgcaggatttaagtggtatcgtgcacttgacttgaccccataacagttcacccttttgctttttgcctcgtgaatttcttcaggaaaaaaaatctgaccaatcaaggttgtgcagaatgttaacactgcatagataaagttcctcttgatttcgagggctggagtatgtccattgatgattcaagggacaattaaaacccttcctgtgctgatgcagttttgcatgatgctgaagcggtagatcggccgatctgtgacttgctgggtggtaaggacagctaaaaaaatctcagagggatatgaagtgaatcagtggctcaaagttgccatcgtctgggcttgtgcagcacctggtatctcgcattgccgtaagagcgacctaacatgaaatactgcacacagtcatctcatttgcaggacagcgacacagtgtaatgctcttcactgcacacactcagctcatctgcaggaggacagtggcacagtgtactgctctttcgcctcccactcagcaagtcatgcaacagcgccatgtgcttgcgatgaaagcccatcgctgcccactaatggccgaggtgatcgtcgcgtttctacatccgcatcattggttgctcggacggaggccatggggcgcctggagccaaagctgcgtagcccatgttctccttgactccttggatttcgtttgcaagcaggaaaggtattgtttgcactttgcagctctgcactgtgttattcgtttccttatcttctttcttttcacgagtagaattctgctttggaataaatctattttgcctctctcctaattgaatcgcctcacaaaatcacaaaatcggatataacgttttcctcatcttcgaaagctggtgaaaactgtcatccttcctgcctctaatgctgctggaagatgagataggaggaaaatggaagagaggattgatagaggggaaaagataaggagaaagttgttgacatatgggtcccactcattactcaacgagtcaaccgaggttaacttgttactacgtcagtagaaaccgtttccaaaccatcgaaggagctgatttgtagttgagagaggctaaggagctgatttgttatattcggttttatagttgagagaggctactgctgggtggtaactactgtcctcctgtcatggacaagcagagggatgtgacaatcagtagctcaagttacgccatcgtctgggcttgtgctacacatatagcgttgcgcggtgtgtaacgtgtgttaggccgactagtgtagtcctcttcattgcacactcagcacatttgcaggacagcgccagtgtaatgctcttgactgcacactcagctcatctgcagaaggatagagacacagtgtactgctctttcgcttcccactcagcaagtcatgcaacagctcatgaaaatatgcagtgcaaatcacatatgcaatggaaatctggagactacgttggatccaaatatgagtgttttagatttgttcgtgtcaccaagaataaaacttttactcgtggttaaatctaagagtaaatctaggaaaaatatgtagtgcaaatcacatatacagtggaaatataaaaactatcattagactaaaatggacgcctacaatttatcaatgccaacaatagaaaaacttataggcgtccattttagtctaagatagttttcatatttccactatatatgtgatttgaactacatattttcccaaacaacaccatacttttgcgatgaagcccacctgtacccactaacggccgaggatattgtctctgttctactaccttcgtcctagaaaaagacaaaccctgagtttccgtgtccaacgtttgacagttcgtcttatatgaaattttttttataattaatatttttagtgttgttggatgataaaacatgattaatactttatgcatgacttgtctttttaattttttttcataatttttttaaataagacagacagtcaaacgttggacatggaaacccagggtttgtttttttattgggacggagggagtatattacaaatctttcaggtttatcctaagttaaaattcttttaagtgacattaatttgtaaatatttatcaacaacactaaattaatttgtaaatatttatttacaatatatttattttgtgtggaaaatatacctataatttttttataaaatttaatcaaacttaaaaaagtttgatttaggataaacccaaaacgactgtaatgtgacggagggaatagatacggccaagctgggtagctgcgagcatgagaggattggtctgcacattgcagctctgcgctgcactgtgttctccggctcgttgttcttctttcttttatctcctatttcttctccggctcgttatccggcacgacggcgtgggctagcccgtgctcgctagttgctactcgacccagtgtgtagtcgcgacatggctgtgatttgagaagaggaagcttgatgaggagaaggggaagggaggtggggaggaggaagaggtggttgctagcgcggggtggaggcggaggtggaggtggtggcgcttcaacagccggtggcgccgtggcggcgaagactgccgcggcgcttcccgatcgcattgcctcctccccgacggtggcctaggtgatggacgacaccccggcattgggcgtggagcggaaggggaaagagggggcggagcggtccacgggaaactattttaacagcgctcgtgtggacgtccacccgtttattgcatgtcatctaaatggttatgaaaaaatatgaacaagatagatcaatttgtaatatatcaatccacatatttttgttacaatttgtagaagttgaatttgaacttgcatgtatgtggagtgatatattacatattgatctatcttgtcaatttttttaaaaatttttcgtaaccatctaattgacatgcaataaacggatagacgcccacttgagctattagaatccatctccagctgtccacggctccacgccatatatggcccggccatcctgggttcaaagttgttgggctatcttacatggctgtatgccccgaccatcctgggcccaaagttgttcgtttccagcctgaaaaccagccatattcagtcaaggaataagttcactctaggtccctcaagttgtcgccctgtccgatttttcgtcctcagtctagaaaacctgatacaacgcatcccccaacttacaaaacaatacaaaacaacgtcagccaaaatcagggtcaaatactgccgaggacctcgtttgcactggttttgtaatttgttggacacgctgtatccggttttccggtttagggacgcaattcggactgggcaacatattgagggacctaaagtgaacttattccttcagtcaagtgaccgggtcccccaaggacattggtattatcaggcataccgacaaaccagatgggccaatactgaattcagcatacaacgtactccagctagcaccggtttcagtcaaatgatcgatgtagtgcattactacattggccatggatgattggatgtgattgccggttcctcaagagttaagcatgcgtgcgacgagtcgctgtcaaagttttcagaaggtatggggcagttaacaagctgacatactacaggaattatactgatgtcccatttattagtgttggaatacatgagattaatcagtcaaagccaactgccaaaagaactactgtacccctgaaaccaggaaacttcttttctgcatggttgctcgcctaattaatcagtgattgcgtgcctttcggtagttacaagtagcagcagctgtacttactttgattagttctgaatactacataattaagagtttaattgtgcttttacttgtatagatagtactagtagcaggctactactgttatcacctgagacaacagaggatagatatacgagtgagccggtctatccgccgcttttgttgcggacaaatcactgatgctcccgggacagctgctccttctcccgggatttattctcagaagttgttttctcttgacgagatttattttcagaagttgtttttctttttactgtaaactgtccaagtttctaccccgtttccaaaaccattttttctctctcgtttggtctcaaggtctcaccgacctctcttggtcttggccctggggctgatcaactacctagatttattttttatttttttactgtcaactgcacggcatgaggtagtactgtttttcttctctggaattcttgcgaatgcttgaatggatctttgtccatgttctctttttctttagcattacgtcctcatgtcctatgttgcaatttgatgcaggaagcttcttgtaattttctcctgtaattttctctctccttaacttttccacttgatctaggaagtgagccttgtttaggtcccttttgaatcgcaggattgagaaaacgtaggaataggaaaaacgtacaattttgataggaatgtaagtgtaaaacaaagaattgcaaaacgcaggaaaaatacaggaataactgtttgattgaaccacaggaaaaacacaggaattggatgagaga

SEQ ID NO: 38921 - DNA, 1189 bp, Oryza sativa
aggaaatttagcaagagcttcaatctcttgctaactttcctttgagtctatctctctcatccaattcctgtgtttttcctatggttcaatcaaacggttattcctgtgtttttcctgcgttttgcaatcctctgttttacacttacattcctatcaaaatcctacgtttttcctactcctacgttttctcaatcctacgattcaaaggggccctaaagctcttactaaatttcctccaaaatctctataggattgtacattccataggaatttcaaaggattggataggattcaatcctttgtttcaaagggtttcataggaaatttttctataggattgaaatcctctaaaattcctatattttttctccaaatcaaagaggcccttagttgagaaaaaaatttgggtttgattgtcgcatcgaatatacggacacacatttgaagtattaaacatatagtttaataacaaaacaaattacagattccgccaggaaactgtgagatgaatttattaagcctaattagtccgtcattaacaaatgtttactgtagcaccacattgtcaaatcatggcgcaattaggcttaagagattcgtctcgcaatttacacgcaaactgtgtaattgttttttttttcacatttaatacttcatatatgtgtccaaacatttgatgtgatgggtgaaaagttgttgttttgggaactaaacaacccctgaatttctttaggctccatgaattcgactttgtgccgcgcacggtgtgcgcatgcaagctagcgagcattttcatgatctgctcctgcctcctgctttgcagatatcattgtacagaccaccttccaagtgtaaagatcaagcaattcaggttagttgggaaaagttcagagaaaaaggggaaaatgccccttctctttccctttcttttgtggaaaggtagagaatatcagaatatatcaaaatgccttgttgcaccaatagagttaattaattatacctctcatcaagtgaccacacacaatggagcaagttatcttaaacaaaaaaaaaagataaaaatcttggagcatcttgagcatggatgcaagaacagtaggcaaagaaaagatcagaaggagagcaccaaagggaaaggaaaggagaggaagaaaggtggtgaaagcaaaggtaagctaaggccaccaaa

SEQ ID NO: 38922 - DNA, 2401 bp, Oryza sativa
acatggggatgtatagttctttcatgcattgttttgtttttttatatagactatctttaagttagtaaaaagctttgctctctctcttcatttaatatcttccaaatagaaaaatatgctgacatggatcttttatagagaatctcttatagagaggttatagataacaattatgggggctcgaagcaatgaggtccaaacgatgcaataggaaagaccagttcattgaatggactcgccaaccattgaaaagctttgcaaattttgccatttactcatcagtctggcactctcccgttgatacaaaggcgatgcacacacagggtaggcagacaccgagaccaattttggtgttcccccccccccccccccccaccaccaaccttcttgccttgtaaccatcgcgcataccaagcttaattactgtactttgcctacacctatatatttcttccacacatacacatctccattcccctctctctctttctctaccttcctctttgctttgccatttcaagtctagagagagagagagagagagagttgctggattggacgccattgatgctgtagcagagaggtgccaaggtccaagaaagtgagagagagagagattgatgaagaacatggaggctgcaagaagaggaagaagaggaaggcaaggtggtggtttgctgctggtggttcttgccgctcttctgcttcttctccttgcattggcgcgcggcgcgagcgcgtgggcccacggcgggctcgccggcggcgccggcgccggcgccggcgagcggcggtacatggatctcgcgatgaggaggatggagagcgtcagatcttccttcgtcgcgaggagggaattagcaacggtcagtgtagtttaactaactctactccatttcatggcttcctgctgcttctgcttccattactgtgttgattgcgtcatttcaacttgttaattgcaagcctctctgctgcttccaggcttgcagctctctgctgcaaaaaaaaaagttttttaatgagtagtttgatcattttgttggggagcgtttgttgtgctgggtacatgttgcaattaattaactgcattacactgggccaaagttagcagtaaaaccatcattttcgaagaacagcaatgcatatgcacacaaagagaagttatcagataattgtgtcggtttgcttttgcactggcagtacattctttttttttttcatttgccttttgcaataaaatgagcagttttattaccccaaaaagcagcttttttcctaagcatatctccgtcatttgtcggccggaagtctctgtccacgctctcaatgaaatctagccgtcctcaaagaaatgtctttcattcataaatccgcattcacatgcccaacgcattagctcatgcatcagtaaaaaaaaaaactgcatttgcagttcatattttccaacttttggtatgcacaaacgcattacctcaacgttttttctttttacacttttggtattcccatgcacaactctttcaagagttcaagggcgtcatattttgactgcatttgtcatcaactttggaaaaagaaaaaagaagatctcccattttctcacaatttcgtcaagaacgttaggtatactaccaatctagcaatgtaccatgaaatgcttacacggcagcgaagaaattgagaagttttctcctcagaaaatcctgctcactttccaccgtgttcggtagcaggtagcactagtagcaactgcccccacataaatgtaaaaaaaaggaagtaaaaattaaaatcaaaagcttcgcggctactcgtgccaaccaaactttgaactttttaccggtgctaactttgaactttctgagttttttttttaaaaaaaactttgaactttctaccggtgctgtgctgtcacgtctgacatggcgagttcgtgcattgcagtctacggcggcgagctcgtcgcgggtgtaccacgtgacggactacggcgccgacccgaccggcggcgccgacgcgacggcggcgatcaacagcgccatcgccgacgcgttccgccgcccctccaacgccaccatgaccggcggcatccccgacctcggcggcgccgagatccacctcgacggcggctcctacctcctcaagggccccctctccctccccgcctccggcggcggtaacttgaaggttagtaatgatgtcacgtgagtatttttatttattacttcatccgtcctataatataaaaaattttagagggtcataagatacatgtttcatgtttagatttatatgtttagatttatagtataatgatatgtcacataccttattcagagataccttattcagagggagtatatatcttttcctaactcattagttgtatacatattaa

SEQ ID NO: 38923 - DNA, 9050 bp, Oryza sativa
atcatttttaagaaattctttcagtcccaaaataagcacagtaatgagtttccgtgcccaactttaattgtccgtcttatttatttttttttgaaaaaactaaaaacataagtcacatataaagtaatctaatatcaataaaaatattaatcgtaaaaattttcaaataagatgaatgattaaagttgtacgcggaaatttatgattatgtttattttgggacagatggagtaatgaatttggacaaactaatactttgggatgtagaaggtattttgacatatgggtcccactgagggtgtatgtacacgtggcagattcacagcgggtcgctgcgggcggcggacgacttcccgacggaccggtatttgatcgagctgtcggcgaaggcggccggcggtggcggggggagctcgccggcgatgagctactactacgagtacgtgacgctgcgcgacctgatgctggactgcaactaccgcggcggcggcgtgcgggtggtggactcgctccgcgtcggcgtcgacaactgctacgtcgtccacttcgcgacggacggcgtcgcggtgagcggcggccacgagacgttcgtccggaacaccttcctcggccagcacatgaccgccggcggcgaccccggcgagaggtcgttcacgggcaccgggatccgcctcgacggcaacgacaactccgtctccgacgtggtggtgttctcggcggcgaccgggatcatggtcaccggaggcgccaacgccatctccggcgtgcactgctacaacaaggcgaccgggttcggcggcgcgggcatctacctcaaggtgcccgggctgacgcagacgtggatcaccaactgctacatggactacaccggcatcgtcgccgaggaccccgtgctgctccacgtctcgggctccttcttcctcggcgacgccaacgtcgtgctcaaggccgtcaatggcgtggcgaggggggtgcagatcgtcggcaacctgttcaacgggagggggaagggggtggacatcgtggagctcgacggcgagttcgcgacggtggagcaggtgtacgtggcgcagaacgcggcgacggggatgacggtgaggtcgacgacggcgcgcgccgcggcggaggggaacgggagctcgtggacggtggacttctcgccggtgctgctgttcccggaccggatcgggcacgtgcagtactcgctcgccgccggcgacgcgttcccgggccacgctctccggaacgtctccggcaaccgcgtcgtcatcgccaccgacgccgccgtgtccgccaccgtgcacgtgctcgtcgaccagaacagcagctgaagaacaaaaaatcaaaatgctgctgctgcctgccgcgattgcgcgcgagcaaggcgttagattcgtttgttcttgcgattcaccggcaaaattcgtctatatcagagagatggcaaaattggcaatagctatagcttgtatttgattgtttctgaagatgattcagaatggatcacttcgtcagttcatcgtgcttccagtttccataaaatgcctcaagattcactgattcagccaagatttcattttttttctttttcggaaaaaaatggaatcaagagcatgcagggatgatcagaattatgacgacaaggagaacagctggtcattctttcagttacaaactgaattcactgacaagaatgatgcaattgctactatactgtactccgacgtaggagtactgtatccacaagtagtagtacttgtcccatttgttttgctggtcacccgtcagtctcaagtgtaatactctgtactagcaaaaggcaattcattcatgcacacgcttgatcatgcccaatgccccagggacccaaagtactaagcaaaattatgtggagcaataacaacttttaacaggtagctcacctgttttcctggctattatttcgatctgtcggtcggcactggctatttcttgatttcttcttgcgtgattcaactgcaaagacatgtaggtagcttatctgattatctcttctcctaatactatctatgaaaaaaaaatgttgttagcactgatatttcctcagtaaaatgtgagtaattaagcatcagaaacaaactaaatggtccaccaatcttgtttcttcttgttgctattgtctgtttaccatctttaattgatgtgtttcaacattagtaagttgtttcagagcagccaaaaggaaagcgatcactagctgctgaaattttgaggtgaaaggcagctaatcactttcaaaattccaaaatggactctttccttcattcccaattgttgatatgccaaggactttttgagctgttcatggggttagtttacctgctttctcttgtcagacgtcagtgtgtgcctcctctttcttgatcttttcttcagaaaccttccaaatggagtacttaagctgaatttttctgtataaagtagctcaacagtttctcttgacgaatcttgtgcgtttacacaccaataacttctaagttgtagaccaaccaaaggtaagctgcatttgaaaactgaaactcttcaaacgaagaaataattctggaagctgattttgccaaaggtcttcatttttactgagttattcattaggcttttttttcttcttcttgagttataatgttctcaattttgccacttcttgcagagttagccattgggctttttttttttaaaaaaaaaaccccaaatgctacaaaaagttaaaccgatacatgtgccaatttctgtgcttttggcattgtcaggtatagtgtggagaaggtggcaactctatcatgtccttggtcccagaccatatgaattatggcatatggaaatcttgatttcttgggtcactggtccaatatttttctttttctagaatccactaatccaatattatactactagtactaagctatttaaaagtctcttactagagttggttagagttgcacaatttcactgtcaccatgagcttactttaagatttggcaatcctgtacatatgatgcattgtcttttaagtttcactaatcactgtcaaaacacgagaaaaacatggcattattttgctgaaccagtcaaacagttaccattaaaaaaagttaaacagttaaagtagggggagagaaatatggtagtagctcaagaaaaagtcatgaatccgttaatatggttcattctttcgcttatttgtagaataagccaaaatcatatttgcaaacaaaaaataatttgtgaataaaacttttatatacgtgttcttagtgatctaaaagcaaatgctgaaaaataaattacgatgagaaaacccaaaaatcaacaccaaatttaaggtggaaaatttaaattttggctgataaatataagcataaagaaaagatgaggcccgtcctgtggaattcagtgtagaaattcagattattcgactggtgatccacccaagtcgataaacatgcttgtagcatggtgataaatgccttccggtgagaagctaccgaccagggttcaaatcctatatatatatatatttttacataagaaggtataactggcttaccttatagtcatttcattgatagaaatcctaatctcgcataaaaaggggatttgattcacccaaagtccatgaactgtgttgcatttgtgtcctcctttcttggaacaggtccaaagatgtccatttgagatctgcatggcatccgtgattgcgtgaggattagtctgatagggtagttagaacaaaccttgttaaggacctacttgactttgaaccgtattgatagttgttggtgagctaatctgacgaagtgaagcagacagtgatcatttgaggtcaagaactgatacgataagtacaaacaaatcatcaacgaattaagctttttgttaagggaagtaatgcatagtacggtacttgaatgaataaagtttcaaacagcaaaaatcttaactttgggaagcatagatatttgtcattttctgtaccatacaagaaaatttctcgtccttcacctgaaacttgcttgcaacctaactctggtagagccaggatataacaatggtttcttttagataatgggatataacaatgatatgcttcctctcttttccatggaaggtgacattttcttcgcttttcagtagcaaacttcagtggacgcatttttgtgcagatgcagacattcagaatccagtaacaaattgcttgcttttcacaagccaactttaaagccatgtgattgtttcagatggtgacatttagtatagattagagattaatattaaggtgcagtatgtctactaaggttcatagtggttcatatatatatatggttatttcttgcagcagaaaacacacaccaggtcgaaccaaacagcaagccaacatgcttgtgctgtattcagagctccagtacttgtacactgaaccaaaacgcgagtgaatattcgttaagctcaaaggcatcccacatctctctcccttgataattcatggatgccaacagtatttcacagccgaatatactctctcagcaagcagtacaaaaattgccaaacagaggggctgatatatcacaaaatgttcatggcaagttggcattttggcaaccttcattttcataatttaggatattgaaagacctgctaagaatagccattaacttttgagacttaagagactggtagatacattctagaatgcgtagcaaagattctgagacatagttatctaccatgtattgtatctaaaattgttattctagagctacagtgtaccaagattaatagcattatgatttatgtatccaccttctatacatcttccctaagaaagctcactaccaagcagctagccctgaagctcattccatcctatgaacaagtaagcagaccttcaatggcaatgccagcaggatcattgccttcccgctccacggtttccaccaccgcctggtagagatttgcccatgagcacccatcaccagtactcccaaccatgtcccagaacgtcaaattggggcttggtgggcatgaggcgacgacaatgtcagcaatgctgcctactttggctgctggccggggaaagtccagtgccaaattatcgactttgtgctcgtaaatcttcccgttcctgtcgaccttgtatctcgaggtgccactgaagcaaccgtatgattcccacgggacacgcggggttccccacagctcccaccggacaactatcgagttctctgtcagttgccaaatgcgtgatatgtcaagcccgatttcacggaagagtaggcgcccatggaatctgagagcccagaagattgtcttgtagttgtcgattccatggaaagtgttcaacggatcgacgaatgttatatcttcactgcagtgtgatgcaaagagtgtttttagtgcccattttacaagaataactgtagaatatatcaacaaaaataatataaatatgaaactacaagaagtacacttgtcaagtcaacaactagtgttcttcatacatgactagaatcaagaatcatttggttacacaaactgctgtaattgctggtgatatatggactgctacctgtcactgctctctgaaagtgtaaacttatcagttgattcaattctcagtctccatgtttatcagttgattcaattatcaatcttgaatatgacactctcttttaatggaaatcttgacaatgataaattatcattctaccaatcatttcctccgtttctatgttgactgacacatcattttccatgattagccaactagcacaaacactgaaaacttcagcccagttttagtggaagctttcagcttcagttccccatggacatttattcactgacgaactagcaaactaaaaattctcactacagcaacaacgataataataagcaaaagtaacaaactcaaaatctatagcaataacgataatacgaagaaagtaattagcgaagattaatttttaccggtagatgtcgtagttgggttcccggacgaacaccgccggcaggtcgtcccgcagcgtgcgcaccgccgtcccaaggttgaggtaataatccgacctccgcgggtcctccccgccgccgccgccgctccggccgccaccgttcttgctccggctcttgggcgtcgggacggcggcggcctcctgctgcgaggcgccgagcaggagcaggaggttgaggtggctcggtgccacggcctgcgccggctggagcttcccgccgccgggaaggccgagctgcgacttgagcgggctcggcggcgacttgcaggacggcgtggtgagcttggggaggaggaaagccatggcgcgcctttcttgatctttctggctagcctacaagtagcggattccttcgcctacgagctccatgtagtagaagcttccaaattggccattgggatgttcttggggagggagaattgagtggctccgatgggtgcagcgaaggcgaaggcgaaggcgtgtgtgtgggagagagatggggtccgacgtggagccagccagccagccgtcgaggtggagatgatccggggtttcatccttcgttttccttgtccttttgtaacaaagaagaaaaaagaagaagtaatttttgctacattttctagtagatagttttctttttctcctgattacgcgagacacaccactacatatgcagaccgcatacacgcactataccgtaacacatgagcttatcaccgttacatatgcaggccatatagacgagaacacgccacgcatatagaccgcatacacactctggtgaatgtattgtaatatgcgactatacctgtaacacattctaaaataatagatttgagaccgaagttaaattttcacgacctcttttctgtagtaaataattagttgatgtctcaggtcttgctaggaaatacatggagaaatacatggatgaatgtatgctgcatattgcagaaatgaaataaagtggaaatgatatggggtgataattcgatatgcttatatattaagctctagaatgtattaaataataaatgctatgttatatttgtatgtgatttaaaatattttgatagatttgcatgttaaactttaaaaagctagcgggattcaaatatataaagatattccatggtgagcgcacttctatctatcatgctctaggcgttgactagatgtagcatggtcatttgataaagtaccatactctacatcttattaaattttagcagaatatgcacacttgtttttgtttttgagaggatacttaggagggtgtaggtacacatgagttatatacaaagacagcctacgacatggctggcctgtacaaacattacttgtaaacggttgcacatcacaccacaattaaacatcatcacccaaaggcagcatacaacatagtcttctttcgtgtatgctcctcatggaatcaattatcaaacctaaactcttcctctttttttcttaaacgttggaactgtcaaagcaaaagcagttctggtgcaagaacataaaaaggagctttcttgctgtccttgtttccacagcattaaagaataagcacagcacccttaacagccaatgacactaacacacaaacagttcctcttgttttcgaaggttggactaaccatgctacctatttctagcctaaatacctaggagatcttccctacttgcaattcacgggtagataaggttattattgttgtgaattgcagcaatcagactgatttatatccccatcatgtgatccaggcctggctgaggagcagctcccatgcctgcgcctgtcacattaagaagcaattgctggagccagcgccttgttgtaggatcatcctgtggttgtcaaaagttggtgtttcaaacctttcatttagtattaatttatcaagtacaggaataagaaattggtggcagctgatgggttaatatcactcaccctaagacagttattgaacgtgccatccttcagcatgtcagggaggcaagtttgtagtgcagcacatgccctgcatagacgccgcgtagaaaaaaatagcctgttcagaatatttaagtaaaataatttgatagcacacaaatggcagcacagacctggaattgtctgacagcctaaggtaacatcggataatgtgcttcagcaaccttgtggaaggctgctcagcaagtgaaaccaccatgtttgctaaaacactgcctacagcaaagaaacgctcagcagtggcacaaatgtagcgcaatccaacatcatcgaggagaatcttctgaacaatgaaggtggccacctacaaaaatatttgactaaatcagtgaaataataatggttcattaggcctagcttggcaaatgagatttatttctggcctcatttgaactttgagctctcatcaacaaaagaagcttaagttcctcatgagctaccaacttaactatacctgtgtacctgtgtacaaacttaactatacctaccaagtttaaacagttaggtttgggtcataaaaaaatggaattaaaagtggcagcaccatatagttgccaaattgccaacctcctctcaatacatatagcacaatccaccttttaggcttataaaacgaaaggtggcatttgagcttaacaaagggaagcctggttgagaacaagaaaattccaaagatgagcggcagcctgtaataagaagattctaaagatgacaggtggcttacttcacactaacctggacaggctatcattattcatggtagcagaaattttaacctagccaagctacgattcatggtaacaaaaaaaaaaattacacacaaacttcagacagcatcatcacatacttaaagaagaaaaagatgatggtatttagataaacatgagatggttagcgacatacagtttttgacagctcacttcccatttccatggtacgcaaacacagaggaattatttcagtttgcagcagaaaactgataacttcagtatcatcaacctgcgtgtattacatgtgaaagaagctttaat

SEQ ID NO: 38924 - DNA, 12618 bp, Oryza sativa
cccccccaaaaaaaacatggatacttggtagttacagtgctacaggaaccaggcaaaccactaaacagaagtaaatggctggttaccacgaggatcttggaaatcttttgcttacaatttatgcttgctgttctgcctaatacaagaaggatgcattcttataaggcctcatgcctaactactgaataataataacatggctcttcgccaagatggcagaatagaattactgaaatgtgtcaattgtaatatatatcatgttcgtatcactgtttaaacgattaactcatgtaactacatagatgaattaccttaacaagtgcaccgatgacacccaggctggtgagtcgcaggtattcaaaaggtcttgtcttgctggtagtattcaagaatgggtacaggtacaggggaatatgagctgaaaagaacaaaagaaaatgagagagggaaatggaatttttcacagaaacaaaaacaagagctaaaaggttctttagtgtgttattttcttatgaagattaagactttacctcgatttttgttagcacgcttttcaaactaataaactgtgtgtttcgtgcgaaaactttctatatatatgttgctttaaaatatcaaatatatctatctgtcaagtttgtaataattaaaaattaattaatcatgtgctaatagctatcttgttttacgtgctccaactttatcttcatcttcatgagtttcaaacactagtactacacatttaggaattaggatacgtcaaatatagattacaaaagcatgatcatacacgcatatgagagacagagatgcaaaggaccatgaccattaccagttaagaaaaggatcctggtctcagggtgagatgcaacacactgaaattatttttgaaaagcaaaaaagaaagagttaatcagcaaatctatgtcataaatccaacttgggtaactcaaaaggcaatttctactgtaaaatacatcatgaaatgcaagcaaccagaagacaacttttccagcattaccgccctatttcataagattatgtacctgaagaagtgcaagtgcattgcagactcggttcgatgcacctggtgacaatgttgggggtgaaagtgcagagtagattgacacaatttcctgtatgtgttggcaagtatggatgcaccaagtgagtaagattgctgaaatttgagtaagtttggattctaagcaacaagtgctaatttgaacagcatacaatatttgacctcaacagcaaactgatgacttgagagtaggattaaaactataaattatttgtgagtttaatcttcaagcatgcaaattgtaaacatatacgaacaggggaatcatgcagacctgaagaagtgcagcaactgttccaaaagaatgccaaagaagtggggccagatcttgaaatatctctcttttctgaaaagaaaggattgaattttttttgaccaaataaactggcttatcatgttaatgactggaacatgaagtctacaattattttgatcaggaaaattacagaactaattaggtacaaaacaaaaatttctaaattagttactacaaagaacatagggttctaaaattttctttagcaaaacattgctgttgacaatgaagccatctgctctggaatatggtaaatctacaatccaggtctgtgtgtatgagcggtaatctgtataaacactttacagcgtaaaacgccttaaagagttaatggaactctcgaaggctacccataataaactgagtctaattcgctattgtgctacccaataataatggtaatctagcgggaagccgggaagtttcaccgaccacaataattagagatgctaatgttatcttgatcaaaacgtagtgtaatagcccatttcatgatagatgcgcatcaaccatacggtaaccctaacaccaaatcaccattcaccaaccctaaaaaaaccattgcattcacaatgctaaggcgaaaccttcccccacaggcagtgtgaattccacaaattaccaccagtgccccagatagggtaggctatagaaccctagaagaacgcgcgctggaccttcgagagctcgaggagggcgttctcgcgaagctcggggtcgcagaggtcgagcaccagctgctccgccgacgccatcttcatatccttggctggctgccccaccccgccgcccacgccaccgccgccgatcggagaaggcgatggcggcgaggccccggcgaagagggcggaatggaaagcgagggctgcagattcgccattatccccacagcaactgcacaacaccaacgaaaccaccatcaccatttcttcccaaaccacaaaattatccaatcaaaaaacacacaaactcgatcaattccacaaatgtagcaaaataagggattcgactgctcacaggctatacagcacggagcgaactaggacgaaatggaagggatcacccgaattccgcgacggatcaccactctccgctcctctccggcggcgccgcggccgccgtgggctcgccgcgacgggaggagaacgacggcgaagtcggaataatgcgaaactgcagccgaggggagagagatcccctctctcgccccctatggcgccacacggacggccaggatcaaccgatcgccgcgatcggacggtccacattgcaccgtccgcgacgaacgggcgtgatgaagcggaggttgcgtacacgggccgaggacccatgtagatccgtgatggcccggagtttgggccttattgggcttgaggttttgtggcccgtaaagggaggggtgtatctgcatatttgacacccgcggcgctgcgctataaagagtggctcactagggtttacctccgcgccgccgcatcctccttcgcaagcctcgcctccactccccgcgccgccgccgccgccgccgactcgccggtcgtcaccctcgccccgcagccatggctgagcaggtaaggcccggcacctcctgttcttccgtcgagcttctccgtcgcttgctataggagtcagttctaggtgggggcgcgttgccatgtgatgcgcgtgttgcgatgtgagactcgatttctcagttctcgtgatttgggctggaacgctagcgatggaaagttcgtgtgatagtgtcatgaatttgttgaggtcttcttgttagatgtggatttgttgaacggtgggtttgttatatcggtactcgtaattctctcgtgttaaattagcaatagaagttttgggttactggatcgaagttttgctgagatattgttactggatcgaagttttgctgagatgttccaatagattaacgcaaccgtggatgtattcgatgtttgggttcattaccgctgccgtgttcatggtaacgaatgataggtctgtgcttaatattcgtgatgctgcagttgtgtgtttgtcacgttttaacttcttttatggttgatgtggagcttatctgctactgaattagatacagatttgtattcttgtttcccatttgttcaatccaaataagtgatgcaagtggttctagctatgttgtgtagagtgttgatgtttttcatccatttctgttgtgcagactgagaaggctttcctgaagcagccaaaggttttcctcaggtagggttcttctgctctttcaatgctttatgtattctgtgagcagttcacatgtcttaacgatgtttttctgcttcattttagctcaaagaagtctggcaagggtaagaagccaggcaagggtggcaaccgcttctggaagagcattggccttggcttcaagacccccagggaagcaattgaaggtacaataggttatttgcctctttgtttagctgattctgtctaaaagttgtatgctgtacagaagaactttggtgttttcactgtagccactgaatgatttgtagtgcgttaactttaaaattgtcactgaaagaacagttgtttgtcatgcattgacagtatttgttaagttgtttttatacactattgccggtatgtttgactagcaatttaaattcatctgaatattacagacctgagataaatgctactatttgttttaagtattgaacagttgattaactgcaattctttccagggacatacattgacaagaagtgcccattcactggaactgtttctatcagaggcagaatcattgctggaacatgccacagtgccaagatgaacagaactatcattgttcgcaggaactacctccattttgtcaagaaatatcagaggcaagtaaactaccatggattatatacttatgtttcctttccttttctccgttctaacatagggtgcaaacctcccaccttgcaggtatgagaagaggcattccaacattccggctcacgtctccccatgcttccgtgtcaaggaaggtgaccatgtcatcattggccagtgcaggtaaaacttaactcccataccttagtttttgactccttagaatcatcttaaataacagaggtgctattagttcaaacattgtcagttcacccagctagtactatgagatttggttgctgaagtacaatttctgcattttcaacaggccgctgtcgaaaactgtgaggttcaacgtcctgaaggtcatcccagctggatccaccggcggcagcggcggcaagaaggccttcaccgcagcatgagcttgtactcgcattattcatgggtagtttatagacagatccttttgcttgaagtcctggcagggctggtgttttgaccctatcgatttggatattgttcccaacaaaacgaagtcttttcatcagaacgtgtttatggaatctactctatgcaaagttttgttaagatgcctgttaatgctcgatatgctgtgatccttgattttcctggctggctatgtgttcgcttgtttgttgtgtttcttcgaaagagtattggtggatatcctgtgcctgtgcatgactgagattctgaataaggttttcccaaacccaaacctgacctaattcagtttttttgacaaggcttgaatcttataagtttatcaatggacctgacatcttcctatcgcacctaagctttgggaggatgctaatatctggtacaacgtttacatttcacaatcaaacacaactctgaaatgttcgaatatctgaaatgttagcctggtacaccatttacatttcacaatcaaacacaactctgaaatgttcacctttgtccttcagagaattagagttcagatcaacgaaaaatgttcagtctcgtataactgctacagtcttgcactccaagacgatgcgatcgaccacaaattaacgagaaatcactgccatttttttttagcatagacgatccatcaaatgagtaatgcttgaagtttaattcgcacgaagtgcaggttggggtgatgattgttagtggtaaagctgcaagaacaccgctctgagcttcttcccggccggagtttgggccttcttgggccgatatttacggcccatatagagaggggtgtatctgcatcgctagggtttgcctccgcgccgctacctccttcttagcaaagcctcgtctccactcccctcccctcccgcctctccggatcccccgcgcgccgccgccgccgcccgcccgccggtcgatacccctccgcggcagccatggctgagcaggtaaggctcctcctagtcttaccctcgagcttctccgtcgcttgcttagggtcagttctatggtgtccttgttatgtgactcggatcttcttgtcggtgttgctcagtggtattgcgtgatttggcctggaattgtagggagtgaaaactggtttggtagccttgcacatcagtatgttggtcattattgtcgattgtagatttgatttggggttctagcctagtctcatgagtttgttgaggttttcttgttagatatgggagtagttgggcggtgggtttgcatagtaccattctcaactctcacttgatatgttgtgacttgtgagccatgttcatggtagcaaatgccaggtgcagttttgtggttagtgtggagcttatctgttacagagttagatataggtttgttatcttgtttcccatttgttcatgcaaacgagtgatgcaggtggttctagcagattttgtgtagtattgatgttttacatccattcctgttgtgcagactgagaaggcattcctgaagcagccaaaggttttcctcaggtagggttctgctgctccttcaatcaattatgtactattctgtgagcaattcacacgtcttgacaatgtttttctgcttgattttagctcaaagaagtctggcaagggtaagaagccaggtaagggtggcaaccgtttctggaagagcattggccttggcttcaagactcccagggaagcaattgaaggtacaatagagtcttgcttctttgtttagctgttaccagaattccaattcattacattttagattcttgcttactatcttttgtgtgctgtagagaagaattatggtttgttttactgttaccactgaagtgatttgtagtgcattatgaacattaaaaattgtttctgaaagaatcgttgcttgtcatcagttgacagtatttcttaaattcttttgatacactgttgctggtatgtttgactagtaatttaaatgcagctgaataatgctatttcttttatgctaattctttcaagtactgagcagttgattaattacaattccttgcagggacatacattgataagaagtgcccattcactggaactgtttctatcagaggcagaatcattgctggaacatgccatagtgctaagatgaacaggactatcattgttcgcaggaactacctccactttgtgaagaaatatcagaggcaagtaaacaattatggattctacttatgtttcttttccttttttttccccatttctgacttgggttgcaggtatgagaagaggcattccaacattccggctcacgtctccccatgcttccgtgtcaaggaaggtgaccatgtcatcattggccagtgcaggtaaaacttaactcccataccttagtttttgactccttagaatcatcttaaataacagaggtgctattagttcaaacattgtcagttcacccagctagtactatgagatttggttgctgaagtacaatttctgcattttcaacaggccgctgtcgaaaactgtgaggttcaacgtcctgaaggtcatcccagctggatccaccggcggcagcggtggcaagaaggcctttaccgcagcctgagcttgtactctcatattcatgggtagtttataggcagatccttttgcttgaagtcctggcagggcgtggtgttttgaccctttcgatttggatattgttctcaactaaacgaagtcttgtcatctgaacatgttttatggaatctactctatgcaaagttttgttaagatgcctgttttgctcgatatgctgtgatcccatggccgtgtgactcgagaatacttgcttgttcagcgtttgcatgactgagattctgaatagggttctctataacctgagcaaaatcaggtgttcaatgacaaggggaccagcttgagaagtttatcagtggacctgacatcttcctgtcgcacctaatctttgcaaggaaataagatactcccttagagcaggtacaatagcaggctataaatcagctgcaaacatattttaagcagataaatgaggagacagaagggcagcgggctacagatttgtagccagctgtagcatggactccaagacgcagcgtgtgtatgacaggtgggaccagatattaatagtgtagtatgtaactattctatgaatgagctaatggattagctatagatgaattggagctagtagtgggctatactattaaacttgctcttagtagttccagaatatagcaatcatgcatgctattatcctagtatttggacgtgtctaatctggttttaggttactatattttactaggatagaggaagtatgaacttgcgaatgttgacctgctaggctgctactcccccttatcaaaatataagcatttcaccatgagatcaccattactctcaggataaaaaaaactgagattaccatttcaccatgaaaaacacagctctgaaaattcgtcaccttttcagtaagagttcagacatgcaattctcgtatgatcgcttccctccactcctggcaccgatccaagacgagaaatcactgccattttaatttgcatagcgtgatgatccatagtcaaatgccaaatgcttttccagtttgattcgcgcgatgtgcaggttgttgtgatgattagttgggtgttggtatagcggctaattaagctgcaagaacaccgcactgagcttctttcctgccggagctcccggtatcctgctggttccctgaatattcagagagttggacagttcaaatgcatgtttctctgaaatgaaatcatgggcattcaaagatctatattgttttgaagggggaaaaaacatctacagattacatgggagcaacacaggactacaggagaaaccaaaatggcactgccacacaaatgtttttgtgtgaaaatcaagatggccttagaattttgggggctacattacaatactcacagatgacacaacataaaacaacccggccaatatctgaggagctcactgaactgtacagcatccattcatcccatgacatagggaaaatggaaaccctgtgatcttttttttttttctgtttgagatgaaatcctgcaatcctttctctgccactgttccacaaatttgaagttacagagctgtttgtgtcacaggtcacctagaaggaaatctcactcggcgcatggaatgtccgtccgcggcaaatggcttccaagttttctccagcataggagctaagtggagaaacttccacacctacaagcaaaatcaatcatgacaatattagtaaaagaaaatatcatttttccttgttttttgttcttggcaagtttctgaatgtattggacaggagaaaatttacctgtcatgtacaatgggacagaatgggtcaagaagccaccagcagcaactacccatctactatggagacgaagcagcatcagctttgcgctatcaggggtatcataagacgcgccattcgcattctttacaggcgcaaattcctcctcccgcaaaacctgaattttcagatatgtataccgatgagtttctcaaaatcataacaaaaagacacagcatgacatctagaatgttataagagcataggcgactgagaagttgaacctcaaaaagtgctgtggatggggagtaactgaacgcgtcgaatatatactgttcaagcttcaagcccattgcgtacccatggatggaagggatcttcttctcagcaagatgataactggacacaaaagttttgtaaatttcatgtgctacaaatacaatagaatgaatgatggagcttgcagttttaaacatggctctcactttcttaggaagagtaagaggggcataacgagaaaatagataactactgtaatttgcaaagaaagtaaacacaatgaattcctactgcttcagacttaaaacagttatagaagcactcacgtactgtccttctcaaggctgtttgctacttgattcaaaaaatccaaagtgaacatatgcaagcaaatctgcagtgagataagaacatgcggttgttatacacctcaagagaaagtgcaaccaggagggattgagaaacaaaggatagaacatacattgctccaacaataacgaaggcgtcccgttgactgattaatttcagtagccatagctgcgtccatttcactatactcaactacagagagaggtccaccacgtcctcgtcgaacaaatactccaacattctcttgtgggtaagcctgttcagcatattatttactatcaacatggtgcatattggattaatgatatgaagcatgagaagtatttgactgtaccttcctaacaacctttgcagcagaagatacagctttgtctatgaagtaacctaggaacgtcggatcagcaacgcggacctgcatacataatattgataagcgaatgaggagaaaacgcagaaggttatatggattatcctatggggaagttaatgtcctcaccagtgcattgtcaaccccgtagcaatctacatactttacaccccgtgaagacatatcttccagcaaccttctggacttgagggctgtaggatgttgcagtagtgaaaaccaggcatcagaaatgaccatgcaacactacaactagaaatacaatacatctttttgggagattaccagcataaactccaccattgccatcaggagcctttgctacctggtttcgaacagagcatgtgaaaaaaaaaaagaatgccatcatttaacattttaaataggcagcatcaaaacaatatttgtaggtatcacaattgcacttgaattgtgagatctcagaccatgtgtcaaactcgaaaatcaagttgttacaaaccgcagtatcacctcctagtaatacaagatcaatcagtggaagattagaaaaataatagaagatggtaccttgtatggtgtctccataataaatctgccatcagcagaaacacatggaagggtgccttgttggaaaaatgtcacctgccaagaaaatgttcagctgttcaaacctacctattaaacattactagtgaatgggggatcctgttggatcttttgttgaaattccattggaatagttaacacaaatgaaaaaaaaaagtacttgatcttacttggtctgcctctaagccaaagtatttacggctttcgaagaatttgcgagtgatgtcatcggtgaaggggctggtcattatataccaatgaataggtacggtgttatttggacctgcaagttatttcaaatttcagggtaaagatgtgaaacgaaattaaaaaagagagtaaaattgtggttaaaagacattactatcacttgattgagcagcaagcttttgaacacacaaaatccgttcagcttggagttggaaaagcgactttccagacggaagtccgatacctaaagggcagaaataagaggttaaaaataagccatgatatatacatagacagagttggaccaagaattatcgaaaagagcaactgagcaattccacactaatatggatggatagagataaactagaatatgtcatttcctttgattaaatggcattaaggtgatgtagactacatttatcattattattacactctaaaataaacaatctgagagctatgaacaaaaaagattgtgtaaaacagaaataattcagagcacctcacttctttttttggctcaacaaatatccatacatttgtgcgtacaaactcaagtactaatatacaaagattgaagtggaatcaacttactgaaacatcctttaggatcagagctaccaagccgagtcccctgcacatacatgaaaagaaattaaaccataaggaggctgcttctcaatgcacaaactatagaaattgcaaattcaggtaatctttccatcagagcacctgaccaccggctaaaaggacgacggctagcttcccctccgaaatggccttcagccccttcttccaccaccgttctttgtcctccggcaacctctcctccaccttggacacgctggactccggcaccggctcgacggtgggcaaagtgaatcctgcacttagaaagagcataatcacaccataaaactaaggcaattactgataaagtgttctcggtacagttctatcatcttgatgtaattgactgagttcatcaaaagcttccattatctataaataaactaaggcaagtgcgatgataaaaaaatacaattaactaatgttctacattggaaagataattgttctttcccttcaactgagagacctctcaccttgtgatccaagggagcgccggatgatccgatcaatccttgaaagatccaggctctgaaaaaaaaatgcagtatatgtagctccattggtcactgtcgaaatggtaagctcaaatgacaataaaatcatgctgcaggtttctcttgagctattgtacagtgtaagcaatgcagattaagacctatggagagcagataaataattggtcacactggcaacaaagctgtgaaagcgtgaagtaaattatcactcaaaatccaaactccttttccccacaaaccgcagtaaaaaatttcaactgataaatcaactcctgcagaattcacacttagaccaaaaaaccacattcaaagaccagagcttacaggcagaattccggccaaaaaaggggaaaaaaaatcaaacttcttatgcagagttcgtccctgacaaacagaaacggacagagagctcccgacagaaaacacaatcccaacgaaagaatcaaacattcgacgcgaaattccggcgcaaaaccgaatctctctctctctctctctctctctctctctctctctctctctctctctctctctctctctctctctctctctctctctctctctctctctctctcccaaccctcgcagccgc

SEQ ID NO: 38925 - DNA, 5597 bp, Oryza sativa
tcctgcagcccagaagctcatgtaactccaaaccaaaaggaccaataaccaattactaactaactaactagtatcataatcactaactaattaccaagtaagtaagtagtaattactaacttgccaggtcagcatctttagttcttttcacagcttcagaaaggcacaaacaaaccaaaggcttatatcagccagaagcagcagcagtagccagcagccagcagccagcagccagcaaagaaagaagccaagaagcgccaaaggaggaagaagactcctctctcttctcctcccttggctgcaattgcaatactgcaatacagcaaatccatatccagagaagcggttgaattccaggagccgtgtttgcgcagagaacgcatgctgcttctggaatcgtttcctgcctacttttcttctcctcccgtttggctgggcgccgctgctctctccgcctcagctcctcctcctcctcctcgtcgctctcttccctgtcgcggctgttgcgttttgccagttagagcccgactgcgtcggagccgtggcggggattgttgttgccggtgccaaaaatctgatcttggcgaaggttttggggtggaaagattgggttttctttggctgggattttcatggttataggaacctgtggcagacaggatttggagttctgagtttgaagtacttttgatgtgattcttggcgcttcggagatccatttttgtgggtttgttgcgaggctctgaagtttttcgctatcaaaggtgtggaagcagtttatttttccagtacagaaggactgttagtactgtggagatttcgttgggagctcaagtgtttgtctgattagctaaagctccaatcgttttgttgattgaagaattgaaggtggaggtgttcttgtggacactgagtccgaattttgtgtgtgagatcacctgaatttgttggaggccgaatgcttattgctaggataaatctacattttggtttctgcaaagactgaagtggacttgcttgctggggagtgtgcttggtacgaggatttgaggaggagctgtagctgaggtgaaaagagatcgatggcgtcgctgtcagagagcgaggggacaaatagggggagcatgtgggagctggatcagaaccttgatcagcccatggatgaggaggcaagcaggctgaagaatatgtacagagaaaaggtctgagatttctttctcttcagttattagcgtatgaaagtcgatttgttttgcacaaatgagggctttcagaatagctgaagtagatgtaaagatcggtctctgcatgtgactaattcatttcattggcagattcactactaacttttttagataatgaatttgctgcttagatggatggtactgcacgaatatttagtttgccatttgtagggcatgaaaaaactggatgtttatactgttctaattgaagtaactgagctggtaaatcagtaatttgtattgactgtttttccttaatacagaagttttcgtcgcttttgctactgcggcttgcatttcagagcctgggggtggtctttggtgacttgggtacatcaccattgtatgtgttctataatgcctttcctcatggagtagacgatgaagaggatgttattggtgctctttccttgatcatttacacccttaccctcattcctcttctgaagtatgtttttgttgtcttgcgggcaaatgacaatggtcaaggttagataattgatcttcctacaatctaagtagcatataacattgtagcctgaaaccatttgactgttctcgatattgcaaacaaatgttgcttgcgcaattctgcttattattcacttgataacttgttacatattttcagagaagaccacttacagattgttatcctcacaggtggcacatttgctctttattccctgctatgccgtcatgcaaagattagcactatacccaaccaacacaagactgatgaggacctgacgacatatagtcggcaaacatacgaggagaattcagtaggagcaaaaattaaaagatggctagaagcgcatgcatataaaagaaattgtcttcttattgttgttctcattggtacttgtacagctattggagatggaatccttacccctgctatatcaggtacacatcttaatttctttttaatcaatactcagcatcatattcttctgagaaaatccaatgcatcttgaatctgatttatgatcttttttgtgttccagttctttctgcatcaggtggaataaaagttcaaaatccgaatatgagtactggtaatgctgtgtgccctttatagtctatcaaattcttggatattgtaaattctgtatatactgagtaaaatcatgttcttccttgatggaagtaagtcagtgacatttatatctgtttctatgcattattattgtcccaaatgcatgatccttcacgatcttaacaaggattccaaaatcccaatctaataatcattattttcttttgcattgattgatgttgcaaacttgtttgatctttggtctaccctgtattggcagatgttgttgtaattgtttccgtgatcatcttaattggattatttagcatgcaacactatggtacagacaaagttggatggctctttgcacctatagtgctcctctggttcattctaattggaagtgtcggagcactgaacatacacaaatataaaggctctgtgctaaaagcatacaatccagtctatatataccggtatttccagcgacgaaattctgatagctgggcctctcttggaggaatcatgctaagcatcacaggtgaggccctttcttcagtaatagagtttacctgcatcagcttatgtaaaacccattgtaacatgcaatacaatgttgtcctcttaaggaactgaagcactatttgctgatctatgccattttcctgtatttgccattcaggtaacatattttaagcaaggcattaccggatctttatgcaattgcgggttaactaaagtaaacatgtctattttttcagattgcattcaccttgattgtattcccatgccttctactggcatacacagggcaggctgcttatatcattgcccacaaggaccatgttgctgatgctttttatcgctccattccaggttctctcatctcaacagcttttcatctacctttttgtggaatagttcatccatgctttccacttgtctaagttgtcttgtgacagaatgtgaatgtgccaccacatcatgtctgctaggtgcacattggcatagtgcacaacccaatattgatagcttgtattgcttatggccctatttgtaatatggtgctcactgtgagatgtgtttaatgattgcagattccatatactggccagcatttgtcatagcaactgcagcagcaatagttgcaagccaggccaccatatctgcgacttactcgataataaagcaagctcttgcactaggctgctttccccgtgtaaagatagtgcacacctcgaagaaattccttgggcagatctacatccctgacatcaattgggtccttctaattctttgcattgctgtgactgctggattcaagaaccaaagtcagataggaaatgcatatggtaacatttcaccttttatataatatttttgaataatttggcatgccatggagctgccattttagcatcccaatgcaacatttatatgcaaaaacattttaatacactttgtgctaatcagtagtactttcataaaaccatttatatttcattttgactctggccatgattggtggttacctgacattcacatacaaatccctgatgatgtagtacaaaaactataaattccaaatttccatcattgtagatatcgtgccaaatttggataaataaatagaccatttaaaccaatacgactgcttctagtgacaccaatttttttttcctgaaaatgagaggctgatactgatttttcatgatataatatgcattgcatcattagtcaactcttgatttccattttatgatgtatgaacaggaactgcggtggttatagttatgctagtcacaacatttctgatggtaccaataatgttgctggtgtggaagagtcactggattctagttgtcacctttattgtgctttcgttgatggtggaaatcccctacttctcggcctgcttattgaagattgatcaaggtggttgggtcccacttgtcattgccacagccttcttcatcatcatgtatgtgtggcatttttgcacagtgaagcggtatgaatttgagatgcacagcaaggtctcaatggcctggatccttggcctcggtccgagcctcggtctggtcagggttccaggtataggctttgtgtacactgaactggcaagcggtgtcccgcacatcttctcccacttcatcaccaacctccctgcaatccactcggttgtcgtcttcgtctgtgtgaagtaccttccagtgtacaccgtcccgatggatgagcggttcctcgtgaggaggatcgggccaaagaacttccacattttccgctgtgttgcgaggtacgggtacaaagacctccacaagaaagatgaggactttgagaagatgctcttcaactgcctcttgtccttcctgcgactcgagagcatgatggagggctattccgattctgatgacttcagtgtgccggagcagaggacggagggatccatcagcaatgcatttctggctgagaaaaccaacaacaacacaatgtgctccaatggtgacctgagctactcatcacaggactccattgtgccagtgcagtcacctctgagggggaacagcctactgaggtattcaagccaggccagccacactgtcagtgatgaactggagttcctgaaccggtgtaaggatgccggtgtcgtccacatcctcgggaacaccatcgtcctcgcgaggagggattcggggatcatcaagaagatcgcggtaaattacatgtatgccttcatgaggaagatctgcagggagaacagtgtgatcttcaatgttccccatgagagcttgcttaatgttggccaaatatattatatatgaaacgcattttccggcttaatttgtgtaggagtagggctccatggaagagggagggaggcagctgtacatgttttttagggagaagcaactgtaaattattaataaacagtcatttttcatggggggtgtaattagtgagttgtaaatgcatatgacaaatgaatggatcagatcgaagcatgagagagatctgaaggctactattttctagatgatatgactcaatacatgttaagtttttggtgccaactatatagaatattaaaaaaaaaggtaaaataccgaagtcattccaaacattatttaagaagaaaatataagtatgttgggaatttaacatgggaccttaagtttgaaaccacacaaccttatcactgcactattaagtgcatctcttccatcatctattcatctatacaggaaaaaaaaccaaacaaacaggtgatttctttgcggaataagttcaccgaaggtctctcaacttaacag

SEQ ID NO: 38926 - DNA, 8797 bp, Oryza sativa
  unsure (1)..(8797): unsure at all n locations
cggcgcgaagcgggcgcgctggtccatccaccaggcggcgcggagagggggacagaggcggccggcgctaccgctcgctccggcgagagatagggcggcgcggtcggcgctaccgctcgctccggaggcgacgctctcgggttctctagctcccgcctgccgcgctcgcctaccgccgcccgccgctgctcgcctaccacgcgaacccgccgccacgctcgcccgctgcccgcccatcgctgctccacccgcgcggccgcgctcgcctgccgtcgcccgccgccgctcggctgcctcgcccgccggccacgctcggctgccgcgcggacccaccgccgtgctcgcctgccgccgctcgccgctgctcgctcgcccgccggtctcactcgaagaagaagagagagagaagagagaaaagagaagaggaggagtaaagaaaagataagaaaatgtgacactgacatgtgggccctacatactttttttttttttactagagtgccacgtcagcgaaaccacccatatatactgtctagggaccttgagtgaacagttttgtataatttaggggtggagatttctggttttgtggttaagagaccttaaaaaatctcgctgttaagttgagggaccttcagtgaacttattcctttctttgcatgcatatgaattcaaaaaccaaaaaatttctccgtagcaagaacgagtgaactagcaccgttcgaatgtggaaggcgtaagaagcgtagccgcgtcccgcgtactcctcagaccggcgacggcggcgcgacggccggaatcgcctcgctgggcgacgagcgggccgggcccatataaaaatttggcctaaacggcggttcggcttatgcgcggcccatttctgtatgggcctgaacaaaggccgcggctcctgcgtgctcgacgctgacatcatcgacggcgccgacgcggcttcccttcttctctcgccgctacgtgctgctgctgctgcggcggcggcggcggcgcgcgctcgctcatgacgttcgccgcgccgagctgtactacaaggtataccgggctcgccacgacggcgaccagcaaggccggagacggcgagagccccccatggcgcggtaaactgtcagaagtggagaattcagagaagaaagcagaagaagttcagagaaaaatgttcagaggattcagagaagaagagtagagttcggaatagagggataccgcttcgctgtcctctgaacttcttctgttttcttctctgaattctccacttctgacacaaacatgatggcatgatggcattccactcaatggcggatcggcgttaggcatgcacttcaagttcaagcccttgagcaaggtttgtttttttaccactctatcagttcgaaaacgtagtagtatattttggagcagtacagatgtgcatcacatgtcagtttctagcaacaagctatagctagcacacctgtaaaaatagttttaataaagttattagtacacctcaaacttgaaaacaaaatactacctttgtcccataataattgtatttcttaaatttaaatttatcctaaaataattgtcacaatagagtaataatgatttcattaatcacttctcattcaaaattcttcctattttgccctcaactacccttcacttttacctataaaccatttaataaggggtattatcatagtagctagaaactggagataggatttttgtgttctaaacgaggtggtgagctattagcctattaacgtataattaattaattattaattattttgtacttggaaaatagattaatataattttttaaagcaacttttctataatatttttaaaaaataaacatcctaaaatgtggtggcaaattttagcctttacatggttgtaagtagagagataaaaagacttgtctcctcgggtaggtgaggtgcacgcccagatgagttgaggtcaccaaggattagtaagggcggtacacatagacatagttttctgctaaaaaacattttttacaccaatacttagattattatattttgaaataaaaactctagaagttagtctctgttttaaaatataagagattttagttgaatataacatagctacgaatctagacaggaaggtggacatataagattcgtaattctaggatttatctcgttcaaccaaaattctttatattttgagatagagggagtattatatttagggatgacgaaagcaagaagcatcgtgagtatcatcctgattgcgaggttttctataacagcaagaaattcacgaaatcacgagagggaacggaggcaattctgttcataaacaaaatatttgattgtacggttttcttatctcttgcaaaagttgcaatgactggaacagtttgggctttggggtttggcaccacctaccaacaacgtgcgatccatcgttttccacgtcgaacacgtggcacaggaagaacagggggtccagcactccagtgtccacatctgcaaatttctcctctctgatgatcatcatcaagtgatcagccatatcactatgcagcacagatacagagagaactggattcccctgtgcaatcttactcatgctatcatgcatacactaatctattcatcccagtgattgctctacttttgattgcttaatcagagcatctcattcgtctggattagtgctttgatctgcttgcttgcttgtttattctggctgtctacctctgccccatgacctgactgaacttgccttgcctctgcttttgcttgcttgctcatgaaagaaagcaggtgtgattttgtgagagaattcttcttgccaataattgatggcaagaagaatggagtgtgagtgtggtctgattttttcttgcagaatcatcaagggctatctgctatctcatcttgtatgacaaagattgattgcagctgacctggaattggcaggatatcagttgagagtgaaagtgaatgctactgctagcagtagcagtgatgcagcaaagctgccacaagccgaaggcacgttgacttaaaagaagcccttaaaaatcaccaccaaaaagaaggcaaaaagaaaaagaaaaaggagtagtagcacgattcgacaccggaaaaagaccccaaattttgcataaatctcgggtcattttgcctaattaacccaggcaataataaacatctcaccaattctgtactggcgtagtaccacactgtactgtactgtgtacaagcaaggagagagaaaaaggaatcagacattaggagagagagagaggaaaaaaaaggcagaagaaaacagatgcctttctctcctctttatccaacgctgctgctgctgctgctgcgactgtcgcggccatggcgtccaccattcatcatcaacccgggggggttgccaatcaaatttattactcctacaaggacaccgtcacagtccacacatgagtgagtagtagtggcagcaatcgcaatagcaatagcatcacgttcacaggaaggagattgctagtagtagtagtagcggaggagacgcaacgagacaagcaaagaaagagatagagatagaagactctgtgtagtgtagtgtgagagagagtgagagagagagagaaagaaaaagctctccctagtccctagtgcgtggaggagtagaggtagagcaaaccactgaaccacatcgccttctttctactggtttctaccgtgttcttgctgctgctgctgttcttcgtgagcctcctcgacgacctcgatctgcttgtttcttcccggctccatggcggcagcggccgggccgtagtggtgagttcttgctcggcttcttgcctattactaacgacgactactttttcttgtgcggttggttcaattgatcctgagctctaatcagtttgagttggttattggtggataatagtttgttctagctgaaattttttacgattaacggggagttctgtgggtttcttggaggtttagttgcatgttcgtggtgaatcaacagtaactgctgctagcatggagcttgatatgcttcttgcttttggatctattctgcaaaagtagcttttttttgtgactgtaatatgtgatcgagttcagtgaattgggtaagttattacctcaagactattttttttctacttgaattttttggttttctacgcttcatgatagcgtgatttcattttaaaaggttggagggatgaggaaaaaacctttttttgtgggaaaatgaaagagttcaatactagtaatttcataaatagttgctaggtctttacactgttaaaaggtttgtgggttaaattcgttcttttgagtgattctaaccctataagcttgttcttgctctatgaaactcggtagctgacctcaagcaagttttttttaattgaaatggaataattagtcatatctaagttttgctttgacaaaaaatataaataaaagctcgtcctaggattatgtgtaccgtatacccgcaaagctctaagttttgcccatcttagtagctggagtaattgagattggataagtttccctggattattttgagcccacttgtttgtttgaaccacgagtccacgatgtacatattatgtaatgactctctgtagtgcaccggcaaccttatgcctctgggtttctctgcagaagacttgaggcattgtatttcaataaagtcccccaatcttaatgaaattaggtcacccaatcttttgtccgacccggcaatgtatttcaacgaagtacagctcgattgcttccatttttccttcaataaactccacctttttcacatattagaataaacttcacaagaacgcatacttatagtcagttacaaaaacatatgtactgtatatttaatatctatatgacttaggaagttccatataaacaggattttgtggatttcattatcaaaacgggaaatagactatggattccaacgagggctctcatcgtataacacgaagtgggattgttagggcaaaacctgctgtcacggtatggaaggttttgaccttttttgtttaaatgtctttccattttagttcatttctgtaacaatttatttttgacaactttgtttacttcctactgctttcttactccttaggccgatggtaagattgagcctgctggggaggggttacctcatggatggttgaaagannnnnnnnnnnnnnnnnnnnnnnctgggtctagagtcaagggtgatacggtaagtgtagttccttttgattaaatcatgaaaataccaaacttgatcctttttttaatacgttatgtttcaaaattagtcatgcacatttttggtgtccttctgaactctgatgtctcttccacaagcaagccaaggataatccttgaaagaacaagtggctgctaatgattagatgcaaagcaaccccttgacttctcatctgcattagaatttatgcagtttcatttagtggagtctagaccacttacctttctttcccagaagcaatttatcaaatactctgatgatatatagttggattgcattgctgtttgccagctgtcaacatccgcaatgtgatggagcaagttaatgaacaacctttctgcaacacaattctaatatcaggacatgttcgagtaaatttctgtggaaccaaggacttttctttagctcttttcaattaactaaacatagcagtattttctgtgatactccgtgtgtcttctgtttggttaacaactgcctacgttacagtattatggagaaattactcgttagtgaatctttttcctttgtttatgcaaacatttagcataagaatgtgaagagttaatgcatggtaatgatcaacttgcagttcaccaatgttttctgcaataaaaataattagtcagttttgcacagaatatttttgttcaaccttgaaattatgacagtatgaatatgaagaatgagagctgctaacttcacaccttggttttagcctcacactaaaataattttggcgtgttctaacaagttagtagtgaatgtattctgttgataacaaattgattacaacttttcttgagttgttttcttacaataccttttaagctctcgttttatgccataagatggtctacttgaacctattatttgcttgacatcattttgtttactttatgttttaaccttttgttctgtagttttaactggtatgtccatcttatcactgcagttctatattgatccaaccaatatgtatgaatttcgttctcaaaaggatgttcaacggtatcttgaatctggagatgttactaattgtgtaatgatacaaaataagaggaaaatggaagacctgcacactgcaagaaaccaatctcatcatgtatgctccttttctattctagtggtatatctaatttgtaatatgtctatatgtttacaaaaaatctagtgccaggctgccagctacattattcaagagagagagtttttcagtagtactaagtccatgtatgaatctaaatataaacagtgttgttccttataaacagtgaaaataactatatttcactaaaactttgaagtataaaagagaataatactaaatcattctgtcaactataatgctaaatcaacaccatgtgatttctgctgtattaatgtattgtacgtgagtgaattggatgggtttttgcttgttacatttgttttccttgtttctttttctgtttgattactgtccccatcttataatcattgtttcattaaattcagacacgaagaccatctgatcacagacaacttgatgctggtgaaggggctactcaatgtgatctaccaatagcaagaggtaatagtgcacggagtgattttttggtaaatgcaaacagttcagacaattctgaagatatgtcatcatcagtgcccaagggtgtgtccgaagggaaacttacacggttaaagcttcagaaggcaagggttccgaatcaatccgtggagcatgaatcttccacaggagaagtagcaaatatggagcataagcccaaggaaaagaaacagaaaactaaacctgtcaaacagatctctacacctcttcgagcgtcacctcgtttagctgcgctgaagattaaccaagaaggcaataatgagcccaaagatgaagctctcagcacaaacacagacactgctaatcagtcacaaccaaagttgaccaaaagtcctaaagcaaaggctaattcctctgtacttcctgagaagagtgatggagcacatacttcaaatgcttctgaaattcctcaaaacaagtatccatcagctaccgagcaaatgcaaggatcatctgttcatcctcaacaggctggaacagctgatgctatgcctgggtccgccctttcatcgttattgcgaagtatctgtcagatccatgcctcaagtttgcgatcaagactcttgcaggtgacatccctgctctagacttcattccatcacaggacatgaacaaagggacgacaccgaattgttcctcttctgcttatgatggtagtagaaaccatgcgcaagtcgaccatgtcggcatgccaatgccaaggccatcagataagttctacggcagtggctggtttcctccccagtgagttccatctggggaatatgtggcaaatcttctcacctgcaaaagcaaatcagaagaaagccaaagactaaccagcctcacaggcttcttagaactcctcattaggtaccttgacaaggatgcatgttgcaagaaagactgtatcttgttggaactgtagtagatggttcgtcactaataagtaataataacctaataatatacccccatcttatgctaaactggacactattttctgtctgtctgaatttgtgtagtaacctgactactaattcatttgtttgtatcattagtgcagactagagatgctgattgtatgcagatgcctgtgccagattgtcatgctcagggtcactgctctgccagcacaaagacccttcatgtgtattactactacatgtaataatagcttagacatttgatatggcaatgtgcattggactaagttctacctaaattttgtttctggtttacctgtcctgagtttcttgtttgatggagttgcaaatgttgttcctgtgcacacactgtgttgattcttcggacttttttggaatgcaggaattctacagaattttcacaggaaacagttcagttcccgcataattcctccgttccaaagaaggccttcaagtactcaaatgttgttcctgtgcacatattttgtcgattcttcgcacacctttggaacatatgaattttagaggattttcgcaataaatagtttcaattcctgcgaaattctttcgttccaaagaaagcctttaaagtactcaaatgttcctgtgcacatactgtgttgattatacggacatctttggaacagatgaattttacaggattttcaccggaaacagtttagttcctgggaaattcctccatttcaaagaaggccaaattctagtactcgaatatatggctggcatttttgtgtctgctctcattttggtttctccatactttggttgggcactaaattgttgataccaacaccagttgttgggagatgcattggatgccatggaagtacagatcattggtcttatctgtgcttttgtggagttgtggtccttgacaaaccatgtccagaacaatgatcagacagcaaaaggatttgcccttctgagaggcccacccactagctgtaacactgcaagtcaa

SEQ ID NO: 38927 - DNA, 1440 bp, Oryza sativa
tagatagaaattactctatgattgctggtttactaactgaagttgcagcttccattatgggctaaagatgcttcctgatacaatatgatcccaatatccccatgctatctcatgataagatgcaacttttaacagaataatgccctaatccacatctctaagctaccttaagctcaccagcaggcatattctctgggcatgtccagtggagactttcttgctaatcaactaggcattatttgttacttctggttcagatgtcaattttttcatggtacatttttttcttactctttgcgtattttgtactagctatacagttcttctacggctttctggtacaccgacaacgaagttttcttgacttcttttaggggaaagaagaaaattttcttgcttgggaagaacagtgctgttctacagtgcagaataggccccaattcacagcagaaaaccaaacaaggcaatgtactgatcaacagtagcaaagatccaagaaaagcggacgttgactcttgtcaaaagttgtgaaaagctggctaatattaatcctattaatttgtacaaaattctgttagattatacttatacttatttgtaaagcttattagtaactaaaaaaattcatacataattttcttatatacatgtacttagcaattcaaaagcaaatattgtaaaataaacaaagataaagaaaacaacaaaatcaacttagaataaagttttaaaatttaaattttggctataactataatcataagtaaaacgatggggcaacatttcacttgaagctaatcttcagatcaagattttacatgcaggtaatcttcagattcagacaaaaaatcagtcctggcctgaaaagcctccaatcgaaattattcatgcccattactcattattcttccaatttggtcctataaatacctaagctccaaagaatatttggtgttagttattaattaaaaatgtcatctagttcagaggtcaggtttgttgcaactatatgtttagctttcatgacagcgacttgagacctattgggtacagtatggtgagtcagtgcagcactggcttacaccacaatgcaaagcttaggtagctaaagctgggcataacagcaaaagaaaacctctttaaattaattagctccgataatggcgaccaaaatcggtgttttgtggcccatgattaacgaaatgatggaggttggagaccgacgggaaagcttctttggaatcgtttttactttaatttcagaacctgtggtttgggtgggggcagcagaaagtctttaatactactccatccgtcccataatataatagattttaagtttttacttgtaatatttgatcactcgtcttattaaaaaaaattgtgcaaatataaaaaacgaaaagttgtgcttaaagtacattggataggggtgcagga

SEQ ID NO: 38928 - DNA, 1688 bp, Oryza sativa
tttataaacttatttaaacttagatacgcttgactagaaaaaaaagtaatatgaaatggagaaaatatttattagagaagtaattcccacgttacaagcaagacttttttctctctctttctggctttctccatgtgacatttaccatggataataaatacagaatggctatgaatcaagttttgcttctgttttcttcaagggattatattccaaggagcatgtatgctttgcgtgcctgcagagcaaatgtgtcaaagccccgagaagcaccacaacttctctttctccagcctgaccaccaatgtcggctgatccatatccatcatatccaatctgcgagtatactacattactactccctccatcccatttgaaaagacagtcatgatttttcatgtacacatttaaccgtccattttatttaaaaagtttttttaaaaaagttaaaaaaacataagatacgtaaaaagtattattcatattttatcatctcataataataaaagtattaatttaaaaaaattaaataagtcgacgattaaagttgggcacgaaaatttattcttgcatttaaaatggaacgagggagaagtagactagtagtagcagagtaatgtaaacatgcatatgcatggttgcatggttggttgttggtgccttgtactgcctgccggtgtgaggtttgcatctgccatccggtgacagaaaactcctttctatcggcattgccctcctgccagtttgattcatcttcttcccaagcgacatatcaccaaactattggttcatcatgcatggttggtgatgcacacctgatcacaagcctgtttcttgctgcatccaaccaacattgatagatacggtgtacatgttcttcttctatccactaacagatttcttttttaaaaaataacccattatatatattgtctaatatatttacttttttggtgcccgtttatcgtttctgaattctgcatgacagttgggtgtccgccatcactatcatcttttatattagtatagatgattttcgattatctacctatatctttttatgtttgttcatggtttcacatcaagaattcaggattgatttggtcttgactcttgagtaagaggcaagcaactctgaagtatgcagtagaatgcatcattcagcaatgcagtgacaaaaggagactgtaaaagctcctgcgtggctagtggatgaatggatgtatcaaccagtaggaagaaaaagatgaaagcagctttcctttgggtagaagaacagaacctgacttggattgcaagcctttcatccagcatatatgcagtgcagattggtgtcggtgatcggttcctgcatgataatctgccgactgaagcttcatctgatgatctgcatgccaaccggtttctgaaaacatgatctgctctctccgttccagaatataaatatttttgttatgtatataaagtcggtgattgattcttacatgatctatcaaccgatgttcatccgcatgccgatcaatttcttaaaacataatgctctcttctttaaaatataaatatttctgactatgtatctgaacaagtacgattgaacgtattcttgagaggaacataccatttatacatttttatacaattaatacaaaatgtatggtgatgtatatacatgatggggtaggggtgca

SEQ ID NO: 38929 - DNA, 7670 bp, Oryza sativa
  unsure (1)..(7670): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccacccaatcaagctctactaagctacagctctgcttcactagcgccacattgctgatcaacccagacccacaaccacaacctccctcgacccatcaagatgccatctcccatgaagccgcttagctagatcgccctcttccccagccaccaccaccatcgtctcaccaaaagagaaccggaaggagtcagccataggaggggaggagctccatcgagaggaaataggggtgcgattggttagcatggacaaacctgccatgcttgcctaggcgaagccaacggcatcatctcagccgccgccgtcatccgcgtccgctaccggtgcacctaaccaccacaaggagccatacctgccatcgtccacaccaaacgccaacctgtaccatgtgcatcagttgtctactatcgtagctgcgccgacctcacccactgccattcgccgcatcggcctctcccgacaccctcggccgctttggcctctctcgtagccctcggttgtgcgtgcctctcttggcgactaggccacaccagcctctcctgcaaccctcagctacgtcggcctctaccatcgccatcggtcgcgccggccgcttgctaccatcacccacggcaaccccaacctccccagtcgctcgctcccacatccgctcgaccacggcctagcctgacgtggaggtgttggatccggtcgtggcggtgatggatccctagtctcctgcgccaagtacgccgcaaggcccgcaactgcctctggtgcacctagaagtattgcttggacaggaacgcgttgttcaatatttatgacgattgcaatacttttatatatttattccatattgtattccctataatcatataaaatttatttgctgcacttcaaaacaaataactaaatgtggatgtgttctcaatgaagttctattgttcaaatacaattctactaccttcatttcatattataagatgtttggcatctctatcccttatctagatacactaattatatacatttgaatttgtatatatacatacatacatgaagcacgtacataaatctatgaatgaatctatttaagacctaaaatatcttataatatgaaatagaggaagtacatctttagaatctacttattaagtatttattaagacaaacactcatgagtatgaaagtatggtctatatatgagtgttgaaggttgtgtatgtgcacacattagttttttatatattatgagaagttctaaatagcacgagtagagaccgaacacatttaatcaatatcaagtttttgccttttctactccaatatgccaaccactgagcctcaacggtcaccataaatcccatttttagcactagccacaaattcacctcagcataacaaattcacaaataaatgtggtgatagagataagcaaccggcaaccacattagcagtaaaccacagccttgtccgcgcgataagatagtgtacttaattaaccccatacagttaatttaccttgttagcagtaaaccaatcattttaaaccccagacagtgcaaagtttcatattgatatggtagaaaaaaaaatacaagattacaaactgggatatcgtaaccaggaaaaaaacaaaaacaaccagcaccttcgcatgttggccacacctcacacaacctaggagaaaacacaagcgtcaagccgaccgccgctagagctaaggggagtcaaacgccccccacacaccaacttcatatggaagatcgtcaacaagttctctgacagagcaggggactagggttcgccccccgtgccacctgcacagagagacgacatggggtctgtccggactaggaatagctttgccgatctagctaggtgtaaactagtagactcctttattttttgcaagtattaagggctttctacattttcaaattttcgacctagttcaaaatttcaaaatgttttagtacaggccaaagtgaaagaatgaactctaaagaatatagtcgaacagttccagaactacaagtcagatctatacaagaaatacatcctgaagggcctgacacctgacttcaacaaattcaccaagctaaggaatcattgggatgtgtttgtcgcatacaagacagaagagcacgggcaagtgcaaatagaaaaagaataaagccaatgccgctaggaagcagtaccatcaccagctagggtcaagcggctataacaaggcagttgccaagtgggagagaatggaaactggattgctagaaagaggtattgttccagccacagctaactggcctgaacgatcaaagcattggtactatgctcacagtggaacgctcaatcccagtgatgggtccttgctattaagtgatgagattcgcgaagcagcaagctgacttatggatgcagtagaggcctctgctcagggaacattctagcccgacaaagagaaggacgagcatacgctcgcactacaaaatcccgagcatctagaataaacgcgaggaaaagacgtggttgtttggaaatatggatttcaagaggacatccacacgtacaaaagtcgcatgaggagcaagagagataccgagacgaaattagtagatcttgagtataggcttgcgacccatgagctaaggatgcaagaggaggtgtcacgacatgtggaccaacgcctggccgaacagtagatccaacagactcagccgtctgttcctcccgtcatggtgagcccctcaggcaatcgcaacaactgcgcttctacagggcaagtaggagaacagggtgcagaagctgcagcagggccctctcacgacaaaccaccctacccggttgatgaaatcacgcggaggacaccgtgtgacatgcatattccctttaggaacttatcaatcaaggtatgcgcgtagttttatgatatatgacatgtacattgcgaaagttggtgtatatgtcaattactaattaacctcgattctcatgaaggtggcgtcgggcatggccataccagtggaccaaaatgggacatttcattgcaggtcgactccaccttggtactcaaaggtcgaagttgaactggtggaagaaggcttcgaggatctcgagctagacatcccagaaggagacagggagacgaaactaggagacacagccccacaccattatactatagtgcaagtactacatcatgtttcccgggcgaaaagcagcgtcctttcctccgcctgcaccgtctcctccacgagcaccaactcctccacgagcactgactcctccgaggtctcctccgtgagcacggactcatccgatgtctccgctgcgggtatcgtctcatccatcttcaagtacccgaaagtcgtgcccacttcgtcccatgccgtcaaagtccacaaaacaaacgaagaagccaacacttaacaagccaaaactccccgctctcaagaaaatggcgtacgactgcactcccgaggagactgacaagatcataagaacagaagtgaaggcgcacttcaagccagggagtctaaaaaagaagactcctatagacccgtcagctaagaagttctttcagaagatgagcgcaccaatcacacataccttactatcggactatgaccgatcaataacgaagtcttttaagaagacaagaggaaagtccaaagatgtccctcagctcggaaagcaaccaaaacaagcagttgagccattgttaccacctgatgaaaaggagataagactatttatggcagagatgggtctaaagagggagcaataggtgggagacacacaaataaaaaaagcgacagaagtgtaaaatatatatttatacatatacatgtataatatataaacaagcagcaagtagaacaagcaaattaagaaaaatggaaaaagatctggactaaaggtggttccaaaccagaactaaagataggttcctagcagtggcaattgcaattacacattaattgagtggtcaaaattaggagttcgatcgtcactaggacaacgatgataattgtattgtatcatatacatgtttatccaaaaatattgctacatcagcaaaaattgctcacgtaggacttacgagcagtagggtgcatatgtctgctagtccccttcctaccgtatgttggtccccattcccttccttccgtataatggtcctgattcctgagagaatcacgaaagcaagtgactgcacatcatcatcacattctgggaaaggtggctacgtcccaaccactaaccattatatgccttcaaccacccaaaagtgttgcccaaaatcggatgtgatttgtaatgacaattatacatggattttttcctcatgtatttgcaagttccaaggcgtttaaaactgtacagataccatatagaatgtgtcaaggggaatgctcaagattgaatcccaagttaattgtataaacaagccatctttcaacctctggatgacttctagttttatcctcatactactgtaaaaaaaaaaggttttatcctcaaactaccgtggaaaaagagtagaaaatatagtttaagttcagctgaaagatggagaagtcattttgccccttaagaaaatgcccccttatttcttgtattttatctaaacggttatgaaaaattttcaaacaaagtaactaggttcatgcccgatatatcactccacacacatgctctggacgttgttgaccaaaaatttgtgctcggccgatggtgccggatctgtgttggcgcgaactaaattgacgaacacaacggcctgggagatctgcttagctctagtgcaggttcaaaccttggtgagatgtgggcgtgccagtcaatttgatcctgcaactgacaagatatataaattaaagatcaccagagagccgatcggctgacaagctgatggagtaattctagccgataccgatactagctgatgccgatagggttttgagcaatcagctatatgtccaatgtagatgattatataaagacaatcggctgatgagaataaaacaacaatataatccaatagaaaccaatcggtgaacaatgatatgatagaataagtgatccgatggttaaagcatatatcggttagaggtccgatatcattaaatcaaaagattagataataaatgaaacttttgttgcgatcagttaaaaccaacttgtatacgatccttgtaagccgatgcaacgtccaaataacttatcggctaaaaccccgatgaaacccttattataataaaaacatgttagcctttataactctaagcacgactagaaatgatgcatcgcaaagtatgcgaagaagtcataaacataatgtgcataagagcatacatactgatccattgcaaaccaaattctaaattcgtatggttgacggaaagaaccgatcaaaacagaagggacaaccttgctaataatcgatggtactattaacataacgatcaatcacataaacataaaaaaaagaatataaaatgcagtgatgaatttttttctaatacctgcaaagcatataattggaatagtactcatgatcagatattacacactaatacaagtttttgaattttcttttatattaatgaagacttgcgtgcataaacaccactgtgcaagtacacatccataactgcgtaatcttaacacttgctcaaaaacatggagatcagcggcactgaaatttagttaaaagggcacacacacgtgtgcagtatggaaaaatgggaataaaaacttagaagttagaactctactagactgtgtttagtttctaaaattagagagaagtttaggaaaagttaggagtttggaaaaaaagttaggagtttatatgagtaagaaagttttagatgtgatgtgatgtgatggaaagttgggagtttggtgtgaactaaacaggtcctagataaaatcatacacttattactccaacacatttctaatgttgaatgttcaaatactcacgtgcctgaccaagccattaaatggaccatcacatttatgagtgatatatggctgctatgaactctgaagtatcgacattactgtattttagaaggcaaattaacaagataaataactttttaatggtaaagaacagaatcccgtccatcattatccatgtggtatcctcgcttgcttctcgcacacacaccacacgtcggcgtgtgacgatgctctcaggtgatctacgcatgtgtgtatggagtatggacactcacacatgcgggctttagggacttggcttgtgatacatgtgggtcgtgctaagccacactgtgtcccttttctactttttttattttatctatttttaagttaaactcaattacatacaaatctaaagtttccaatcaaacatttaaaggttacatgaattgatagtagcatgctatattagaatggtacccacatgtaccaacacctgggtacatcaaacttggtatcaacatataccatgtctggcactaagtattatgatacctataggtataagtaatgatacgtgtaagtattttatcgcgagcgctaaacgagccaaggaaagcagtgggctagcaacccaacaccatctctaacactaagaactctaaccgtgcgtgtgtgtgttatactcatccgtggcatgcagccttctctcgattctcaatttaactcatccccttcatctactcgtcacctcatgccgctccactcagtcaataatctcaacatttagaatgctctagctatgtgtttggttgattgtatggaagcatggaaccaatttgcagttacaatgtgataaacacataatggaactagtgatacatttacttttatgtacgcaggtttgatactcagattgtatgcaaacattttcaaacttgaactaatattgctttgaatgtgttgggctgttagctcacaagtttaacaagccaacaaatgggtcaagccaagttaggcttccagcttgttaggataatgagccgagctaggttggctcgatatacgaacatatctctagtgatgaatgtaaatatgtgtgccaagtaccagtaatgatatgtataagtaccaacaatgatacttaataggtatcgatgatgataactagcagtgatgatacttgatcatatatattaggataccaggatgatatggaggtttgtcgagatgtgggcaagcaatatgcgcagctagctagcccacatcatgctcacgcttttgtactcacacaagcattttcttcatttgttcataccgacgctggccacaactacctagctagccgcggagtacataggtaggctcatgtaccgtggcgtatgcgtgttgggcaactcgtcgagcatatgcaaagagccaaagatacctcgtgactatgtgagaactattccataatagcatctccaaa

SEQ ID NO: 38930 - DNA, 853 bp, Oryza sativa
tgcaacgccagacttggttagggacggaggtggccgcgccggctgtggttgggccccgaggcggtggtggacgcggcggcaccggatgtggccggtggtggacacggcggtgctggatgtggacacggacgaaggcggcagcgacgggctgtgcgggagtcgagagcgaaggaagagccgaagaggggagcgagacgtgtgggagagggatagtgcgtggggcccgcagttggctagcgggtgtggctggctagatttggccagttccgtgggatgtttagccagccagatggcttggccaatcagttagttagagagtctgttgcagagctttttttttttctcctatattagctataatttggctcagagagctatttggccattctgtgttggatatgctctaagagaaaaataaatatctttctatggtatgtgacgtacctatcgacaacaatacatctatgtgttgtcttcaatttcaaaatatgtcggtctaatatctcagatatgcttacagaggtatggtgtgtttatttttatatggtaaatatatacgtgtgtatatgagagtccgtgtttgcagttgtactgtgttttggggaaaaatatacgtaaattattagaattttttagagtataccttacactttctctatttttattattagaattttttagagtataccttactgtttctctatttttttagtgtgtttacactagtactgaatcttccatccgtgacggcctccaatatgcatgaaattagtgggccgtcacaaggaagtcatctcaatcgagccgaaaaagcacccgattgagatatagtcgcacaaacatgttagatggg
